United States Patent 7,868,149 (PLANT GENOME SEQUENCE AND USES THEREOF) - sequence listing, part 63

SEQ ID NO: 34104 - DNA, 19383 bp, Oryza sativa
tatcttacgtctcaacagcattgtgccaacggaacacgccttcaaggcacaaggttcctgcactagaggtgtgtgcataaccaaaccactcgcctaagatggcatggtcaaagtgccttcctccgttacaactcgcatggagacagacgagagatcgacaatcatatgtgaccatgccactgctccagggattccaacatacctatcatgctggcagtaagtacactcaggtatgtgaaagatagaacaaggttcaccaaacctttattcaatagcaccaccatgtgaacatggcttgctcatatatgttatgcttcttaagtcaattttttgtatgacgtggtttgggtattctattgatgtacacccataggctttttaaattaaatgtggtgtttaggttgaaatagtctgctttaatcaaattagacatggtgtcgaattcgattaatgaaccgttagagctagtactttcatgggcattggatgtatatcttctatggactaacctctgcaggaaagttttcaatttgacgggtaagtcctcatgttcaattcacactagagataagttagggcccgggaaacatagcgataaattgcaaacatgcaaaggagtaacacatcaccttttaaggtgcactgtgagtatactgtcgaatgctcgttggttatattcgtgcaattttaccttagccctatataagttttgcctaaacgaaaatttggtgagcaacaaaaaaaattaaaaaaaatgtttttagaagtgtctctcaaaaaaaaataaatttggtgagcaaatttatgggacccatgcttctcaaaatttttttttgatgcaaacgcttctcaaattttgaacacaatttctctttagcgtggatgtaaacaactaatcttgaggcatgataaaatcttttcaattttttgtagtccaccgagtatttgttgtccactaacctcttgcacgaaataaaatgacaactaaagagcagcatacgataactccaataccaatactgtcgacgtttgatgtcgcgattccggtatttgtatggtatggggatcattgatactaggatatatgcgagattgtagtaaaagagatggagacgaagatttttatacaggttcgggcccctgaattgtcaggtgatagccctacatcaggttggccaaagccggtattgctcttattcaccataatcacaccagtacaatatttagggtagcctatctaactgttgtcgacgtggcgggctgtagtactgactcgtagttgacaacagggtagccctactcctcgaatccgcatccggcgagatcagagacagtgctatatctctcctgacggtagccataggcaccgtaggggactagccatgcctatctctgaaatcgatatctggcgtcttgtcttggcgtatgttggcttgtatgttgatcttctgtcttgatctattgttccgtgtcccctctcctcctaggggccttgtatttatacccataggtgtccccttgtccaagtagaactagggaaaccaatatggatacaacccgagtagttcttgtcttttccatgtagaactctattcatccttccttatacggaactcctcctatatccgtaggtcatttccgtataagacattgtacgtggtggtcctgccaagatttagtcgactactattaggtatgtggtatctataaccctgacagtagcccccgacttcaatgcaaatgaacaaattcatattctcaaccgcagaccttggagtaactgttatcgagctcacgtaaccgttctcggtgagttcagagataacgttggacttccttatcagcctcgtgcgggcacctatagggtttgtctgagtcaatctccgacgtcaaccaagaaagtacagagcatatgactacgtctcccgtcttgctgtaatcgagaatttggatggaagtcaagaaattttatcacggcgggtacaccatctcttcattccgtattccttgtcgagatccaccaaccattcttcaagcaatcgagaaggcgtagaatctacgacgaagccttgtcaacatttgtcgtactcgccttagtcgatcttggtgtagaaccatagagacatggagtcttcgacaatgtcgaatagaattttcctaaaatcaatactcagaaaagaatattagatagaaatagcccccgagcgaacgctcaaagggtgacatgttataaaatgtatggaaaactaaaaatgaattaaatttacaaaccaatgttttgtatatgagcgtcttctcttttaccgacttcgatcactcagtttgttgagtcatacactttccctagcccctagccttgttgtcggagaatcgttctcggaggataaggctcttggacccttgacctgccttggttgaaaaagcactgaccctaaccccccgccgtgaagttggaaaactcaatttccgattacacggcttggttaatacgcacggcgagaactcttacatgaccaggtcttacatggtcgtttgtctctacatgatccgacaaggccttatccgctctgggtatccccagccgaagttccctcaggttcctcagaggccttgttaggacggcgtaaaggaacagtaggattggtttcatctctaggtgtcatcgtggtaagggatctctgggtaaaacacttggcaatattgtgtacgtgatatcaactttgttggagtagaggtaatgggaggatcgctacactgctagtcgaaaaccagttgtagccccaactcaaccacttgaagtaaaggtagtgggagaatcgctacaccactggtcgaggaccaggtagtagtcgcaactcgaccacttaaagtggaaatagtgggagaatcgctatactgatgttcgaggaccaggtagtagtcgtaactcgaccactagaagtaatgtacgagagatcgctacgattgactggttgagaaccagtgagttggtacgagggccgctatgctgccggtcgaagaccagtcgcagctgtccctcaaccatctgaagtcatctgaagtcgtggtgcgaggaccactacgctattggcgtagtcgtacctcgactatttgaagttaaggcgtgagagattgctacgatttactggttcgagaaccagcgagcgagtagaattatctctcgaacaccaatggaagttgtggtgcgagagatttctacgatttactagttcgagaaccagcgagcgagtagaattatctctcgaagaccaatggaagttgtggtgcgagagattgctacgatttactggttcgagaaccagcgagcgagtagaattatctcttgagcaccaatggaggcgctagagttggtttattacatatgcatctcatgtggccaacatgactcacatacccaacttgtagcatatccggatgtccatccgcaatcatgtcgggtgatcaagccgacatcgtttgcgagcaattatccgttaacaaccttttctcgaatagcccagccatggccggtgctatagatagatcgtcggtcttcgtcggcaggttgggcgcgaggactctgcatttgtcgagatcgttctcaataatagagtatactcgaccacaacctactcgagtactcaactgttcctgaaaaatattttctagaagacaagacatatagcaggtaatatcgagtatgtactcaaagaactgcaagaatcttatagtattatcaggttataacgagcagattaaatatcagacattatgtaaacagtaaacaagcatgatttatacataaggaaatagagcgagcccccagtgttaaaccgtagttggcctaacatcggtaacactcgcataatagatattgtataaccatgctctaggtaaacataataaattattgatctgacaatattatatttatctaaataaaatagatatggtaaattatatataaaatattgcatacatgtgtagatatatgccggatatatctacagaatcagtagattaatttaaaaatcaatcctgccaattacctatgttgttatcgtgtacatgtagtagatttagctactcatgtacgcgtggaaatccttttattgatgcactgacttggttgtaaagaccaatccatgcacgtgactccttggtctagtctgacatacgtggtttttgccatccatcattgccgatcagggctctgttttcggttttaaatgtccgagtaggatttaaaccaaaatacagttcggtatgtgtccggatgacaaccgaaatcggtcgaccatgacatccagtacctctgccgtagatcgctcatatggtcggcgtgctgcgccccggttgtccgtcttgagagcaaatgttgcggcgtcgaaggtcttgaggcttggacgatctcgacacgtcgaattgttagcgacgatggttccgatctcgtcggaaaatatactccggttgggttggatctccccacaaccgaagtcgtcgagtagcttgttgtcggagaatccatctcttaaacccatctcgtttaaactctgaagcaccaaaatctccctacctgacgcgccactgtcgacgtctgatgtcgcaattccggtatttgcatgatatggggatcgttggtactaggatatatgcgagattgtagtaaaagagacggagacgaagatttttatacaggttcgggcccctgaattgtcaggtaatagccctacatcctgttggccgaagccggtattgctcttattcaccataattacaccagtacaatatttagggtagcctatctaactgttgttgacttggcggtctgtagtactgactcatagtcgacaacaggatagccttcctcctcgaatccgcatccggcgagatcagagacaacgctatatctctcctgacggtagccatatgcaccgtaggggactagtcatgtctatctctgaagtcgatatctggcgtcttgtcttggcgtatgttggcttgtatgttgatcttctgtcttgatctattgttccgtgtcccctctcctcctagggggccttgtatttatacccataggtgtccccttgtccaaatagaactagggaaaccaatatggatacaatccgagtagtccttgtcgtttccatgcagaactctattcatccttccttatgcggaactcctcctatatccgaaggtcgtttccgtataagacatggtatgttgtgggtcctgccgagatttagtcgactcaattaggtatgtggtatctataaccctgacaaataccatgctccttggcctcaagggaaaatagatgctcagtgaaccaagcaaaataaatgcaaagctttgttgcattaactcttgcatttggtttaaagcttggtaagacctatctagtaagaatctcaaacaccttgtgcatcatatctccaccctgttaagttacccatcacctccatgatttccatggaaaaaaaagatatgacaaactaaaataaaaataaagtaaatttaggtacttcatacgcctagagttacttgaataaaatttggctcaccggtatttcaccccggttgtagcctatttctttttctatgtttttgttgaatgaagataaggtacaaaataagtgtgggggagtcttttttggaactcttgacatgcaacagtatcaactcaacatgtcaatattatgaacacaggcccacggccacgcacaaaatttagcagccagaactgagtcctggatgggtcgaccgaaccaagtgttcgtccgaccattgcctggcccagctctgtcacccctttgccatgtggtcaggtttgtgcatctcctcacctgtttgtgagttaaactttcgcagaaaaattgaatacaatttagtttaactccaaataaaaattgaaaccattaagtctcaacaaataaaattttcctatgactaatcatgcatactttttattccttgctaacacttgtcacttgtgaacaattatttatcacagggaaccttactcatctaagtaattgatatatgtgatctggttatgacaacataaattcttgtccaactgtcataatacctgagattttgtttttgcgaaaattaaaattcttttcgagcaatactcctcaatgactatattattacctaccaaggccatatatgattttcatttcaaaaccttatatatgtctagtctgcttgacattacattgagctttgtcaaaatattatgacccgtgtaagatgcttttcatgctttcatgatcaaaatcacagacatccaccacatacacgcacttgtactaaatttctacactggaagttagtatatctcttttctcattcattccaactatcatccacaaaataaatactccataacatttatgcctcttcctccaaagttctttaaaaaaagagagaggggcatggctatgcaaaagaaagaaaaacaaagttttgctctcttataactatgaagcatcatgatgaaaaaaaagagaaaaagcaagaaaaaaagatagccatgcacaatcccaaattttcaaagagagaaatatggaggagggggtataccaaaggagttgctattatctttattttcctttttccatccacaacacttgctatacacaaacccatacacatatcatgcacacgcacactcttgataaaaaactatgacttgctatctccttgggtccagtcttttggctttgcaatatatgtgatgcaggtatgccccgattaatccctaccgagctccacatatacaaccttttagaatggggacaatttggcaaaactatgccttggtgaggatccacaaatcaacaccacatgagtgatttgagagaaagtcatttgagaagtatagctactttgtgaaaatatatgaaaacaccaagtgattaacaggagaaacaagaaagaattgagtcacgaccgttccatttatcaattacctgagatggtaagttagacaccgcaaaacttcacaggtacaggtatgtggcttagaataatttgtatacttatattatatcttggaaagtttattctaaattaatccttaacctttagttgggacgatcaaagagttaaacgtggggtttttttatggctattaaataccaaattcacaccgttcataaaactaaaaatataaaatatccaacatagtggcaaggtttatttctaataatttccacaagtgttagtgtatatttggatgcaagtgacaaactaccaaagttgagaagaaatacacataaaggaggaggaaaattatattcatgtccaagccaatgaagtcttgggcccataaacccaaataaatacttataattgggcccaatcaccatgccactggattaagggccaacctgccatgatcctggagaaaattcggagccaaatgggctgaaaccgaaactgacctgttcagccccaaatttcactggcagctactaccgacctcccaatgatggttgtgaccgtttccggcgctccaacaatcatcaggaggacatatggcaaaaggagagtgaagatgctcttaagattctccgcactcccaaggcacctccacctatattacccctctcttccctcattcacaacacaccaagtatgagttgaattacaagaggctctattgtatcttttatgattagaatagggagagagtaagggagaaagagtcggaggaattctggagttgtcggtactttcctctctacttttgtacattttcaattactcttctttaattgataatatctttttcgagtaattgagatttactttgtgaggattatctcttacttagttcctaataacgtactggaatactgttcactagcaatagtgtttactttaatgtttgatcggcattagagtagtatttaatagtgtagacatggtgtctatgctattgagtacatgtatttgttgtgtatcccatagtttgttagaggttggtgtagagatagtgacccgaagtcatccctatccgggacggagtagagcacgtcctagtagcagcgagcaagcccgtgtatgaagtattgcgataggattaaaatttagctttctatagacattgtttctcattaggaaatcatatctatcctttgcccatttttgctttgtgttcttggatgaacttgaagaggaattgaacacatacattccctgtggaaatttgataccttggagtactccggggtgtagtgcttcaatggtatctctgtgtgtttctggattttatctgtgaccgtaagaaataccaacaatgttgtcaaaacaattgaatatggtgtactagaaactagtagtggactaaatcaagatatagggttatctagacccggtgagactcgatcgggttctcactatagaaccgttgttaatattattgctactagaaaaaatggtcagagacgttttattcagtgatacaatagctattaggagctgagcaataaattgaaacattaggatcagtatatacattataattgaaaaagtcaataaaaatattcattcgttttgggccgaaagcccattctttctttccttttcagccccagctcagtccgctacctccctccgctcggtctgcttttcttcgacccagcccacaagtggagccacaaacctaggtcgcacagccatcttcaacctccagacagcccgttgtaccagtatgccggagccaatcctccccgtcaaatctgaccgaatctttctcaatctcccaaaattacttgagggcttttgatcctctcgatctccttttgtggttttttcccaaaatcggaacgaatatgcaaaattgggatgaaaagggtcgggccagccataatcggggactaagattaaatctagtgaattaaagccaaattaaaggggaaattatgagaaaaatgataagggagaagtggaaaaacaaattttgaaatcaattgaaattaagaaaacgtaatgggagacaaatcgacgtggtggcggcgctagggtttggcccagtagcggtagcgggaggcgcactgcccgcgcgtggaacgatggatgagataaaaaagggcaagggaaaaacaggaaaaaacaaagcggaaaaaagacagaaaaaaccacgtgaactgaaaaaaaagtgaaaaggaaatcagatgagaaataaaaaggatacggaaaaaccgggaaaaacgaagggaaaaaagacagaaaaaaccacatgaatggaaaaaaaactagcgaaaaagaaaaaaaggatcaaaatactatgcggaagcctttcttattttaattaggtatagatgtatcctgcaattcgtgatgaacttataaaccttggagaagatactgcacaaaggaccgaatggccaaaaatacatgctatagttggagtttttttagtcattttattttatttttagtgcacccttgatgcttgtcattcttgatacacaaatgatttatctgagtgtttgtaaagaagagagcattatattcttaatgcaatgacactcgtgcatttgccaaggagtagaatgcaagagttgaggtctgatgggtgtgttgcattccttgaaagggtcactttgttctgcaatagatatggtcttgaatttcatgaaatggatggtgtttatgtgccttatggaagatctcaaaggtttgcacgaaatcaaacgaatgatgaccactttagaagagaagtatatattgggatcattgatcaaattagccaagaatttgacaatcactttgacgaggttaatatgaagttgctttcctgtatggcagccttgaatccaactaactcatttgcatcttttggtacacagaaggtatgtataaatgtataattgttaatttcatttgtatattgtatggtattcctgaatcctgctaagggttgactcattttttttattcacacaaggtgcgtcgacttgctgagttctaccctaatgatatttcaagtgctgaattattgagacttgatatgcaacctgaaaattatattgatggcatgcgaaaaagaagatgatttaaaaggcctacaaaatcttgttgatctcttggtcaagcttcgccaaacaaaaaggcatatcgtttatgatttggtctacctgcttcttaaattggtattgacactacaacaaaaaccttatgtagagactcttttgtagagagacaacttttaaaatgcctctaagttttgaagctctatagtctagagacactttttagaggcactttcaaaatcgcctaaaatatttttactctagagacactttagagacatttttagcatactttgttaaatttatctcgtagagacatcttttcggcactttaaaatttgcctcatatgtaaaggcattttctaaaggcatttaaaatgttgtaaaggcgttttttcaaatattaatatatatcaagtaactagatataagtaacacaaatcacatatttacatgtaattatatgaggttgagatggttagtgcattgaagataaaaatagttgacttaggaggtcatgagttcaaggattggtaagtgataatatttttattttttatattgatttgctatagttgccgcaacatattaatgcctctacaaagtgcctctatttgcatagagacatcttataaaatgcctcttagttcatagagacaattcaccaaaaggcacttatggagacactcttcaaaatgtctctatagcactgtaaaggcattttaaaaatgtctctatagtattaggaaaatgtctctacaaggtatatttgttgtagtgtgattctgccggttgcgacgacaagtgttgaaggagcattttttgcttgaaatttatcaagcataagttgagaaataagatgtgtgatgaccttttggatgactgtctagtcacattcattgagcgcgttgttttctttaaagtggatgaagaagataaaataaacaatttcatggccattagaagacgtagacccgataagaaaaaaaagtagtatggtaatcttcttcaaatttttatagccatattactaattttatctattttaaaatgctttattaatatatcatggtatacttttggtctattctattatctatacttgcattgtatgtattatcatagttagatttactgtgtcaagaaaaattttaggttggtgttggcaactttttcggcaagaagacaatcacgattggaacatctaaacgccttgcggttatatggagtcgtcagccaccccaatctagccaaaggccaaatcaagatgtgttttgtagaaagaaaagctaaaccggctagcggagctgatttagagatcaaaatcagcctctaggctgatttagatcaatatgagaataattacccgtcttgtgggcaaacggaaggtttacgggacaaacctacaaagggggaatcgcactctcgcagcaacgacggacgatttacagtacaaatcgacaaagatggactaaagctagagtaaagtagaaatcatggctgaaagtaaagataaaagaacgattcgattgtgttcggggggaaagagatcaatcgaaccggccttgtcccttaaataggggttggtcttgcctcccacaagtcctcctccacgtccaactcagggtagaaaccaatggaaacccgaaacatacactgctggagaaaccctttttaatcccggttcgtaacccctctagtcccggttatgcaaccaggactatgaatctgggactaaagatgcccatctttaatcccggttgaaataaccgggactaaagatccatctttagttccggttggtaacaccaaccgggactaatgtttttttttggattgcatgatttcgagccccacaaatcattcataaaatcatccacaaatcattcataatccacaaatcattcacaaaattcccaaatacatctactctatatccccttatacatcacaaatcattcacaaaaacatctccgaaatctacaacaaaataaaaaaaattatccacaaattcatccacacatcatacatcgcacatcgcccagatcagaaaattcatccacatcgcacaaatcggggaggggaggagagggtctcgggtgccacgccggccgccagccctctgccacctcgggctccgccgccgcccgccaccttgccggccttgccgtccggccgcccggtggccggatctgggagcaggctcggctgcccgtggccgccgccgccggtgggaggggcaaggggaggggaggaggggcagggggaggaggaggtggagaggggagggagaggaggagaggagaagaagttaagaagataaggtagaggaagaagataaagagatagcttttttttctctgtacctgtgcgtctctcctcccgcgtgcgattttttctagatccctcatgcacgcgttttttttttatctttcctccgggttgatataaacaaccggttttaaatatcaaacgggactaaagataatagggtgcctgccacgtcctgatattgaatgaaccgggactaaagatgatttcttagtcccacaccacccaggactaaagatcactgaagttctaatccaggacgaaaaatgatctttagtcccagtttctatttaaaccgggacaaatgtggtttttagccaacgtagccaagatggtttctccagtagtgataccttcccaagcaagaaaacccgagacctgacaaaagcaaacttgggcacagagtctgcaggtctgaccggccacacaccttcggtcataccggccctcaagtaacggtctgaccggccaacatacggcggtcagaacagccctatggaggaaaccgacgatttttccaactcttagcaataattccttaatttgaacctaggtgtcaacagaacggccctatggaggaaaccgacgattttttcaactcttagcaataattccttaatttaaacctaggtgtcaaatttgggtgtaaatagttggatcacctctattctatatcctagctccgccaatcctctctgcctaactactgcagaagcagacggcagttcagtagcctgtgccagacgaccaaggagctaccggcatatgccggcgggcggctgccgtcgtgtcgtgcctcagcgcttgcggagacggaccgtccactagccgaaccaagaacgctcgtgaagggttctgggtatgatggcacgacagcaagtgcattactcgacccttcagtctgactcataaaaattcatgacattccatacgggaattgtttttttctggaagaaaagccattgacgatcattacttaaaaaagaatttttgcatgcggtgaaaaagggttttcacgtgcggatgcatatttcgcccgcacgcaaaaataaaaaaccgaaaaataagataaaataaaaaatccgaaccctaaccctagaagctgccgtcgccgtcgttgtcgtcagatccgctgccgccacgcctcctcccgactgaccgccggccgccgccaccgccgccagatccgcgcagatctgggcgggccggtcgcccctcgccgccttccacgcgcccaccgacgcgagcacgccggccgccgcaatccgccgagccgctcgccgccacgcccaagcccatcacctcgcctcaacgcgagcacgctggccgccacctcccgcctcgtcgcctccccactcccgatcccgccacctagtcgcctcgctcgccgccactcccggccgccaccgtgtcggcgtcaccgctgagccgcggagaggagaggagaagctagaggagaggagagaagagaaagagatagagaggagaggagagagagggatgagtgggaataaaagagagagagatgaaaaatttaaagtgagtgagagggaaaagagggatgggtatttttgcgtgcgggccttttaagaggtccgcctatgaaaataggctcatttttcatacggtccatttaagaggcatgcgaaaatcaatttttccgtgcggtccttttgagccgcacacaaaaatagaggacgattttcgtaaacaactagttatggtccgtctgcaatctaaagatatccctgtacaggaaagtcattttttagtagtagatgaaccaggggcagtaacctcgtgttgcttattatgactaagagtaaaagcagtattatcaacaactaaaggctttttatcaagtgtttctctacctttttcattaaataaatccagaatgcgcctgcaagaatgacgcatggtgactgtcagggaaagacgcagttttggacatcaaaaagttattcttggcagcccagaccgacaaggataatctttttttggcggtactaactatcaagaataagtaatttccttggcggttcaactgtcaagaataaataattttcttggcggtttctcggcagcaaaggaaatatatatccttgttagtccagaccgacaaggttatatttcttgacgctttcaaaagctcgcaatcttcttaatttgcttagcggtccaaccaccaaaaagatattcccttacggttaccagccaacaaatctgaatatccctaactttctagacttgacagtttttacttggcggtcagccgacggaataatgaacctttgcaattttcatgcaatacttgttggttttttaccgccaaggaaattatggattcttgttttctcagcaagcatgtttcgtcactcgataagggtaatggtagaagatgagtcacattagcttttacctcagttttggcatccgtaggggagggaaacgcgatatcctcgagacaccatgtcaatctactttgtagcttgccctcaccgccagcataacttcctcgtcatggcattcttgcgttcctccaacagttgacaaacctcctcgggaagttgctagagtaagccgacgttcttagcgtcgacattggaaagatcatcctcactgttcattgtagtcgatggcttgcttttcatccctagcagagtcgccaaaatttttgttggtgcaaatatcggctaaatatctagttctagaaacaggagtatcctgtattcacaaactcactgtgaaaacctacatacataatagaaaaaaagcctgatcggaccggcaattcgaccaaaaaaaggccggaaccagatgtcagcacggcttggtttcctccaaagaccagacatgtattcaaactgttctggactggatgaactgatcaaggaaagttgcaatatgtgggaatcgaaccctggtttgttggaggctccaagtcctagccatcaggctatccaacaaatagaagggaatacatgcacgatgtgaacatcggttcgatcgcctagcccaccggtcaaactagtgaactagtgaaccaagtggtcggtcgggtcacccactggtctgtttattttctactaggcctacaaacaccgaccccattggagcaggtccaccaagggttgctctagggtccgcagaccacctagagcgccttcaatcgctgtagagacgaaggtaggatagaaataagggtttggaagggtaaagtgcaaagagatagaagtaaaaagtaatagattgattttgtcgattggattggatatgtcaatcggccatatgaccctttatatttatagggttgataggtcttaccatttatacaagttgaatccataataaaatcgtgaagaacacaaactttacttttgaactttctaaaaccggactatccggattagctaacagaagcatccggttttcttctgagatgaaaaaaagcaaattaagttgccatgtcattaaaaacaaagttatttaaatgtcaaagtacgtaataaaaccactgacgaccttaaagagatattttaaccatttatgattgtaggggagtataaaatatctactagatggactgtatttcgtttttggagtaaaacaaattttgcttttcatactagatagcaatcacatatataggtcgttgtacttagcatgagtaaagccaaaagtggagcgcgctgttcattcaggacgatgcctggtatagtttctgtgacttctgtctttaaaggtggcgtcagatatgctatgttgtcgaagaaacgagtctgcagaacaaatgtactgttatatgtccatggaatggaacagtatggctgtatgggtgaggtatgaaataaaactagacatagagtagaacgtacggtatggggtcccggtagagtacaacaatacgagggacccgaccacgccgcttttacctttgctatgctgccaactactgggccgccaacgcagaaaaaaacaatgggcgccgtcaggaccgtggtgatggctgactaaagttttcgtgtgagaaaataatcccttcattgttccaaaatagttttatctttgtcctatctatttgtctgacgaaaaaattaatttttaagcaatcattataatataatttaataagtaacaacaaatggatttatacttgataaagttgaggacaaacacattgcgacttgataaaatgaaagatattatagtcttttagatcctgtgtcggtacataatattggctaaaaacaaagttattttagcatggagataatatttttttttaaagatgtgctttagtccatcaaatatagctgaaaagttgtctcgctccgtggaaaccctaagtgccaccaggggatcgggagttggcctcattttccatcttcgtgatacggatcggactgggtggaaggaggagtcctgttcgacgacgatagtggctcctttaaatctctacctagtgtttgctagtagggtgcttgatgttcaatctacagacgcagtgaagttgatgtggtgacgacgtggttcgtagaaccatacatctcgccggctggtgtttggggcaggccatccgacgaatctattcggtggcatggcgtcagaggaggatatgcgggtacgcaataaggatgaagggggcgccgcaatcgatgaagaaccaattgaagatcagggaggggaatcagatgagggggatgacgaagatggtgaagaggccgtgagctagtagaagaccaggggcagggagggcgctgaaggttgccggcggaggggtggcgggcggctgccgtcgcctagaaggactcgaggctgacgaatgcagccgccgcagcggcaactgtgagcaaggaggagacgaggagtaaggggggggaagggcggggctcgagccatggctaatggccagcgagcggagggggcctccgcccatcgacttcgatatccgccgccctgatttatttctccactggctactctacgccactgattcgtgccaccaccgccgaccagctcttgggttcatcgtcctagctctgacgatggcacaccaccgtagagtcatctctgcggcaaccaccaccaccacctactattgcgacgatgtgggaggaggcagagatgtgggcggcggaagcatcgttcacgtggggtcgtggagggaggaggacaagcggcggcgctctagcggctcccgagtgaaatagggatgggacgctgcctccggtgggtggtgaggctggctcccatgcaggtctggggaagaataggggaggaggggtgcagtgaggggaagacgacaccgtgctcccgggtctcgccttccttgtccgccttgccaccaccgtcgtcgacggcaaccgatggcgtccttcctctacaaagctagcttctcccgccggcccacgctaactcagcgctgttgaaattgccacggaggacaaaaccagtcgcatactgccttgggacttatattacacatgttttaatagttgagagacccgttttatctggttttccggttcgacgaaaatcggattcgttgtcaaattaagggacctcaaatgaacttattccaattttgtatgcattcataagccaagcccggcccatccctagctaggcacgagggtaaactaaaggcaacaaataagtacatgtgcgagactagttataattatgacatcacatttttatcacaaaacatttcagttttgtcttacgatgtaaattagaaaacttacatttataatgtcaaatttcacactgcaaattctgaaataagtttacatttataatctcaaatttcacactgcaaattctgaaataagtttacataattatgatagtgctttttggcacaaatctatacatatcatttgttttgtttgcaaactaagcatttaagaagttattgatggtcagaatttaaaaaaaaatctgaattttatcttaaaacatcaaatatgtttaaacggatggagtatatcacagcaaacttttcatttagccacaatcctcacgtacttgtacgaattgcacattggcatgtatagaggattgatacgaaaacacgcccaattattttatttttgtaattttaaaagtaaatatcatgatttggtttgaaaccaaatggttgataataaattataagacatctacaatgtgctataagaaagagccataagatcttacgagtagccatatacaatgttagcaactgtcataaggcattaaatactaaaaaagtcattctattaaaatataaacatggtcataatgtgagatagaattagtgataatgtttaagactaaaatcatagtatagaatttgactctcaattagcatcaattggacacactcatttgcaatgtcattctattaaaatattgataagagataagtactaaaccaaataagtctattgacctattgtttcggtattactctcttctttccaaattaatcatcatactctgcaccaagacaaagataatttaaatcacatcaatctaaatatcatgcacacatttttccacaatacatgcatcgattaaaacaccatatcaattacaccttagaatgcatatattctctcatgctgcattaattgtattctgatgaaatccgtgtccatgtggttatatgatgatcaatttaaataattttaaattttataacgatcaatttaggaaagatggagcattaataaagtccctctataaccaaatcaaccatgcatacctccgcagcgagctttatcaccggctcacctcatcatatatacaacccataaataaataaatatataaaaatatgtaaaaatatgtgtagtcaaacactacacgtccagtctccctccgccgctagccgtcgcctttcggtttaccctccccactgcccaagttaaaaacagcaattcgagagagacaggccaagcagcagcagcaggaggtgagagagtgaagagagagacacagccaaagctca

SEQ ID NO: 34105 - DNA, 31454 bp, Oryza sativa
  unsure (1)..(31454): unsure at all n locations
tcgcccgtatgtgtaccacttaattaattaccacccctcctatgaatttttgcctcaaactctcatctcatctcttctccctatatatatgtcgtcgaaggcggtgccgcggcggcaacgggtgcaaggtcggcgacgacaacggcagcctgtaagtgagcaattgagcatatatacgcacgcacccccaaccaatcgatcgatcgtgtgtgtagttatcaatctggggatatatcatatatgtatgcaggatgctgatgtgggaggacgggttctgccggccgcgggtggcggagtgcctggaggacatcgacggcgaggaccccgtccgcaaggccttcagcaagatgtccatccagctctacaactacggagaagggtgggtgctgggtaggtgatgcagtgcgtaatcgtgtacagtttcgagtgttttttgcccccttggttctcgtggagtcagtcgacgactcgatttggtagtcatgtcagcctctctatcgcatcgcagctgcggatttcttcgctcgaccgtgtcacccgccctgttcttggattaggacccctgcatgcgcgattaatgctaatagtttccccatgattcctgcgtcgtcgtcgtcgccgtcttagagcaagtttaatagtagagttcactactttctattagtcaatattaaagctaacatgtatagtaggttgagtataaggttatctttattttcttcgtcctctctctttctctcactatgaatttaatgcatattttttagagtttgtatacagttagcccttgcatgagaaccaacactccccacttttatttatctctctcttccacataagcatataacttgcttatagactactgttatcctcgctcttagtgtgtgaaagtgcaactctattttggcccaaccagctagtactacactagtacgaccagtcaccagagagaggaggaaaggggaggagatcgatgggatgggcgtgtgcttttttttcatctttttcgctttaaatttggttccaatatttatctaccgttccttgctcgcctgctttgcttttgggtttaaatcagtgtgtgtggtttgaattagttaacctagggtttggttgattttcggatttggtttggttttgacgacgccggggcatcacatcacgcgtggtgcagcgggggtcattatgcgtgggcagaggcgtgggtaaactacaaattaacagccacttaccccctcctaagtcagtggctttaggcgagggctgtcacgtgcgcacgttcgttggggtgcgtgggggcggtgcctcgtatcgcataaacaaatcccggcgcgtcagtggcttaattgcgggctttgtctgcggattaacaacgcccctctgctacgcgcacaacaaaactctacacagcagcaggagcagcagaattgtaaaaaaaatgtttcaagcagatggaaatgatagaatttttttttctgtaccttttcttgtgattctgcgtccatctgtacgtctatgtgagcgtgtcgatgactttagcacagtaatatagtaatatctctgtttggctactgtattggggattaatttgggtaattactactggtaattgcgttaatctggtcgctttcactttgttctactactactaccgagcttttgagcgtgatgttggtaagacgatgattttgatctggaccgctggtgggtgctgctgcaggctgatgggaaaggtggcgtctgataaatgtcacaaatgggtcttcaaggaaccttctgaatgcgagcccaacatcgccaactactggcagagctcttttgatgccgtatgtaccatctcctgcactctcctcctttctctttctgcagagccccctggcccccttgcttttggggggaagagaccttattactgctactactacacacctcattaatcacttgcaaaaacaagctcagcacactgccacagcaacagtggtaggtctcatgtttttactgcgggaatgaggcaaaaaaaaaggaaaaaacaggtaaacagtaaaagagcccgagagagatatatcgacatgtctctggggagttctcaggctttgcatcaaatctgctcgtctgctctgctcccccaaaaagaagagaggaattggatgctctctctcactctctcatcaggatatcaccaagctagtatagaattaacgccgccgatcacagtcacggctaagctttattcctgtgagaacttaaccaaattcccctctcatgcttttgcttttgcagcttcctcccgaatggactgatcagttcgcctctggcatccaggcatgcacttctgttcacctagatcttttacatgctcgtcttagtttgtgattgatatttattagtgatgctaaacttttgcttaatttgcttgtagaccatagcagtgatccaagctggccatggccttcttcagcttggctcttgcaagatcgtgagtacagctatatattgctccctctatttttttaatatataacattgttaattttattctattatatcttttaaacttccatcatcaatagttctctgaatgttcagttaaaaaacgtaaattatactccatccgttctaaaataaactaacatcatactataatgtgatgcatcctattacaacgaatcgaatctgggatgcgttatatcttagtatgaccttggttttttttaagacggatggtgtactacataggtagattttacattataaatggctgtgcaacattacaattttattggatattactccctccgttccataatataatataaggcacaactactttttttagatgttacataatataaggcatgcatacaattaatttctcttctccattaaactattatttttttaaattctccactctcgagatctctaattctattggatgcatgtattatatttattagggtgatctaaactaggagatgataataattgtttcttggtctttggattaagagtggttatacattatattttggaacagagggagtatctttataggggcaattgttatatatatatattttttgatacgaaaataacggttaaagttactccacgcaacagaccgaataaaatgtgtcatatgcatttagtaccgagaggtacagtgagacatggccctttcttgacttgtttttgtcgcgttggtcaaagacgccgacgtggacgtgtttgtggggggcactagctaattgggcaaaacgtacgtacgctaactgtgcagataccggaggacctgcacttcgtgctgcggatgcggcacatgttcgagtcgctcggctaccagtcgggcttcttcctctcccagctcttctcctcctcgcgggggacctcgccgtcgccgtcgtcgttcccgcttaagcagcagcagccgccgccgccgcagctcttcaactggccgggccacgcgccgccgcagctcccgcccggcgcgtcgccgctcttcccgcccgggccggccgcgttccacccgtcgtcccggccaatgccgcccttccccggcggcggcaaggatgagagccacctgttccatctcccgccggcggcggcggccaagcagccgcagcacatggacgagcaccaccaccaccagcagcagccgatggcggcgccgcagcagcacggcggggaggcgcccgagggcgacctgaaatggcccaacgggctgtcgttcttcaccgcgctcaccggccggaccgaggacgcgaagttcctcttcggcggcggcggaggcggcggcgcggacgacgggagcaagacggcggcggcggcgcaggacgcggggcacggcggcgcggagaacgtggaggagtacctgagcctggagagccactccaacaaggcgaggaggatggagagcgcccagagcaccaagttcaagaggagcttcacgttgccggcgaggatgagctcgtccaccacgtcgacgtccccgtcggtgtcggcgtcgacggcgccggcgccgccgcagcagcagcaagggatggagtacaggggcccacacgagggcggcgtctactcggacctaatggagacgttcttggagtagcctaagctagcttagctagcgaccacaccaagctagcaaacatggaagcatgatcatgatcaagtgtttgttcttgtcacctcttagttttttccttcttttctttctcccaaactatgtttaagcttttgagcggtctggtttggagtttgcttctgtttaattaattaattaattagatcatgtagtaatcctttttgttcctccctagttgtactagctctctccaagtgcaaaaacatgaaacttgatactacatggggagcgtgcatgcatgcatgcaaagatgggcatgagtttgcttccgagatggctggcaagttatatggtgcaatgatggcgaggtacaagcgacatgcagcacctaataatttgctcttttatactctcaaaagtgtgtgctgcttggtcacaacactgtccctgttgcctacttattgctcaggctgcttttcgcgcccgtatttctttcttgtcgtacgtacaagttacatatgcatacggcaagggcctgtttaattcgcgactggaaacgtttgtgtgtcatatcatatgtttgatcggatatcgaaagagatttttgaacacaaatgaaaaaaactaatttcataacttgtctggaaactgcgagacgaatctttaagcctaattaattcatagattaattaggctcaaaagattcgtcttgtgatttctccctaactgtgcaattaattttcttttaatctatatttattgtttcatgcatgtgttcaaagattcgatgtgatgtttttagaaaaaacttttggagaactaaaccaagccatatataggacaaactcattcaaacaactctatatgccttttctgcgctctacttttacttactcactcctccgtttcggatgaattataagtcgtttaacttttttatcaaattttttttaggtttgacgaaatttctagaaaaattagcaacatttatgacaccaaattagtttcattaaatttaattttaaatatattttgatacaatgtttcttttgcattaaaaatattactatattttttacaatggttatactctaaggagtttgactaagaaaaaaaaatcaaacgacttataatatgatattataaaacgaggggagtacatgaaaaaaagatagctccattaattcaatatatcactaacacacaaattatttccacagtcaccctttctttaatgtttttacagggaacttaaaaaaaaactgtcaggttacgggaaaggtataccctctgcccttcgatatatatatatggtatacttgcgtgtatacggacgttttcggcatacgttaaggaaattcgccacggagttcacagatggaaggagtcctactcggacaggactgggtcgtcattgtatcgtgctgggtccaatgtctccgagtcctacttggagaccagttgacctgcgatataaaagggaccccccgggaggacctaaggcatcgaatctcatagccaacacatcccccacagcctacggagttgaagcctataggagctaagtcgccgggagatctagtcggaccttctcgattacgatctcggcggtatcattgagttccgctttccctttgaaatatgtggtttccaccatataatctcatatcaactggattagggctattacctatcgaggggcctgaaccagtataatctttgttttctgtctgcttgatgtcgtatacgtagatcctcgtaccagcgtaccccaataccttctatatccggtctacgggtatcctccatcgacagtggcgcgccaggtaaggggacttggtgctcaaggttctactactatgtcatctagcttcgtcgacaacagcgtcaacaccaacctcaaccaaggagttctcacttcaacaatgctggtgtggactcaagtcggtgaaatcgtcttcccggtttacaccacggtgccgatctcggctggtccttcaatgaccagaagcgagaacgcagtggctacaaccctggatgactccatgtcgaaggatcctcccgccgaagcggagaacggaacgtcgacgacatccgagcccgagaaggatcctagtgcagccaaacattgtcttttcgacaagaatcacgagccgacgaggatgacttccgaggtgacaaggtcctggtgtcctatccacaaaactagaaaacacaccttgcaagcctgttgggtttttctcaacgtccacgctgaaattcgtgcctgcaaagagcatggacttcagcgtacttctccaactcatgatgtctattgtcctattcacaagacaaagaatcacgacctctcgagctgcaaggtctttctcagcgccatgaagacgtcacctcctaaggtccagcagtcacgtatccccctcagggatgaggacaaggaacaaggagcgacgatgatttcagatcgatttgttggggtaatcgacatcgatccccacgaaccatcagtcttgcacctgctcgaagactatggctcatcgtcaacaagtacgccacacgaggtattggctatcgacgggaccagcacgtcagcgcgcgctaatgcggaagtcgaaaattaagtgactacaccagcccaacacatcagtaccgtcaacgcaatactgagggaaaccccttacgatcccgttctgaacgatgacctcgcacggtagacagaacgactacgggaatcagtgaccaacctcagcaacgcgttcgaagaggccgctgctgcagcgcacccagaacagccaccaactggcggtgctaatggcgaaaaccctgaacagtaggaatcacctcatcgagccacccctccgcctcgcggcaccggcgatctccgcgatcacctgaatggccgccgagaagcgcgacgcacgcgagacaacgagaaccgttcccgacatcgcgtctcttcacgacgtcacgatgacgaagaacgaggaggccgttcaagcgaagaccgagaccgtgataaccgccacaaccgccacgatcacgacgatcgcgaacggtggatgctgggcgatactggtcgaggacgccgccataatgatgacgacgatggagatcggcgccgggacaacaacgagagacgacgacaggattctcgagaacccggccgacgtcctcgtaatcgtacaccggaaccaagtgactcatcatcatcgtcgtcatcttcctcatcctcatcatcagatagacatccacgaaggacatacgatcgtcaacaacccaccgcccccagcgctgggtgtagagctttcagtcgttcgctgcgtgatgtccgatggcctgatagattccgaccaggagcaatagagaagtacgatgggagtaccgacccagaataattccttcaggacggtactctacgcggccggagcggacgacaacgcgttctcgaattatttgccaactgcattgaaaggctctgcacgttcatggctgatgcatctcccgccctactcgatttcttcgtgggcagacctatggcagcagtttgtcgccaacttccaaggaacttacaagcgccacgcgatcgaagacgacctacatgcgttgacacacaacccggggtaaatccttgagggaatatgttcggcactttaatgagtgcagaaatacaatccccgaaatcaccgacgcttctgtaatccgcaccttcaagtccagtgtcagagatcgatatactaccaagagttggcaacgagacgcgtcacgactactcagagattatttgaaattgtcgatcgatgcgctcatgcggacgacgcactgagacgcaagatcgacaaaccgaagatcagaggagagaaggactcagccaagcacgcacctgagacaagcaagaagaaaattcgcaaaagtgggaaaaggaaagctcaagcggaagttctcgcaacagaatacgcggaccctccgaagcgcccagacccacaaggcagcgacacgaagaaaacatggtgcccgatacacaagtcggacagacactctccagaagattgcttgttttcaaaaagtcacacgcaaaacacatggcattggaaaaaggcaaacgagtacgcatggtcgagaaggacgctgaggcggctactcaagaatcggactcagcatacccagactccgatctccatgtctcgcacatcttcggaggttccacggcatactcctcaaagcgagaatacaagaaagtggaacatgaagtctgttcgacgtggcagggagctgtgcccaagatgaagtggtctgaacagaagatagaattctctgaagaggaccaccccaagaccgctgtcatcccagggcaatatccgatcgtggttgaacccactattcggaatatcaaggtcacgcgagttctgatcgacggcggcagctcaatcaaacttctcttcgccagcacattggacgcgatggggattccacgaagcgagttgactcccaccgatcaacccttccatggaatcactcctcagtcatcgtctaaaccattgggcaaaattacgttgcctgtgactttcggccaagcaaataacttccgaactgagcaaatcacctttgatgtcgctgaattagatacagcatacaatgccatcattgggagaactgcactcgcgaagttcatggccgcatctcactacgcgtatcaagtgctcaagatgtcgggaccgaagggaacaatcactattcaagggaatgctaagctggaagtgcaatgcgataagcggagcctcgacatggtcgagcacacgcccagccctcctgccacagctgagccacccaagaaagtgagcaaaacaaccaagacgccgaagccggatggcgcagtcaagattgtccactctccagtgccaaccccgacaagaccgtcaagatcggggcattactaaacgagaaataggaactcacgcttatcacctttctccgagacaatgctgacgtgttcgcttggcagccgtccgacatgacgggagtacccagggaggtgattgagcagaaactcatggtgcgacccgatgccaagccagtaaagcaaaagctgcggagatttgcaccaaaccgaaaacaagctatacgagaagagcttgacaagcttctcaaagctggtttcatcatagaggtactccatccagagtggctagccaacccagtcatggtgcagaaggccaacgggaaatggagaatgtgtgtcaatttcaccgacctcaacaaggcgtgtcccaaggatcacttccctctccctcgaatagaccaactggtggactcaatagccggttgtgagttgttgagctttctcgacgcttactccggctaccaccaaatcagcatggcgaaagaggacgaggagaagacagcattcatcacgccgttcggggtattctgctacgttaagatgccattcggactaataaccgcaggaaacactttctagcacacggtccagggcgcacttagcaaccaactcggaaacaatgtcgaggcctacgtcgatgacattgttgtcaagaccaagacaagcgactcattgattgatgatctgcgggaaacgtacgacaacctcagacgatatcgcctcatgctcaatctagagaagtgcatgttcggagtaccatcgggcaagctgctcggtttcctcgtctctggcagaggaatagaagcaaatcccgagaagatcaaggcaatcgagaacatgaagtcgcttacaagactcaaggaagtatagaagctaaccggatgcatggcggcactaagtaggttcgtcgctaggatgggagaacgaggacaacctttcttcgctctgctgaagaagcaagacaaatttgtatggacacaggaagccgaagaggcattcattccactcaagcgctacctatcaaatccccctgtacttgttgccccccaacctaatgaagaattattcctctatattgccgccatgccatattccgttagcactatcattgttgtcgagagagagagggtgcaacaaccagtttactacgtcagcgaagctctccacgacgcaaagacaagtccatagatccaaaaactgctctacgcggtaatcatgacatcaagaaagctacaccactacttccaagcccatagggtcacaattgtatcctccttccctctcggtgaagtcgtgagaaacaaagacgttatcggccgcattgcgaaatgggtagtcgagctaagccaatttgatgtccacttcgtgccacgaacagccatcaagtcccaggtactcgccgacttcgtagccgattggaccatgcctgataacagatcagacaaccaaatcgacaacgaaacgtggacaatggcgttcgatgacacactcaacagccaaggagcaggggcaggattcatcctgacatcaccttcgggagatcaattcaagcatgcaattcacctcaactttagggcaaccaataacacagccgaatacgaaggactactcgctgggataagagctgcagctacactcggagtcaggtgactgatcgtgaaaggggattccgaactagtcgcaaaccaggtgcataaagattacaagtgctctagccctgagttatctaagtatctcgcagaagtcaggaagctggaaaaaaggttcgatgggatcgaggtccaacatgtataccgcaaggacaacatcgaaccggatgatctagcatggcatgcgtccagacgagagccactcgaacctggcacctttttggacgtcctgacaaggccatcagtgaaagaggcaagcggcgaagatagccaggtcgccccaacaacagctcgggggctgcagaggcagagcgcaccgttgctgatatcgaaaccacagatgactggcgcaccccactcattaaattcataggcagcgaagagttgcccgaggacgacgcagaagccgagaaaataacccgtcaagcaaaaatctactgtatgatcggcaacgatctatacaagaaggcgccaaacggggtactcttaaaatgcgtctcgtctgaacatggcaaacatctcctcgacatacatgaagggatctgtgggccacacgccgccggtcggacattagtcggaaaaacttttcgacaagggtttttctggccaaccgccctcaaagacgcttgcgacatggctcagcggtgtgaagcctgtcaattccatagtaaacacacaaagctaccagcgcaagcactccagactatccctcttacttggccgttctcgtgctgggggctagatatactcgggccattcccacgaggacagggcggctacaggttcctattcgtggcgatcaacaaattcactaagtgaattgaagcgacacccatggaggaaatcaaggccgacaacgccatcaaattcatcaaagggatattttgcagattcggattgcctcaccgtatcataacggacaacggctcccagttcatcagtgccgatttccaggattactgcatcagactaggagtcaagatctgcttcgcctcggtttctcaccctcagagcaatggacatgtcgagagggcaaacggcatagtactacaaggaatcaagactcgcgtctacgacaggctcatgtcacatgacaagaagtgggtcgaagaactcccatcagtactacgggccgtgcgtaccacatcgacaacgtctaacaaggagacacccttcttcctcgtgtatggttcagaggccatgctccccaccgagctacgacatcaaaatacatgagtacagaagcattccgatgaggatcaggaggagcagcgaaacaacgatgtgaatctactcgaggaacatcacgaacgagttgccgttcgagcagccagctaccaacaggcccttcgccgttaccatgagaagcgcatccgagcacacacgctttcgatcggcgactacgtcctccgacgggttcaaagccaagcagggcgaaacaagctctcacccaaatgagaaggaccgtacacgatcacacaagtcttgcggccaggcgcattcaagattgcagacggcgatggtcgcgagttgtcaaattcctggaacattgatcaattacgtaaattctatgtataagtcaatagtatccatacttgtaagacatcttacagcttcaataaagcctattttcaggtacatattacaatcaaagtgttccttcccgatgatcccttacccagatgacacctagcgttgaaacctatcctcatgtccctttacgccgtcttgacaaggcctccgaggaacctaagggaacttcggctggggacgcccaaagccgataaggccttgtcggatcctatagagacgaaagaccatgtaagatctagtcgtgtaagagttctcgccgtgcgtattaaccaagccgtgtaatcggaaattaattttcaacttcactgctgggggctaggatcagtgcttgttcaaccgaggcaggtcaaaggtccaagagccttatcttccgagaaggattctccgacgacaaggctgggggctagggagagtgtataactcaaacgactgattgaagtcgcgaagtgagaagacactcttacacactacgtccagactaagaaagcttagttatatagatttcttttctatttcacaagtacttcttacaattccgcaaaaatccaaaattatattacactcttccctaagatatttgtcataggacacggagactaccaggaaggccaacgccagtccatcgactggaagaccttctccgccagcggcgccatcgactttgccaggccatctatctccgtagaagttctccgagaacaagagaacccttcgtagaggaactcgaggtgcagctgcagacgatgatctcgtatgcaagccaatacatgccctccggcatatcggctcgatcgacggcactcctgcttcagggcctcgtcaatacgcttgccgatgccttcgagctgggcgcaggccccattcaaccacaagatgtatccagccgccgattcctcgggatcctcgcgggatactcggagctctctacagactctggtcatggacgtacagcaactcttcaggtacgagtagaaccacacctcgcgacctcggagcgtttccacggcctggtctttcttcacttctagcatagtcctctcgagttccgctacttgaaattttgtcctccaatattggatgagacgatcttggtcagcaagctggaactcaaatgggccggaacgatcactggcaactcaggctgcccgcgctgctggacatcctcgacatcaacatctctacaaacgacaacaaagtactcgagatcaaatgctaaagaaaactaaggtgatgactgcagacacgaaggcggttggaaccaatgagagttttacaaagcatgactaaagagtacaagggagccaaaatcctactcttcaaaaagcgggagaacggagtcccccagatcgccgacttcctccatcacatccttgcgcgcgttgctagccgccccctgatccaagatcttctgcagatcgagttcagcgtgcaccagcctcacacacgcaaggacatggcatgccctggtatagatcccgttagacgtctcctctccgatcctggccgcgtgcttggaggggattgcctccatcgccgtcgccagttctacaagcaaagacgtcagcgagaactcgtcgggattcgccggtatggtggtcttgacgccacactccccagcgagctggtgcagaccagtgtaggtgacccggaacgagccacggatctccgacaagttgttctcgagctctgacatacgatgctcgagcccttgccgttgtcgctcattgccggccaccagctccctcatcttctggaggtcctcgcgaacctccgtcagatcacacgtcagccggtcggcgcgctcattcgctgacgacgacgccgccgccctcgcctccacgatctcgcggtaatgccgcgagcaccagcttcaaggaggcgccccatctcgacctggagctcctcccaggtgaggacggtagacggcggacaccgaccagccgcaagatcgctggccgggccactaggcgtcgcctcgcggctcctgggcacaaccgcgacatctgtcgaggccacagtaggggacgtgctggaggtccctccagatccgtcctgtgctgcctttgcccatgccgccctgcgaaaggttgcaattgagacaggctgcaagtgtttgacgaagtgacaaaacctcaaattcatccacttacttctcgccaagcgtcacaagccgctatcgtcgcggaggcgggggagacgcgtccgaggccttgagtacaacgggtatgatgtgaggtggaagttttccggctacgcgatgaaacaccaggagagcttaccgagggggtgggtgtcttccgacaatttccgatcacggaggagattttcctccccttttcggaacgttgccaccacttattgtggcagcagcggcagcgacatcggacgcctccttgacgacgtcctccttcagcgacgccgccgcctgatgatccacgagtggcccgatgatatcagtcagagagagagaacctacgcttcatgaagttacaatgctatctcggaagaaaaatgcaaaaggaccgctgagtacactcacattgatggcagtttcgtgttcggctgcccccttatcgcaaagggggacggggacgttgttcgccattgtcgggccgctgatcatcaattggccgacgcggcgctccacggattcactgctcaaacctgtagatcgagaaccagaattcgataagtcaggaggaacacgcacacaaggaagtcaatttaaatacaagaaaaataccccaaggagaaacccgggtcgcgtcctcaggtccagaatagtcaaaggctaggtgggctcgagcctggagcggctagatccgtctaccaatgaagtcggcagcgacttcataccccgacaacccccgtacttggaggtcatcaatgatatcgatgaaagactggagggatggggccaaggcgggtttcgcggtccaagacgaaatcttgtctggtcgttcctcaggaacaacgaagactggatccgaattttctatctgaagatagaaccacctcgcccgccatatgctacaagaagaagggcactggaacgggatatagtgcgacttcaggccatcccggagttggaaaccgacacatgcggataccctgttgggttccatccaacgcaactcgtagtagaaacgaaagaggtcaagaaacggctctaccccaatgtaggcctcacaaagatgtgaaaaaatactgaggaaggcgatggaattggggctcaaatggagcagagaaaggccatagaaattcaagaccaagagaagaaattcagaaggcggaggaagaaaaccacagagaatgtagtcctcgatcgcaaccatgcgacccaggacaggctggggttcaatacctcctgcttctctctccatggtcccgcgaccgggaagggcgccatccgcctgtagtttctttagcgacgcgctggtggaggtggacttgtcgagatccattgccgccggagatcgccggagaagggaccgagatgaactagctagggttcttgcgggagcggagaagacaaggaacgctcggaggctggagggtcttttcacaacaggcggacttcgaaatggatccccaaaactcccttaaatagtcgcacttccgacgatgcgaattccaaggaaaggagagagatagctgccggaaatttctgggtccgttacacgcagcagtttttcatacttcaatttaaattcactcatgaccgttagtttcactgggcgttgtcgattaatcctcgtctctcggtcctcacatcgagaacgacaacaacctcgacatcagaagtcacgatcgggttacatgagttcatttaagcagaagtcgggggctactgtcagggttacgggaaaggtataccctctacccttcgatatatgtcacatatcgatatggtatacttgcgcgtatacggacgttttcggcatatgttaaggaaattcgccatggagttcacagatggaaggagtcctactcggacaggactgggtcgtcattgtatcgtgccgggtccgatgtctccgagtcctacttggagaccagttgacctgcgatataaaagggagcccccgggaagacctaaggcatcaaatctcatagccaacacatccaccacagcctacggagttgaagcctacaggagccaagtcgccgggagatctagtcgtaccttctcgattacgatctcggcggtatcatcgagttccgctttccctttgtaatctgcggtctccatcatataatcccatatcaactggattagggctattacctatcgaggggcctgaaccagtataatctttgttttctgcctgcttgatgtcgtattacgtagatcctcgtaccagcgtaccccaataccctctatatccggtctacgggtatcccccgtcgacaaaaaccatctaaaatatataatggggtgcctagtcattgtccgtatgtgatttttacaagaggtcatcttaaagaaccgtctataaaaaatagaactttattttacacataacatctctagtttattttgtgctaacgctccacccaacccaactccgctcacatttcaggtcactataaaaatacgatttttctatacgaggacccatttaggttgcagacaacccatttaggttgcagacagaccgtaattggcatcgaccttcattttcgcgtacggctcattaagagacccgcatgcaaaaatctatttttgcagacgggcctcttaagggggccgcatgtgaaaataagacctcttaagtggtctgcatgcgaaaataccaccccttcacatttttttttatcttcctccactatcttttccctctcactacttcaattttttttttgaactcctctcctctctctccccctctcctctcctaattatttactctcctctctctcccggccccacaatgggcggcggcgggcggtcatggcgccgcggatctggtgttggccccgcgacggcgggcaacatggagcggctggcagcgcgtgtggatccagtgatgacagcgggcgaccgggagcagagcagccgaaagcggcgagcggcaccgacgaggtagcctagagcaacgccaccctgtgtgaattcgacaatgacgacgggtgccggcgaccgggagcgggcggcgatggctcgtcccctcgtggaactggcaccagcgacgacgacgccgaccgggagcgggcagcggtggtggcccatccccacgtggatctggtgccggcgatctccatcgcgtggatctagtgccggcaacgacggagggaggtgggtccggtggatccgatggcgccgccgctgacaacgatggcgggcggcggatctgatggcaccgacaacaacgacaacggtgggtggtggatccggacggcggcggcggcaggcccgagttcaccctggttatttttatttttatttttttcactaaatttatttttgtatgcggctggtatatgaaaccgcatgagaaaatggaatttttgcatgcggttgtcctggccgtatgcaaaaaaaatcccattttcacgtaccttttggtgcatgcagttgggatggccgcatgcaagggatcacttttgaccgtttgtaaaatggtttccgtagtagtgagtgaggctaaaactatttgactgagaggtggagttggagctgtgctaaacagcccggagtatacactactgcactatatatgctactccttccgtcttgaaatataagggattttgaatagatgtggtatatactagtactacgaatctcttatattttgggacgggtgaagtatttattgaagagactgtgcatggattgggtcctctctaaatcctaggtattgtttagatcagggactaatcacatcggatgtttgatactaatttggagtattaaacatagagtacttgtaaaattaattatataaatgagagctaattcgcgtgaaaatttttttaagcctaattaatccataattagcccatgtttactgtagcatcatatagggtaatcatggattaattaagctcaatagattcgtctcatgaattagtccgggttatgggagttttagtccatccaagccccccaaagttggctgcttacaagggtaacctacgtacacgtcgatacatcatacatggaatgggtcctttttcaaagaaatgattacgacgttcggtgcgcaaagaactggacagacataagaacacgaaaggcagaccaacgcatgctagaaaaatttaaacgagaagattagaccgtgtgctcaccaagaaatggtttcaaaacatcctgtgtatctcaccactatatagaaataactatctggaacgtctgaacgtgtcgagtagaactgtttgtgacgtaccataccatcgtggctaattctactgtctgtcacgtctacaagacccttgtatatatgtatcggtttttagatgttggctcatttaaaatcagcatatagatagttttccatcttcgagcaatgaaaatatatagaaccgacacctttgagaaactataggtgttggttcaataggaaaaaatcggcaccactactataggtgcagaaattttaaaacaaccgacacctataaatatatggaataattgctcatttgaccatgtttggaagtctaactattgatctgaccttgcttttcatagtttgcttatttgaccatgcttttcaaaatctaataccccatctgaccctctttccattacaccgttagtgtttcatttagaaaaaagaaaaaaaatatatttactatttaaaccgactaaaataccctcaagacactttaaccctacccagcccaaccctatatatctctctctcctctcctctctttctatcctctctctctctcttcatgtcctctcgtactccgagcgggagtgggcggtggcgggcggcagtcgggagtggcttcggtggccgcgaggacgggggatcaagcagcgccacccacgggagggctggatctaccgtcctagggagcggcaactggcgacagcgggcggcgagggtggtggatccgacgacgccgtccccgggagggcctgatcctccaccctagggagcgattgcgatgacgacggcgggtggcggatccacctacgctgccctcgagggtggcggatccgccagctccccctcttcggatgtggtcagcagcaacaggaggggcgtgtgtgccctccagccccttcccggcgcgcggcggcgatggcgatagctggcgaaggtgcatccgtcgacgctggcctcgagggtggcggatccgcgcgggctcctcctccgatgaggtctgcggcgacgggagggacctgcgcgccctcacccccttcccagtgcacggtggtggtggcggcagttggcgacggcgggtagggcggcgacggatggatgctcccgatttttcattttttatttttattttttttggccgataatcattttcgcagtcggaccacctaacacttcgcatgcgaaaatcccgtttttgcatgcggttgggctggccgcatggtaatatcgccatttttacatacacctaagtgcatgtggttgctacatccgcataaaaaatgcaatctaactatatcaaaaagggttcctgtagtagtgttagtaataacgagtgtaaaccgcttctagataaatcatcttataataagtgccctatattaaggaaacaatcagtatcggactagctcatttggattctctactagtgtctataacttccttagaccttatcaaaacaaacgggctcatatattacaacacgagactattcactcaagagataggtgttgcagccacagcagtctgtgcagagaaaggcagtagtgcatggccgttgcccaagatattcttctgtgctaaagccggccaacgcaatgcctagaggacagtgtgggcgtggatttggaggcacgggacgacggtgccgtctagaaccaaccctgtccgttggtggtaacatctcaaagtggcagccatctttcactctctccctttccttttaacaccagagagatgtcacagagagggtgcgtgcatgctgtatagtagtaaaccggtggtccaaacggctccccatcccgtgcacgcctttgcatatgtaatcacccaaaagttggggccttttgggcgagccatatcgaagagatatatcacgaactctcacgcatgttacggtcgatctgatctgacgaccgtcgtccaacctacgctttcaccaaagacagccgtggaatcgtatagattccctactccgttctaggtcatcacctcttatagattttagctattgttaaagatataagaggtcagtgataacttcacctcatctctaatgaataaagacatgtcagtgatgatcaatacctcggatgtgtgtaagcagtccgtcacattaaccattgacccagcggtgttgccacatactccctccgtcccaaaaaaagacaaaccctgatttccgtgcccaacgtttgaccgtccgttttatttgaaaaaattatgaaaaaaaattaaaaaacaagtcacgcataaaatattaatcatgttttatcatctaacaacaatgaaaatacgaattataaaaaaaatttatataagacagacagtcaaagttggacacggaaatccatggtttgtctttttttgggacggagggagtatcatagatgtgagctcacaaaccagttctaacccgtcacaggtcatgagcttagctctgatggattttaccattaatgatgtgttcttcggaaaaacaaaacccacgtccttgataaacccagaaattccttagatctgggcatccggcaacatatccacatccatacataggagaactcacaactgtcaggtttgtacatgaagcttggtaggtgcaaactctatacctgtcgcaagtgagaggttacctctggcggacctatgtgtttgcccgttagaagtgatttatcaggtgcaaattaaataagaggcccatcacatataacctagctcttacctgtaatgagccgcaccctacagcttcatctattaccctaattgaatctgtcacacatgtgatcattcacgatgagacacttttatccatcacaaataaatcgatatatagcgtaatgatattctcgtggtcatgctagctgcagccgcctgtagatcacttgcagctagctagctagctttgggtaagtaggtaattggataggttaggtatatatgtcgctgcacttttgtgttggggttcatttcgccatcggttaaacggaatgtgaactaacagcaacacgaagattaattaccaaacagattaacggtgaattggatgtacggaaacagctagtagcgagtaccttgttgcccgggcaaatttcattcttcgagcacagctaactggctaattaacaagctgtttgggtttggagcattgtaccgctcaactgaaacttggcaacggaggttggcaataatcatgaaaagctgtaatactatacgtgaaaggtcattagagtaggtataataccagactataaagctagctataaacatattttaagaagataaagagaagatagaagagttgcgggctatagatttatagccagctacagcacggactataaaatacatctgtgtatgatagatgggactatatattaattatgaagtatatgtttatatgtatctatctatctattataaactaaaagtccattaaacttcctaaaaatactcttaagccgccacgtggcactcctataaactctcctagaccgccacatggcactatctaatctcaccgttaattttcacttaaattggtggacccattaatttaaaccattagattagatctattattaaaaaggtgatatcttttcatgcaaataaaatatgcaactggtggcttggggaaaggaaagaaaacaaaaaatgtccgtacgtaagtataatcgaaaaaaagaaaacaaatgaaccttcctcccattagccggaaggaaaaaaatgacatctgcgataaaaaataataaaaccaaaaataaaagcgtacttattactaggaaaaaacgacggtctaaaataggattttgtataatataatataaatatcaaatatcaaatcaaagtctctaaacatcatcttttaaattatttataattatatgcccaatttatgatccattgtattcgtttaattatataaactatcgatgtataaaagttattttttagtcttaaatacatcacgacacatcgagtcgacatataatagttaacgttggaaactaaaagtccattaaacgttatataaacgctcctaaacagccttaggacactcctaaaaacgcttttacgccaccacgtgatgctctaataaattagagaaaaccttataaatttagagaaaaaagaaaaacatccaaccctcattttcattggtggacctactatttttaaaccattaaattatatttatttaaaatacatccatgtaacctccccgaataaaaaaaacaaccgtgaactactcacgaaaaaaaagataaaaaaaaatgtaattacaattggagaaagaagaattagccctgccacggtcccacctaattgtcaagagtgacacgtacatacgttccgttcacccaaaaactgaaaaaaaattctcacatgtacaatacgtactattattcaccggattaagaaaaaatgtactattattcacctgattaagaaaaaataaatttccagggtacgtacatactacgcaccgtacttccctcattgaatcttatacatacaagaaaaaatcacccgtcccctaataaacttatctaaattagatgtacatgggaaaatattaggactacatttgatattaactatattttaatttaaaaattatcacatggaaacatatttagctcttcgtccattaaatatccaataaacactattaagcagccatgtagcacttctacaaacgcacatacaccgccatgtgacattttaataaattagaaaaatcagaaaagttatgagaataaaaaaaaaatccgtttatcgattttcactaatatacagtggacccatattgtgcggacgtatctctccacctatttcctttctctccttttttttccagtttatgttagatggaaaaactattttaggataacaaatttaaataattatattatctaaatcatatagctaactttttattggtgcataccattagattatttactataaaacttaaaattgaagatccatgttaactatattattaaaaaattcatgctttgggtcatatatattctatggactagttattgttcactcatccatactttttcaaggaaaaaatcatatagattttaaaacctttcgattaataacgtactcttaacttagaataattttaaacaatttaattggtttaattaaaaatacaacacccaaagtacttcctaaaagatttatgattaaatgtatttatgaaaatagatgactcaaaactaggaccgacttgatctattttaaaaacaataatctcctctgatcctcctgcctcgtgtatatctctgaccttccctatctgcctcagccatcaactcctctccaattcaattatctcctcttctatttttttaacttaacacaatataaaaatattcataactattgttttatttataattaaataaataaatcgagatcgcattagccatattttacttatagaagttaacatacaacatttgatggtagaccttatcgtttgcttggcaactaaataacaacgataaattaattgaacatatgtattatgttatactaaatcactgtatataacaaaaatcaactaaacacccctatagcgctcatgaattgctgtataatatgtcataaaattataagaaaaaccaattaaattgacgtatccatgatttttaactattagatctattttttttaaaaaaatattaagttgcaatgtgtcacatcctataaaaaacaggaaagacaagataatgaaacatcccgttattggctttcacttaaagcacttagaaaaattagaaaaataaaatctccaccacctcctcacatgtacaaaatactatcgtcccctccctattattttatgtattaaattaaaagagaaacaataaataatatttgatactctttttgagaaacaaagtataaacgcagacgctcacaatgcgcgtacatttactcctatgaatgtagacataccgctatgggtacttccaagagactaggctgacatattttgacattgacgaagtcgccacatatacctcgctgtcgacgggtacatcgcctaccactaaaagaatttgtcaagtccgggacttaaactcgagtgggcaagttccaccacaaggaataatattagatattaaaacaatcataatatttaagctacatttctagaatacccctatgacgtttaaaccggtggaactattatttctaaccgttagatatatcttatataagaacaaaaagcgtgtattcatggtacatcacatttcaaaaatattattgtgtaattatatttcgtcgttattgtattcacgtctacctttgtttcaaatgatgaataagattataaataattgcttatagatattacttaaatataatataatatagttagaaaattataaaagcatgccgactaaaacaatttagggagaaatcgtggtaaatgttctccggttaatatttcactcgtacaagtgtctcaaacttagtgtacgatgtatatccacgtatccgggcgggctacctttctattgtatgaattgtctattgagttgtacttgctcttaggacgtggtttttgatgtggacttaattaaggacataggggtgctacgtgcgcacgtggcgtggcagtgggtcgcagcctcgatcgtcacacttaaacaaattgcgatggccagtcagagatgctggatcactttgggaggagcgcggaaactatacttaggaggagctgatagtaatagcaagtttaatagtatagccaactcgctgcaaattatctatatatagtcaacttaatagccaatttatataatagttacctataaatatatactacacaattaatatatggtcccacctgtcatacacacatgtgtcttggagtccgtgttgcagctggttacaaatctatagctcgctgctcttatctcttctcttttacctctttaaaatatatttatagttggtttataatttgttattaaaatatatttatagttggtttataatttgttattgtacctgctctaatactctactagaaaaaaatttgcaaacaggctaaatcggtctatccaggcagccttcggatttgcctgcaggcaaaggcctgtgaacgcaggcagcctttggatccgcctacgaaaatcattttgcaggtggcctcttcttttttgtagccaccaaattcacccgcctgcgaaaacattgccagcgcacaaaaaaaaaattgcctgccaccacccctacccgccgccgccctaccaactccggctagatctagggttttgggagggagagggaggggagggaagtcatactgctgttggccgctgccgccggagctggaatggagggagggaggaagccgcaggccaccaccgtcagatctggaaggagggagggagcaagccgcatcgccgccgtcctcccgccccctccggctagatctgggaggtggggccgccgccgccaccaccacagctacaggggggccactgccagatctggaaggagggagggaggaagccatgccgtggcaaccctcccgccctcttcggccaaatctgggaggggggctgccgccggatctagaaggagggaggaagttgccccgccgccgccctctccgaccagatctgggatggggggccgccaccaccaacgctgcaccctccgatcggatctggagggaggggagccgctgccgctacaaatgtgctccgcgccgccgagtgacgaagggagccacctccgcgccaccaccatcgcgtgcccgcgccaccgcccttgctgcgtccgggggagccgtcgtcgccacgcgtccgtgccgctacctttgacgtgtccaagccgctgccgttgggatgagagagagggagagccgcctcccatccacgtcgcgccgccgccaccctccctcctctggtcggatctggaagggggagggagggaggggaggggaggggaggagggaaggggcacagtgaggggaggggaggcagcacagttagcagaggcaggtgagcgactgtaaggggagggaggtgaggagtgatttttataactaaaaaagccttttgcaggtggtatttttgcaggcggagctcttagatggttcgcctgcaaaaatcgattttcgcgggtggacaataatctcatcccacggatgagattttcgtaggcggcgaattagctccaagagacctacccacctgaaaaaaaatgccatcaactaaaaaaatggtttttctagtagtgatagatggatcgattatcaattggactaactgtattgggcgagcgcttgcttacacgggttctttatatatatttcgattgatctgtaaaatatatggagaccaaacaaggatccaggttgaaaccgatatagccgtagaaaaacctatagatgctggttctaatgagtccatataggcatcggttccggtatcagcatcgattattcggcaccaatgacacaacacattggtgccggttcttaaactggcacttatatgacaccataggtgccttgccggttctaaatttagaaccgacacctatagtggtgcaaccttttaattttccaagtgctaaaaaataaaaaaatagtatttaattaggcacctatacagtcacagttcacttcccacaagtcatatgattttctcaacccatatcatgtacatgctttaaggaaaattcaaagtcaagacctttctccgtgtcatattatatgctgttttgattttttatagtcaaattttgttaaatttgaccaagtttataaaaaattagcaacatctagaatatcaaattagattcattaaatctaacatcagatatattttaatagtatgtttgttttatattgaaaatactactatatttttttttaaatttggttaaacttaaaaaaatttgactaagaaaaaagtcaggatgacttataatatgaaatggagaaagtattgtcttgagactattgttatccaaacttataatccatatttaacatcatatatgagcttaaaagaaaattgtgtcaactacaaaaaaaaattgtatgtcatctatacctacaactttcaactttcaaatagattttgcatccatccgagatcgtttttagaaaatttaaatattcacttatgtaaatagatctaagaccttataacatattttcggacatccaaacaactatcaactacaacttttgtagatctcatcgagctctacaaatttgatattaagtttatctttatccgaatttatataataaaaaagtgagataaaaacacacacatatgagttgtgttatcataggtgacaattttagttgtgaactgaaatttttattaagaatcggcacatatatgattcccatacgtatagattaggagaaatttactgagctgcctcttcttagtttgctagttgattaattacacattattatttaagagagaatcccttatatgccactagaatttggccagcttccttatatgccactcaaaattggcttctcccttatatgccactagttcaagtttttccaccattttatgccactcccaccactatagtgttagttgactgttagtcaaaggttagttttttcgtaaatgaccaatatgccctctcaactaaaaaatgtgtaaacttcaaaaaatcataactaatttattttaaatcctttttgagtgaacaaaattttgtcagaaccagtgaaaaatgctctttatattaaaaatattgttggaaaactgcatgttttatgcttacattgaaaatttatttgtgatggtaatggctaaaattgcatgtgatgcagaaaaaatcaattttcatatgttgtatcctagctatattagtactaaaatatctattattggttgtatactaattctaaagggcaaatgcgtctttttacaatgaagttaacggaggagaaacttgaaccggtggtataaaagggagaagccaatttgaagtggcatataagggagcccgttaatttagagtggcatataagggattctctctattatttaatccatcatattagatgtattctctattcttatttagtgtacatccaaacagtcctgctctgatttatggccaacttagttaagtactccatatgtatgttttgcatctgttgcttttagtttatttgagcatacacatcaaagctaatttgaagcactttttcatgataatattaatgtgtatagtactactctctccaagcaatagctagatgtctttttttagtaacttgaaggacaatatacatatatgcctaatcttacatagttcttttggtctgtagagttcctcaagatgtattgaacatcctaataatttgccttataatatgttacaacctgtattttgatcatatgcattcttaatatttgacatctgatttttcctttacgttactaggtagtattggattgatcatggataagggatggatagaagcatctaggtcgagtgttgaatatagtatcggcgttagtatatttctagagctcgccttgtccaattcagccaatgacaatacaattcttgttggtgtttattacggtcacaaataaaatccgcaagcgcacggatataccgatgtagcacttcaggaggaagtattcccatgtatggaatctgcagggaacatgtgaggttatctcttcttcaggtttatccaaggacacaaaataaatgtgggcaaaggatagagaagattttctagtaagaaacagtgtttacagaaagcttggtttaatcctattgcaatacttgcaatactttaggcactggcttgctcgcagctaccatagcgcgctctactccgtactcgtccagggaggactgcagtgatctcgagtgctgtcactacctctacaccaacctctaactatctgtgggatacgtagcaattgctggtaattaactacctaggcatcgcgtttatgcaattaattaccactctagtgttagctaaatactaaagtaacactattactagtgacattaatccagtatgctaataggaactaactaagatataattctcacaaagtaaatcttaattactcaaaagaatatttctattaaatcagagtaattaacaagatacaaaaagtaaaagtaagagtagattagtgacaactccggaattactccgatttcttctaccttactctctctctctctattccaagtatacaataaagcatacaaagagcatgttataattgagcttaagctatatcttggtgtgtgttgtgtatgagggaggagaggggtatttataggaggagtttgcttgagaggatgatgatgctccatggaatccaaagggcatcttcactcttgagcctccacctatcctctctatgacggtttctaccagtaaaaacgctcccaaccgtcatagcaagtcggcaagtaattgcctctgaaaaatggggccgattgggctccttttgggtttggccaaaccatgggttcagccgaacccttgccggctctttttgccccgaattttctcgtgggctctggtgaagaatccctcagcccatatgtatggtggatgggcccatttgaatgtgttttgttaggtttgtgggtgcaaaactccataggcttgaatgtggaagtttaattaacctccttctttatgtatcttttgtctcaactttggtagtttgtcacctgcatccaaatatacaccaacactcgtggaaattattagaaataaaccctaccactatgttgcatgctttatactttcatatttatgtaggtattgacgacgtaaatttggcatttaacagccgccaacaatcctttgcccttgcaaaaatcgtggaaatagatattggttagtgagcatctgatttgtgatggattcttggttgtgcacacctcatgtattcatcatggaggaagcatgtttacttccaagccaagtgttgcctcaagttcacacctcatggattcactagcctatgccgtcgtacattctcgcgaccctaaacattctattatgttacatggtacgtgaaagtcacagtatatatattgctcacaaaaaacgtgggtcacataagtgatattatcttgatatatatatataatgaatggcttaatatatattgcaaactttacatccatatgagtcatcatcttataactgtatgtattgttgcatgacccccttatcctctgcttattttccgttggtgcgtatgctttatatgtcatacacatattttctaaggtttttaagcatttaggttattttaattttaaatttgtatgaaatcattaaacctatagaaaaatcattatgaaatcattctaaaaattcaggtgatcatgcctgtcttgttagagggaatgtgtatctccttgtagcgatttttttttctcaaacatgttaaatattaattgttagaaaaaaataatatttggtcatatatttcgaatatgccctgaatagtgcaatattgactaatgaatccttactaaagaatgagggtttatttgtaaaataattttctattatatgtgcaaatcgtaaaattatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34106 - DNA, 541 bp, Oryza sativa
  unsure (1)..(541): unsure at all n locations
nnnnnnnnnnnnnnnnnnnnnnnnnnnnnnnnnnnnnnnnnnnnatcaaccgccattatgtcgtcgtcctcctccagggtgtgttgccaatctgtgggctagggtggtgtatcgattcagataaaaaaaaggaaaaaaatgaagcaggggcgagagtggttggttgggaacgggaaaaatataatatataccgaaagcagagaagttgttttttatcgaagtaaatcatttactccgataatggtgggaacacgatgcgggacgtggggtgggatcgaaagcaagaaagttatttttattatcgaagtaaatcgtttactcgaataaaggtaagtggtaggcgacggcactgcttcgggcctcgctgtcggacactggacagcaccttaaccagtaaggaggtgttcacctaggccaaatagcaataaccagcggctgcttcacgttggcgacattgatacaataagcaagtaaggaactgacactctgatttggatctggtgctctcctttaactttacgcatgaagctttttttttttg

SEQ ID NO: 34107 - DNA, 542 bp, Oryza sativa
tacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgca

SEQ ID NO: 34108 - DNA, 10891 bp, Oryza sativa
  unsure (1)..(10891): unsure at all n locations
aataaatgtgtcgtatctaaatatggaacgtttattggaaaaggttataacagcggaggcttgttccgcttttccttggatgatatgtgtaataaagttgtgaaccatgtaaacgatgatgacgatgagtccaatgtgtggcattcgcgattttgtcatgtgaattttggttgtatgacacgcttagccaacatgagtttaatttcaaaattcactttaatcaaaggctctaagtgccatacttgtgttcaatcgaaacaacctcgcaagcctcacaaggcatcttaggcgaggaatttggcaccactagaacttgttaattccaatctatgcgaaatgaacggtgtgttgactaaaggggggaagaaatatttcatgacactgatagatgattgcactagattctgctatgtgtacctattgaaaacaaaggatgaagcattacattactttaagatctataaggtcgaggtagaaaaccaactggaaaggaaaatcaaacggttgaggtctgataggggtggagagtgtttttccaatgagtttacttctttctgcgaagagtatggaattattcatgagaggacgcatccctattcaccccagtcaaacggggtagccgaaagaaagaaccgcactctaactgagatggtgaatgccatgttagacactgcaggacttttcaaggaatgggggggtgaggcaatattgatcgtgtgtcatgttctgaatagaattcctactaagtataaggaagtaacaccattcgacgaatgagaaaggaataaattaaatctctctcacctgtgcatatggggctgtttggccaaggtaaatgtacctatagccaaaaagcgtaaacttggaccaaagaccgtagattgtgtgtttcttggttatgctatccacagtgtgagatataggttcttaatagtaaagtatggagtacccgacatgcgtgttggtacaattactgagtccagagatgccacattctttgagaatgaatttcctataaaaaaaatgcacctagcacttctagtcaagaacctattttatcccctgagcactttgcgtcgatagaacacattgatcaaacgcttgaggaaaatcctgaggaggataacattgtagaaactcaaaaaagtaagagacaaaggactgcaaagtcttttgaagatgactacattgtatatcttgtggatgatactccaagaaccaatgaagaggcatattcatctcctgacgctaactattggaaggaagcggtacgcaatgagatggactcaattatgtctaatggtacttaggaagtcatcgagcatgcatatgggtgcaagcctgtacgatgcaaatggattttcaagaaaaagcttaggcctgatggtacaattgaaaagtacaaggcagtcttgtggccaagggttatacccaaaaagaaggcgaggactttttcgacacttattcatcggttgctcgcttgaccacgattcgagtactacttgctctggcagcctctcatggtctactcgtccatcagatggatgttaagacagctttcctcaatggagagttggaggaagagatctatatggatcaaccagatgagtatgtactagtgtactagaaggtcaagagggaatggtgtgcaagctgttgaagttcttgtatggtctgacaatacacttacatctgctggctttattgtgaacgaagctgacaaatgtgtgtactatcgctatggtgggggagagggagtgatcttgtgtttatatgtcgatgacatattgatctttgggaccagcctcaatgtgattgaggaggtcaaggactttatgtccaaaagctttgaaatgaaggatttgggagtggttgatgttattcttaacattaaactactgagaggagatgagggtggattacacttgtgcaatctcactatgtggacaaggtcttgagtcgctttggttatagtgactggaagacagctcctactccttatgatcctagtgtgctattaaggaaaaaccgaagaatagcaagggatcaattgagatactcctagattattggttcattgatgtacttagctagtgcaacgaggcctgacatctcatttgctgtgagcaagttgagccggtttgtttcaaatccgagagatgatcattggcatgctcttgaaagagtaatgcgctatctaaaagggataatgagctatggaaatcactacgctgggtaaccaaaagtactggagggctatagtgattcaaactggatatttgatgctgatgagataaaggccacaagtgggtatatgttcacacttggagggggcgctatttcctggaagtcttgcaagcagaccatcttaacgaggtcaacaatggaagtagaactcacagctttagatactgccacagttgaggccgaatggtttcgtgagctcctgatggacttgccggtggttgaaaaaccagtaccagcaatcctgatgaactgtgataatcaaacagtgattattaaagtgaacagttcgaaagacaacatgaactcatccaggcatgttaaaagaagactgaagtctgtcagaaagcagaaaaactccggagtgatagcattagactatgtccagacggctaaaaatctggcatattagtttaccatggggctaccacgtaatgtgatagactgtgcatcgagggagatgggcttgagacccagttagagttgcacaatagtggaaacctgtccattgtgatcagagatcccgtgaatttggatggcgaaacaaactattgtgtaactgagagaagagaccctaaaatgggcttatcttcatgatgcacttctcttctaatctgtatggtaggatggtatacaccttaatgtgattcgagtggcttttcataaagcagagatgttggccaacagaacatcttagaaggaacacacctatatgagtccgactgctagtcacagtctatgagatctgagtgatctctagatactcatgaaaaggccaggagtatgacttatacactccaaacagaggggatgcaaacggcagcctagtaccagttaagggtttgagtgaaacctgaatcacacaagactaacaattcaaggcatagtccattgttcagttgtgatctggtgtagctcttttcctaggtggaagttaaacttaatagtctccaccgaaatactggtataacaaacaggattagaatcgagagcatttcctgtgagccatgaaatttggtggggattgttagattaatgggctaggcccaattaaatcctaataaattccattggcccacattaagtgctatgggtaataataccaccttggaaatctaagtgaagaggtctcaacttaaatacggagctgttgagatggtgcgcggacaaccaggcggggcgaggcgaggcgaggcgaggcagacagttgttgctgctgcgctctctcgttttgtaacggacggtaataaacacggagaatcgatttcatatcaatgaacgcatcggttacggaattaaacgtcgtaaatttattccgtcggttacgaaattaaacaccgtgaattgattccgtcggtcacggaattaaatgacgtgaattgattccgtattaacgagcacgtcggttacgaaattaaacactgcggttgatgactccgaacattactctcgcgcttgcatatatatactccgcagcgaccagaaggacagaagaagttttttctgacctctcttgcacttcgagttcctcctcctctgttcctgagctgcagaatccttccctggttctgttcacctgcgcacacaggtgtacgggacgagcaggtgcctccgaaactccgtccgcttgagaacctgcacgggtaggcaagcgatcaagtttttgggtagcgcttcaagcgcgactacccttattcttcacggctactgctgctgcatcgacgccttcaccaagatgtcgacgaagattagaaacaagatgatgaacgacatcaacggaggcaatacttcctcaaaattcaacggtgggacgttctcggggtatactttcattctcccgattctattagatgtttctttgttaatactcttcgcaatggcagcgcattgcgttactatgtaaatgttgatgtttatttcatattaagcatactcaagttgtatacatctagcactgtcactagatctacttatattgcaactgtcatgtttattgtcttaatattttagattaaaatatgctgaattatgaccaaatttccaacggtgactgcgcggctgcgccgcacccgccagcgccagtccgctccataggctggctctgttgcggcggcacagtgtcagcctcgcctcgcacagtatccacggatcgcacccgctagccatcacctccgtgggcccgcctgtcgtggaaaaaaaattggtggagactgggtgtaaaccggcctgctctggaaaaaaaaagggactagctatatttatggcgccatatttttcacaaaatatagtcggtatgtgtttacattgtaagtcactaaattacatatgtaattttagtgtatttacgatgtaagccccaaaattacatatgtaagtattaaaattacatatgtaaatcctaaaattacatatgtaaatagtgtgttagtgatgtgtaactactatgtaaatttatataaatatataatttacaacaacaacaaagtttaaaaagcatatcagtatgcatctacgccgtgtcagaaccaatcatagcaaagcgtgtgtgctgatgccccatgagcacgaatcttcatgccaatcctaaggctgaaaattcgactgcgtttgtgggaaaaatctgtcgtcataattatagccgatccgaaaaaaaaaaattgatggagactgggtgtaaaccagcctgctcctgtccagcccggccccaatgattgctgcgtggatacaaacaagagatcaatcatctagctcgttgcggctccaagcgtagcacaaataaagtttgatacgttaccgtaagtatagcgcggaaatatatacatcggcgttgaggcataaggacatcgttgctaatagtgcttaacatactattgatcgatgcaatactccatacgaatattgttattgaatcaggaattaaaattgcgctctaggctaatcctggctaagaggtacgacctcatcgatgcgggactcatcgttcaacacaatagaggaagaaagacttggcggctacagccagctttgcctattagagtggtattcatgcctaggttttaaaggtgttatttcattgataggtagaagtggtatttttaagaatatctatatggatttggaaataagtgagttataaacggtgatgtaagtagtgatatattttagtgtattaatgatgtattaggtcttttacatatgcagtttcatctacttcctccgttttacaatataagtcattctagcatttccacattcatattgatattaatgaatctagatagatatatatgtttagattcattaacatcaatatgaatgtgaaaaatggtagaatgacttacattgtgaaacggagaaagtattaaataatactcagcttttaaataataataataagtagtagtgaaaatagagaaatttatatgcaaccgggactaagtgattttttttatctggacatattctattaagtatataaagtgtacggtctactttactttgtagaaatggtgagacttttttttttacgaaaccgcatatctaggcggcttccttggttcgaaaaagttggtcagcaagattttctttattttttctaactaagaaactataactgcattctcaaaagaatctcaacacgaatcccaatcctaaagtttgacgatttttgttaatcttttattagatattctgggattaaggggattaaattttatgtattgttagccgtgctcctcaaaaccactccttgtaaaaaaaaaaaagcaaatgcaaaatgcgcgcatgaatggttcccttctctactgtaaagtacggagatggatctctctcggatggatatcaacccgtttcttacatacaatctaaataattatgaaaaaaatctaaaaaaatatataagatatgttaatatgtaacatatcacttcacaaacatacaagttcaaattcgatttctacaatttataacaaaaataacaaattaaactctaactagtatacgtatattcacagtcaaatttgttatttttgttataacttgtagaagtcaaatttgaacttgcatgtttgtgagatgatatattacatattaacctatcatgttaatttttttgaaaaatttttataactatttatatagcatgtaatatatataatatacagatagacgaccacctgagtgtttaaaacagtttcctataaagtactactccaaactccaaccatacgtcagggggcctacatctagccacatcaagccgtggaacaaaactagcagagcaaacaaatacttcgctggcatcagctaacaaacagatcgacatgcactccactcaacatctgaaccttatctccgtctaatataggagtattaggttttgttctattttcaattactcgatctcggccattccgtgctttttgtgctctaaaagaagccagtacaacagcactagtacatgctaattaaacacttctattactacgtacagagcagggttacgtaggcagatactagaccacgcccggttctcaatctgatcgctattaccagtggctggcactctggactaggtaccggtgcggccgcgcctcgccgctgtgccggttgtgatgctgctgctggtgcagaacacgagcgggaggagacgacatctgatgcgccgcccaccgggatgcgcacgacggcgcgctgccagtctgacggtggtacagggcatggggtaccgtcctggacggcggcggcggtgtcgttgtcgtcgtccttgggaacaggaacgccggatcttgagcggctggaggcggtcccggctggccgcgtcgtactcctccagcaggttggcgaggtcgtcgtcgccggtgacggagacgagcgcgtccaggtcctccgtcgggagctggcaccgcaggcacaccgcctcccacccgcacatctccctcagcttccgttgcaactctggattcacaatccaaacgtacgttgtaagagctccgatcgatcgagagatcgaactaccagtctcactcaggagcaggttgcaggtgtaccgtggaaagggagggagcggtcgacggagacgacgcggttgtcgccgccgacgtagcgcaacgcgccgtcggcgtggcgagggaggatcctcccgccgtagctgcagaggaacttgacgaacgtcccctcggctgcggcgtccgctgccttgacgacgcacgcgacgacgacgtcgtcgtcgagagagccgagcgacgacgtgcacgtcgaggacgatgaccaggaggaggttcccaccatggctctccttccttggacggacgaacggccggggacagcgagaatctcactggagaatcttggctagctatagctctttggccttgctgcccccatgagcgaaccgcttccagcctcgtctcgtcgacacgaacgccacatttataatgtgtggagagcgtgacggttttggagatgccaaatgactggttgaaacaaaactctctgaccggccaattttgtgaaacggcctattgggctgaagcagaatcgtgtcaattgcctacaagtattcaacaagctgtagaatcaatcgaccatagtggatgcacatgcacgcacgcatttcctgcggttaggacttaggaccactaggacgagctggatctgtaacagacggtccagagcaggcgcggctgcgatgatacgaatatctcgtcattcattcactcgcagctgtgaacctcctgtttgtttggttcggcgatatctccgtccgtgtgaattgaagatgtgaataacggtgattatactagtacacacggaacgtcatggaaccggacaacgtacactacacacgtcgcgcgtccgggttcctcaaatattccgaggcttatcctcccggagatcatcaagacatatattgcaagtaggaacaggacgaagatgtgaagcaatcggtgaaggctggagtccggtccaccagcagcgccgggtgacgacagtgctacagaaataatgcagcggggccccgttgcccacgtcaattctctgaggagctagctgatgacgacgaagagataaaagctttcagctcgccgcggggcacgaaaatttcaaaataattagagtaaatttcacaaaattataaatactttgatcaaatcattataaaaacaatagatttaagatggcgtatcttgaaactacatatttgaaaataaatttatcataaaactacaagtaagtttaaggttaagcatggctaaaagcgatttttctgtacgtggacctatttagattacagacggaccataattggttgcgcccgggaaaataagttcattttcgcgtgtacggtcctcttaaacgaaccacacgtggaaaggagattatttttacatgcggacctattaagagagccacacacaaaaatacccactctctctccctctctctccatgctactcactttaaattttcccatctttctctcctctcgtctctcgtctctcctctctatatcattttcttgactccccacatctctcctctctatctctttttccccgatctcttctctcctctcctcccgagtcccgacggcggcagcgggcgtaggcgacgacagcggtgcatggcggcagcagcggcgcgcgggatccggcgggcggcggccggccgccctctcccccgcgggaaccagctcccctcccctcccctccccttccttccctccccagatccggcggaggggaagggcgtcgacggtagtgcggccagagggaagcacggattaggcggcgagccgccctccccccctacgagatccggctcccctccccagatccggtggaggagaggggcgttggtggcggtgcggccggaggggagcacggaggccagtggcgggcggcgcgaaggccggtgggatagtagatccggcagcgggcgatgcggaggccgccgacgagggtgggaggtgtgtcctcagccgacaacgatgacgaggaggaggaggaggaggcagccgggatcgcgcggtgccgccgccggattcaaggttttcatttttttttgaaattttattttttttagatttttgtttttccgtgtgggtgcgccacccacacgcgaaaatcggatttgaccgcatggaaaaacctttctcgtagtagtgaagtatcgcaaaactgctaattttataataaaattatcacaaaactatatattttaggcattaaatttccatcacaaatgttatgtttgatttataaaacttttagttttgtgataactgttagtatttcgtaatgttcacagataaagtccgcaagcgcacagagatatcgctgtagcacttcacccgtgagtattccaaggtatcgattttccatagggaaacgtgtgtgttcaacttctcttcaagttcttccgaggacacaaggcaaaaatgtgcaaagggtagagaggatttcctagtgagaaacaatatctacagaaagcataatttaattctatcgctatacttcaggcgctggcttgctcgttgctaccagaacgcgctctaattcgtacctagacagggaggactacggtaatcttgagggctgtcactacctctacaccaacctctaactatttgtgggatatgcagcaatcactggaaattaatgacctagataccgtgtctatgcagttaattactactttagtgtttataactctccaaagtaaacactatctataattcaaatgaataatagtccttgtcgttgcttcatgcccctatcttcccctcacagatctagcaagcatgaggccggatccggtgagctcaaagtccacaagctcagcaacggttagggagggagccttgatccgcaccgacaacgtcaaccgggagggaggagtgggagctctagatggcggctggggagggaatctcatcgctggacagcaagggatgaaaatggattggaagctagctctatcttattcgtttcattttttttccggaataggaatcggaaatccggatacagaaatagaattgaatagaaatacggagtgaatacgaaacggaacaaatagggtttaaccaatatttgctggaatataaatgcccctcctattgatcttgtaatgtttgttttacacttgaaatatttacaaatacaaatatcataaactacaaagtggtagatccattaaattctacaattttgatatcgagcacgtctacatcggatggtgtttaagttgttgatttaatattttgtaaaaacaaatatggtattttgtaatgaatatttagacacctaaacgatctcaaataataaagttgtcaacaacaaagttgtagatctcattgagctctacaattttggtataaatattgtcttcatcagtgataacgacgtcacttcatcggattcgtgcatatctccacaagttatagtgacaactcgaagtccagttcggcctctagagacaatactgacttcaaacggacttagcgtcgtcttcatgtcaactccgatttggatgatcttggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34109 - DNA, 1483 bp, Oryza sativa
aaaaatgattcagcaagcattcagcacaggaatcctaaagcacccacttgacattgaaggagcaccgcccaatttgcaaatacgcagatgataccctgatcctactaaaaggagaagctgaccaagcaacagcaattaaagaaattttggattcctttgcaaatttctcaggtctgcaaataaattaccataagagcactctagtacccatacacctgaatgaggcaacaaaaactatggtgacgcaaattctacattgccctgctagttcactcccttgcagctaccttgggttacctctttcaaccacaaaaatctcgcataacatgctgctgccagtcatctcaaaagttgacagatatctagccggatggttgcctctatcaaagggaggaaggctaactatgatcaacgcagtcatgtcagctatcccgacatactacatgtcatgttgtatctggccggaaaaatctatcgaagcaccggacaagataaggcgtgctttcttttggaaaggggaaaaatccataaaaggaggtcactgcttggtggcatggcaaacagttctactacaaaaacagcaaggtggtcaaagatctcagggcacataacacagctttaattttaaagctaggacataaggtactcttttgcccaaacaatccaatgactaacttggtttagaaggcgatatctgaagcatactgtacagttactccccagatccagtgatacccccacttggaagctcattatatctcagtttaacaccttaagtgctgcaactcaggtaacccttggtaacggcaaaactactctgttttggaaggataattggctgcaccaacggttacaattcacacacccaattctattctcctttgctctggatcaggactgcacggtagattcacagtttacacaaaactcctggcatgtcaaattgcatcctaacctctcctaccaagcagaattagagctgcactcgcttatgcaaattctgcacaggcttagccccatccctgagattcctgacacaagagttcttttgcattctgtacccaagttctcaacctcaatgcctaccaacttctgacttaccatggagccctttggaaaccggcagaatatgtctggatacacaccatcccacaaaactgtaagatcttcctttggttggctttcaaagacaggcttaacaccaaggcgaatatggtcagcaaatgctggagcgaagatccgcactgcccgctttgcccggcattagaatcagctgaccacatcatcctgagatgcaagaatgctaatagcctatgggaaaaaatgaacctactgcacctggcaaaccattctgaatcatcctcagctttccttcaagcagtcgttgacagaaatcattcaaatagaggaattgaacctatctggtttgcagcttgcgcctaccaccctgtggaaagcacgcaacaacatgatttttgagaga

SEQ ID NO: 34110 - DNA, 9366 bp, Oryza sativa
  unsure (1)..(9366): unsure at all n locations
tccggagcatgagagccaatgaagcaaccaaagaacgaattctctcctggtgtgcagggctgtagttgtgacattactttgtatatacccttgtaattccagccccctgttttgtttcttttcttttcttttcttttgtctattttatttttcccgtttcccctttcttaataccccctctgctataacctgtaacttgtaaacctcatttctcttaatgaaatgactataaggtagagcacgctctaccttcttgcttcaaaaaaaaaaacatcgcttattttccatttagattgaacatggaaatgcacatatgtgaaggactagatcattggcatttgaactgtgaaacacggtgtatagccataaaatttaaatggtgctaaacaattaaaactgtccaatgaattgtacatcatcgctcaatcagtatatcagaaaggagatattgacttattgcaataccattgacaagaacatactgtattcatgtttgtgtcttggaagtaccataaacctaactcactcttctagcttgagattttctaacatggaaatgattaaccattacagctgtatcttgatgaaggagagctaagctatcccataagtaatagaaaacacctctaaaaaagacgaaaataggtatggcactgtcatgaagagaacaagtcatcctataaaaaccacatgagtaacttagagaacaacagggcacatgaacacatctaagattctaagtaaaagtgtaactgtaatgtgagtgcaggtaccatgctacaataacaatactacctcttcaatttcctgtgggatatgattatgaaaatcttgaagcatccgatgcctatccaaacaaaagaacaaaactggatttatgatggaaagattgtagttcagacttcagacagtagagtccttaggagaagaaaccaagcttttgcttctcctcatctaactcagctgtatcattatcagcattcccttgcttagctacagcctcacgcggcagtggagaattccattttgttgtaactgattgctgatagagtaccccgccagccagagtgaagagcaagcaaaccaaaccaattgaactcgcatgtttatcccagatcataacattgattgcaaccgtgagaaacttgttgacaacacgcctgttactgtgaaagccgtggcagagattgttttccttgctgcgaaaccaaagaagctaatgagcagcccaaacacaggacaaggaaactgtcacaaaggcatcaagttcaaaccaactctggccccttgattcaatggctgatctgaagactgataagtgctctccagtcaaaaaccaaaatacaggagcgattaccagctagagaagattgttgtagagtacgaagccccatgtgttcagcccagtttatgagaacttaagattctgagaagtagctggtgagaagctagctggtaagaatctgtagaagctgagaaacccagcttctagcttctaatttatttttggatttcataactatagattcttataatctgagtgaaaatctggactatttggtggagcttctagcagtaatagcttctaaaaaaatcttcagctcctagaagctcctccaagcaggcccatagttactagataagcaactgcccatgggtaggctgtgaggctgaaccccgaatatgtcatcacgtaaccaacagcacctcctaaaatagtcacaaaggacaaaattgtaagcttggaaggacatggctgcttcctgaatcctgaaggcagtatcatcagcgatggcaaccaaaagcggggtcaacgatctgaacactataaaggtatccacattagcacgcttcaggagatgtgtaggtgttggtgaagatggcaaggtagaacacaagcgccgccggcgcaaacttctttgcggtctggaagttgaagggatcatggtagagtagtccaagctttgcgagggtccagacaccagccactgatgtcaagtactgaagtgcagtcaggaggccagggtagctgaacttggtcatggcatacttgttgatgatcgccagcaagctcgagcacagagaggcagccgaaccacggagccctagcagctacaaacgcctctcaccaatcggccgagatgcagatcccgcaggtgagattcggattccgatcgcattcgtgaggaaaggggaaatgcagagcagtcaccgctccgacgaggggtcttaccaagaaagctcaagacagtatatatctcgggtggacggattcccgcgggagggggagggagagctccgccgctggcggccggccggcagctgccgcgacccgcgcgtgggcgaggttgagcggatcgggagaagagggaggggcatgtttgtggtgtaatttggcttctattatttaatcttggtaggccaaattatttagtttagctttcattatttattgaatgtttggagacgtatacgcgtcggacgtacggcgcgagccgaaaaatcggacgcctcgcacgaccgtccgatgcagcacgcgcgcgccagccgtccgattggagaaacaactgtcacccgacgcccgcgccgttgcaacacccaaacacattaatctgtttcattcaatgtgtcccgccgttgaccactagcacgaggggagatcttcgcggagcgactggcgctgcgctgccaccggcgattctctccagcgccggcgaccctatccctcgcgcccctatcctcctcgcgccggcgaagcctgcaacaacgccgacgtgccgccacaccacacgcagtcaccgccctgcaacttcgccaccgacgccatggctcatctgatacaccaagttgagagggatttttcgccgagctcatctagtgcaaacagaggaacaaccccaatgcataatgcaacgaatttggtgagtaaaaaatttctagggttttacttgtttcactttttttttgaaaaagtttcaataaaaaattgaagtatagatctatgaaacaatgtcttccctcatgcaacatttatattcatgtcttatttttaattgtaacttctgtataaatttggactggaatttgacttgaacaataatccttaacttgctaaaacataattgtacaagttaatgaaacaagataaaatgttacagattgatgtccaagcaccaagctcatctggtggcttccttgatgtgctattatccaaatcctctgggcatgaaactgacttggtgagttgtccttggatttgaaatatcacaaatgtaggggggatattttgctttgaaaacacagtatgtaacttagtgaaacttttttgtgtactaggttgtggatgtggaaagtgttgacaacacagatgtggctgctgtgactgttgaaattgatgaacaattggatgaagatgcatctgaaaatgatgaaaaagaaaaggatgttgtttgttccccaccaattgttccatacattggaatggagttcgatatagtggaagaggcaagaaatgtttacaacgcttatgcttataagctaggatttggaacaagaattgcatcatctagaaacagccaggcatcatcaggggaaaaaaagcatcgaagaaatgtaaagtatctgaaaatggagacaatcatgatgatgaaccgaagttgataaggagagaatttgagtgtgttcatgcacgtaagccagaaaataccacaaaagatagtgctggtggcagtagcttcatttctgaagagaacaaggaaaatccgcccctgcttgaaggtaacaaaaagaaggctcccttgctggtggaagggaagaggaaacgaccaaaggttgcaaagtatgattgcaaagctcatatggctgtagggcttagggacaacaagtggagagtcattgctttccaaccaaaacacacgcatccgatggtgaagcgccttggaagaaggagatattacagatctcataggcacatctcaaatgaagactatgaatttctaaagactttgcattatcgaaacattgcaacatcgcagattttggcgttgttaggagatttgcacggtggtgtaaggaatctaactttcattgctaaagatgtctcaaatttgaggacaaaactgagacaacaagtttcactcaaagatgttgcaatgactattgattatttccagtaaactcaagcagatagcccctccttcttctatgctgcaagatatgatgaagacaacgtgttgaaggcgttgttttgggtggatggcagaacacggaaactgtatcaaagctataaagactgtgtcttctttgacacaacctttatgactaaccgttacaacatgccatttgcacctattgttggaattaataaccacctgcaaacaatattgcttggatgtgctttgatttgtgatgaaacaactgaaacattcatatgggtctttgaaacatggatgcaagcaatgaatggacagaaggtaggttcagtgatgacagtccgagataaagcaatgagagcagcgattaaaaaggtgttccccggtacaattcatagatgttgcttatggcacgtgacaacaaaagcagatcagcaactcctgcccgtgtatacttcaaagaaaggcttccgtgaagctctgtatagatgcatatatgactctgaaacaatagatcagtttctatcagattggcaaaaaatggtagatgaatatgacctccatggaaaccaaactttgaataacttgtgggaaacaaaagaaatgtgggctccggtatactttaacacaagttttttcccttttactgggacgacagggagatcagaaggtctaaatggactattcaaattatttgtacacccacaagattcagtgtggatctttgtcaaacaatatgagcatataattgagacaaggcttgacagagaggacagggagggctacagagtagagacaacagaacctagaatgtattcaaggtaatgtgatatgcctgtcttgaaacaatttgaaaaagatgtgctttctgtttttaattagaaaaattgatgaaacaaataatatctgtactgtgtaacataaactgtgcaagtgtggaacaattgacattaatgggttgaaacattgaattatgcaggtcactgattgagaaacaagcatcgcagttttacactacaagtgtgtttgcagacaaattctagtatgaaatatatgaagcaacagggctggatgcagaaaaaacacaagaagtccccgacataatatataatgttatgccaagtgacatagaaagaacaggtaaaaaatatagggtcacagttgatgcagcacactcaacctactcctgctcgtgccacaaatttgaaagagatggacttctttgctcacacatcttgagggtgatggctgtccttaacatccatgagattccaagtaagtacttgctgaaatggtggtcagagcaagcgacattgcaaatacgtgatgagtacaatggtccagcaccatcaattggagtcccggcaacaagcaagctgagattcaacgcattatgcagggcaatgacaagccttgcttcagatgcatgtgttaatgaggaaaagtacttgattgtttcagctgggattcagaacctacacgcaatggttgcaacaccacacactgttgagacacaacatcagtaaggtatttttcctagtcaacaagacccatcaagttcagctaagaatccagcaaccaagaaaaggacagggaggctggtagaaaaaactcataggatgaagccaataggggaacaaataactgaaagcagcaagaagaggaggacaaaaaagaagagctcatgctcatattgcttcaacgagacacacaatgtttcaacatggccgtatctcaagatagcgaacatgcgagacgctctactaaaccaaaaatggtgcaagagacggagttgacactctgagaaaaaagagtttcaagagctataaatttagatgcgatgcactatactgttagaaaatatagtggtaattgccatattacaatataaaactatcttcttgtgttaggtgaaacaaattatgttgtgagatgcaacagacatattttttttaattcacatatgggcagaatgttggatgattatgtgaaatgagtctttcttatgatttatgtgaatgattgttaagtggaaagaagggaatgccaaaaaaaaaattacatctctgcactaatgattacagtggaaaaagaatatgtagagctggtgaaacattcattaagtgtagggtgagacaactgtataacagtaggtgaaacatttgcttcttatggaacagaacatgtggagctgtgaaacaatcattaagaacaggctgtaactattatgtaacagtaagtgaaacattgcttcttatggaacagatcatctggaactatggaacaatcattgataacaagctgaaacatataagtactagaaggtgaaacattgtttcactctaaaaagaacatcttgaactatgaaaacaatcattcatgactgccccctagtagatgcaacattatataaagagtagcagttcaacttgatagcacaacttcagtgcacaaacaaaaaacagaaaacacaacacacttcagtgcacaaattcagaccacacatagctacccagagcatccactttgcactattttttctaccatttttacaacttcagtgacacgactgccccctacactaatttgcttgaagttgatcatggttaacgaatttccggtagttaggcatgtccccttcattgaatgcttgcaggtttttcccatcccaattctcaatgtatctcaagctgaagaaactgcaatcaaacctaatgcatggaaaagcaagtgataagttaaaatgacacacttgtgcacaaaaaaaaaagaaaaatgaaacaacaatttggaaacaaaacatataaattgctttgtactggatactgtggaggagagcaagtctgaaactttgatatatctttgattggaattttagcatccactgcaaccttggtgaaatttgtgacctgaacggcacatcggcattgggacaaaaaaaagaacttaaaactcaatgaaacaattaaaaaattataatggaacacatggtgttccagtgaacatcttaccaggttttgagagagtatgaaccactgagaaatatcatccctcttgattgaatcaaagtaatttatttgttcccgcaaatggttgatgcaagtcagcacccaatgcttgtcacgtacaattgggaagaacaacttgatggggtgggaggcaaaaaaagtagcatatattaaatgataactggaacaaggaacagctatgaatgaaacaatatgttagcatatggtgaaactaacaattgaaacaaataaatgatcattgaaacatagtgttaaaaatagctgaaacattgtattagtatgttgtgaaacatatcagcagactaactgaaacatgaaaaaaaatcagagggatgggaaactggtaccagatctagtttaggaagtttatgctccttgttgattgatttcagccattttacacagctttcagacacaaacttctcaggattgcaaatcaatttatcctaaggaaaaaaagggaacaattgaattaaaagcaaaaaaacaaaaacaaaaatagatgtaataaaaagggggtggttaaaacatgttaccgtcaagccaggggaaaaacaaatttttttatgcttgatttcatcttagaatcttccctacagtttgcattgaacatctcaatccaacatgacataacttcattgttcaactctcctctaggtttcattgcttcacggaaatactcaagtgagacatggaattctccaatccttaagaatggagttgtcctgtttttcccaaaaaaaaagttgggaaaaaattcagataaagctgttctgaaacaaatgttttgcatttattgagacatgtcatagtgactgatgaaacaataggggaacctacactgaaacatattaataataaaaaggttgaaacatattttgcgcaaaaaaaagtgtgaaaacacttacaactctttggcatctgccttccttgacctatttggcaaagaatcaacaacagatcttctgtacacatcatctatttcagaagcggtcttcaacttcttcgcctctacatcactatcacctttctgtgcccttttcttcctatttttcttctcatgggtgcttggaccactactaccagcacctactatagaggaaaaaacattagagaggggtaggggtgttgttcatagttactttacccacaccgaaaagagagagagagagagatagagaaagagaaggaacaaaaaagtggtgattttacctagaggtagcgagcttgtagcacgtggcggtgaagatgtagctggggatgttgcccttactgctgctagagagagaactactgaagttgatgtttttgttgcaatgggtgaagggggggctggagaaggtgtccttgcagtgggtgaaggagttgcagaagatgtccttgcagaaacaggtgactgaggtgatggagaaggtatccttccatccattgccgattgaggaacatttgaaacatccaaggagagcatctcaacagccaagtcctgagtactaatgaaatcaggatcagattcattgaagagtctgaatgacggtgcatcacatgcatcatctagatttgagatatcagagtgggaagcaaaaatataatcatcaatagctgggctgcttggcacagaaccgccagaagcttcctggcttggtccatcaaaatctgtagcctcagctgccccctcaatgcttgatggttttgaaacggcctcagctaccccctcagtgcttggtgtgtttgaaacaacctcagctgccaacccagtgcttggtgggtttgaaacagcctcggaaatgcccactgcagtgttgctgtcagctagcaccttgcttatgtcagaaatcatatcacatgttctttttgcacgcaaatcaatcatgtccctcttgaagttgtcaagtgctgaaacaaactcatcctgccacatggcactgtgcttctcaatactagattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34111 - DNA, 1017 bp, Oryza sativa
tgagcttcaagtttggcgttggcttgcgagatggtgattgttgtcgaagttgtagcttgttgcgaagaggcggcagcttgagacgcccccaatatttgagacgaaaggattacgtccctgatctggagcgtttccaccgcggccgctgccttcgccccctcttggtctgtcgaagtagtcggtgccgaaggtgggagagatggcgccgccgtcggaggtggcgcggctcctgctgctgcagaaaggcttgaaactgggctttcaaggcctaagctgcctccatcattgcttgtggcgtgcgagtgggcttcggatactgtacttgaggtgtaaccgggcgaaccggcaccgaagtcatgtgacgggtcgggtgcggggccgcagctggagcaagcttcgcgaagtagttttaattggttaaaattatttccaaggctctgaaaaattcactaaaattcatgttaatgtattagaacatggggaactcaagaaaaattccaccacgccatttttgattattatttacgtttattaattaggattcaactctaggttaatttaaacaatttcttcgggcgatttacttaatgaatttttaaagcaagaaaggggaaacttcagggcgtgacatctacgtaatatgacatcaagcagacaaaagaaaaggattatactggttcaggtcccttatcaggtaatagccctatccagtttatatgagattgatgacggagaaccacagattacaatgaaagtaagcgaatcagacgataacgacaagatcgtaatcgatgtactcaacgagatcttctggcgacttggctccgcgtactccggcttcgtaaactatggtgggtgtgttggcgatgagattcgatgccctgcacccctccctggaggtccctctttataccgtggatcatcttgacccccaagtcaacggaatctctatcccttcgagtaggattcaggaaatcgcttatctcgtagagatatttccgtaatttgcaacagatt

SEQ ID NO: 34112 - DNA, 6340 bp, Oryza sativa
ctgtgtgtataccactatacttctctcactaacatgaacttgttcagcctcagcctctgcattgtcaccttccatgcctacttgctgcacttctgcattatcaccttccatgccaacttgctccatttctgcattatcactttccatgtcaacttgttctaccccattcccatctgattcatctcccatgtcctcttccatctccaactcatagtcacttccttcatcctcatatgatagatcaactaggattggtgcatctgcatacacctcagccacccctccatccacaatacaatcattcatgtattggcacatactgtcgtcatccaatagtgcccttaactcagaattaagatctttccctgggaacaacaaatgtagcattgttccttcaccaactttgtagtggtcatgcaaatggcctactattttaggcagagataccttatcttgatctaggtaagacattgcctcacttccaccaacatagtgcttctccctaccagacaccacaaaatctctattgaagtgaaacgtaacttgaagggtgtttaagacgtccatggaacctacatgcaagttggaaaaaaatcacttccccatcgttttaaaatacctaggttttagatcccaaataaaaagagaggcaatggatgatatagtatgaccaaatcgaggttaccaactgttgttctacataaacaatgctgactacaccaaatccgagggcacagtgcgcatctaccacaacatataatttggtggagaaccctaaatcaaaatggggagaccacgataaagaaagggtggactcaccagctcgtgctgctccagttgcggtcgccccaaaccaccaccgcgctgcattccaccgctgtcgacgcgccccctagcgccacccgagccgtcgccctcttcgtcgccaagctcacagtaaacatgtctagggtttcggtcaatgaaaaaatgagcgggatggctacacgcgtgggcatttaccagtccggatctcactcagctaacgataacctagtgtcagctacctatttcccaccatcctcagctaagtcagcaatgttgaccacagtcaagttgccatgtcatcaaatactgcccataatactgccataggagtcggtctgtaccggttttaatattgagggttagggtcgttctatccgggttttcttaacattacgaattagatttttttaccattaaggaagtcaaggacttcttagccgatcgagacaaaggttatggaaagcccaaatcgacaacgacatcccagcgtaataatgggcctccggcccggtccccctccccttctctctctcaaacaaaaacaaaaggggagaaaccctcaacacccgtccgtcccgtctcgttctgcgccgtctcgccggtctccatctccatcaccggagaacagcgatgtcggcgacctactgcttccgccgcatacttttgcctttcactcctcgcgcccagtcaatctccccatctcctcggcctcggcaatagtatcctcgcgagttcgcccgccggcgccaatctccatcccgcgagcagccgtgccggcgtcctgctgcttccgcccccggtgagcacccgtgccctacactcatcgtctttattccccatcttctgttgtagatctgggatattttttcgctttgtctcaatcctagtactaataacaggtttcccccaaaaagaaatatatttggtgcccctggcatccggtagatcggcatgccagcggccttggtggcgtgcagcggcaagcgccggcggcggacggccaccactcatgctgctcgggactcatcgtcgtgggcttctctggcggaggatctggtgagcctgataggctggcgggtgctggctggagatgtgcgagactacatctgcttccgcgccgcgtgccaccactggcgctcctgcaccgccagcccgtgcggccgcggcgttgtggacccacgcttccacccgcggcggtggatgatgctccctgaggggaacggtctctacccgggccacggcatgctgcgtggcttcgttcgcttcttcaacctctccaccggcgctttcgtccgtctcaagctgcccatcgtccgcgaccaccgcatccttgactccgtcgacggaatcctcctcctgcagcggaaccgtgacaccgcggtccgtcttctccaccccttcaccggcgacatcgtcgacttcccgccgctggacaccttgctgccgtacatgggccgccggtcggaggaatatctcagagatgtcgctgctgcctccataacatcatcagctgatgatcaagccgtcttgcttatgatatggttattccgcacggtgcgcgtagccttcgccgcctctggggataagcagtggagggtgtcgagctggtccatgtaccaagcctatactccattgccattccaaggcaagctatacatattggatcaagccacggcttatggtggacctgaggtcttgcagatagacccacccctgcaactgcaactggaagggacgacggagctctcgctaccaccaccaaaatcaattgctaaatgtccagcaaggacacctgactcattctttctctaccatttggtagaatgtgactctgacattctgttggtcacctttggtgttagtgtgtatgcacaaatttcagtttacagactagctgatcttatttcgggaacaactgtcccggtgacttgcatcggcagcaattcccttttccttggtaataggaatctctgtgtcagctccaaggcgtttcctaccattgtgggtgatgccattgtgttttaccatcagaaggagaattatcttgcacaataccacctcagaagcggcacattgtcacccacatcagatggatgtatctttgcgactaatatgccaagtcctagtagcatcattcaccatatctacacctgttgctttcgtacacaatggttagtgacatgttttttatttttttcccgtcattgttctctttaataatagttattcctttcaatggagcattttgtgctctgcttggtaattaagctcattgtttcccctctctacctgtaggaccaagggacatttattgtttcaaagggagaacagggcatggcagatgaaacggaagtagggatagacggggtaagtcttgcctccggtgcaatgattctgcttgaatgtatgcatttttggcttctactatgcacccaactctcaatacaactgattgatcaatttattaattattgagtctttttcctagtattaaagtgaaagcaagatggctgcagagctttgcattttaattagatattatgcaactatctgggcacacatttctcaattggggtttgcaaatcttcgtgagaccctacaagtgtatatatttattactaacattgattgcttatttttgttgagatacactgaaaaagtaattgtcttctgatgaattgtgtcgtgtaaacaacttgctttcttctaattgtatgacatgcaatcttttgcatgtttgcgagaaaaaatacgctgtgcattttagttacaattattattatgcataagatgaattagtaggttatgctatttagagtttttgttttttgaaaagaaacatattcggtgaggaaaataagatgtaggttaagatttgcatttgcactttacagcacaaatggacagttagctgcacccatctgcatacaggactgaaaatggtctcacagctgcttgtatggagctactaaaggagtttgaacaagtaatgctggccattgaggttatgcaacctacaaaacatatgaaagtagtagtaatgaccttgatgtaacacaatttgaactgtacaatgtgcctgtagagtgtccatgttctctcttgtcttcttaggtaactcgccaagcatcacaaccacaattagcacagttgaatttgattatggttgtcatttacaattgcaatgttatcactgttacaaatcatacttgactagtttatttcttctgttagcactgaacttaattagcagagagaaagcaaatgcatttctgtgaggatgtgcatatgtatttgcaagttattgcattgtttgggagttgaacacacattgctcacatgttgattttccagaagctttaaaaggatagtcttaatatgttcagtggagatgctagtttgccattttcatatttaggatctaagacattctctatctaaatgctttatcatgcatgtgtttcctactattttatttgattagattggttcagttagtatagtgatgactaacttgtcgcctgtttttctacttgggtcctgctaggcgtaaacaactcttgttttgtgttggtggtggtgcctgcctgcctggttttccttcagggatatatttgttgatctacaggggaagtagttcccgggggctgtgaaagttttgctttggtacttataatcatgttactatttatgtgacaaagatgcttccctctgttgttgaatcaggcaactgtttcatgttgaaacaactaaattaattattgtaattggcatggtattttccaatggagttatgtaaccctggcttgtaaagttcttgtgacaattgatcaaacttccatcatcatagtagaattctaatatatccttatgagctagtcaaacttagctatcatgagcataactaattagagttgtttgatgaaaatattgtaaaattctatctaattctgggggttcctttggatttttggcaagaggtattctagcctagcctagccatgctttgtgtttggaactggtgaaaaaaaaatcctagctttttggagcaagctatcctccacgggccagaaaaaccgggctcgtcgagaaattcgtgagaaatgacgagcattcgagcaaccgttcggcgtagctgaaacaagctagtttgctagctcgagctatagctcaacttggctatgctaccaaattaccaaaacgatcgtcatacactaagctaaaatcatgcgctttgcaagcaaaatgtacaatcaaaatattactccctctgtctctcgatatttgacgctgttgacttttttaaacacatttgaccgtttatcttattcaaaaatttttgtgaaatatataaaactatatgtatatgtatacctaagtatatttaacactgaatcaaataatatgaaaagaattaatacttacttaaattttttaataaaacgaacaatccaatatgttttgaaaagtcaacagcgtcaaatatttagagacggagcgaatactatctaaaataactttcccctcccgtctctctcggtgcctcctctgagaggtgactttcagtgcgacgtagagttttcccctccggattccctctccgtctccggtggtctttggccgccggcgaggggatgaggggtccgagggatagtcgggctcatcccgtagtcaggtaaattctgtagtaggtttttttttttccttttgctgtgcagttcgaagaggatggtggcatcttcctccttcgtcctggaggtgtctggccatggatggaattgctggagctcgctctggcatatatcgtccggttgaagacctctgggttaatcacctacgtcctactcctctgtgtgtgcaggtcggagttctccagatccccataggagaggatgcgccggctgttctagaattctccagctagaaaatacacaagaatgtgttcttctccttcggcatcgatgtcggatttacaaggggcggctgtgatttatttgtttggccaaggtagcttcaacctccatcacggaggtcccgactgggtttgctcctcggctcaatcatttgtagcttgccatgctatcatctccgtcgttgtgggcagtgggcacaagttggatcattgctcttgtgaaagaggcagatgaaggacccgattgccttttcttttcttttcaagtccttttctgcaatctgcatcttctaaagttaatttcctcatcttacagggtactttccgcaaactggatctactcccagttcctatgttccctcgtgtaccatgtacttaagctcactaaagagtataagtgcatgctgggacacgccgcgcacagaaattggctcgaacaaaattaccatgaagcacaagcacatgctaaatattgttgactgaatgtttctagtttcacttaaccatagccatgggacttgaaaattgcaattagaatcatctaagtcaatatacatggaaaaccatgatttcaaacatttataatactaaattatcatgtgttaacctttttagactcat

SEQ ID NO: 34113 - DNA, 14183 bp, Oryza sativa
caagggacgaaggccgaggagacaacatgggcgaaggccacatggcgaaagccgtggcatgaagtacacaagcttcgccggggatggacctcatcggagagccattcggccgaagactacgaggcgaaagccttgccacgaagggcatgggtttcgccaactaccaaacttcaccaagaaaaggcccagcgggccaacatgccttccggaggcttcgccaacaattgggccgagctacttggcccattaggagcccatgcaagcaaaagacactgtatgcccataataatgtccctatcataaaagcaaccatgtaaattcccctgtaaagcctaaaccctagaggaggaatctgtaatagggttataagtagcccatgtaacaggggatctgaaaaatttttactaagcaatacaattgtctctttttccaaccactgttgagagaaccacttgaagcagttgtcgaatcgaaaccactgagagtgaacgaaaccactgatgccattgaagaagatcgttaaggagagagttgccaagcgaaaggagggtagcagcgagggggagatggctggggaagaaggagcagagcctttggcttccaaggccgaagcaagagccacgccacctccggcggtgtcgccatctctcccaccttcggcaccgactacttcgacagaccaggaggcggcgaaggcagcggccgcggcgaaagcgctccagatcagggacgtaatcctttcgtctcaaataccgggggcgtctcaagctgccgcctcgtcgcaacaagctacaacttcgacaacactcaccaactcgcaagccaacgctagccttgaagctcaagccgaagctgacatgggcgctatgcgtcagaacatggccaagttgcaagatacgcttcgccagatgcaagagcagcagcaagcgtacgaagcggcaaggcaagccaaggcctacgcctagcagtttttgacagtcttaacccagccccaagcttttcctccgcatgctgcacaagtcgtacaagctcgctgccgccttcatcctccacacctgccgccgtgctcaccggtgaggatcccttcctctttttctcctctccctcctagcaccgagccgcgccgccgccttccgcaacgccgattgccgtcgccggtgaccgcgtgccgccgccgcactaccatagccgtccggccggcttgaagctgagccgagcccggcagccgccgcccgcgccgtccgatcggctcccggccaatctggaccatcggtctcgaggaccggctgtgggccacccgcacggtcccggtccacggtggatcggcccatttgagccgctgccaggtggggcccacttgccggcgccgcccccctgtgctgacatcatcacctgggtttattgcgcaataaaacctcttaaggcttttctttttatagtaaaaacacagataatcttctaaaaatcataactacttcatccgagctccgtttaagtccattcaagtctaagtaaattcataaaaatccctagaatccattaaaaatggttttgtttcctgtttcaatagacttatagcatgttttgcttgtgtgctttgtttgtcgcgtagttttcagccatttcgtcgctccgtggtgcgtcaaagtctttgcaaatgtctcatcagtgcgagagcaaggcaagtcatgcttgttaattgatcatattgctcccatattgtaaatgctctacttttccataaatactgcatggttttataatgtcatggtatgggctatttacctactgttctcagccttattatttgtatgtcctattcctttgctaacctgggatttaacatgattagatgttggattaggaatttcttagccatgtttagttcaactagtacacaaagggggattcacattaatacatagatattggcttttagcataaaccatggttgttcgactggctcaaactctgcgacggacgcgggtgtccattcggccacaaaatcagcgaggacttgggacttaattgcagtgcgagcgacaaagtgtaggtcgaaaggtgatagctcagcggcccatttgcttaggcgccccgtgatttcttttcctcgaagcacttcgcccaaagggtactgcgaaggtactacgattatgtggacttggaagtagtgtttaagcattcttgaagccatcactagggcgtaagcaagtttttccatttcaatgtatctaactttcgcccctggagcgcttcggagatgaaatatactggcttctggcctgcttcggtttcttgtaccaaagctgcgctgacagcgacaggcgaagctgctagatagagccacaactctctctctctggcactgggctgaccaaagctggagggctttggagatactgcttaagctcatcgaaggctgcttggcactcgagcgtccaactgaactttcctacccctcgaagggtcttgaagaatggcaagcccctttcggacgcctttgataggaatcaactaagtgccgcaatttgccccgcgagcttttgtacttgtcgtacgctcgatggtggcttcatttgctgaatggcatcgattttttcggggttcgcttcgatcccccgttcggacacaaggaatcccaataacttaccagcacgaacgccgaacacacacttctctggatttagcttcatgccggatgcacggagattgtcgaaagtctcttgcaagtctgacgcatggtcgaaggccttgcgactttttacgacaatgtcatcaacgtaggcttcgatatttcgccccaattgtgaccccaagactttgtacaccagcctggcaaacgtagcccccgcgtttctcaggccgaagggcattctgagatggcagaaggtgctgaagggcgtgataaaggctgtcttggggatatttgccgggttcatgtgaatttggtgatatccagagtatgcatccaagaagctcatgagctcacatccggcagtcgaatcaactagctgatcgatccgaggcaaggggaaatcatccttcgggcacatcttgttgaggtccatgaaatcaacacacattcgccacttgccgtttgacttttttaccaatactggatttgctaacgactctgggtggtcaatctcttgtattactcctgcttttagcagcttgttcacttccgctttcgctgcctcctggcaatctaccgatattttccttagcttctgctttttcggctttgcgttaggcttgactgcgagatggtgcatgatgagatctggcaaaacacctcccacctcgtctggaccccaggcgaagatatcaatgtttttcttgaggacaaccaggatgctattcacttgttgctcatccaggtctccgccgagcgatatgactttcgctggatcggattcatctatctgcaattggacaactttgctgtggggggcgggtttcggtgttggttttgcgttttcttgcccttcgacttctaaggtatgaacttccctgttgaaaggagccaccgtggcagccgaaggctgggactccttgacaactatcacaccagctgggccaggcatcttgagcttgaggtagttgtgatgagagactgcttcaaactttgtcaaagtgccccggccgaagatggcgttgtaattgtatgggatgtcaacaacgttgaagagtatctcttcttctcttctgttatctttcgtgccgaaggcgactttgatgagggcctgccccagtacttgcactgcttcacctccgaacccccggagcgaagttggtgcttgggataacgccaaagttggcaaacccatcttggtatatgtcccgacgaatatgacatcagtcgaacttcccccatcgatcaagatgtgccggacttcaaaaccagccatctctgccgaaactaccaacgggtcttggtgtgggaaaagaaccccatcggcatcctttagcccgaaggatattggctgcgacaagtatcttgggaccccatcaccttctgagacaatgttgtgcactactcgaagttgcatcttcttctgtcgttttgacacttgtgaggggggatcggatcttgtgatgacctgaatcactcttcgctgcgcgtcttggtgttattctgcttgaggtgcttggttgaggaccgcttcacgcggtgcctcttcggcccttgcttgctgctgcctcggcgcttgagcgttcccttgctgccgaatatttcgacattgctcggtcgtgtgtgaagagcgtccatgaaaagcgcagtacaggtccttgattttcttgcgaaaaggttgttgttgtccgcccgcttgttgggcgtcgaactccttgcggagggcctgcacttcttcaaccgccatcactgccttgctagttcgctcagtcctgaatttcttccatgtcattggggcttggttcggccttggatgctgtccttggttcgccggagcggtagggtgaaccaagacgggcgctgaacttacaacttgggcttggacctgagcttgggcgttggcctgtgcagtggccgctgcggctgaagctgccttgtcatattcggcttgtatctcttgtcttcgcttggtgtcctcttcacctcgagcatatcaatcaattatgcgaaagaggtgttcgatcgtcctcagctccttgcgttcaagctttcttgtgagttcgccctcgagtaagctggctgaagcagcattgatgacggaagcttcggttatgtcttgcacttggcaccgtgcttgcaagaagcgacgtatgttttcccttgttgattatcctggcctttggcaaatgccgagaaggtcatgctgaattttcggctcctcataggtgcctcgaaagttaaggacaaagacatcgcgcaattgctcccatgagtaaatgctgctagtaggcaaattaaagtaccaagacctggcaatgccatcgagcgcgaggtgaattaccttcgccttcgtattttcgtcaccatgggtagcttcgattgcggatttgtagatggaaaggaactccttcgagtccgtttctcccgaataccttaataggaggaacttgagctggggggatggggtgattcttgatccccgaactgagggtcaaacccttttcgccacccgtcttgaccatggtcccttgctgagagggccaattcaactgtgggtatcagggcgcgaacggcaaagccacagcttgtacatgaggttggactgcgggtgtcgattgatgccccgtgccgaacatcattgcctggttttgctggtctgacgaagtagcttgcattgccactgcagggtcgaacatggcttgattccaggcttgatttggtggtggggctgctccgtacccagggggtacggcttgtgcgaaagtcatgggtgcttgggccgctgtgcttgggtcaaactatggcggttggcctttaggcgaagccccttgagcttgacttggtatggcgaactagcccaacagctgtcccaccggtgcaccctgatttgggcttccctcggcctaggccggaggcgaagttcttggtaaattgttgtggggttgattgagttgttgcaagaaggcttgaaactgtgcttgtaaggtcgaagttgcttccatcattgcttgtggcgtgtgaacaggcttcgcgtactaggcttgaggtgccgtcaggcgaacaggtgccgaggccacttgcggtgtcggacgcgcggcaacggctggggcgggcttggcgaagtacaccggtgcttgcacagcgtgtggaagaagaacttggggctgagcgtagaagtgcagggtgtgggccttggcttgtcttgctgcttcgtacgcttgttgctgctcttgcatctggcgaagcgtgtcttgaagtttagccatattctgacgcatggcccccatgtcagcttcggcttgtgctttgaggttggcgttgccttgtgaggtggtgattgctgtcgatgtcgtggccggttgggcgaaggcggcggtcgaaggcgcccccggtgcttgggatgacaagatcgcgtcgggcgccgaaggcgggagagcagacggcaacaccagtggcagtgccgctctagcttcgccctcaagaagccgaaggctccgctccctcttcggctaccatctcgccttcgctgccaccttcctttcgcttagcaactctctccttggcgatcttcttcggtggcatcagtggtttcgctcggagctccccacggtcggcgccagctgttgtcgaatggacaactgcgtcacgtcgaaaggcgtggatttctcaacaatagttggaagttaaaacaattgtattgcttagtaaaaatttttggatccccctattacatggccttagggagctatttatagccctattacaggttcccctttagggtttaggttttacagaggaatttacatggctacccttatgatagggatattattgggggcacacggtgtccttgtatgggccactattgggctaaatggctcggcctatttatttggcgaagtcctccgaaagcacaacggcccgctaggcctccttacggtggggttcggtacttggcgaagcccgtgccttcgtgccaaggctttcgcctcaccgtcttcgcccgtgcggccttctgacgaggcctttgcctggcgaagtccgcgtattccgagccacggctttcgccatgtggctttcgcccatatggttcttttctcgacctttgccgcttgcctccggtctgagcctttcacctatgttcttggtttcggtaggtccggccgaaggcccttcgtggtgtacctccaacaccatgcatcatgtccacggtaacaggtaatccctgggtcaaaagagatggtcattttcgggatcaatgtggtacagcctttcctaacagttggcataatctcaggtcatctactttcataatttcattgtcttctgctacatctcctgaataaaaatggggtcatatgcttaactccataaacatcacagaggatagagaaaaacttaaacaaaaggttggtctcaagctagacagatgcacatattgtcatgaaattggggtcacggggacgtaagtttcttgcctacagctagctatatttgtttttatggctgctcttctgatttcattagatatttagatgcatgtaaaattttgctcttatttcaaatagtatatttatttaatttcaagaaatggaatatactaaacagcaccatttcccatagactgatgcacaagaaaacaatcaatcctggtcgcttcttgaggattcttaatttttatttgtttccaacagggaattgttaagtaaaaaatagcaattttattgtgaagaacagaagaatggtgtcttatgaactagattagagccaactggaagttagtagaaaaccatcatattcgttctttttcatgatatgaagtacactaattttgtctggtttactgtcatttacaaatttcttaaacattacacagaaataaaacaacaatgtcttaactcacatgggatggacatggactccataaaatttattagaatttgaaatacaaagcattattaatccctaaatgatatatatatggaataacaaaatccatggatcccagtaatggtagcaaccagctgagttgctctgctactaactgtaggattgagaactcacattctaactgtgcctaattcaatgcttgcaattagtcatcagctcggttaatatttgtctagcagttgttctattgaactgtacagaataaccaaaaaattaatatattcatttcttactatgccacataaaataagctataacttcattaaagtcaaaacagttctattaaagtcaagttctcttgaagctccacttttcttatataaaagtaaagtggacctaaaaactttcaaatatgcatgaacacaatagcgttaatagggtgtaatgaattttctagaaatagcaacaccaattagacaaattagtgaaatctaatatcctcaatgattgcaggtacaacatcatcatagattcaccacttaccgtcaacccaactaggatgctaagaggggctccgtaagtacttggtatagttaataccaaaaatctaaaaatattctcataaatcgaatttatcctttttcatccctcatatagagtgcttgagtttaaagaggaaagctattcaacaattggggttatgcccccgttatggtggtgcagactcagtaatatggggccagtttggtttgagatctaaattaggcttgccaattttttggcaatctcaacaataattgtgtatgtttggattgaagccaaattttggcatgcctatataacataggccatttcaatagccaaattagtttaatttggcttcaatccaaacacatgttggccttcccaaaaattagcatgccaaaacttgccaaaatttggcatggtaaggccaacattggtcacaaaccaaactggcccatggttttatgtagaaccattctgcacattccatcttgtcaattgcttcgaggaaggtgatctcggttagacacaggtccactgcaattttgaactacagtaaatatgtgttcaaaggaaggagcatctatctaccataccctatagttcaacaaataattaccctcattctttcattcatcactcaagggttcagatcatccgtgtaaaatccaacgcatcagatcatctccacctccccacctctgcattccccagccccacgcacatcgatctccccctcatcccgcaatccgcacgccctctcaccttcctccctccctcccctaaccgcgtcgccgccctgatcgccgcacccgcgatctccgcacaaatcccgcaaggccgccaccccttccaggccgctctagaccggcgtcgtcgcccgcatcgccccctccgctccgatccccatatcgcgagttgcaagcagagcatgggaggggaggggaggggcgccgtcgtcccactgcagaccggcccgttcctcgcgctctcctctcttggccccctccgcggccaggaagacgtcgccaccaccccctctatccgcgacgacgccacaacctccgtccgcgccgaccccacgctgcccatgccgccggtccttcgtccacgcaccgccgccgccgatcctcctttcgcgcgccgctatcgctgcctccaccgccgtccgcgtcgaccccacgctacccatgccggcggcctgctgccccacatcgtgttaacaccgggatcaggattctggccatcgtctccacgcagatataggagttgtgaatttcccccttttatctttcttggtttttctgctctcagttctaataggcctacagattgtctgaatccatttgaacaaggttctgcacaaatcttctgatagaattctgattttcacaaaattaaccgtggtggtattttacgcatgtggcaatttaattaccaaaataataactatttctatcactcttaatgtttaggtaacctgcccaagtgaattgtattaactaattgatgtttttttggggggtctctgttgctgttcctggatgattctcttctgtttcatggtctgcagtgcatggacagtgtttacaaggtagccctatactcctatattcatcacaacatagtaggtaggtgcgtatccatttgctttaattcacatagaaaactccctacaattgaaattcacgaataaggtgcatattttgttctcagccgcatcaccgtctgtttccgccatggcagcgtgactccgcgcgacggctggaggaggcgaggtcgggcctgccctccatagacggcagactccgcgtgacggctggaggaggcgaggtcgggcctgccctccatcgacactccacgccgccgcagcccgcagccccatcagcgccgtcgctccatcgccgtcccgacctcgaaggcgaaccggtttcgagtccctcgcgctgccactgatcccagggctcctcaaccctgcaagccgtcgatcctgcctgcgaacaaggtaagagtgcttctcgatcccgttcctgtacaataggaggcatacgtggcatgttatggttcattcatagagatgcataatggctttatcccctttgttgaccaaatccccattgttcattattaaacattgttcactgtgcatggatatctgtgatgcaaaactctaatccaaaatctgaagtccttagtggtttactgtacctgacaagcaaacatctcaaacatgtttgtaaaaacctctcgaaagtagagtagcacgttcctcgaccctgttcattgaggtaagtattgtttaatgatgctaatgtatggtactgttaagctgatatttgatgctactgaaatatgtaacatatggacatgaatgttcacttcttttttatgtaaaatgtatattacctcattaatatgagtgctttcaaacctgacaccatcataattggaatatttgattatgagaaaacccttataatttatctctactgttcttgagagttagaaaaatctttcaatacattttagtagttttagatgctaaaattccagaagttgaaggcttatccatgcagttttagatttttggttggatggaatttggattcattgaacattcttaaactatggctcttttaccatcaaaactttacattttccatatcatcttcgactgcttgtagacaaacaactacagaagaatatctcatgctttttatgaaaccggctaatgtgacagtatcgaggggggtcttggccggatcagttgctcatggccggtaggagtgaggagtacacaggcttccacactacgaggtaatctgcgtgcatgattcatgtgcctgttggtttctctatctaaatgatagttcattttggtatacctccatcattccaggaaacttcaatgctcgagttgtcgagctaggttggggatatttgattctttaatctatatagggtttggtagcgtgcactcagcccttaggacttaacatgacagtaagtgagaaaaagggaaaacagtgagtttttgcatcaggctggctcaactaaatgatttttatgtccctttggtaatgaaaagagatttttctgttgtataccatctcatatgctcttaagatacattttgatttacataacaattatgtttctatgtgaaagaaactaaatatatatttggtcattttggtaactgttcgtttaacttgcatggcatgttgactaaacgagaattggcaactggaggggacagttgcagttcagtgcctgacttggctggctgtaggtacaagtattcatagtcaactaataaacggaatacatctcctcgtgctaattgcaggtccttttcatgacagaacttactcaagaacgaaatgaaatctgcatatagtcagtagcaactaaatttacattttctgtatgtaaatttacatttagtgtaggatttatgggcaatggctgagttcgacaatacgagggacttataataggtgtctccccaagctgaaaactgagcagatttttgtagtgcttctgtaattaaaaatgccaactgacctattgattttttttaaaaaaaaaaactttcctattgattaattagtggagatattaccttactaacattctctttacctttattatttttgacataatcaatgagaagatatgtcttgacataatcaaaaggggttgagatttcatgagcaaacaattagataatattttctcagcccaggtttagtcctattcccatgcttcactgcttgctccactcctttttgtgacttggcaggtaccatctcatgaggttcgtggtggttttcgattctatttatgtacaggtgatcactttatgaacaataatcatcttgattttcctccatcaatgttcatgttacttgctgttggtattgctaactagacttcgtttaagagaaatttcttctgttgtttagctacctttggtagggttatttcacttctgaaatttattcatttatttaccccatatttgctatttagacaaaatagcatgatctctcttttgtgtcacaaggtaatatcccagccatcaaggggtctttgatctgttagtaatccaggtcatggcctatattacatggccacagatcctatgaggtgggctgtattacattgccagacatcctatattacattgccactggtaggggtgaaaacggtacggaaacggacggaaacaacctttatcgttttcgtttccatatttttttcggaatcggaatcggaatcggaaaccccggaaacgaaaacggaaacgaatattatcgaaatcgaaaacagagcgaaaacgaaccggtgcggatacggtaacgaaaatttatcggaatacagaaacccctcaaactgagcttcaaacttttgtgaagttcaattctcaagttttaacagtcaacaattcattataaaacacaattatatgaagtctaattggtaagtctcaacagcaaaatatattcttctataacttcatataatttgtataacaaatattctaaaaaaattacagcaaaataccatggtataaggtataaagtatacactattagcccgcagcccgcagcctctctctccctccacgggccggcttccccttcccctcctccctcttcgggccgccggcccagcccttttgctcctccctcgccgagaagtctataatgcctccttcctctcaattcaaatattttttagggtagtaaatgatttcaaatgaaaaaaaagtcaataacaaagttgtataacttatcaagatcaacaacttttgttttggtcattttgctatatgactttgtttcaataatttgaatttgaatttcaaattatgacaacttcaaacaacatttttaaatactaaatgatttcaaatgaaaaagtcatcaacaacaaagttgtataactcatcaatatctacaacttttgttttgatcattttgctatatgactttgtttctataatttgaatttgaatttcaaattataacaacttcagacaatattttcaagtactaaatgatttcaactgaaaaagtcatcaacaataaagttgtataactcatcaatatctataacttttattttggtcatttcttcatccgataaagtgatagtaatatcattcacaaaatttacatatatctccaatagtctataaactatataagagatatgtatattttgtgaacgatcttataaatcactttatcggatgaagaaatgacccaaataaaagttatagatcttgatgagttataccactttgttattgatgactttttcagttgaaatcatttaatacttaaaaatgttattcgaagttatcataatttgaaattcaaattcaaactgttcaaacaaagtcatatagaaaaataaccaatactaaagttgtagatcttgatgagttatacaactttgttgttgacaactttcccatttgaaatcatttactacccgaaaaattatttgaatttcttatattttaaaattcaaactttatatagtccaatcaaactcggatggagaaatgaccaaaagaaaattggtagatcttaacgagttctacaactttatttttgataactttttcacacaagttcatttaatatcataaaattcgattcaaagttttaatattttaaaattaattgtttttccctcctcctcgcttcaaattttttcatctcctcttctctctccctatccagatatttttacctccactctctctctttctatcctctcccctcactctctttctttccttaactctctttctctcctctccactcctcctagggcggcggtggcggtggcgggagctggcggcggcggcggcggcactgctcggccgccttgggctccggcctggagctggcggtggcgggggcggcgacctcggtcgaagagtgggcggcaacctcgggcggcggcaccaccgccatctcctcctcaccgtcgccgccgacgacgacgaggagccgacgggccagatccggcggcgacggttctcgtcccgcccggatccggcggcggcggacctcgtcccgcccgaatccgacggcggccttgggtgaagagt

SEQ ID NO: 34114 - DNA, 2244 bp, Oryza sativa
gccgacgacgacgaggaggcgggggcaggtggcggcgagcttgggcgacggctagggtttctttttttgaattctttttggaattttatttttttccgtgatttagtgggtagccggcatcgacggtgtggccagtggccggcgtcgtccgcgtcggcggcgtcgtctgtggtggtggcggcggcgaaaatggtgggggcgaggacggagcgagagagccgactagccgaggacggcggccaggcggccagcggtggcgctctcgacccctggatgcgccgctccgccgccgcctctctcgatctctgatgcgccgcctctctcgatctctctctctctctctcctctctagggttagccagttagggacttgggttgggctgggaacttggggaggaattatggactatttggatgggcctttttaacttcggaaattccgacaaactttccggaatttttccgaccgattccgagttccgacggaaactggtattatcatattcgattccgtttccgaaaaaatatttccgttttcgattccgtttccgcgaaattccgaaaaaattccgaccggctgattccgtttccgaaaacaggtccggaatccggaaaaattccgaaccgttttcacccctagccactggcaatgcagcttaacgagatatgggaattaatctgggaatttcactgtaatttacgcatctctgcatgtggatttactgttatgaaagatgcttgtgattttctatactgattcgtttagttgtttctcatatacaatggatagagtgattggggagctaaagctgtgtcaccttctctccagttgtatcgagagataaattagtgagataggtactgtcattaagaattttgctattttgatgtcatgaccacttataaagagcatgccctgtacttgccatttcttttgtttatggtacatttttcagtgtcatttaacattcaagtacttccaaattgattccttcctagcttctgaacatacaagactcagagctcatatttccaatttgtttgtataatcaatattttttagcatcatggatgcatatttagtgttttctgcacttgaatctgtaaataaactatatggtgtcagatattactatggtgtttaatatagagcacatgttaataagcaattgtgaggtgggcttatctatgcatattttattaagaatccgttacatggttgccggtgtgctgtatagttcatttattttgatccatatttgtacctaaatggtgcatctggaagtatttgtaaatatgagttggattactaatcttatatgttgtcgattaggtaagtatggataaaaatcagtttggtggtggaccgagaattgtatttggagatataaccaataaccaaacggtgtagtgaaatggaaagatatcatatatattagtgcttaccccttagtacatatataagtgatatatgaatcgttcttctctgtttcattttgcaaaaaaaaccacaggtaaaattaatgatgaagattgacagttgaggaatagaaaacaacatgaataccgtgcaaggaaacaaatttacgtgaaatatatttgatgtacggcattaattgatttaaagctcacatgcacatcacagaccatataaaaatatttttttgctaacaagaaattctaaaaattattaaaaacaaatataattgcaccatagcgtttagcacgggcatattactagtaagcaatagttgagtaactcagatagtcagatagagatcaaatagctaaagcagcagctcgatgactacctgtttctcttgtgcctagcaaaatgcccgtgtgctgttacggaattaaaaatatcacatcggcacattgcaaagaagaaatctattttgaattttagaacttaattttagaattagtgagagatttttcatctttttatattttagccgtaaaaaatttcaagcggactcaattgacttgtaccttggactttatacaagtagtggacagtggtcccacatcagaaatttagggaatttggtgatggggaccacaactatcttttaaaggaatatagatttatcttttaaaggaatatagatttatattttagccgtaaaaattttcaagcggactcaattgttttgtacattagactctatacaactatttgaagagggggtggacagtggtcccacgtatcagagatttggagagtttggtggtggggtg

SEQ ID NO: 34115 - DNA, 10874 bp, Oryza sativa
ccactcaccaccactactactctcttttaaagcagtatagaaactcaatgtcaatttctcacccacatcaagcactcaaatcttttacatatataaagaattgtaaaccttcctaaaagttgtcacttgtaaatggttccaatgtatctccaatctatgtgtatttcactgtttgtgggttatccttgcatactctaagttctgcgattatgggtccaaggcggaagaacatggttaaggatacttccagtccagaaccaaatgaagagaatttttctcgattgtatgaatggaaattgaacctaaaaacaaggactgttgcaggcaaatacttaactagcttagatgttgccttggaatttccagttatcaatgataaattttctggcccacggcataggtatgtgttgtcgaatggacaactgagtcacgtcgaaagacgtggctctctcaacagtagttggaagtaaagacaattgtattgcttagtaaaaatttttttggatccccctgttacattgtcctagggggctacttatagccctattacagactccctcttttagggtctagggtttacaggggaatttacatagttacccttgtgatagggatatcttcatgggtatacagtgtcttttgcttatatgggcccttagcgggccaagtgtttcagcccagcaactggcgaaaacttcggaaggtgtgtcggcctgctgagcctccttctagtgagacccgatgcctggcaaaagctgtgcccttcgtggcaaggctttcgccttagaccttcgaccgagtctcccatggtgaggtctgtctttggcgaggcttgtaggctccacgctacgtctttcgccatgtggccttcgcccacgccgtctctccgatcttcgccgcttgcttccagctcgtgctttcgatcatctttggtttcggtaggcccggtcgaaggtcctcgtggtatgcttccaacaagcccatcacgggcaagggtgagtaaggagctttggccaagactgtgcaagtcgtgtggtgtaccatcagacaccccctttcggccgatgttcctgccgaaacctatgttatgtacctatgaaaggaaaaaacttgtcctcttgtgttaacaaaaaaattttgagggaagtttccttcttgtttcgccaatgagtggcgaagtggttaggttacagtttgtactactatgaatagtgacgggccctgtgggccgcgctatcgttgctttcggccctttactgtttgaccccggcccgatgggaatttaccgtttcgtctacccctagacacgtgtcaagctctgattgggtgggagccgaaccgtcgcgcgatggggttacataaccctaccccaggtctccgctcccccccccccacgcgcttttcacttttaccaccgtcacgctcccgtgctctcagccctagctcctgctctagcctttttccaccgctgtgcgctcacgctggctgcttcgaccttctcatactctttcaccctcgacctcctttttgccacggactcgatggctccacgcaagcctaccaaggccgggtcgaccggcgaagaccccggtactcagcgaagggtggtcgtgctaccttggcaagtcccttgtcaaggagtctgacctaaccgagttcgtccttactggcgtccttgcagagcgtctggcaacttacgggggtgaagctgttgtcccttcgcccggcgacagacgaacggttgtctttactactttcttcgccgttgggcttcgccttccatgtgacgactttctgccgtccgtgctggagatatacgaagttaagctcccccagcttagcccattggcgttcccgaagttagccgtcttcgcgtggatgtgccaaacttgcgggttcgctcctaccgcgaagctgttcgccgttctattcacggcgtgcgcaacgaccaaagacgtgaacatgccggccgggccgaaaaagaccgttttcggctgcgtgaacttcatgctacggctggagcattcggatgcctggccggttccttcgtcgatggtgatgcagaagtggttctacgtcgataacccataccccgccgacgatgataaggcgaactggctccggtttcagtgccttcctgtgaagatatgcttcgactcacttcatttttttctcgccccattttatctagtccacacttggaagatgctgaggcggaggaggtgaggatagtcggaggtttgaccaccgccgaattcagtcgcctgctttaacgtcaagccgacggaagggtgaaccgtgttcatgccggcgagctagctagtcgatcgatcccctcaaaggccgccgccaacgacactgggacgtcgaagaagcgcaagcgagccgtcactaagggtgactaggcgcgaacccgtcatgccaccaaggacgcgccgacacggatgcggatgaggaggatgacgatgaaagagaggccgggtctgacgaagacggcggatcgcgcggctacacccccaatgtggtttgggtgaaggctggagcgggttctaatgctttgcccgtgcgtccgcaggatgttgccggtgcgaacgcgctcctggcgatctccagctccacggcgaaaataggggcgatagccagaaagaagaagaaaggggtggtgcaaattgccggcggcttttccgctagcgaggaatcttccgacgggacgcctacttcgccggcgctgcgacgcgttgtcccccgaaggagatgcctgtcgccaccgcctaccagcgatgccgaagcgccaacggggggtagcgcttcggccccggccgctgctccggtcagagcaatcgagtcggcggaggcgaacatctctggtgccgacagagtcgacaaggctccttcgtcaagccaccagcgggacgggaaggcgccggcgattgagatgatagtgtccgacatgacactcaacgccccgcacttcgtgtccgtggatttcgcctcccgactggagtcgcccccttcgtggatggggtttgttagatggtttcgccgtccgacggccttagtctcttcaccgtgctcaacgagttcggcgagagttgcgcagctgcggagagcttattcgtgcaggtaaaaatttttcctttcgcccacatagtttttctgtccttttcgctcttgttgtactcaaacagcttcggtttctcttacccagggtctcgcggcgcacctgagtgcgaagcggtccggcctatagaggctggatgggtaccggcttcaccttcggaaggccgaagaggacctccaccacaaagaagacgaacgtcaggtcgtggcggatgccctgaagaaggcgagcgcggagaacaaatcccttgtgggggaaaacaaatctctccgcgccgacttggagggggcgaacaagagggctgccgagcgggaacgtcagcttgctgcggccgaggaaaaaataaagtctcttgagacccggctcggctcgaccgaagcagctgttgaggctttggcgccagtgacagagtccgccaaataggcctgctatacccttcggctggccctcaacgaccttggggcgtgtgcggaaggcgctccgggcgaagacgggtcagtgttcgacttctctgagtggacgcaggatgcggttggttcagttgtcgaagtgtctggcgcgtacagtgactgctgtgcgcgagttgccgcggattcgtgctcagcctgcttcacgaacatggttgtgaccatgttgaggatttccctcagaccatgaagaaggattggcctgaaaatgcccaatccgccgcgtcggctttgaaggcctttcggaagggcttctgggaaaacggcagcagggatggcgcgaagacccggcttcgcgagcagctggagaggatagcgagggccgaagacgccgctgccgccaatactggcgaagaccccgggccgtcggagacagctactgatcgtgagggcgaaggcaacgaaagccgagaccaccctgaggtgtgagtcccttcgccctcatgttctttgctttttaggcttttgtagctgtagtttgtctatatacaagtattttgcatgttcggctagtggccgttaccatcttgtagctgttatggccttatgtttattaatgaaaagttagtgtttcgccaattgtgcgcctttatcgcaatgtgtgattgatttcgttagcatttttcccttttcgctgtactttatgccttgttggcagggttttagccgaaagtcgagcgttcggcccccctttgggaattggcgaaataaaaacgagaagttcgtggcggtgaaggtgaaagtgtcaattaggcctagagggggggtgaataggctaattcaaaaaacaattaaaagcggaagcagtaattttcggatatttccgaaattttcggatatatccaaaaattttcggaatcagcacaaacacaaagtaaatcctagatctagctacctataacaagaatatgctagcacaaacagcaactagacctatagcagctcaaacaagcaaagctagtggagagggaggaagtaaagtcaccaaagatgaagctcacgaagttgttcccgaagttcgaatccttgaagggattctactctccgttgaggatctcactaagagccgggtcttagctatccctttcctcaagaggttgcactaagcactcctccttccactaagggtatctcttccctttcagaggtgagatccgaccttcacaaacttctcccggccaaccacaagtagatcggtggctcaggagcaacacctagccgcctaggagtcctcaacctccaagagtaacaaatgatgcaacgaactcccggagatgatgcaagtgctcacaaatcttcacgaagtcaacaacaagcactcacacaaactcgaattcacaactctcacacacacaccaaatccgaatcgaatacgggtgagaggggaaacaagaaagcaaggctcaaaagtgaatctcaacaagagcaagccaagggcatagaatgtccaatgtgaccagcagccctcacaggtgaggggagggggctatttatagcaacagcccaaaatctgcccgttatgcacaataattgtgattttcggatattccgaaagattttcggatatatccgaaaattccaactaaagatttttcgaacattccgaaaacttttcggacaagtccgaaaatttccagacccaaaaacacccttctggactgatctactatccaactgccattttcggaaagtccgaaaattcctttcggaaaactccaaaaatttacagaagtgagaaagactctattgatgatttttggaaaatcgaaccatttttgccttttcagtcattttcggaaagtccgaaaatacctttcggatatatccgaaaattttcagaacacatcaaactgaggagaaacacttttaaaaattgattttgagcactttgatcactcctcatatgtcaatgcatcatccctcttaatagtgcggctttcctattgactctaagaaaagaaaaggtacaatataccaattgctcatttgccgcatctcatcatgtcaacgcatttggcgggatatgcattactttaactcattgaggacataacaaccttcacatttgcttaaataaaaatgttagtcctctctaatcgcattgtaattaatcaccaaaatcattaggggcctagatgcacttttaatctccccatttttggtgattgatgacaatacgattagatcacaagagagaatgaatataattaatggatttggtgcaaaggtttagtgaaaactccccctaaaagtgtgcattaaagcaagtggagagctccccctaaatctttgcatccacattgaagctcacaagacaataaatatatcacaatttactcatcacatacaacacatcacatgcataataactattacatctcatcacaagcaccttataaagaagataagacattgcatcacattaaacataataagatccattacatctcaagcatccataattaaacaataatgtcttacaaagcattaaactcacttaggaaccacacatagtctcatacaaataaaagccaaatgtgctcgacccaaaagacatgatagataatctccccctttggcatcaagacaccaaaaagagaggacgatgagacgaagactcaaacaaagggcgcctgagggggatcctctggaggaggaggaggatagccatagccatggccgaacccaaagaagtcgaagtccggaggcagcccaacaaatggatcctcgagctgttcctcctcaggctcatcgggctcagcctcaaagcccggaggggaaggcgggacatcgatgtggtggtcctcatgataccgcgccttgagatacttgacgtcgcgagccgttttcttcgccgcattccgcaatcggcggttctttttggcctccgcggagcaaagaccaaaaagactccgcaaaatgcggaacaagggagatggctcacgacgagccacaggagatggacgatcacaagcaggaggcggctgagtggaagaggaggggatgtccccagctgcagaggtgcctgcctgagaagagcgggaggccttaacaaggcgcaaatgaagctgggaatgagacacatcatgacgaaactgaagctgagtgacggtctcgatcatccgcataatgtgaggggcatagaccaaccccttccagtactgaatggaggccatgcggatttccgcccaaacgaagtgataaacatgaaagcgatgaggagggggatcgaacctgagaagcacagtcctggagaggtggttaatgctgctagcatcaccatctttaggcacaaaggaccggcgaaacatccggttcaaatagaaaaagtatggcttgagaccgtcgaccttgcccaacaccacatttggatcattaggaatgtagagagggagcaaatcagtgttggcaggaatttaaagattatgcaggtcatcaaggttgaacaaggaatctaagtcaaagccccaaatctcagccaatcgccgataggagacagaataccaggacccatgagtcatccagtgaatggcgcgaaaaccatcaaagaaggcggttgcataaaattgagcaatgacttcgttgcaccaatcctgctgtaaagtcatgaaggagcgaagtcccatgagctcacaattggaaatcacatagttgagcaccggatcatcatgagcctgcagctgctccagttgatccattgcatagggaccgtggggtgagctttggacttaatcacagactcgtaaaagtcttgttgaaagagagtccaaaaccgtgaatccgtggcggtgcggcgaagggggcgcggatcctcatcccggcgaggagcaacaacctcagtcttccgcctccaatcatacacttggcgaatcaccgccgggtccctctcgggggtatgaaagcggagaggaccaatggggacattgggttggtgtggcggcgtttgcggttgatgagaggagccctcaccaccgccaccaagagcttgagtggaccaccgaggagggagagtgccgccccgagccacccacgcaacctgaggaaccgcatcctcttccccggaccaatcactgtccgtatcatcacgagaggatggggtgggagaatggttcctttggcgcttggacgagtgggacgagcggggaggcatcttcaagaacgcgaagaactttggagaacgcggtgaagattaacaatgtaggtcccaagtagtgccccaaacgtgctcccacaaggttggagagaagggaagccgcggggggtcaccagagtaggggtggtcgccggtggggaggggaggagggagtcaagctcgtgggggaaaaagagtggaaaggagacagagaagaccacgggtgaagggttatatatgagccccgaaattttcggatatttccaaaaattttcggatatgtccgaaaagatacaggaggtttcgaacggatctggagtttttcggatatatccgaaaatttttcggaaagtccaaaaaatcctgggattgcttggaagaaaggcgacaggacaggagattttcgcaatgtccgaaaaattttcgaaatatccaaaaattcctggaaaactcagatttgcaaagggatttcactgggaattttgatgaaactattttgcaaacatttttaaaggaattttgcaagggactagcaccgggaaattttgacaaaacacatttcacaaggatttttgataggattaaaggaatggagggatggtcgagcactatagactccatttgaacttgaggctagcacacacaagcatacgaaacaatagccacaagtcaaatggacgatccgagggatcaaaagagagggaattaccatgagacaagataattcaccctcgagagagggaatgtgtgaatctatctcaaattgtgttaggaccaaaattcattgaaaaatgagatccccaaacacatagattcaagttatccacaaaagtgactagtgtccattttgtcacaaagtggtatgcaaacctatgctagcaaacaaacatgcatgcaaaagatcaagccacattccaagaatccaagatatttagttcacttctcaactcacaaaacctagcttcatctagaggcttggtaaagatatccgccaattgtttgtcggttctcacatgttggatgtctatgtcgcctcttgtggaatggtctctcaagaaatgatggcgaatatctatatgtttggttcgggaatgttggacggggttgtatgctatcttaatggcgctctcattgtcacataggagtgggattttggacacatttaggccatagtctctcaaggtttgcttcatccaaagaagttgagcacaacaactccccgccgaaacgtattccacttcggcggtggatagggcgacggagttttgtttcttggaagaccaagaaacaagggacctacccaagaattggcaaatgcccgatgtgcttttcctatctactttgcacccggcataatccgcataggcatagccaatgagatcaaacctcgctcccttaggataccaaagaccaaggttaggtgtgtgcactaaatatctaataattctcttcacggccacaaggtgacactccttcggagcggcttgaaatcttgcacacatgcacacactaagcataatatcgggcctagatgcacaaaggtaaaggagtgagccaatgatggaacgatataccttttggtcgacatctttaccttgctcgttgaagtcgaggtggttatttgatggcatgggagtgtggattggcttggcattctccatcccaaacttcttaagcatgtccttcaaatactttgtttggcaaatgaaagttccttccttgagttgcttgatttgaaggccgaggaagaacttcaattcacccatcatggacatctcaaaacgtttggtcatcatcctactaaactcttcactaaaagacttgttagtagaaccaaatataatgtcatcgacatatatttggcacacaaaaatatcattatcatgtcttttagtaaaaagagttgaatcggctttcccgatttcaaagccgtttttcacaagaaaattgcgaagacactcataccaagctctaggggcttgcttaagcccgtagagtgccttgtggagcttgtacatgtggttgggacacttcggatccttgaagcccggtggttgctccacgtataccactcgttgataggcccgttgaggaagacgcttttgacatccatttgatatagcttaaaattgaggttagtagcaaaagcaagcaatatgcgaatcgactcaagtctagctaccggcgcaaaagtttcaccaaaatctaatccttcgatttgggtgaacccttacgccactaacctcgccttgttccttactacgactccggcttcgtcttgcttgttccggaagatccacttcgtgccaatcacattttgctgaggtcgctccaccaaagtccacacttcattccgggtgaagttgttcaactcctcttgcatcgccatcacccaatccggatcattaagagcttcttccacccttagaggctcaagagaagacacaaacgagtaatgctcacaaaaatttgcaatacgagaatgagtggatactcccttgttgatgtctcctaagatgttgtcggtggggtgatctctttgaatactttggtggattcttgggcgagctagattgatcggtgagggtggcacatgctcaccttcttcaccttgatccaagcttgaagtagagagatcgtcggcttgggtcgatgtaggtggctctactttgtgtgaggaagaggccccttcttgtggctccctaggacgtacgtccccaagagccaacctcttgattgcttcgctcgggtcctcctcatcacctaacacatgtgagtcaacttgctctacttgagagccgttagtttcgtcaaatgtcacatcaagcgcgatctcaacaataccggaggttttgttgaaaacgcggtatgcgcattcatttgacccatacccaagcaagaacccctcatccactttaggagcgaacttagaggatctagccttcttattaagaatgtaacacttactaccgaaaacacgaaagtaagagacatttggtttgttaccggtaagaagctcatagggagtcttcttaagaaggcggtgaagatagaggcggttgatggcgtggcatgcggtgttgacggcttcggcccaaaagcggtccgatgtcttgtattcatccaacattgtcctcgcatctcgatgagagtc

SEQ ID NO: 34116 - DNA, 15850 bp, Oryza sativa
ctttgcttgaccttattgagattagatatatatttgccaataattaactaatcgcatgattgagtttgtcctacatggctcattgaagagtcgttcacactggaacagagcttagcgtgctggttatagatagagatccaacaaaataaagttgttaagttctcaaaataaaaaggctgaaaagaggcatatctttcgtgctctcttttcctatagacattgggttgtccccaaggaagcaaatggttggtgcagattcaatgcaaatataggaacaagacggaaattctgttcaaacagctcttggctcatttttatgggttttttcgctttgaactaacattgagttaaattgaccttagttaagccgcaaaacaggtctaatttattagtttgaatgtcatgttagcatttgaccaaaaatacctctaaaatccagtgaattcaggaccgtaggactgctttgagattcgtgcaacaacatccaatcctaatacatcttttcctctccccccagtcccgattcccgtcgccgccatagcttcgcttcctcgcgcacgcagccgaaagacgtcaacgatacccctcgaccttgatagctagctgaaaaacatcaacagctccagcgcggctccccttctccccttctcccctctcctcctcctaaagctgccctcacccccatcctcctcaagccagtggcggcaaagtgccccccatcccaccgtctttctcatctttgacaactctccccaccgtcagatccatcatcaccagtcaccgcctcctaaccacaagctcactttgccccgccaccatgctggcccaccgcacaccttcatccccacggtcccagcacctcaccacccacagtgcgtgtccaccaccgattgccttccgcggctatccctttctatcccttgatctgggaccctaaactctaacttcactgtttttcgtcggcccaccgccggtcaccgaaccttcatctgagttagacgaggaattaggtgcacaaatattcaagcagatagggtgtttcaaaatatataagaaattctcttcattttctgtcgaatgttatttaacagttgtctggaaccaagaataaagccaagcagtactactagtactagtgtacttcgatgacattggcagctaaccgtgtcaccggtagtttgattctttaagataatgaaaaatcacagcctttgcttccacagttacagcttattattaattaatactacaatgctcacagcataaaaaactgaaagtgccaaagtattaagatgacaagataacataccaaaacactgaggtaaaaatttgtatgaacgtcgagatccgtcatgcaagctggatattgtccatatatatattcttaatgcttagagatattatagcaatataagatgggacccatagtcctatattcttttatgtatagcacaatatataatgtatatggttttcttttgatcttaagttagggctcactaagaaaagggaactctatttagcaggattaaaagagcaatatgttgcaaaggcttaaatttttttttatggtctagctttaagtttaaggttcgtcatagcaatattctctcatttgcttctctcccaatgtataaaggtagaaaaaatattactttattgcttgaggtactttttatgcaactagaaaggtagcccgcgcattcgcgcgggcatgtttttatttcgtttcgaaaacagatctatcaaaataagtttaaattaaagtgaggtattttgcttcttaactgaatgttcattgtattttttctttaaaagtcttgagaaactttcattgctcataaatatataatttttaccatcctactatctcctttttagttgatcaaatatacatatcttagatagtgcttcttatacataggaccctacaatatttttaagaaaaatacctagtccatatgagtcttaaaataaaaattagtaggaaatttataatcatatcgttatacgaaatgctattgattttgtattgacaccttagaggcatttacatgcaagtcgtggaatttagtgtattcatttaattattattgacctttgtctcttgatgtgtcaaagggaaatatgacttgtatgactaaaatagttcactgtgtaaaagcttcaacactatcttgtgggttaagtgctccactaaaatagttctgtgtaaaaacattacaaaagttatttctacaggtagcccatgagtccgaggcaaaaggcttatcacataggaggctgcacatttgaggaacatgtaaaaagtcttctcgtggaaatcatttgtttaggagtgtgctgaacataattgtatattcaattaaaaaagttggaaaagtggcttaaagttgtcatttcacattgattggttatgaaaataatggtatatacaaatctttgtgcccatatcattgtttcgcaacaatcaatagaacttgatagttacttttggtattccttttggtatgtagcaaattggctaaatattttacaacttattgtatcgtttacaaagatgcacctgctttatttctctgtatactggattgtctcattgtttattaatggatgccttgggcgcatgcgacactatatatatttggaaaaagtacgaagcttgcgcccgccccctgcaccgccctgcctcgccaccgctgccgcctcgcctcactactgcctctgccgtcgcctatgttggagagaagagagagagtgtgtgtgtgtgtgatagattgggaaagagatagaatagagactgacaggtggggtctatctatttttttataaaagaattgctgactggactgccacgtagaccaaaaccaccgtggattgggtcgaggggggtatttcgtcctgtttgcataattgggggtgaagaatgtccggttttcggattcaagggggtaatttcggtcgaccgcgatagttcggggggaggggggtaattcgtactttttcctatatatttcaaataaaaagccttctcgagtctaaattgatttcgcagtgtgggaaactccacgtagcttagcaggaacataatttcatagctaaaaatactccacatgtgtgattataatgtagtgtggtttgattgttgtcatgatttaaatattttttactctaaaatttatgattaaacattaggaatttacataatgcaaacgatcacttgtgtgattttattttagctaacatgcattgggcctttagttattatatttatattgcataatcctaaatacgaagcatacaatgcttatcctattttatctttcttgtttgaaagaattagccatttatacaaccatggtagtttaaatactaaataacttttaacttttaagtttctaaaataattggtacaaaaaggttttagctcggtcatctgtggtacacatatagtcccaagcaaatttgccccctcacgctgacagtgtcccgggtaatgtcgatggggataaaactgtgaccgattaggagtattaattttttcagttccagaaagaaaaatgaatctcagttttttagaccactgtctaatgttttcttccgtaagtgtacaaatgaagctatagccgatctcatatcctttacattagatcgatgtatatggtccacatcattatattattttatatagatctaatggttaaaattaattggtccatcgatttaaatatttttattttttcttagaatttgcaggattttttctaatttatcagagagccacgtgacgatttagtagcgtttgtagtatataatataagacacgtataattatattattttgacttatgggggagtaatttcttttggaacatttaggtttattctaatttaattattgtgaaattatgtttgatgataaaatctatatcattatttttttcataatattttagaactatttaaatggcacgtaaaagtcagaaattataaccataatgtgacattctttttgaaagtttaaatacaagcagtttagatgttatattttttttaatcatcaactgtgcttgtctattcttctgtctaactaatatattaaataaaaataggaataagaaataagagagggaacaaagaaggagagagagagaggaggcataccggctgtcaagtacgtacgtacctacaacttcacgtatagtcggataggaggattgcttttttttttaatagattgatctaatggctaaaattgctgggtccaccgaattaaataaaattttaatagattgatctaatggctaaaaatactgggtcctccgaattaaataaaaatcaatggtcagatgttttgcttttttcctagaatttttaagaatttctctaatttattagagtgacatgtggcagtttaagagtgtttgtagggtacacgtggcagcttaggagcgtttgtaggaagtttaatggacttctagtatataatagatattgtggatgtccttatacttttgcaactaagtttagattgaactatggtactttttgtacaaaatgtggatgaccttatatttttcccttatgtattaatagtggtgtatcaacattttgttcctcggggtcactggatcacagctaactaaattaattatatcatgctaactagtactccctctatcccaaaataaatgcggttttgcactatttatgtccaacgttcgatcgttcatcttatttgaatatttttatgattaatattttttattgttattaaatgataaaacatgaataacactttatgtgtgactattttttttaatcttttataaatttttcaaataagacggacaatcaaacgttggacacggatacccacggctgcacttattttgggacagaggtagtactccctccatctacttttaatagtcatatttcatcttggcacacagaccaatgataagtaattctacttatcatccatttaaatatactattagttattcctcgtaaacaagcgatttattaatatttacatttctcgatgcccatgtagccaatcttgtgtggaagaatggagagtcacgcattaaatccgagaaagtcattaagaagataggttgttggattgaaatatgcctatcaaaaataaatttttcagatttggaaatatgactatcaaaattagatgcagggattataagttaataattactccctccgtcccaaaatataaaaatctagtactggataggatatttcctagtacaacgaatctggtattaggaaatgtcccatcatattataggttcttatattttgggatggagggagtagataatttggttgtgttctagtatcaagttttcaacctctgtttttttttcacgtgtatgcttcccgaactgctaaatggtgtgtatatttttaaaaatccataagaaagttgctgtaaaaaaatcatattaatctattttttaaaaataacatacttatttaatcatatgttaataatcgatcccgttttccatacgcaggttctcaaactcttctaccgaaaaagccttagtacatattgtacacttcgataattcttgctcaccactatatgtatatatatgtgactgttagaaacttagaataattagtgacgccacacaggtagttgccgtagtggagcggatgtgaattgtattatccgtgcggatgaaaaaggaagcattgaagcaagatgatggccagcagaaccggttggtttatttgccacgtaggacgatctgtctgacaccacttgcaagtgtgtgtgacgtgcagccttccacaaacgtacagtgccagcagctagcaaacaagtaaccaaggaacactgagacccggctgttcacactagctggctcggtcactataaaacttactcctatatcgcacgtgcgagctagctatttgttgcttcttttttttttttgcttcgatcgacatggtagatcgaggtagcgctggattcaattttattatcgaaaaaaaactagcttcattctgagtacgcaccatatatatatatttcaaatacacctactcacacgcgcgcacatccatataagtatgtcataacacacgtctaaataagattaaagacctgatatcatgtactccctctatattaaaaaaaaactttattatgtcgagattcaaacctagaattagattttttttcggacggaagaagtagcacacaagcatgcacgcgctttaatggttgaacatactaccatatctcaaaatgtacaaatttattctactcactccatttctacatatgattatttctgagttgtttaaaaaaatataaacatttatatattgttttattttttttcctcttcagctatcttattggttaatttttaaatcgcttgcatttcactccaaccatttgatatgttggaatgcttagatttccatgtgatggatttagtattaaaaaatgtttatattttgtacaaaatttgaatactttaaatgtttagatttccatgtattggaattagtataaaaaatccttatattgtgtaaaaattggagtacctggatttaaactctgaaagaaaatacgagcagcctgtcgagcagatatcatacgtttaatcgatctgatgtctgaaaggaaaatacgagcaacgtcgtaactcgtacgtgtatagccgggcagatgctggtggacatgttccatatataaaagaaaagactccagctatcttaaaaagtactccctcgtaaaggaaatcgtttaggataatgtttaagtcaaaccttgaaaatataaattatgaataactcttaagttgttgagtttgaaaatgtaaaaattatgtgaatagatttgtcttgaaaaatactttcataaaagtatacatatatcacttttcaataaatttttttatagaaacaagaagtcaaagttgtgttttgtagaccatgtcgctgtccaaaacggcttcctttatgagtatggagggagtatgctaactactctcgttttggtttcatatcgttttggtttcatatttcaagacggtttgattttctttgtttcatcaagtacataaaaaaaaatctaataactgaataatttaattctgacagtaggtttgttttgcgttggaaatgttacaatgtttttctataaacttgattaatttttttagaaaacaacctaaaacggggaagagagtatgtcgttagttttctctatacttctgtaaaatcaaagtgtttttcattgttattctatgatgaacaattggcattgaagattattggttttgatatttgaagattattggcaaagtgattttggagatgattgattttcaggtgatgaacagggttactgtttttatcgggaccgggatgaacagggttactgttggaccggtcagaccggcggaacaacggcggtcagaccggcgacagcaacaggaggcggcgacaggttttggtgattagaccggtgatctataccggtcagaccgatagcttctagacagtcagaccggcgcttcaccttcggtcggaccatgatccgtcgaatttgagagtaacttttaatttcgcaaaaagtttaggttttgggtataccaaccattcacacctccctctggttaacttagttattgtgtttcgatccaacgagttcctctcctccacacatgtgagttacataaatccttttatgacaaacccatgtcaacaaccttcattgtaagaaatggctgttgagggagacatgagatatattctaaaaaaaatgaaagaaaaataaaaaaaagaaagaaaggaagggagacatcagacatgagatgcccaggtggattagggtcggccggcggccgtgatcgaccaacaacggcatgcatgcatgcaaggggtgacgtcatgacgagatacggagggtggggatccacggcgggccgcccccgttcacactatcgccatttactaatccgcatagggttggcggtgggcccaccctccccgccttagcgttcacacctgttcctttcccgcgcttcggattcgtagtttttttatataaaaaaaaagaatagaaatgttggagctgtgctgaactagtcgtcgtcttcgtcgggctagctagcgtatataagagtcgacgagggcgagcgaattcattccatcatccgcaccaacaccattagttatattacccacacatcgccacgcattgccggccatgtctgccgccgcctgcatctcctccttccctccaccgccaatggccgccgcggcggcgccggcgccggagaccaccatcgacgtcttcgtcgtcgccaaccacacgccggtgaccgccgccgccgacaaaaggtacagcatcgttcggtgtactgtgtctcgatcgagatctttaatttctcctcgtttgagtttgcttgaattcttggtggtttttgtgatcgatcctggccgcatgcagcagctgcgagggggacgtcgtcgccggcggcgggaggacggtgaggaggccgcgggcggtggcgcggacgctggagtgcgagcggcgggtggtcggcgaggggttcgcggtgaggaggggcatcgggaggaaggagctcgacagcctcgatcctttcatctccctcgacgagttcgagtgtacgtactgtaccaccacccatctaccttctcttctctcgctcatctcgcctccctctcttcccctctagtagtgtacacaagttgaaaacgtacgtctttgactgaatcccaaaaaataaatttgtcccttacaagatgaggatttttggattaattaaacggctggacggttttatagcattgagcacatactaatacatgttcttttaagtaagtgatgtcattaacttttttatgatgtttgatcatcttatttttttaaaaaaaatgattcagtatcatttattttgttgttatttgttttatcattaacggaattcaagaatgactttttttaatggctgtagtaaatttttgaataactgaataagacaaatatttaaatttcaatcaaaagttaacaacgtcatctattaaaaatgagatggagtatcaatgacgtacctacatgtaactacccgatgtccttagacaccaggtagcttgtctatttctagctattttatatcatattaatcatcatataactcaaaaattagactataagtaatttttattttgagttcaccaacggaggatattatgtaggcacacgaattaattagttggagtaaccagtgatcaagaaaaatggtttccaaacggatatatgttgagtatcgtgtaatgtcccttcaggtcaccaactagctctcatatgattattcaacagagtattcacaccttgttaacgttccctttctgtttctattttacagtttctccaccagccggcttccatgatcatccccacagaggtttgtgatttcttaatccccgttgatacagctgtgcatagttttatatttacacgctaatctcatgaacaattaatttagcttaagttttaataaagtatagttattatatgttattcctgaattctgatcttacaattttcttccattttgtatgtggcacctgttccttcaggattcgagaatgttacctacatgctcgaggtaactaattaacagtttgattcatttccatcaacaatattgtagtattggcgtatcagttgtaataggaaaaccaccaagaatatatttaatctgtcacacaattccatctcattctttctaaaagaatatttagtgacaaattaactgttgttcttaactaattttaatctgttgttttcagggaggcttcagttaccatgacttttcaggccacaagggcaccatcaacacaggagatgttcaggttaggtctccaactgtaccattaaacttagagttggactactcagagcaatatcctttataacttgtccctgttttcctttttccttattttcgttgaaattaacagcctaacaacaactatgaatagtgttatagtactgttcttcaagtaattacttctccatttcaaattacttgtcgttctaactttatctaaagccaaacatttatatcattgacatttactttctaaaagttcatataatttaacatcataagtttattttttagattcaccataaaaaagactttcataatatataattcacttgtagttataatagctagacgaatttttagaaatatatattaatggctaaagctgatacaggtgtttgaactatgacaaaagatataacgacaataataatttgaaagagtaatataatcgggtacagagatgtaggggtagtacttattaaagacattaattcctcgagaacgacttgtctgaaaactgagttaattgtatttactttctgaaaacttgaaatgactatgacatagtgtcagcgtgtgatcactagtggagtaggtactctaaacatgcaaaatgttgctatctactttttttaatagtgaagtacaactcgtggcatctattcatctggaatatacacaaccattgcatattgccgtcacgccgaagaaaaaggaacaaaaggttactatcgaacaaataagaaagaacactatgtttgattgttctaggggataaagctggagttctactccaagtagtttgagatttatacacctggaaattatttatggctctttgaaacgtaggaatcttacaggagaagtcctctaaaactcctccattccgaatgcgacctgaacttaaacttccactggataccttttgattgactataagactattttctgtgcattttgcagtgcatgagatgcaactttgcttgttacttttgataaccacaaaaggatttttgacaacaaacagtaggggtcatttttaaaataaattgatcaaacgaattcatgtgcagattaattggaaaggaaaagagggaatattggttatgttcttccctcttctttcgcaacttacctccattgttttccgtgcatgttttttaaaatgttaaatgtatgtcttttcaaaaaaaatattacagaaaaattgctttaaaaatcatattaatctatttttcaagtttttttagtttaataattaattaatctcgctctgatcacttgctttgttttccatgtaacttgcctcccgaactcagcccggtaaagagagctaacttggtgtatgcatggttgtcgttggcagtggatgacggcggggcgcggcgtggtgcacgcggagatgcccggcggccatggcgtccagaggggcatcaacctctggatcaacctctcctccaaggacaaaatgtactcttcttcctgtgcctctctcatcagccgcagcaatggcggctactacgtaacagttgctgaccactcgctgtgccgtgccgtgccgtggccatgatgcgtgcgtgcgtgcagggtggagccgaggtaccaggagctggcgagccacgacatccccgccgcggagcgcgacggcgtgtccgtcaaggtgatcgccggcgaggccctgggcgcgcgctcgccgctccagacgcgcaccccggcgctctgcctcgacgtcgccatgcggcccggcgcgcgcctgcgagcgcccgtcccgcccgggtggagcgcgtgctcgtacgtcatcgacggcgaggccgtcttcggggacgaggccgcggcggcgggcgcgcacacctgcgtcgtgttcggcggcggcggcgacggcgtggccgcgcgggcgacggagcgctccgcggcgaggttcctgctggtggcggcgcggccgcacggcgaggccgtggtgaaggacgggccgttcgtgatgaacacccgggaggaggtggagcaggccagggaagactaccggaaccgccgcaacggcttcgagatggccgccggctggagctccgaccacgttgccaccgccgccgcggcgcactgatggtcaccggcgacggcgaggccggtgaccatggtgtcatcagctcatccaggtcgcaggtgaacgctgcgtttgcgcgggaggataggaattttagggaatttcgttgcaaagttgatgtaagataaaatggaggattaggtgtgccgtgtgaaactcctgtaaaataaccttatgcgaatattgaatttcgttcaatttttgtgtttgaaacgatgttaaaacttactgatcaaatttatgggtggtcatcttgtgtgagaatcaaatttatgccattgaatcatcttgcagaatatctacttcagctgctacattgctaatctgaatttcattgtataaaatacaaatggagaacgaagtgttttttttttctttttgttgttctgggtggtcatcttgtttatgtttccatggaacgtcaaacatgcctttgtgccaaaatgccattttagaaaacagagctagtttgttctctccatggtatatcctttgtagtgtcttgttaaatgcagaacataatgtatatcagtttgatgaaaaactaggcgataaacctgccgattgtgaataggattaaacaaacaatttaaggtgcaacacagctgcatggtcaaactatttttcacctgtttcagtgatatcctctctacagctccccataaattttgatacaaaatttgaacttgaatattaaaatcagttaaagcagaaaaaaataacaggccaaaaatatttggattcgtcatacttgagaagttctggagatgggcaccaacatttcaagaaactggtggtaccagccgttacactggtttcctgaactctgcttctgaatttgtaagataaggtcataagggaatttcacgatcaactgaactttggaacaataacttactgtttacttccagtcgaatgtcagttcgtttcagttttttccacctgttacatctgttgtttcgttctttgattgcctgcctccagatttttctttttttttttgcaactaggaaggtagcccgtgcgatgcgcgggcatgtatattaattcgttaaaatcatgcttgacaagttaaattaatatgttttttcctttctttttaattgaatgttcatcgtctcgctcttttcttatgaaatattaagaatttattaattaatgaatatattttatgtgtatccagctatccttacctctaattcatatgcatgcaagtatattcttgcacaagatctatctatctatgatatgtggcacccatatgatatttttctaaaaatacctagtcaacaggagtaataaaatgtaaatttaatatgaaaaatataacttttaaatatgaaaggccatcaattatgtaatgctattagtggcttatatacacgcaagagtaaaaaacccatgacacattggaatttaggatagcacatatttatcattggcttttgtgtctttatatgtgtgaaagcaaatatgactcgtttgaaatatatataaaaaagtaaataaaaaaatattgttgggacataaaatgagatattttgtatagttaagggagtacactgattcaaactcggtgtaagtgatctatataattgtatgagtaaaagcactgcgatgaatataattgtttaaacgattaaaaaagttggataagagacttaaaattatttgtgccaatattcgatagttcgtatgtgaaataacattagcaatgcatgctagatattataactcattcattgtgtcctgctctgatactgttaattttctatttcttttctcaaagtattggattttttccattgctaaaataaaaagtttcgtgaggtccaatttaattgtgcgatgtggaatacaacccatatgccatttcataaagattgtgcgaggctccacgtagttcgatggaaatatgatttgatgtctaaacataaccgctcacgtgtcattgcttttacaatgtgaaatttttgttgatatcatagattgaatatttttctgtaaaattatattagagttataatttatttactacaaattgacattttttttaattttttagctagcttgtagtgggcataaattagtgcctatcatctttccacttctaaatttttgttacatagttaggctttttttttatgttcgtgccaatttattatatctgctacaatcatatatataattatacatttaactctcactaagtatagttaatgttatttttctaatctctatatttctagcacctcgatgatttgtctggtcgaaaactctctcttttgtttcttctttcataaagccataccaccttagttttgtcttatgatgttgaatctatatttgatctaaattttcaaagcacataatcttaactgtgtttatagcttttttggatgattaactaaagatgcaaactgtacaaagtaacatataagattacgttgtttagctacgaaataaatttattttgtactatgtttctgtcattatcattcatcatttctgcagcaacgtttccttatacagggttttatctaattaggttagttgtgacttatttttcttgattgtcatctcatgctatgttaagccatacttcctccatgcatgatacgatcaaatttccttgttctgttcatttaggtcacgtcaaactttgtttgtgcttattctttgatgtttcgtatcttaatttatatgcagtgaacatatacaaaaattaattttgatggactgcaacactgcattacgattaggctggaagattttatcatatgaatgatgcctctctctctctctcgttaacggaacatatgcgcggagtatgtgtggttgactcatggatagcgtcatcaagcgacagaacacgcgtgccatcttgaattttttaagtaggttaagattaagattagatctagtgattgaaaatatttgccctaccaatttaaagaaaaaaatcaatggtgagatgtttttcttttttttcttataatttctgtgtttttttcataatttattagagtatcatatggtggtttaggagcatttgtaggattgccacgtggtgacttaggagcgtttatcgaatctaaatttaatatttgtgtaatatggtgcttaaaaatttgctcttaaaacatttatattagaaatctaagctatttatatgtatatggattcatcaattaaagttgaatagttaagttagagaaagaaatgaaggaaagtgggagggatgaatgtacgtagtcaccgtgaggggaggaggtccaggagaaaagggcggtggagatgatttttgatgggttttgggatttttttaaaagatagatctgacggtgtaaaatattgggtccaccgtattaacttaaaattgatggctatatgtatttcttttttcttataatttcttcgatttctctgatttattgagtgctggttgttgtaaataatggacacatacaaggccagccacgtggcatattgatggtccataattggcacctataagtcggtataggtgtcgattattggtacaaaacaggcacctacacacattataggtgccgattctaccaccaacaccgatgactaaagtcatccgtgctattatctgggtatcggttagaaaaaccggcatgtaaaagggtttcttgttacctatggtgtagttgaatgtgctcccagtaaattattgatttaaccccagtccacctggtccatcttgtatgagcacagctactaattaaaatttttgtgattagctggctggtttgcaagctcattggatgattttctagcaacagtgtagaagaaaaaaaaaatatcggtgttg

SEQ ID NO: 34117 - DNA, 868 bp, Oryza sativa
cattccaccatcgatcaaacatccttcctaatcacaaacatctatgctccccatgccaactccgagagacaagaagtgtttgatctgctcactgccttgaggaccacacgccttgagccctggatgcgcatcggcgatttcaacatatacagattcccacatgagaagacaatgacagcataaatacaagaggaatggaagagttcaacagttggattaatggtgaggggttgtttgacatagacatccctagtagaaagttcacttggtcaaacaagagaagatgcccgacttcggtaaaacttgacagagttctgatcgacaccgcctggaaccaaactttcgccaacgcctccgccaaagcactaatagcaacaacttcagaccacatccccatcctcgctgagttctcggacaactgttcaaaatcagacatttttcgtttagaaaattactggttgcagatgcctgatttcatcgcgatgacagaaacaaactggagcagaggaaccagacccctgacagcaatctccaagctcaaccacaaactcagacggcttcgagccagcacgaaagcctggaacagaaataagcgcagcattccaaccctcctgtcagccaacaaagacacattggaatacctagacaaaattgaggagtggcgtcaactgactgatttggaatactacctgagacagaggattcaaaaacactgcaatgagctaaatgatttcatcacgcaaaaatggaagagaagagctcgtatcagattctgcacactaggtgatgaaaacacaagattttatcacactctggcttcagtaagtagacaaaaaaattccatcagactttttattgaagatggtgt

SEQ ID NO: 34118 - DNA, 1360 bp, Oryza sativa
ccttataaagagaaagtatctttataatcagtctataacccaagttaataggaaacaaggggattcacaattttggtcagggctcatgaaggtcaaaaataccttcttaaatatgggttcttggattgtaaataatggaagacaaataaggttctgggaagataaatggctgggtaacttggcttttaaagacaaatatccatctttatattctattgttcgaaggaaaagttctactattgctagtgttatgagttctgttccacttaatgtttcctttaggagagccttagttggccataatcttacatattggcatgaattgtgtacttctattatacatattcaatcgaaccattcttctgattgctttagatggaattatcatcagagtggtagtttttttgttaggtcaatgtatctagctttaattaataatggatatatcgaaagaaataagattatttggaagcttaagatgccactcaagattaagatctttatgtggtacttgcttaaaggggttgtgctgactaaggacaatttggcaagacgaaattggaatggcaatttaagatgttgtttctgcatgaaaaatgagaccatacaacatctttttcttgactgtcattatgcaagatttgtttggagagcagtacaattctcttttggtttaaaccttccaagtatcatatctaatatgtttgatgggtggcttatgggggttaataagaagaaatgtaatctcatacttgtaggagcatctgccatatgttgggccctatggttgagtaggaatgatttagtgtttaacaaatcaccatatactttatatatgcaggtaatattcaaggtaatatattggctccggttttgggcaaagctgcaaaagtgtgaagaggatggtgaacttatgaaggttgcatgtcgcaaactcgagacgacggtgacgtaactctttgcaaactatggatggagattcacaaatagacttgaataaatgtgtactctttatcttggtttgctttttattttgttgagtgtgtttgattacatttgaactacactctttgtatgagtgatactttgtaataattggttgtaactctgttgagtcaaggccgggatataaattccattatctaaaaatataaatgatgttgatatatatgctagttgaagctgaagttaacaagcattttactccaattgtctttccttttccctcctcttttcacacagtgccaccaaagatgttgatacaaagctaccaaggtgaaaaatagcatgctaacacatgtggattaaatcatagtaagacacgtcaaagccattgccatcagcacctgaaaacaggaca

SEQ ID NO: 34119 - DNA, 4443 bp, Oryza sativa
atggagaatgtggtaaggtggttgtcaattgtcctcctgaagatcctgccccagtgtcatcttctgacaaccgccgtagaattttaagagcactgagttctggatcatacgccacaaagataaagaacacaagagcaaccatagtagcattcaccggagcaacctccaggtcatgcaaggcgatgagtcatgattcaagtggttcaaccaagcagcatgttgagtcgtccgcaggtaagaggaaatggcaaaaagaaagtgttgaggtaaatagagatgattaacaagatatctgtgatcccgtatatcatggttatccttcgtattttctgaatggactgcttgacatcatgggccatgagaagttcagtccaaaactcctaatatcttgttctgaaagatgacgactgaaaaattgctatcgctacttgtttataatcaagctaattttcatttgtgtatgtttctaaaatatagcggttgctcacatttgtctgtattgcatggcatttgaacacatgttttgcaaccataatgtaaatagacaacccaccaatggagaaaactgttgagaattactacaattagtcacacaatagtattatgtttcagtagcatgtggcaatggacttcacttactagttagaaggtacagtaccgctgttgattcctcatttagggcatacaaaagattcctcagatgctatatttgtttaatcctaagttgaatcaaatcctttcgaccacagggcagagaataatccaaattatataagacatgggtatgcattgaataccacatattcaaatctctttaaaagcctaatttgctactgggagtggcacttgttgactgcatgtatcatataatctagtgttaaacaactaagaatgggttcatacgtaaccgtattgaatgttcaaattaaaaatgagtatagcaaactacatttgacagcaaaaatgcactgttttcagtttcacatatatggacaatatgggcaaaagtattcatatgaaagaatagtaggatcacaatgcagacatgagaaggtattcagtcatcatatgaacagtgaggagaagcagtacagccaacatcaaaaggatcttccgatccacaacaatgccaatactggaacactttgcctgaatctggagtatccagagtcccacccgcatagacactttcaaattttctcttcgtttctcctggatagacagagattggccattcagatattagactaacacaagcagacaatgttaactagttcaaaataaacaactcagtcagaatttctgtctaggtcatatgccaatagcccctcggatgtttggattttccataggaacattggactataaaatatccttaacacaatttttcccctcaggattatgttgggagaaaacgttatgcacccaattctactgaaatctcttgctaaatctcgaattcgtttctctcaaagaagccctcagctacacatatgaatagctcgagcaatcaaatgaatctgaaagaaactactccagcttccttccatttctccgacgagttcctcacctccgaagtgggcggtgtggtggcggcacgccgaggggtggttcgccgccgggtcgtaatgcttcttgcagttcttgcacgtgcgcagctcgggccctcctccgccgccgactccggccgaggcggccacgggtagccggactagccgacggcgcgtggcgagctgggcggcggggcacgcccggggcggagcccgtagcaacggcggcgcgcgcgcttgcggcgtcgccattgggagggatgagcaagtgcggcggagagggagaaggggttggtgggatcgggtcgagaggcggaaccgagagcgacaaatgcgggtgggccgctagtctgtagttgggctcaaatgcgggtaaggatcagaagcagcccatgaagcccacgttggaatcgtggtagaggtagcccatatgcaagcctagggattgggtgctcggcctaaaattcagactatcaaaattgataaaatttgctatataacacttaaagtcaccgaaacaacgcgtatcttcttgtgaacagcataaaaatattataattagctagatactcaccgcattattttattattttgggtggaaacggagagagaaactttcataaaagacgacgagtttgcccgtggggtcattgtgtataaccctcacgccggtgaagacgttgacggccggccgcgaatcctcgccacggcgcacgggtcgacggcgacggtgacccagccgccgtcatgagcgccgcacaagcacgtgtcccagacgccttccaggaggctgaggtggcgggtgaagccggagagtcggagtagaggctgaagtaggacgatgtgtcgtgggacgggaggagcagccacgggagcccgcagtgcagggcgttgacgaaggccgcggcagtgcgccatgggcggtagacggccgtgaagccaatgcggtcgacgaggcagttcagttgcttgaagatgacgccgagtagcttgggcaggaggccatctgaccacggcagccgtgacgaatgcctcggatctgccctagctcctccgtcgcgcgtcgccggctgacggcgaaatttggcactggtcgtcgacggtgagcggcgagctctgaccctgcgcgtctctggcggggatcaaccgaccctgtgaccagcgtttcggctatcgccggtcaattcggtacatttatcgttctttctctctctccgtttccaccaaaaataataaaataatttagcgagtgtcgggcaactaattttcacatttttgcgatgtctacaagaagatatgtgttctttggtgtcttacaacaaaaaccacaattttttagtgtcctgtaacaaattctgccatcatccccgaaaaaaaaattctggcatcaatttgacggattaagttataaaaaggtgtttagtcattgagacatctgaaacaagatatatgagaaattatcacaccacaaagctagaatacatagttaaaacatctttaaaaataaattcattaattggaacattataacattttctgcaggtatggaacatacaaaccaaagatgtaaaacacggttccaaacatatctctctcgtgcttgaagtatatttatttcaaaagtagaataatgtgaattgttgtttcaaatatttaatttaatacacgacataattagatcgcatatcaaaataatcccccatccctacttctaacccacccaacaacgttgcgcctccctctcgacctcgcacctgtactgctagctacctactcatctgtggtgcaccgtctcaggtgaaggccgccgactgctctctccacgctaaatccgtcccactgatctcctctgtttccaatggttcacacccacccactccaccttctaatcactctgcccaccacggccgccgccgggcacggccccgccgcccgcccgcccgccgccagatgggaagggaggagggggggagaggggaggaggaaggggagggggaggaggagagggatctgtgaagaggataagtgcgacgaaggggaggaggaagagaaagggatttgtgaggatgtggttgcgattgtggaggagaggataagtgctaggaattacatactacgcattgaattttagtcccgattagtattaccaatcgggattaaagtggtgatctttagatccggttggtgtcaccaaccgggactaaagatcctcggtcccctgacaggggatgaactgggactaaagattgtattaccaacagtaacctcaaacagtatttacgtcagaggtactgttttacactgtagtgctaacttaaaaaaactgtgcgcctctgacgttaccgtccaaagtcagaggagccggttcccgaccagtgtatctatgggtggaagtgcaactaccaggataccattccctactttattttattaactggcgtaatacaaagcaacaattaatatatccaaggtaacacacggtagtctatagctaggcgcacttgaaaccctctggcacgttgcggccgcagtagttgacgaggagcgggaggtcgacagcgacatcctcgagcttgacgccatcgccgagcacgctggccttgatggcgaggcagaggcacacggcagcacactgctagaaaaagcattttcatcaatattgggtatttattttcacatacgaacatgacccttagagccaaacagccacctacaaaaatataaatcgggcgtgcctacgaaaatgattttcgtagacggaccacatgaggtgcgcctgcaaaaattagcgtggtatatatatatgacacatcagttgatatttttctaagtgtccttacctctccccttcaccctcctctcccctccccttcacctctcccctcccctcccg

SEQ ID NO: 34120 - DNA, 2807 bp, Oryza sativa
aggcccagcgccgccggcggccgctcccctccttccctccctcccctccagatctggctagagggggaggggggaggggggaggccggtggcggctcccctccctcccttcctcctagatctggccggaggggagaggctggcggcggggcacggcatcgcgcgtgggcagggtgtggatcagccggaggcagcggggtgcgtccgtgcgatggcgacgatgacgtccgtgcgaaaatttgtgatttgatttgatttgatttgatttgattgtgaaccactatgatgtctgttaatctgtgatgtttttgtgtatttgatttggtttgatgttgaatctagatgggggaaatgggaggagaatgagaagctactgctaccggccgaaacggcggtgggcggtggctgcctattttttttaatgccaggtgctattttcgcaggcggaccagttgtccgtctacgaaaatcaactattttaacagtcgttcagttgcagacggacaattggcccgcctgtgaaatcctgtttaggccgcctgcgaatttctagtagtggcgtcgacgtcggcgagcacggcgatgagcgggcagcacggctccctgctgggcggcggcgccgcccccaccaccgcgtggatcagcgcgttcagcacgctcccgcacacccctagcttccccacctccaccggtcacttgccattgccatccgccttctccaccgccggcggcgcggcccgcggaacgatcggtggcaggcagttggatttcccgagtttgcacgccgccgacggcttagcgccggtgaggcacagcacggccaccgccaccacggcgacgagggcagcgtgcgccgtgatgctgctccctgtttgcgccattaattcgctacagctaagctagcttttgcttgttagttgtattgtgcttattcttcagctaacttgctttgatagagtatttgtaggggattataggaggatatgtatggctaaattaggcatcggtgattagcctgcttaaataaggagtttcatccaggtattatgcaggggactttgtggcagtttttgccatcttaaatggaaaagattcagttgtcatatcgtgtatctgtggtaaatacacggtatgagaaccgaagcttttgcccagaagataggggtaattattcacgtaggattattttttgatgagttggagaagagacgatagaagagatagcatgggtaactataaacaggtacaatagcatacgataagccagttataaatatattttaaagagataaaagaggagagagtagagcagcgggctacagatctgtagccagctgcagcacggattccaagataaaacgtgtgtatgacatgtgggaccagattaatagtgtagtaagtaactattatacgaattggctattaatttggctatagatgatttggagctagtagttggctatactattaaacttgctctaattggtcgtgtggctgcacactcagcccaaggacggagtcctcaccggagtcgtcgatgttgcatcccacgggctactgccctcgtccatggacaccgacgccaacgcctacgtcctcgtctgatgtcaccaccgccatcctcgcccacgaacgccgacgctgccctcgtcctcttccgccaccaccttcatcctcgtccgcgtccgttactgacaccatagtgtgccactgtcgatgcccttgtcctcgtccgtcgtgtcctccaccgcgctgccgctgccctcatctattgttggtgccaccgtccttgtcctcatttgttgcagctgccgactccctcgtcctcttccaccgcgctcgtcgcctccatcagtcactgctgttgcgctcgtcctccgtgtcctctgccaccgccgccatcatccaccatgaccgctgcagccagcgctatcaccgtcttctcgagctggcgaccaccgagcataaagaagacaaggaaaacggtaaaaaagaaaaataggcactgaagaagtggtgggaggaagaaagagaagggacaggagaagatagcaggccccacaaaaatagtagactaatatttgtgtggtagtataatatttttattgtatctttacaatccgcttctcctctcttctctcctccaccttagtatttagctggcttatagcctactattatacttgctcttaattacaacagcctgcaggctagctgcttcatgcatgtcacagtgatagtcgtcagtccgattgagtatgcatagctatggtcggcctgttagtgtggtgacatggtgagtgtgtggctatcctgctcagtcccaactacaatctgcctccttccaatcaggccttcttctccgccaatcaactcgttgattatccccgtcgcttcgtggttgaagttctggtttttataaatacatgactatgaatctgtacagtctatcatcatgatctccaggtcccttctagccaaacataaatatttgagctctgttttgccaagatgctttaactctagttctcgatgcatccagttcctagcagattctcaccggtcactaccatctccttcctgctagcaccctcacttagcaaggataaatgcatgtaatgacaggaacaggctggtcaggctctatagttttgacgtgtttatatatggggccttccccagcattccacatcaactacatcactactacagaggtgatttttctggacaccggccccttttggttccaggcgggccaaaagtggctccgcctggaaccaggcgaatgccggcgccgggctgtgggcc

SEQ ID NO: 34121 - DNA, 4621 bp, Oryza sativa
gcccacgtaaggcgaccgcttgcgatggtcggggggcatataagccccagcccgaccgttggtatgaaattccgacggtttctctctcataaacatccacaaaattaggggggaaggttttcgacctcaaatctttgattgggttccatataaaaggtgtagagcttgttctcctccttcatttgcttccatttttgtcagttttcatcggtggaatacgaagaaacttgcacttttataaatggaatagtgtaggcacctttttgttttttttatttttttagcaaatacataatgattccattacatgtttataaaagtatttagtacctacattgaaaagttgggtttgcctctattaaatttattttcatttggatgaaaggatgattttttttcattttttagaaatggacagtattttattaatgcttaaaatcactgtgcggctatttaaatagttcgtaaaactttaaattaccatgtgattcgttccctccaatttaaatacattcgtgtttgaatcgggcatggatgtattaatgacaagctttattgtaagtcatggatcagacatggatgtacaacacgaaaagagctcatccaacgttcttgaaggaagcagccaaatttgttgagctcgcaaaggcacatgctgtgagggagaatttgaggaacattttttgcccatgcaaagtttgtaagaatgaaattttgctgcaagatccgaataaagtattgtcgcacatcgtagaatgaggatttaagaagggctacgagatatggacctttcatggggaagtcaatggtcgtaatgaagagttagatgatttctgttttgatgatgcagaaaattttattgtcgaagacatgtcacagggaaacatcccggaatacggtggctctggtatagagaatgaaggtattgattttgatctggaagatatgttgcggcacgttgaaccagagatcctaactggtacaagacgagggttggacaattgggaagcgttggaaaaagcagcgaaggagcttctgaacgacgaagccaaaggatgcgacaaggactattcggtcctgcgctcggtgctcgaacttctcagattgaaggccagacatggatggtcggacatgagcttcaatgatttgatggatcttttgagagttatgcttcctaagctgaacctgctaccgacgaacacatatcaagcgaagaaattgatatgtccattgtctctaggtgttcagaagatccatgcatgtgaaaatcattgcatactgtaccgcaaggaattcgcggatttagactcttgcccaacatgtgggacgagtcggtacaagacgggcaacggagcctccgatagagaggtggtcgacaaagatgatgcaccggtggatgagaaaaaaaagattcttaggatggtgatgttggtacctgccagttaaagatcgcctgaagcggctattttccaaccatgacgacgccgagttgatgagatggcaccaggagggtaggaaaaatgacggtaagatccgacaccccgccgatgttcgacagtggaaaaactttgatgcactacactcggaatttgcaaaggacccgagaaatgtaaggtttgcattgagcacggacggaatgaacccgttcggtgccctaagcagcacacacagcacctggctagttctgctaacgatgtacaacttgcctacatggatttgccagaagcgaaagtatattcttttgtctatccttatacaaggatcaagacagcctgggattaacatagatgtgtttctggaaccattgatggaggacatgcaagaactgtgggaggaagggttacgaatgtgggacgagtaccgtagggaacattttactctgcatgccatcatattcgttacgatcaacgacttaccggcaaacttttcgctctcgggctagtttaaggggaagttcggatgcctcctatgtatcgacaagacgtcgtacaagtacctcacctcatcaaccaagggtgtttacatgcgtcatcgtcggttcttacctcagaggcataggtggcgtgcgaaggccagattattcgacaatacagtagagaacgatctagctcctgaaacacgaacatgtggctctgtcttcgagctgacaaagaacattaaggttgtcttcggcaagccaaaaaagaagcccgtcaagaggaagaaacggacggatcaggaaacaactgatgcacctttagaggaaagtaacctgccctttaagaagcactcaatttttttcaggtatcttgattactggaaagacctggaggttcggcatgccatcgacgtaatgcaccttgagaagaatgtgtttgatagcaccattggcactttactggacatcccgagtaagacgaaagatgggttgaagtcccggaccgacctcgtcaatttggacataaggcatgagctttacccaaaagagctgccaaatggaaagatcgatattcctccggcttgctactcactaacacttgacgagaaaaaatctttatgtagatgcttgcatagtgtgaaagtcccgactggtttctcagcgaacgtcagaaaacttgtatctttgaaagatttgaccatttctgggtacaatgctcatgattgtcacaagatgttaacagtcttcctaccgattgctataagagcggtcaagccagttcacactcgattagtgataacaaagttgtgctactttttcaatcgagtatcacagaaggtttttgatcctgaagagttaggcccccttcaaaaatttgcaatcgagacagcgtgccagcttgagatgtttttccctccagcttacttcaacatgatggagcatctgattgtccacatcgtacctcagattatcgagattggtcccctgtacctacaccagatgtgggcgtacgagaggtacatgtccgtcctgaaagggtatgtccataaccgagctcatccggagggatcaatgatagaggggtacacaactgaggaggtggtagaatgctgcatagattacatgaaggacgccgaacccatcggtgtgaccccccctttacacgaggggcggttagctgggatggggatcgtaggcaagaaaatgttctatgatgaggactacaaagatgtagcggaagcacgtagcagcgttttgcaatagctcgccatcgtcgagccatacattcaggaacacatgaacgagatccgagcccccaaccctagaagaacggccatttggatttgtaaagaacagaaacggaaatttcttgaatggttgaaggagaaagatctgccgttgggtgattcgctgaaggaaaaaactttgcgcaggctagcaaatagcccaactagccttgtgacctcatggcaagggtacgacatcagcggatataggttttacacgatgttcaaggacaggaaaagcgcagctcagaacagcggagttcgggtggaggcgtttgacgcatcaggtgagaagaagtcttactacaggatcatacaagacatttgggagctggactatggccttaacatacagatcccagtgctacgatggcaatgggtcagagacacaataggcgtattcgtcgatgactacgacctgacggttgtgaatcgtagcaagctaggacacaaggatgatccgtgggttcttgctgagcgtgttgctcaggttttctatgtcaatgaccctccgacgataagatggccattgctgtaccgggaaagcaaaacatcattggcattgatagcattgaatatgcgtcagattacaatcaatacgacgacgtccctttgttcacagattttcctaaccggatcaaggaagttgagacaagccttgacgaagatctgttttcgtgtgtgcgtaccgatggtgtttccaaaattgtgaaacattagtacatattttggagtgtacaacttagcttgtaaacaattaatggatgagacttattttgcgaatgaatgtatttctcactttatctggtcaaatacttgacttatattaatcaatcgatatgaattatatgcgaattaaattcatgtgcttaattctttgtgggttgaaaaatattatttgattaaataattacttgattactttattacatatttatttaatgtaggttgaataatttgtgggttaattaacccgaactatttttaattcgtggtttagtaatgtacattaaatatatttaatttgtggttcaataattatatggataataactacaatttatataagatttattaattaaatgtatttaattgtgctatattatacattataattaataaatgccaactaaattaaaattttgcaaaaaaaaaatggtaggagccttcccgtgtgggccacttaagcctattatcccgtgcgggcgtattaggtcacccgcacaggatgcccatgtatatatagaggaggcgggtagaagggctgaaattttctaagtccactccaccgacgctgccaggctgctgaaaaatccaaccgccaccgccctcccaaatccccctcgccctcgccgctgccgcctcctctcctcctcggccttgccgccgccgcctctcctcgagctcctccccctcg

SEQ ID NO: 34122 - DNA, 2931 bp, Oryza sativa
caggcgggccgggcaaccgcacgggataatctattcaaccgcccggaaaaatgggtattggagtagtgcatatttagggcctcttatatataggcaccgggaacatgaggtacatggagtgatgtacacaagcagatcctctgatcacttacttcccactgactttgaatcactggtacgtgggttgttgggtagatggcccacatatcagtgacccacgttagagaaaagtaacttggaggatctcaatctgtaatatactacttctcataatttggtttataataacaatccattgattccaaatagttcagtgaatactacggattagtctacaaatgcaacacatatagtagaatcaaagtagcaagtcgatcatggcacgctgcaatggaacacttcgggctagacccttttgttttatgaaagaacatgcgacccttcttgccttaatgagcaaatataaaaaatggtgagtgcatcaaaacatgtctctggacgaggggttctgttttttctggaacttgttgatggatgtagagtggagatggctagggacagtgttgtggatctgagagaaagggtggtcatggcggccatacatggtgaagaagaggatgggaaagttgagggcaaactcttaccgaggcgattttggtgtgacggagatgtggagggcaaggtgcgggagtgtcttagcgatcatcgatgacattttagtagttagagacttagaggcagggcctatgtgcgaagagagatagagatagagagatgggggacttgacatgtggacctagggtatttcaaagaattcacatgatttctctcttcaatttaaccgaaaataaatattctaatggacgcggtgtccatgatctaattttcatgtttacagagtgttttctccccaaagtcacttcatgtagtgttctacagctaaaaccgtgaagtcatgatgtcctgttgttaacagtgaaatttggtaaagcccgaagacatcatcggctgagagtcagtgtcggcttccgagttctagagacagccaatggtagtcattaagtcgccatgctgtcgtgttcctggtggaatcggatcagtcaaaggaagcttatctagaagagtccaagttcaaggaggatgtggcatggtagtttatctattaattaggcatagtttgttagtttccttttatctttaggaaaatgtgtttagtgtccgatagggactttatcttttccttttatctttagtttctttcttgtccgacaaggactagtatctacccatgggtataaatatgtacacccggggtctatgtaatctatcaatctcgatcaatacaactactctcggcgcatcgccaccctctttcctgaggtttttacttatcaaccggcggaacttggcacctgacgcggggctgcatcggctttcgatctccggcgaaggggtaagtcctacgttccgccggccttggtgaatctatcggctatgttggtgttgaggctgcatcgcttcgatctcttggatcgctctggtttctttgatatatttgcctacctgatatctcaattctatctctagttgcattgtgtttagagacgcatcggtttagttgggactgtctcggttaggtccgatcttctgtcttagtcgatatatctctacaatcataatgatgttataaatagatttgttatatccatcacattagacagatctatcggctcatcgagtattagattatcatatacaatctcgtgctacatcggttaggttcgacctactagattgttgttgataatataagtcttgttaagccgataggttcatgctaatgttttatcagggtgctagccgataagttatctggatttagccgatgacaacaaaggtttcactgtttaacctaatctgtggattttatggcatcggacctccagccgatgcatgctttaaccctcggatcaatgcttattatatcatatcacattgctagctgattggtttatactggattatgttgttggtatattttattatcatcagccaattgcctttatattattatctacattggacatatagccgattgctcaaaaccctatcactatcgctagtatcggcatcggctggaattgctccatcggcttgtcagctgatcggctgtttgatctactgtttgcatatcttgtcagttgcagggtcaaactgactggcacgcccgcatctcatcaacctttggatctgcactggagctaagcagatctcccaggccagtgtgtgtttttcgcgtcaacacctgtagaacatgtctatttgttacattgaaggttaatgatctcttgatgtagtaggggtggaatgacatgctagagtaaaactcaaagcccagcagatcaaatgaatgagatgaagcattccttgtgcaaactgtcctagaatcccaacggccggtgtcgatctaaccataattttgctagcctaacataactcaggatgggaatggttaggtttggcccatttatccattgaacctacgcacaaatatgctccattgggcctttaggattgattcaaaactctaaatgggccaaatggtttgaatcctagaaacctgggaaacaccggatcaatccaagcgactccttcgtgtcctctcgactccttgcggccctccagcgtcatgtccttcttggcacagtggcggcggcactcggacgacggccctctagggccgtctcatcctccacggcacgctggtggcggccctccagcgtcatgtcctccttggcacagtggcggcggcgctcggacggcggcccttagggcggtctcatcccccatggcacattggcgggccctctagcgtcgtcttgtcctccttggcacagtggcggcagcgctccagtagtggccctccagggc

SEQ ID NO: 34123 - DNA, 4969 bp, Oryza sativa
tttctcgtgtgttttttgcctttttttgccaattattttctcgtgtgtttttttgcttgttttttttcaaatgttatttttgttgctttttttaaaaacaagagaatatagacgaaataaaagccgtgtagtaggtggcaaaaaatcgatggatcctatccgactcagagcgatttttttaatagacggtgtttttttcttgcgcggttttttaaaaccatttgttaaaatggcgcgttttttctgacagttttttccttgcatgttttattttttaaaaaagttaccgatgatggaaataattttcctcgcgcgtttttttatttatttatggaagatggaaaacctttttagcgtgtttttttgcgctttttctgacttttttctcacgcgtttgtttgaaccgtttctattctctcgtgcattttttttaaaaaatagttagattatattagagatagagaagagatatatattgattagaaattttgccctttctatttttttcctgtgtgcattttttattttatacgaacaagcgctttatttttttacgaaccatttttttcgccactttcttatggaatcggacaaaattttttagattttttttctgttttttttcgcctttatagtaatctgactttttttcctgtttttaacggaatcgaatctagtattttttttcactttttttttgccttttataggaatcagattttttttcgttcggattacgcttttttttttgccacataggggaaacggaacttttgttgttgttgtttttcttttttttttttcagctttcctttttctttttatgcacctttctgcttttgttctctcttttattattatttttaacaaaaacggcctcaagtaccttattgcaagattataggaactcaaatataaatataaaaattatagggactcaaaagcaaaagtacaaacccaaaaattaaaatcatataaaaatggaatgctctcgacctgtaggttccgttttattaaacagatctctaatccggcacatcattttgtttcaccaagatatgtgagatatcacggtatagattaagaatcggatctatagtcggactttttttctgtttctgagagggaatcggataggagtcggaccttttttttttagcttttttttttacagacgaaggaaacatcttttattattttttaagtagtagagacagagacagatatagagattttttttcgcttttttgacatggaatcggattattttttcgcccttttttggatcggacatttacggttttttttctcgctcgtccgtttttttggggcggtttttttgtcgccctttttcacagaatcggactttttttttgcccttttttattggacagttacggtttttttcatttggtttttttcgccggttttttgtcgccctttttttcacggaatcgaattatttttttcgccggacagttacggtttttttttgcccagtttttttcctcgctcgtccggtttttttgacggacgatggaagcatatctttttaagtagtagagaagagatagagatatatggttttgatctcctgatgtgtgctgaataggacttggtacgatttaaaccaactcctgttcggttgatttacagccaatttggagtgttgatttttttttctatagtcagattttttttatgttatgctgaaccttttttagatggaaacttgttttttttgtcatggtggggtatcgaatcggttttccaaggcggttaatttttttccgtgttgaatagaaataggacttttttttttgctgcgcctcttttttttttgcatttttctgccctttttttaaattttatggtacgataggaataggaatcagatgattttttggggcgcttctttttttttttgccttttttacgtttttttttcgatttttttcctttttttgctttcttttttgtcggacagatttgttttttttccacccggtttttttccgcccaggttttttttatcggacttttttttttctccacgatacatataattcatttttctttggaataggacagttttctttttatttttttaaactctttttaccgcgtcgatgtagtcggattcgtttcggtattttttccttttttttcctttttttttgtcggacatatttgttttttttccgcccgtttttttttcgccaggtttttttatcggacttttctttttttcgctcggtttttttctcccgttttttgacggacgacagaagcacctagagaagtgttttttttcttttctccaatccaatacagatcggatctcttccagggaaatcagattttttttctccagggaatcgaactctttttttttcgctttttttattcattaaacggtttgtctctcggacttttttttccctttttaagggatcgggtgtttttttgccagggacgggtgtttttttcgcccggttttttttttcacttttttttggatcggactttttttttcgtccggtttttttatcggacaaacttggttttttctgcccggttttttttcacccggtttttttgacggacgatggaagcacctcttattttttaagtagtagtagatatatatatatatatataatgattcttttatgcaccttggataaccctttgtttcatgaatctatgaactggctgttgtatgaattggttgatgtctcataggtttaatagggtaaccctttgctccattggataaccatttatttaataaaaccatcaagggttgccccctactaaaccatgggccagagtggtcatgtggaatggtttaggtcaatccagaacctaaccattcccatcttgaaacataaccactcaagcacttctttctcaagtcgtgtcaactctagttctcgatacattctattcctaacagatcaaatctcacccacaacttcctcctataacaccctcggttagcaaatacaaaagtaacaagatgaatggggtggataagctttgtagtgttgattgggtctgtccatcattccacaccaactatttatggcaccttaggccatgtgcaatgggatgcttaggctgatgcctagagaagaaaaccgtatttacttatacaccatggttgtatccggctataaaatgtcctgattgaacacatccgttacaaggctctccatattgaattcctaatatagtaatgtatcccggggcgtctcaccatcaaaccaccaatactacgctcaactcttacttccactcgcattatttgtccatttgcacgctaattaagatattaaaaggggatgtatgatcaagggaaaaacattttttgtgttctgccacttagatgagtataggtttacttgtgagtatgcagtacgcaaggtgtagccatgtatatattggtacatgcagtgatttctactaaccagcgaaacaagggatgatatataaacaaccaatgggactcggatttggcaatggatgattggttaattaattgtgggctgtccactagaagacaagggacaaatagacatgcggctgtgttaattctttcagagagttcccaactcattaccattgttcttcgtgcgcacatttttcaaactgttaaatagtgtgttttttaaaaaaaagattatattgtaaagttgctttaaaaatcatattaattcatttttaaaaaattagtaaataattaattaattatatgctaatgagttactccgttttacgtgtgtacaggaggtgcgctttcagcctcaccaagctgctcacggtgcgtatgtggagtgtgagtgtgcaataaagtccagcccacaagataatgaaaaaaatagcaggctcaaaatgttgggctcgttcgcatgtcgtgcatggtgcatgcaacgctacaaagcctcaatctaagtttgggcctatttagagcttgtgataactgtaatttttcccaaaataaaaaattcgtccaactttttatcctttttatgggaatatatagatacagggtgcaaaaaagaaactttttttagggaaaaaattgtttttgagggaaactgcaaaaaagaagctataagtcaaaagttggttctttttttatcttttctagattcttataagctggatttctacgatctgcaacatgcttgttctgttcatgacaatcatgggtgtccctaagcccgactgagcaaggcgtgtgcttggcagtggtgggctggtggccatctgattattcaacttgtatcaactggaattgcatgcaaaattaaaaaaaaagaaaagttaatattgtttattccttaatagtcagaatatgagatcagtgttaagatagagccaggttaccgacacaaagtgatactgccagccattgttcatagatgacatatgtaagttgggagtacctatatatctttcgaaagattttcatgatcgtatcacacagatttttaatctttggattaaaatccgatagatataataaaaagcaaaaagcaattaagaaacaccataatggacactaaattaccatatcctcaagaaaaagaccaaatccaatacaaaatttaaaatttacatgcgaagattcaaaaattacagtgcaacttacaaaagttacagtgtaagttttataaattacactgtaacttataagaaaatgcactgtaaatttgagtgagaaaatcgagtgagagataagaaaaaatctttcgagtgagatatagcaaaatcgatgtaagtttgtcgtcaattgtcatgggtagtgggccgatgggtcgaggccctaaggataaggatagtgtcggttggataagattagattgggtcctccctccatcatctatataaggatggattgtatcatcattctaattaaacaatgaatcagattagtctcctccaacctaaatccccctct

SEQ ID NO: 34124 - DNA, 10058 bp, Oryza sativa
gacatccagctcgagccgctgattatgaccaaggaggaggatgcgactaaggaagggcgcacaacgagagcatcgtcgtctgcaaaagcctcgcctcagctctctccaccgaaggccgtcatcttggtggagcaggaggcagtaggcatggcggcacaacatgatagtgcgtcacttgtgcccgcgtcggaggtgcaccatcagcccgagccggtggcaaccacctgggcaaagcagccatggcacaccgtgagccacgacgcgtcaccgaagccagcagcagcttttcctgtgatgccgtgtcatcccactgcgacctccacaacaaggcgacgacctctgcagcgactgccacccccagcgggcacatgttcccatcgttggtcttggcaacggcgccgtcatcgcttccctcaatgcagacggaggtaggtgcgaaggctgcggattcctcggtcaacgctccgatccaatccgcaagaggcacgatctctggaggttgttggattggcgcagctgctgcgtgggccaaccatggctcgatctgagcttacgggagatgccctcatgccccgacagttgtgggtggcgcgatttccgcgagatcatgatgcggcagcttcggagctgatttcggcggcggtggttggtgcggtggatggccggcgcccgcgcggtgttcgcggcttggataagaaggaagcacagcagcgccgtttttaccgtgtcatcgtcgattggctgcgctgcggcagagaggagctgcggataggatgttcgcctctgtttttaatgggccaacataacctttcttttgggctgttccagtggactgggcttcaagtgtggcagcccatgtcttggctgttgtgttggccaggtggggctaaccttggaaaacagatcagatatgcaatcaagcttgcaacgtgctgtggacttatcctttctctcaaagcttttggatggggtccacctgcatgtgttatcagcgagatagtatggtggtgcatcataatctttgatttatttaccctttcaattttttgcaataaagtaacaagccgagatgtaaaaggcttaagttatgttaggttttatttagaaagtcgtatgagctgctcgaaaggagggatgtagtgtcataggtagtaggccgagaggtcgaggccctagggataaggatagagtcggttggataagattagactgggtccttcctccatctatataaggatggattgtatcgtcattctagttaagcaatgaatcaaaattagtctctcccaacctaagtctccctctcatccctagcagccgtcgccgcccggctatcctcccggcggtgtttaccccctatgaaccctagcccataacaatttggtagagaaacaaggaaaaagaacaagcgcatgtgtcatacttaacatgatatatgcattgatatatgtcaaatatgtgggcatgagggttgaggacgtgcaatttatcaccaagtcaacatccaagaccataaaaagataaggagttccagtgaagaaattgtaaatttgatattttcagatataaacatatttttttcttgaaaaaaagagagaatataagcatagtttcaatatccaattgagaaatgcttaggtattccacacaagaaaaaataacttattgtttgatatttatttcccacaagaaaagaaatccatctggtgtaaactcccaacttagatcaagactattctggctcctttgctcggttagagaagagtgcattattcacccaagccttgttgatagcaaggggataactggaggcatttcaccaatatgctcaacaggttatctagtagatcataatgacaagaacactagatgattttaccccaaaaaataaaaaacactaaatgattaaacatattatatgtggttacaaataaaggctatattgccttctacatgaaagtcattatcatttctttctggggtatttcgatgacctgtaatgatataattttcatcttttgaaggttcaaacatgaattttccatggttatgcatagggaaaaattctgttataccagatatacaaacatggctagataatctcaatctctgatggctatattgtaatataaccatcaataatatttgctctatcatacttggtttgtgctcttttaatgcctacacaagagagttggccagttgtcaattgatggcttaatttggatctagatgtacttcactggtaatttcttcacccctacactccagtagacactcttattaaattctctaaaggagcaacaaagcaattcccatctgagaagatccaacatattgttttgttcccaacattcagtggaaaataaaaatgcatgtaaaatatagccagaggttgaattccattgtcatagaagagtatattgtagcaactgtaatatgaataactcgtcgcaagtattgttttttagagagaaaaatacctaaaagtgttgcgccagcttgtcttgacgcgcgcagcggggagggaggcggaggccggcgcgcggcgcggggaggaaggggagctgggcctggcggcggaggcggcggcgtctgcatcggcgcgcggggatggaggcgaaggccgtcgctggcgaagggagggaggggagccgggcctggcgacagaggcggctgcggcggcatctgcatcggtgcgcggggtgggaggcggaggccgtcgccggcgaagggagggaggggagccaggcctggcggtggcggcggcggcggcatctgcatcagcgcacggggagggaggcgaccggcgccggcgaagggagggaggcgaagaccggcgccggcgaagggagggaggggagccgggactggcggcggcggcgctcggtggcgtcggcgtctgcggaggcggcgccggtggcgtcggcgtctgcgcgcgcagcggggagggaggcggaggttggcgcgcgaagaagggaggcaggggcggcggcgacggcagccggcgccgagggaagaagcgacgcggaggaatgaaggaggcggcgtcagaagaagaagagaaaagaggaggagaggagaagagagaactgacgggtgggtcccacatgtaataaggtcaaatgagtaagggcaaaagggactttttgtgcttcagttaacaccgttagaagcccttaatataatagggtcataccatatctttaattttgaaaaaaaaggtcaaataagcaaagttgaaaaaaaagagtcaaattggtagttagcttttaaaagagggtcaaatacgcaattgccctattaggaaagcagggcccgtgacaaatttgaaaagtatgctgcaaaagaattacatgtgaagtgttgttgttaatggaatgatcgctcacagatgcagccaatgaaagactggagtcattttctgctgcatggaaaattatcacagattgtccaaccatcccacttgaagcaggattctgcacattatgtgcatgaacagtgttcttctgggaaattctatcttcattactcttgaaattcttgcaacccgtacatctgcagttctctgaacagaaaacactagctttgaagcattcacagtatttcttcagatactctgttctcttgcatttacacccctttgtatgtttacccacaatatcaccctctgctgctttgctctggaattgaaagatagaatgagtttcatacacatcatggaagcatatgttatacaagtacgcagctgagcatctcattggttcttcatatgagaaactttgccttaaatcttgctacgggctttttgcacccaatgactggtaactgctaaaatatgactgcactcaaacttagccaatgtgattgaatcataggaaaaataacaagaaaaacaaaataaagtggtaatgatatcatgacaataaattaatttctagcaatggaaaagacctgtaagttctagatgaccaaaaacaatgcattttgtgtcgctgttgctctgaacctcaaataatattcaaaaatagaatccaaggaaacaacatctaactgacttgtagacatgaaactttgtctaatgacataacaatgtatgaatttcagtccctggaaaataatatcggcatcgttaactgtgagagtttaggacaccaaagaagtctcaaaacttgagggtgccagtttcagtttcttggtgcaaaaaacgtagcatatgctctcaggtattttgaacttccaaattgtaaagtgacgacatgcacggttaacttaagagatatgaaatggcaaccctcaagcctagtggtattttaaaataattcttgggggggggggtggttgggtcttaacggagagggtagatacactttatacatttatttggtatggtggtacccaccaggtttggctgaaagccggtgtttatactgttcacaacctagtgtgaaatcgtcctttattataccttttgctcatgaacaaactaaacaggcaaacaattaacccaaaaatgcttataggctagctactagagaattagaatctgaatagagaaaacatgccatcttgcaaaaagatacatcatgccctacctcacagttgtgggctgtgctattcgaaacttttggcataaaagctgcaggattccgttccaatgcaacattgatagcatcatgtcttgcattctcatgattaacattgttgcaacagtttgtgcaattgcaaccaatgcagtatctgcctttttcaaagcactcacaatacctacaaattcagtcaaaccaaaagactagtatgtgtgaatgtgtgattatggttacaaacgaaaccaggtcattggctctagttattactaaaaaagcctagggccattaaccttgcaagtgtaaattcctcgcaagaaaaaaaaaggcttcacaggtaggaaggaaattgatcaatgatggaagcatgcaaaagttaaatgcagcatctcataattgcaacaaaccttcagagaaataggttgcaacaagcgttcagagaaacaggtaggaagggaaaagaagagatagcttgcaaaaatcaactttcaaccaacatgaaatccaactaagagttattaatttcacacaagaacatgtattctaaactttgtggttgaagagtgtctactgacataatatttctaacaaaaaatctacaaagcaataaaagcagcgccaaagttctataaaaatagtaacaacttgttttatatttatcaaataggaaaaaaaattatatggaaaaacaattcttatgcagcaattggaggaaatttattatggaacctacagcttcaggcatttcgaatacttgcagctgcagtttgttttccttgtcagtgtcacatcttttgtttcagaccacatatcgctagatggcttttgagaactcagcatcctgaagagacagaaaagaagacaatttacctcctttagtaaagtaaactcagttacgtaccatgtgaaacatattcattatctgctctcctaattttctcaattaatccaagaaactcatatatgcattagcgcaaacaatttgcaaacagtgaattatacaactttaaaggtatgcatcatactatcgcaaatatgaagctatcaatttcaatttcttcaacgaagcattccatctcactattccaagaaatggagaactcacacgtcaataaaggttgcaggccttggcaacaatggcctctccatcttcggtgaaccttgcttcagctctggggatacatgttgcggtgaccgccgctcctgcaactttgtgggcttttcaactggcaatacctctaactttggaaaatcttgtggcagtatggatgaagactgctgcacttgcagcttcttggccggaggtgggctaggcaatgacatacgacgcttctgggcaaatgttgaagggcatgtcactggaggccatagtggcagtgatgaatttacttttgccagtgggagctgatagcagggcggcccaagcgcatgcgagagcgctgccgcggtggcagcgatatctgccttggcagcatacaaggaagaggcaaaatctatcttcactgaccctggacgaagctataacggcttctccatttcccaccagttcctagatcccactctggtgccgaattaaacacctgatcagacaaaatcaatcctcttctccgagatcatctagcacattgcagacaaaatcaattgggattgatcagtactaaatatttggacctgaagtctgagcaaaatcgatcaaaactcacatgtaaatgaaacaaaagaagaagcgaggatgcacatcggtttcagtcattttgatcactacgaaacagtggcggatctaacatgggaaatggaggttcagttgaactaccccgaacattttgagaacaaacttaaggcaaatttctagaacagaagctagggttaacgcaaattcgagaagaaaaaggtacgcgggtagagagaaagagagagagagctgagaaagtggacgtgcatagccatggatggatgctcaccaggatacggcggaagcagcaggacaaccgacggcgcccctactcgctcgcgggatggatggggatcggcggcggcggcggcggaggcggcggacgaactcacggggagtcggcgtcgccgccgagaggaaggggaaacaccgccgcacgactatttcctttttttttcttttttttaaacaaaaataatcgtttttggctacattttattgcccatgatttatttgatcaccattcaactcgtgttttcactttagattggaccacccaactcttttcttatttaataaacatctagaaaggaagcccgcgcagatgcgcgggcatcttatttatatagtttaatgaaaacaatgttaatataagttatatcgcatcatttatacgctgtgaaatagaccgtagactttaatatataaaaatgataaggatgtctctagggttttaaatctcccactatagctgtttgagaaggattctagctatttgctctcatgtacaatttagccgctatagctccatttagcccgatatagctgcggctatagctgtaagctaaccgctaaatgccttaggccactatttaaaacattggatgtctcccatattaaaaaaaatcactttgttctggttgtcacttcaaactgtagactttattatatataaatgataaggatgtctcctatattaaaaaaatctgtttgtcatggttgtgacttcaactcattatcattgtttagaaactaagtacctattaatagataaaactccatatatttataccagtaaaataagtctaatacattattaatacactaaaatatccactgcacctaagtattcatgtctgacttattttccaatttgtatatagatatcctaaaaataccacttgcaccaattaatgggatatcattgttaaagtgaaacataaatgtccctctgctgggtgaagccgattgtagcggcaaaacttactttctctgtgtttccttgaaacatgggtcttgtatcgatatagtagtgcctctccatactagcctggagcactattttaatgcctaattcacaccacaccctcatggagtattgtatcgataaatagtaagcctagcacaattggcgagagtggtctccactggggttgcttcaactgacccatatgtatgcccttgctatacttatgttagcgtagcaaactctgctgtccatgcttggtgccctttagtaaaggacaaagagaagatgaatgcgatcaaaataatgtttttgttttaagttttgagtatatttatggtatagagtaaacaccatttatttgtggtgttaactattacttcttaaataattatgatatagataaaatattctctttcaaaaatgaccgaggttaataaaagattatagctaaagagacataccgccaggataatgttcagagcaccatcttattatttaaattttaacaaatatctatagtttagtgtttggtttcttttcaacacctattgttgataatcacatgagacatctttaatcatttggataatgtacttatttttttcaaaacttatttacaatatataactaatttgtaagagaacacttatagtcacgtcggtggcatatatcacatacatccatcaattatgtctcatatgttggaattcctcaactataaaaaaatataacatgattggtagtatgttgcacatgttacttgattattcatttgttgtcaaaactatttggcaaagaaaataaaatgtacatataaaatcataaatctcataatggattaaggtgttctattatatcaagatcattggatgaaaatatttttttatatctatgtatcatgtgctgctcacttctcaaataccaatcaagtagttatagaaaattcaaaaaaaactttgagaatcttaatctcaaataaattaaaattaaatcaaagatagttgaaaaaaacacaactaaattttgttgtttttatgtttttacatatgtagatttaaattagcgttgtatatttgttaagggattttttacaccaaaatataacttgaaattattttaaaaaaacatcatatcactaattattatttgtcggcccgatgtgtcgtgatgtatttatgacataatataacttttataatatttatttaattaaaggaatacaacaaagatcacaaattagatacataattttaaaataatttaaaatgtgaatgtttatagaccgattatatagatctagtttaacattgtgtatttgtggagtaatatattttatctctatattgtagaaaattatattttaaagaccgtcgatttttcttccaatggttatatgtaagtatgggttttttttctgccacgtggcactatctaatctcaccgccgattttcatttaattggtggacccgttattttaaaccattagattcattaatttttatttaatttggtggacccattactttaatctaatcattatttggtgtatatatatatatatatatatatatatatatatatatatatatatagacacacacacaataccttcccggtataaaagtgggaataccatcggaaaaaaatcaagtatgtctagtacgtatgattcgggaaaaaaaaagagcttacgttgtgtttgccccaagaaaaaaaaagcccgtgccaaaaaagagataaaaaaatatgtacaaagtatcatcggaagaaaaaataaaatataattttctaccgtataagataaagcgaaaaaccatatgcacatagtaccatctatatatctatctatctatatattatatactaaataaaatacattaaacctccaacaaacactcccaaaccgtcacatgacaccctataaatactctcaagtcgccacgtggcaccctaataaaataaataaatctaaccatcgatatttatttaaatcggtgaacccattattaatgtgaatgtttatagaccgattatatagatctagtttaacaatgtgcatttgtagaataatatattttatctctatatcatagaaaattatattttaaagaccgtcgattttttttccgatggttgtatgtacgtatgaggttttttctttatcgtatatggcagaaaattatatttttgatttttttatgatactatgtacatatttttttagctttattttttttacacgcgtggctttatcttttttatcggtcctaagacctaagctttattgtttcttccaaatcatattactattttttttccaatccaactatacgtattttcttttctatacatgaggaaaatgttaggtatatatctaatctaatgatgtccaccaattttaaaagaaaatcgaggatgtatataaatctaatctaatgatctaacgggttcactgatttaagtgaaaatggatggtgagattagacagtgtcaggtgacgatttgagagcgtttgtagaagcgtcatgtgacggcttagaagcgtttgta

SEQ ID NO: 34125 - DNA, 6465 bp, Oryza sativa
ctgtgatggaacattcaggtgtttatcgttcctaagctttatcgtttcttccgaattaatcacacgtacgcattttcttctgtatatacgagaaagatattatgtatatatctaatctaatgatctaatgatttaaaataacgggtccaccaatttaagtgaaaatcgacggtgagattagatagtgccatgtggcgaattgggagcgtttataggaacgctacatggcggcttaggagtgtttgtagaaagtttaatggacttttagtatataatagaatagatgttaagaatatgtttgataaagttccaacttctaattttagcttcagagttgggtctgaggagagttgtggagctgcctaaactcagctctacctatctagttcattttgtgagagagctccacccaactccgctcccattttaggtggagctgaaacagtttggctgaaagctggagctgtgccaaacagacccagtacgtcggctcttacttatcaatgaaatctcacaaaccatttttttttcatacaacaagttgtatgtaaatgaataaaaaaaggttgagaatggtctaaagtagtgcaaaggtaagatacccggttcaattaaaaatattggttaaatggtaatctaaaacagaacatccataataaaaaggtggtccaaagtaaaatttactttttcttttctttgagaggatttaattctcagataacggaaataaaacaaagaaaagataatgactctttaaagatttttagatccaaaccagacaattcatgtcacatgtggacacgtggatgaccaacatcgaaacaacactatctctatctaccgcttgcatcatcgatcacagtatcctctagaaagttcaattgatctctttcctctgcgtggatcgttttcttttacctacggcacattgcaatctgtgctcaaggccacgatgcatgattcttcgcccaaatgaggcctaatcgcacccacattagactcccaaaaattcttatcgattgcgtaacactaatcgtcgtccaaacacttctctgactcttaatcgtgctcggatgcactgcggtcggcgggcacataatctcctacgcccctcccccaacaaacgcacgcacctccgcaaatcatgtcatgtgccccccacgaggtcgcatgcagttccaatgccaatcgctcgcgatcctttcttcttctcaaacgcagcttgggcgatttaggctaatgcaaggatctacatccccttatataagcattgtcgcactcatcacgtttgatcttgtaccaggcgtgaaggtgtgtcatctacctttaacctaactagatgaatacccgcctcgttgctgcaggaaattaagttgtataatatgcacaaatcagatgcaatatgattattaaaactaaaacaaattgatacttatgaattttaagcctaaaaataattgagatcgcatggtattacgagatatgaaagaagaaacaatttaaaccatagatttattatttaaaggctagaaataattgagaaaaaacataaataatattaactacacttagtggggatcgatgaaatatatgtataatataggataagcctagcttttggttcgtgccacaactatgatcaggctatccatagaaatttgggacctatgccttatatttaacgctaacaacaaagagctatactaaataagcatatccacctattaaaataggggtgatctaactaagaagaatggttacaccaatttagagcccatttagattggtgccattttaaactatatctttttcttaagtcgataaacatgtggatgtgtttagtttgttaccaaacattgataatgtataaataattttggttacaacatatttagtttatcctaccaaaatttgataatattaccaatttagtttttctgaagaggcccttaatttttgttactaagttaaacaatggaatccttattgtttggaacacacacttatattgttatcacaagatacaactattcgaggtagctatggttgtcatcgaacacttaccagagccaagaaaaaaaatctcgttccacccaaatctaatggattagaagaaatgactttgaaaaaaaaaggtaaaataaagagataccaagcatattgaaatgcattggtgtagattgaaaatatacgattttagggcctaaattttatggccatgagcggtcgatcatcttaagcacagggataggtgtagctatggtataacaccacttttaagaaatcaagaccattcatgattagtacatttttcttgccacaacttgtcattcactgcacctaaagcctttcagaaaacttttcaccctgtcaaatcgaatgtttggacacatgcatggagtattaaatataaaaaaaactaattacacagattgcgtgtaaattataagacgaatcttttaagcctaattgcgtcatgatttgacaatatggtgatacagtaaacatttactaatgacggattaattatacttaataaattcatctcacaatttacatgagaaaatataatttgttttattattaggctaagtttaatactcttcaaatatcaaatttgtgtccatatagacacggtctctctcccaccgaaacgtaaagaaactcgcgagttggccccacgtttcatcctcacgaccgtgtccaacccagggacccaaaccgacctccctcccaccacatccccagttccgccgcctccgcttccgcatcgcgccgccccggccacgaccttctccgtcgtcgtcgtcccgtcccctgctccgccgcgtcgccgccctcctcggcggccgcgtgcgcgccagccaccgcctcctctcctcctcgccgtcctccgccgccgccgccgcagccgagagggcgtcgccgccgtcgcccgcagacccggataccgtgcacatgacgatggctgcatccgagtatgtccccttaccttcctccccttcgttcattccctcaagatcgtgtctcccgtattctgtgtggaatataggcctaataggaggtttctgctgaaaacttttggtaacctgatgttttctgttttgatttggtaagatttgatttaggtaatctgtcgtgatgttctgggaaattatgcggcctcccttttgaggtttttttggggctttgcactgacaaaataccgacatagcgaattgaatttggagtcagctagtcaccgtgtgctatgttaatctgctttggaaatgctacaactggaagcacattttctgaacattttcactagttcagtaaggggggaaaatgcaaaggcctgcatgagttgtatgatatcacagaattctatatgtttgggtatgacagccacaaaaattgggtgttggattgcttttttttttccttctaaatggaagattatgttggaatctgtgaagtgtaggataactacaagcaatgaatcataaataagttgttccgatgctcagagtgaaaaactataaacaatagtattagacagccgaaacataatgttgtcagcactttgatatttaagttattgctcacaccttcatttcgcgttcccggaaataatagaggggcaatagaaggctttgacgcccttcattccattgcgccagagctaaatgctgtgttgattatacaagtttgtttggtcacctacccttgcctatatttctcactgttgaaatggagtattctttttgggctataccagggtttctgtgacaggatttcaattcttgttacatgtattcagggtctctagatgaatgcattttctgttgttaatactatacagtagaagtggtttcatatgcttacacttatatcccatatgtttgcaaaacctttaaaatattatgaaaattttgaaatatggacattgctaaagggatttcctgaaatttcatcagagaggtgatattctttttttggaaacaacaaatatttcctgctctttttttgtcttgatttattttcaactgttacatttgaatatgctacttctatcacattttgttcaacgcagtaggaacatttgagaatttaatttgtgccaagttgacttcaaatatgcttttggtgttcaggatgtatccccctcgttttacatactttcttataattttagttttcctaacagttccgcatttttgtgttctttggaaacttaatgcttcacagagattaaaagaattacatgctaaagaaccaccttctgaaggtaagatgctgcgattaagtgttgaagctggtggatgttctggattgcaatattctttctctcttgacgtcaagaaaaactcagatgatcggtatgccaattttcctgactggtttgtccattttagacaagtttaaattctgtatttcttctaagcatttttgtggaaacttatgaacagagtgtataccttataggtgatttatgcagtgagtgttgcacatacttcatcaatagttttacttatctcaacaattgttgttacacatgtaggatctttgagaaagatggtgttaaattggttgtggacgatgtctcatatgactttgtgaaaggtgccactgtggattatgaggaagaacttatacactccacgttcgtggttagtttaaatttgacctgtttgattctcgatttgaatactctcaccatggaaacatgtttggtcaaatcttccgctggatactaaagttgagaaagatgtcagaacttctcctagtgccaattttatgttgtgaattgtatttttactacgacttctcagctcagtaggcatatgcataaaattaaaaggcagaaatacttttctactgagttagctagtagctaccaccctatcattgtaagacgaattaaagaaatgatattggtttgatcattttgggtaaaaagagcaatttcaaaccactagacaactgcatgtttatttctttttaatatcaagatacaatgcactaaaaacaaaagttccttctcgtagattttcacaagtcacatgctggtgctgcaagcttgctgatctgttagtggtgtaacaaagatgaattattaaatgaataatcttttccattatttggtctggatatttaaatctttttcctcttccaccatatatgtttctctggctcttcttcatcatgacaagtgcacacatggtttctctggtctgaaggggttattggtggactggggacatttaggtgttagggatacattattttagaattagttgtcctccttgccctttgggtgttagggagaggttactttacaaatacttgtcaaccttgccacttccatgaattttgtgctctacagcaatcagcatacattcaacatgatattgttctaaagtttggattcagaatgtattgtatttatattggttacagcttatattacttgtaatctgcaggtgtcaaccaatccaagtgcagttgggggctgcagttgcaagagttcttttatggtcaattagtttcagctttagtagcttgatgagataggtaatatgtgatagcattctgtattgaaatatacttcattgatacatgtgtacaatttggtatatttggtggttccaaagatattatttctactgcttctaccttgtgattcttgtgattacaagttatgtatactgaatcatttggccttcagtatttatttgtttgttgcttctttcaaagtgctaaataagatgcaatcttttgtaacagtgatatgagtgtatatatgtcagaattttcttactatcttgaggttgatcctagtgctagtatatataatatagggtgtggtcgtttttctattttgtctgtggtgcattggtaaagtatcaagagttccttgtacttaaaagattgatcgcatatgatttctgtgcgacaagtttatctcaatgaactaagtccctttgggtatgatctttttgctgatatgttttttttcgtcctgagtcctgagtacacgatctagcaccatgctttacttcaaactcagtgattcccaggcagttgcttgatatctttggtgatcaccaggtatggtgtttgtgagatatcactttctgagtagcagacagttccaaaaggtaaatgtactactctgttcactgaagatcgatctgaactagttgttttacatggcaagaagttgagaagagatcttatggtggatatttaaaagcttactgcccgttagagtgatatattctctggattttcataggcatatagagccaacaacttgataaactcctcatattaatctcttggttaatcctcaaaaccacaatgttttgttctacagcattgcagatctaagagcagaatgcaactacgaaggcaaatcttcaaatctagtgctttatctaacttggaacatattgtgattcctaatcattctcctggatt

SEQ ID NO: 34126 - DNA, 292 bp, Oryza sativa
agcctccgatgccaaagccaccccgtgttggacttagccactaagcatgtctcatgtttggctttacttgaggaaaaatccacaagataaaattttcccatgagaacacccttaaagactaccgaggaatcattccttctatagacggtcacttcaacatcggtaaaaagacaattgtaacccatggaacataattgaaaaacggaccctttcggaggtgagattcgaccttcacaaacttctcccggccaaccacaagtagatcggtggctcgggagcaacacctagccgc

SEQ ID NO: 34127 - DNA, 710 bp, Oryza sativa
  unsure (1)..(710): unsure at all n locations
nnnnnnnnnnnnnnnnnnnnnnnnnnnnnnnnnnaggcatgaaggccttagaagaaagaaaaagaaaaaaagtaaagattggcgggggcctgggggctcattcaaatgcacccgggtcgctggcctcgtcgccaccgtcgtcctcgccgctggcgtcgccctcctcgtcggaactgggggcgaacgcgagccgaggggccgagccctcgaagccgttgacgatgtggtcggcagcatccccgacccgcgcgcgcgcgtcatcctcggtcccgggagggaactcctccagcgccatccagggagagaagttggggtcccgggcctggtaactcgctagcacgagttcgaccgccccccgggcgaggtccctcgaggatgccttaatggtcttctcgagctcctcggggagttgctcgagaacccaagccatcctgttgaggtgcggagcgaggccttccagattggtggggggcaccgacgtctggcctccccagagtcccgcttgccgaccggcgcgcttcatgcgggagaccgcatcccaaagcatgtcgggcccaatctcgcccgccaagcgaagggcctcggcctccccggtggaggagtccagcgctcgctgcatctccgcgacggtgtgttcggcagctgcgannnnnnnnnnnnnnnnnnnnnnnnnnnnnnnnnnnnnnnnnnnnnnnnnnnnnnnnnnnnnn

SEQ ID NO: 34128 - DNA, 13023 bp, Oryza sativa
ggcagaaaccatgtgaagaaaactgaatattgtgctgaattctaagcaaaacaacctaaaccctgcatcaagtatgatcttctgcaattcatcagccctctgataattcttggtcatcagtgcttcggcacggtcagccgctgttctctgaacttcctgggcacattcaaagaccccgggtgatcagctgtgacaacgtgaacagtaatcgtgtcgccgtcagttacagccttagaatccacctgaagaaactagcacacatttttcagacattcaactaccacagcattgctaaaggatatgccaattgcaaagagagtgaggcctcacggggagcgtgtgcagctcatacttaacaccttgaggtttgggcgtcaacgacattatccaattaaatccatggcttgataccttcttctgcaacagcaaagtaaaacgaccaagaaatcgaatttaggacaccaagacattggagtttcttcaccagctgaatctacaacggttccactatcaatcttagacagtataaacaggtcaacaaaaagaaaaatcgacagatttcttcagatatatgtagatctgtaatttcagtgctaatttggaagggaactcagctaatcagtggatttaaacgcgtcaggaactcagcgctcatttctcaatacctgcgggaacagcccgtggcaggcatttccgacgaggacagcagcggctacaaagcagaacagcaccggcgacgtaccgcgccgctccttagctcctcctcctcctcctcctccgccgccgccgccgtgggcatgggcacccctctcgtggcgatgcctgtgagcggcgtacatgccaccaccaagcacccgagcccgtggtgcaccacgccgttccggtccgcagatctggccctggaggaggaggaggccagccagccacccggcgcccaggcggcaagctcttcccgctcgccgccggcgcaggcgagcggaagccgtcgcgaggccgaggcggcgccggcgcggcgggggtcgcgcgtccgtggcgtgcgaaccgagctgggtcggcctgggaccgttactggtggtactgtggcctttcgaatgtgtatcatgggctcatgggctgtatcctttcttgggcctactttttggagattttgttgggcccttaggttctaatgaactcagcacctccgttcataggcttgggcttctatctccctgtctgagctgtctccaattcaggtctgtttatgacaaagtcattggatgtttgttcccttcgttaacagatatactccctccgtattttaatgtatgacgccgttgacttttcgatcagcgtttgaccattcgttttattcaaattttttatgcaaatatgaaaaatatttatgtcatatttaaagaacatttgatgacgaatcaagtcacaataaaataaatgataattacatatttttttgaataagacgaatagtcaaacgttggacaaaaagtcaacggtgtcatacattaaaatatgaaggtagtaattgattatttagcaaaaattaaggttgtaataaaaaagctgagatattatctgttgtacttctagcacatcgaacgagaattaatgataaccgatgaaatgtctgttatagtttctttattctcgagaccccaaaatcccttatatttatagagaaatgaaatggtcaaaatatttgtatgtgtggatggagctagtattctctggctaggggtggatctacagtataagtgtcggtgtcagacaccgacggttttcagcaaaacctatagcaaaactgtttatccatatattataacaccatgatttaagcataattagcatactatggcaccgatagacacgttatgacaccaacgaatcgattttctgtatccgccactgctcccggcaaaaaaaaaaggtacaatatgctgctttaagattgtgctctttcagagaagggggatagatgattacttatattcagctttatgaagttcctgaacaacattgaattcacttggacatcctctaccagtttcagttttacaacaatgcaattctcaaatacaatacaacacacaaatcacgatatgcacttaatcaattatagtacacacaccaatcaacgccctcttcttccttgacaacccctctgccgatgtactagtgtacacactacacgatctacacttctactgtggtgtaaagcatatattgctccgggctacaagtctgaaagagctaatattataaatcaatcatctgttgttcatggttcatgttcatgctgtaccattgcgcttgtccctcctccattcccatggcttctgtggccttgacgccgcccacaagcccttcctgccagattgcgcctgtttctcccactgatagattgaaaaatcaaaggctctcatttagaaatatgatacagaacaacctgaatgttcatggtgcttttcactcaagtgatctgtgtagctgtatggtttcaatgtaccttggccagctctggtcgttggtcataggcagtatagtgccatgcacatcctttcttcaacatttgctcctgttcagaaagcaagaggcaaattatgtaccttgtgtaagtatggaagaaagataggcttcaggaaaagataaactttttcagtacgtgtcatgtgatgaaatattttcacagttccttgcagaacgcggaagcaaaagttttaaaagaacgaattaactttccttcatattccagttaaacacctgaactttcatgatcctaagtaacactccattaaacaaaactgcagtataacaactgcaagcgaaatggcacatggcgcaaactatcgcagtagtactttctaagcttctcccattggtgcacaatgtgccattgcaattcaacaagaacaaaagtgttctaacgatgaaattgatttcactgcatgattacctgcacaaacaccccatcgcagtagatatctccgacgcatctaccataccggtcctcatcatacacatagaccttcaggctctttccctgcaccattttcagaagcgcctcttttgcctccttgccgtacggcatggcgctctccggcgcatcaatccccctgcattttcatttcatttcatacgaccacctcaaacttgagaagaagaaaaacggcagaatcatttgctcattgatcgagtgatcaagagatagtagcacacagaccttagcctgatcctgtacttctttgcgagcacttcctcgcctctcgcattaggaacttgcctgcattgaaaacttcagaattgtcacacagcctgaaccattaaccatctctgaaaatttaacaaaaaactgattgatcgatgtgaagtgcaagctgatgacctatatcctgcatcagctatcatcttctgcaacccgtcggccttctgataatccctggccgcgcgcgcccttgtccgttccgccgccgctttctgaatttcacggggaacattgccggactcccgaggatcggccgtgtcaatgtacacggtgatcgtgtcgccgtcggccacggcctttgcatcgacctaagaaactagcaggtgcacttgtcagtccaagagcctttcttggcatgaaaaattcagatgatatttgttttttttgcgaggaaaattcagagattagaaagtaataatcagtctcaccgggagagtgtgcagctcaaacttgcaaccttgaggttttgggacgtgtgcagtgtgaggcgcaggggtacttgctgctgcatttggaattggaaggccatagaaaaccaagaatccctggacaagcataaacaggcatgcatcgattgttcagactttcagaattcaagcgcctagaatatgagtatgatgacattggaagtttgaatctttgagatatacctcgacgtctgctttctgatgattcttcagcgtggtgacgacgagccgcgcggcttcctccggcgtcctcggcgtcggcctggctttcttccatgtcactatcagcttcttgtacctacagcaccaggaaattttatcacagtagtactagactactagtgtccagggcttacaaaatcatgcgattatcacgcgatttatcgcgtctaataatcttttcagtttttaaaaccacggtaaacacggtaaacacacggttaccgctaaaccatgaggtgacgataatcctgatcccaaacgatttagtaaaccctgctagtatcatggcagcggtttgaggaaatcctaccgtgcctactggctaatgacaattactgcaagcatttatgactgatttaatttaccgaattctccactgcctgattaagcttcactcaattattgcggttcagtttagtaaagttatctctcgatacccctcgacgtactgaaccacaattccgtcaccaaaatcagcgaatgatatattttgtttcttcttgcttgaaaaagaaaggaaattctcttttccaaaagaaagaaatgaactttgttttttcaaaaaaaaaagaagagttattttcctcttgaacacgtcgctttcaaaattttcacacgcccaatccctcgcgattacgacaaagctcatcggctctgatccatttccagctcgaaacaaggaggaagaaaacataagtaggaggaattgaattacgcaccaattagcctgcgctttcttggaggagactacatgccggctcagcccatccggaaccttaaaaattcaaaacaaaccaaattaaaccccccaagaaaaaaaaatcccatcaccttacgacgccgacgcatcgcaaaatcgaatttcatcagcttcagcctcacgccctcacctgcgaggtggcctcgaactgctggatgtcccggccgagcgccgcgacggcggggtgcgcgccgtgcggctggtactccggcgacggcgagcagaggccgcacaggaacctgtatatgctgttccccatgcccccgacctcgccgccgaaacaatcctctcaccggagaatcgactgtgggtttccgtgcgcgaatccgcttcgggatttgaaaacttttccggtggttttgtatggatctgcgcgaaagaggcagtgtgaaagcggttttagccgtttcggaatcggagctctcttcacgagggaggaaaagctgttaagctgtcgagtcgaagcgagatttgccacgtggagggcggtgattggatccgggcggtgccctggctggacggtccggattcactgtggagcgaatcctgtggctatctatgtgtgcttttgtgttgtgtcaatgtcttgatgctgatgtcgagttaggaattactgaattaggattatgttctaactaatctgtccaggcgtcgacaggaggtttgttcccggcgaattcaggattctttgccttcaattcagggaggaaaaacgaattcaaaatgctttgcttttcttttttttggtgagatttcagaaagtcgtcgtcgttgatgctaggtggcatgcgaacaaagcagttgcgaatggcgatttggacgactgcacacgagccacctcagacgtcagttagcagcagctaagggagcagattatttgatggtgaggattctcgtgatttttaacggtcgcagcgcgtcagttcattccgttactccacggctgcactcaagatgctcaattctcagttcgagcgtgcaaggccttgctggaacctgacggtcgtgcatccgttcacgataaggattctattcacgcgagtgaatgtccgtttgtttattgtatataatctattttttaattttttttaacaaaatagattaatatgtaatatatcacttcacgaccaaattgtaacaaaatagttaacaaattaaactttagctatgtaatatattcaatcaaatttattatttttattataatttgtagaagttgaatttaaatttatatatttgtgaattcctgacaaccttgcattggcaaggattttggatttagcatctgaaagaagaaactgctggaaggcttcacgaagtggctaacacaaagcatggaatttatttatttgttgagagataaaactggaaatattgccgtgactgatctgcctacggactcaggattacttgctcacgattatcaagctgtacaaacttaatctttcctttgccatcatgatgccaggaaaccggacaaggctctcctggtacagcacgagtcgcattgaatcgtcgtcgcccggccagcaatggaggccatcttccggagactgtcggagtccgggtcgtagatgtgggcctcctgcgcagtggtcgcgagaaggagcttcctcctcctcctcttcttcttctctgccatggagagatcgccgtcgtcgtcaaggtacctgagcgcggcgacgagccacggcggaaggaatcgtcggcggcgagagccgagaaggagaggacgccgtgggggcttgtcgaggtagtctgtcctgaaactccagtggaggcacccgtcccgtccgccaacaccgggtgcatgcacatcgctgtcgatgctggcgtcgtcgtcggtgaaaccgaggaacgcgtcatcatggttgccgatggcggccggggccctccagcctcgggcatcgccaacggtgagcacaatggcgtgcaggtgcagtttgcccacctctacgcctaaccgcaccaccttgaactctttggccgtcacgtggaagcccatggcggcggcacagtgaggtcggtgcgaccgcgccagatgcagaatctcacctgtggtggggctgcatacggagtagctagccttcgaatggcctagcgacgagccgacgagagcgaggacacaacagggcttggaggctggagccgatcaccctcagactgtcagacagtcgaagcaattgccaatcgccatgtgcgtaggtgtgcggcggaagcaccggagatcggcgcaggcggcgggcgaattcgcgagaaaatgggagttgagcccccggggggtgtcacgggagactatagttggccataaggcccgaggcccgacggcccggcgcaaggcacgaggttttggcccgacctaagcacggcacaacccaatcgctgtcaggcccgtgccggcacggcccggctgttgggtcatgtctggacctatgcctcagcacggtgggctagcctggcaagtcacgaagtttagagaagtgaaatagacttattttcaaccataggtaagacagggcacaaagaatagagagaacaaatagacatattatatggcacggcccaaagagtagggacgcaaaatagacttattttagctatatatatgtcacagccgaaagagatggagggtaaatagacttatttcaaaaaaaaacacgatgggctgctcgtgccttcgtgccggcctggtggagcacgtgggccagcactgcatgagccgacgtgtaggtcgggtcgtgccggcccgacaaatcttggcccgggcacgacaggacctagggcgggctaggatgggccctatgaaagtaggatcaccgactctatgccaagttctcaaaagtgttttcttatatagaaatcaccagaaaagccccgatcgagcacttgagaaagactaaagcttgaaaggggcttcacttctgggacttcttggctaagaggatgcttgctataagaagtataagtaggcggataacgtttcatttcttccatagaatctcaatatggcgaaaatgaagcaaggcaattaaagctacgagccgggcggcccatttggccatctatacgggagaccgttggtccagctatattagtagggagtgctgtttgggccaaattgaggtggagtctcactttggcacgacccaaagccgcccggggttgcttgttggatcaaatcacgtggctctagggccacgagctcacaaacaacaagctatttgtgggatggaaaaagtctacttcgactcccttaaaagtcggtcaaatctaattcatgccccttaactagaaaaccggataaaatgactccccgaactaatgaaaccagtgtaatttgactcccttagtggttttggaggatgatttcactgacatgacgctgttgattgggtctttgtctcatgcggcattgacgtggcgcttatatggcattaaaattaaaaatactagatgacaccccgcgcgttgctgcgggacattcatgtacacattgctatatatttcaatatatatatatatatatatatatatatatatatatatatatatatatatatatataagttgtaaatcttagtaaaaaaataactaagtaaatagaaaggaaaaagaaagactcaagtagggttggtcagatgtccagtgcactgccactcaggtagcaagacccacagcgctgaatcttaggcacaatatcttgtaatgtaatggaaaatgatgctagtgatcattgtttttttaccgaatacacgcatatttccatgcctggtcttacattctttaataatcaaattcctctgacattgtaaagataaactaaacagaaaaaaaaaaagaaagcggaggaacttaatttttgcaatccattcgatttctatagacatgtttcatagacagttatttggaagcatgaatatcaaatcaaacaattaaagaataagatttttccaaaaagaagtaaggatagactaactgtgctgatacgtcgagaacacactccgctggagacttgtatatgtcatgaagccagagttatgtgataccctgaatatgaattgaaaaaacaaaatcatttctaccaataatattttcctgcgtgctgtaaggttaaatcaaccatatatttcgccatcaaaaacaaaaataagccaaacattaattccaagacagaaattcatatttcagtgatgtaccgtggtttgaatagaatgagtctacaatctataaagcttgcattcagtccatagaaccaccacacctgcgaccaattaggcaaaagtcataaagaaaaaagattgatcaatctctccattagagcaagtttaatagtatagccaactacaggctccaattcatctatagccaatctaatagctcattcatacaatagttacatactacactattaatatctggttccacctatcatacacacacttcgtcttggaatccgtgctacagctggctacaaatatatagcctgctgcccttctctctcctcatttatctgcttaagatatgtttgcagttggcttatagcctgctattgtacctgctcttactgcagcagcagctccgtcagttcctgaaggcaagacatgttcgctgaggtttcgcaataaagcggtgtgtatgcatccgccgcgggctgcttcagctcccatcgtggtgtttagcaaaaggagatgtaacagatggaaagttaattagcgtgaaaaagatgagcgatttactcagcgtacaaatagctattgtcgtcgattcgtatgccgtgttagatggcagccgttcctctaatacggagatgacgcagcagactattggaagggttccgcatgacctggtgaccactcgtctgcaggggaaggttgaaggactccatgcctcattgcctggtgggctgagaagaatttccaatgctcctaatcgagtgaatgggccacataaaggagcatattggagatgatcagatggttgagaataactccctcgaatgatctaacggttgatttttagtggatgacatggcttcatagaatttgagctttatagcactaaatgatctttagtgggtaccaattatatataggaagaaaggatatttgtgggacccatttatcattcacacaaaaaagatataatgggcaagaggaacaagtccggggaaggggatattcgccggcgccggtaggtctagccatttcccaacattgccctattggtgggtccgcttggggctaaatacacgaacaaattgtgaatatttctgcgaggggatcggtgatgctgcgcgcgcaccgcgctggtctgggtgtgctgcggcggcgcaaccccgttctgggttgcatcctcgtcggcagcggggcgtagggatacggatcttgcgtctgcgtgcctacttgtcggcgtcgacgaggacttggaggaagccggaggaggggtggatgaagctcaacttcgacgggtcttccaagcactcgaccgggatcgcgagcatcagcaccgtgctcaggcgagggctcgagctggcggtgcagaacgggtggcgcctcatttgggcggagggcgactccaaggtgatggtcgacgtggtgcgcgaccgtgccgacatgcagtcggagaaggacctgagactgtgcagggagatcgccacgctgctcccgcaactcgacgacatggccgtgttccacgtgtgccgcggcgggaacaaggtggccgagctcggccacagggtccccacctgggtcgccggggcgtcgtacgttgccctggccgccgtctccatcgtcgttgtgccgctcccgtacccgcagctccagcattgccacgcgcgctgtgccgttgttcgccattggccgaaggggaagagaaagagagagataaggagagaggaaggggaagaagggttggagagaggatgaccatgtggccccacatgtcagtgggtcccattgtatatttttgtgtgaatgataaatgggtcccacaaatatatttttaattttaatgctatataagcgtcacgtcaataccatgtgggataaagacccaatcaacaccgtcatgtcagcgccacatcagcgaaaccgtactccaaaaccactaaggagtgaaattacactggtttcattagttcagggagttattctatatttctatctggttttttggttaatgggcatgaattagattcggtcgacttttaagagagtcaaagtgaccttttccttgtgggtttgccttgtcgcgcgtgtatgactggtagaatcatcagtagcatgcctttgtgacggcgcctagaaaaactattttagaaatagatcctttttcagctcgggcctcattggcgccgaggtcattaggcttgacagtcgacaccaattacgttggcagcgagactcataccgctgtggcaccataggctcgatgccaatgaggttggttgtttatgtagcactgattctcatcgtatccatgacttatctaccatagagatcgagggtgtagatgacagtatcattagcgtggagacgctaaaacatcggagtcgatgatcgtggcatagagaaaaaaaaaggagcattggcgaaatcaattttcgtaaagactcatttaaaaaaaacattgttaaacaaaagaacaaataaaatgtagtaaaaatcacagtgcaagtgcaacccactcatccgatacaccaccatgtccccaccttggctggaactggaagcctggaaggcgtggtccgccgcgttagaaatccaatccaccactcactccattagtttaaaaaaaaaagccgcgttagaaatccaatctaccactcactccattagtttaaaaaaaaaagtcgcgttagaaatccaatccaccactcactccattagtttcaaaaaaaaaaaacagagagagagagaagaaaaaccctaaatctcggcaatggaaggcgacgaagagccaccggcggcggcggcgatggcggccgtgctgacggacgatttcctgctccgatccatcctgaagtgtctgtgtccgagggatgtggtccgcgcggcccttgccaacaagagctggcggcgcgcggcggccctcgccgtcccccgcacaccgccgctcgtcggctacctcctgcacccggagaaaatccggtcggcccagatcccccccgtcttcgtccccagcgacgcctcgttcccgcgcctctccctccccttggctcccgacgacctctccggtgtgtccgtgcacgatgtccaccacggcctggtccttctactaccctgcgagcttcccgacattctcctgctccgcatactggtgctcgatccggcatccggacgccgggctctgctccctcctccgccgcgcgacgctctgcccgacgaccagtggcgccaaacccggcgcatcatcggcgccgcggtgctctcgcgcgcgcatcccagtaggctgcacttccaggcggtctgcgtcaccatcgacgacgaccgccctcgcgcctgggtcgccttcgtcaacggcgaggattgcctctggtgcatccttccacgctccaagcatgttagggttcttcgttttgatctcagcatgtgctgtgccgcccacgatcagggacagatctgctggatcgcctccaactccaaccaagtgctcgcactggaaccttcatctttggagtttcagttcataacttcttctccagctgctgtgccggttgatgtatttgcatattttctgtcttggccacctgcatttcttagcctgctcgaggttgttttctcacggttccaacctatttaataatttagatttgtccatgcaacaattgtgtttgctaaactaatttattgttgctaaacttattttaggagaatgatgatgcgctaactgacagcttgatgagtcttattaaaatagtcttctacaatatatgctacgtgagaggattgttttctaaggagttcttctctgatatgccttttctaccgacaggttgaaatcttatttgaatctatacctattcttttgtcacacttgtagcaatgaactgataagtttgtttcttatgacagggatgcagataaaaaagcttacgccgatggatgacgagtcccaaaggcttgttgattggctagaaaaaggtgaaaagtacccgacatagcatgagctccttaaatactttgcttgtccagcatatggttatgcgtgaaaaaacaatttcttatctgtccatttgattaacttttggtatcaaacttaggtgtttatgatgctctgaaaaagaagttcctcaaaactatcatcttctctat

SEQ ID NO: 34129 - DNA, 15231 bp, Oryza sativa
tgagctccttaaatactttgcttgtccagcatatggttatgcgtgaaaaaacaatttcttatctgtccatttgattaacttttggtatcaaacttaggtgtttatgatgctctgaaaaagaagttcctcaaaactatcatcttctctatctatgatgagaagggccctctgttggaggagtattgccgtaagtttctgctagagtggggctttggcttactaatagcatatcaagctgacatggctaatactatcacacatttacatttcttttgcagtatcattcacatacttcagcgaaattacaatcgacttacggctgacgggatccactcaaagtatatggacaatgaggtccgatgcagctgagagctttgttaatcaaatttggtgagcctcttatacttctactagaacttcatggttcggacaacacgacatgtacagcagtgaaacaggtcctgaatggggcaacatgtgaatgaaatgaaccagattttgaatagggcaaaatgtgaacaaagtgacatgcataacttgaggtgctagagatgaacatcctttttgcagtagaactgaactttcttgatctttcattccatactcaggattataatacaacctagcccagcttcgactggtatttcaatatgcaatcaaaaccaactaactggttgatcagcaaagtaaagccttgtttacatattaaaaatgcatgtgggagtattgtttacataattggttaaggatattcttctagattactatttcacctcaaaaaattcttctagattagtatgaccaaaaggcgcgtgcgagaaaattgtcatgaataaggagacccttctgtatttccagtgacctatgtggctatttcaaagtgaaatgtattatgcctttttgttcaactgaattgagtgaaccatgggtgttttctccagtagtaatattaacctgaaaaatattttatatctatcactgctgaataatttagttcatacactagtagcttccactgaaaagtactctacccatatgctagtacctgcatcctctctattctagttatagttatatatattgatccatcctgaaattctgagctgctacactgatgtactatctctatgcactgacagaaaattgttccatacaactttgttactggaaactaacacaaccttcttttccccctattgtcagcctctggactatgaacctcctttttttgagagttatgatgatatgagaaaacgttgtccgctcccactacatactactttatcagattactcacaaggtaattgtatgagtcattttaaactagttctgaacattggtctctatagccctgagtaaatgtctttttgtgctcattattcagatttgatcagtttacatgatgtaaaatcagtgctctccaacaatccctttcattccaacaaggtgataatttatctctatttatattcttatgttcaatgcatgcacctttcaatttcttttcgcctgaacaacctctgccgtctcattttaattaggtttttgcaatggacccaaaaagcaaaatccaacaagggcaccttttttgcattactaagaaagatgtccacttctattttgattctggtgctagccaccacatgtgtgatgatgataaactcttcaaaaatctccatgaggttcctactgaacatcaggatactgtttatgatgctagtggcgacccagtgtgcctgcacatgtccggtgaagtgatatatgatcaaatcaaattgagtccagtattctaccactctactctcaaatttaaagttatatatcttggtgaactggatgattctaacaccctcatgtatgttggagataaaaggattaaaatcttgatgtaaataaaggtgaaatgatcggcgaaggatatcttccacgaaaagagaaatgaatatatagttcgaagcatcatatgcagaaaagaagacaacaagctataaccagatcgatgttgtcctcaacggcaattgatgaggttagttctaggcttctagcccttctatccatacctggtaacttcctctcataatttgtctttacttgcagaaaaatttgtgggtagttgattctctatgctgcaatcacatgactggtataaagggacttctatctgatacaagacacgaggtacagtcatttgttacccccagaggtgcatttttaagctcaaaaattggaaatgtgaagactagtacagtaacactgtttaatgtgttgtactgtaagggactgaggtatgttcattacaattgaatcgtatgttgaaaatgttctcatccaataacgtatgggttgcaactgtttactaatccaatttaatgctttcttctatgcaaaaacagacagaatctcatatccgaaggtcaattagaccgtgacggctattcatgtacaaggcttgctcacaaatgcaagattcagtggagagggactcaagaagtgttggtctagctcatcaggacgagaatgcactgtattacgtggattattttcactatgtcagcgacccatctttgaagcatacgaggaatgatggagaatgcatacagaagttgaagcgtccgcggcaagatggatcctctccatctagtaggaaaaggactgcgtaaactggatagatgtgttcattttgtcttttgtaaacatgagaagaataccacccaacatacgaagatttgatgtgctctgttgtttcaacatttttaaacctcgttcttacagatgatggttgcatgctagtaatacccaggaaaatgctttttccatttgatttacattggctcgcgttagtatagccctcaaaaaaatctaaggataaagtttctttatagatctgcattaaggtttttatatgtattgctactggactgtcgagatggtccggattttaccgtgaccgaaaacaagggagcttcctttgaggcataatttgttgaggcgcgtccaatgtaatactgaattttaacacattttggtaaataccaaatgttgttggtgttgagatgcatttggtttacaactttgcaaccttaccagatcttactatattttgccaatagtaaagggtctaatctctggcatttccaccattctacctttcctataattcccatgtgtagttttatgcggccgagtagcaatagaaactaatttaaaaatataatattcatttactagcaaatatgcccgtgcgttgcaccgggtgaatataaacaaatatggatggttaagattacttgtgtacttataacacgtgcacaaaaatattgaatttgtacataccttgcaaatatctccaagttttatacatggaaatatcaaaacatatctcatactgtatacatatttagattcaggtcgtatctcaaattttataatacatgcgtgagatattccaaattttctacacattcagaacatattccaactttcacaaaatttcataaacaggggcagttatagctctgatttcaccatgctctacaaaaggaaaaaggtaaaggcatctgcaatgggaaagaaacacactttgtagtatcaaaataaaattcactaaaaaatctttagtggaatatgtgcgaattttgacatgaaaccatattaacgttggtcaaatacaatatcatatgattaatactttctagataatttttttgttggtttcatttatctaaaaataatctatgagtgattaaataattgatcgtaatttcccagtaattttaaatggcttaaaatagtagcaaacaaatttatgtaaatataaaaaataattaaatcagttgcttagaaaaataaactgattttggcctagcattgtggtttagggatgaatttcaaattcggggacaacttgcgggaccaaatttgaacttatctgtgcggagtgtatacatggcccatgaggtggcccaattatgtggcgacctgggaacggcaacccgacgcgggagaagccgcaaccgttcgatctgatcaacagtcccgattgatccggacatatatataaagtcggcagcccaaaccctaaccctaaaatcatttcccctcccccctctctctctcaaaacgacggcgtcagcggcgcctctccccgtccgccgctccccctctcgcctcccgtttcgctagcatggcacgatgttggcgagtgctcgacgcaatgcagcgaggtgagggtacgacgaccatccttccatttcccctctccccgtcggcctcgatggtggggctacgagcctacggcgcagagacggcggcgacggctgtccttctctctttctcctctgtttccgagcaggaggagagcgctggagggtggggccccggggtagagggagggggtgccagcgcagttggggatgtggtgaatgtggccgtgcccggctggccaggctatgacaggagcgcggtcgacggcaatggtgacgagctcggaacaactggatccgacgggaaactcgctcatttgtgtgattttttccctttttctagggttctcaatctgtgtaactgtccgattggatgattcttattcttttagattctccgtgtagttctattcgataggatgacttttttcaggttctcagtccggtgtagttctgttcgataggatgacttttttcaggttctcagtctgtgtagatctttgatttgattttgtgctttatccatagtacatgattggtatatagatgatgaggacatcacttcatcggatacgctcataacttcacacgttacaatgataattccaagtccaagtccagttcggccttcggagacagtactgacttcaaacggacctagcgccttcatgccaactctgatttgggtgatcttggacttcgtggaaagcttatctcgctaccttcaaacgcatccggtctcatatccaaattcatctcgagtaaacgggaatagccaaaacaagacagtgctgttgctgaaaccgaacttgggccttgggccttgtaatagactaggcccatctcataagtgtctccctccacctccacgaattagcacttaaccctagctttattttcctctataaatagctttctacatcctcaaaaacttttgggttttgtttagttgaattttgccaagtgccattcaccttgtctctagtcctcgttcgattagtcggcgactattgattcagagcccccaatagttggtgtgttgatttgccgggtcgattagatctaccacttcaatcgcaactatttctttgtgcttaattacctattcgcaatatttagattgcatcttatcttgttcttgcagtgttctctcgtttgcattgcagggatcatcaaccgcgcgtcacggttggtacgacatcgtttgtggtgtaccgattgcacggcatcctggacttgttctggttggtagccacgtcgtaaatgtcacactcgatcaaaacgagagttatcccctcaccagaagatcgggccacaagagagagcgtcatcagattgattaacttgtaatgcttgtattgaacttggtactactgtaccttttctttaaattgtgacattgtctttgcttgtgggatatggttgaactgatatttggacatgtaaacgggcatgcccgcgggcatatggcgtccgcgggcgacgggcatgggaagtactcatttcccgtcatgtagtaacgggcatgctcgcgagcataaattacctcgcgggcacgggcatgggtagtcaccacccgtgcctgtcgtgcccgactgccatccctacacataacttaccctaaccaatgcatttcaacccaaatcccccaaaatatccctaaatcagctagggtctcgacggtgaggttagcggaaggaggccgagaggtagcggttgtagcggcctcggcggtgagattagcggcaggaggcagcgcagtgcagcggggttagcggtggtacagtgcggctgaattagcggcgggagccagtgcaatggcaattgctaatcgggactgcattttctatacatgcaaggagaaaaatgagagggaagaacgatttgaggatttttttttttgggattctggtgttactatatagctacaaggagatatatgcgacgtgttgtgatgtggagggggttgagagcaaaagtgtacctacgtggcatgccacgttggcggtcaaatgcaatcaaaggacgtttggaccaaggtggtacattaaaccaagttcacggatctaaacgtgcaatttttaagttcacggacctaaggccctgtttgtttcagcttaagattattgtaatctagattatcgagccaggttactataagctagattataataagccgacataaaataagttgttagctgtttgtttctctggattattagttgcttgttagctattagccacccaataatctaaaaaggcacctttagagtagattaccatattacattaatctggcttatagattgtaataatctgttataataagatatctgtttgttttagcttacatctaataatccagattataataatcctaagctgaatcaaacagggcctaagtgacaccaccacacaagtttaggggccggccatgtatttcactcaaaaggttttatgctactagaatgttgctgagtacatagattcctattttctttcaaggaagagcgaggctggtttgaactattaatttactgaatcgagtgaagctgtgttgcgtaacaagactataggttgccaaggcctataagtacaagtggtcgctctaatggtcactctcaaacttactacttgagtgactttcgtcacttagcttctttaatagggttcaaacaatataagaattcacaatatgaagaaaaagtcaatgaaaaagtttataaattaaagcattatgattgctataaacattataattgaaaattttaatgaaaaatcttcattgttttggactgaaaaggaaggaaaaatgggtttttacccataaactaatgaaaatattagtcctcaacccgtttctctttgacccagcccataagtgaagccacggtatcagttcgaacaaccctcttcaacctccggctgaatctttctcgatctccttaaattggttgacaaatcgacgtggagacagctgcggtagagtttggcccggcagcgaaccgtgtgaactaaaaaacagcgaaaaaggaaagaaaaaaagacagaccaaaaatgcgtacgatacgaaagctttacttatttattaattcggtacggatatatatatatatatatatatatatatatatatatatatatatatatatatatatatatatatatatatatatatagatagatagatagatagatagatagatagatagatcagttcgcctgcaccgatcgatctccatatcccgcgtgcgtcgcgtacgtcctgctgcttcgtccgccgccgccgccggcgtacgcgtacgcgcgcacatatatagatcgatccgtttgtgggtgtgacatacagtacgtacagcaacgcgatggcgagcccgcgaaccaagaaaaggaagacgggcgatgagcggtcggcggcgtgtggcgtcacggtcacgctgcccgaccacgtcgtgacggaggtgctcgtgcgcctgccggcgaggtctctcgcgaggctccgctgcacctgccgctcctggaacgccgaggtgtcgttgcccggcttccaagacagacaccacgctctcgccgccgccaagttaaccttcctggagcctgcacctacgcacatggggtcgtaccgaataagaagaaggctcagtaggcggactttgccgtggctcagcaattgcttcgactgtccgagagtgatcggctccaagccctgctggggcctcgtcctcattgccaggccgtgcgaaggctactccgtgtgcaaccctaccacaggtgagattctgcatcttccccggtcgcaccgacctcactgtgccactgtcatgggcttccacgcgccggccagagagttcaaggtggtgcagttaggcatagacgaagaggtagtgggcaaactgcacgccattgtgctcaccgttggcgacgcccgaggctggagggccatctcgtcgttccagctcggcctcggtttcaccgacgacgccgccagcatcgaccgcgatgtgcagccggtgttcgcggatgggtgcctccactggagtttcaggacaaactacctcgacaagccccacggcgtcctctctttctcgctcgccgacgagtccttccgccgtgttccccagccgcctttctcaatggtcgacctcgttccggtccacttgaacggagtcagaaactaccgtctgttgcgagccaaaggcataaggtccgggagcggcgaggaagtggccatgccggttgggaaaacgctcgcggagctcgacggccgcctgtgcatggtacgcgacgtccgccaccgcagcgaccacgacgtgctgttggagatatggaagctgcaggactacgacaccgggagctggtcgctggactaccgcgtcgacctgccagcgccgggccagcgccagcgccagctgctcacggcaccgtggctcgtcgtcccgctcacctaccttggtggctccccgccgggagacaagaagaggaagcttcttgtcgcgaccacggcgcacgaggctcatgtctacgacccggactccggcactctccggacggtggcctccattgacagctcgggggacggggacgacgattcaatacgtctcttgctgtaccaggagagccttgttcggcttcctggcatgcagcatggcctaggaaatattaagtttgtacaactttccaatagtgagcatatgtaatcctgagctcgtagctaggcagagtgaatacttaatatatttgcatccaccgcgtccagagttaatcaagtgtggccagttttatctctcaacaaacaaatatatccttaatcgattttgctatatctcactcgaaagattttttcttatctctcactcgattttctcactcaaatttacagtgcattttcttgtaagttacagtgtaatttataaaacttacactgtaacttttgtaagttacactgtaatttttgaatttttgcatgtaaattttaaattttgtattggatttggtctttttcttgaggatatggtaatttagtgtccattatggtgtttcttaattgctttttgctttttattatatctatcggattttaatctaaagattaaaaatctgtgtgatacgatcataaaaatctttcgaaagatgtataggtactcccatccttaattgctacaggattgtacgtgttagccactttgtggagccttcgatcagtttcttttttagataaagtccaaaatcgttgccaacgcaagggtgcgaggaattcacaaatatatcacttaacaaaaaattcggcttctaaaaattataaattatcaacaaatttgattgtggataaattacatagttatagtttgatttgttaatcaatttgtagaaatcaaatttaaacttgttattgtatcgtgaagtgatatatttattacatactagtgaacgtgcacgtacaaagcacattgatacatagaattgttgatcatttactgatacattatctctttttttcccctccaaaaattgtatgttccaggcgtaaaaatgcacactttgaaaggaactttagtggaagtgtcaggtttcaggtcaacaagcatttttaggactccattcaggatattgccccttgggggaacaaaaataacatacaataagagaaagtgcaaagcataatttgtggcttttatcagctgaaaaccagcatagctaatagttggcacttaattaataaaggttgttctcttgttcacatattagaagacaaaaataacgaatctaggaaagcatttccccccattttgatttaggcagcaactgaaggttacatctgggagggggagggcgccggccgtctcgcccgccacgctgtgccactcccgccgcgccaggccggcaccccgccgccgcgccccttgccagagcgccatcccgtgcgcgcggccgcgccaggctggcaccccgccgcgcgccatgcccgcccctccccctctggcgtggagaatcgagaagaaaggggagaagagaacagagaaggagataagaaagagagagaaagaggaagagaagaagggaaagaaaaggaagaggacacttacagttgggacccaccttctttaatccaatgaaaaactttgaatcgaattttatcgtagtaaatgaactcatatgaaaaagttgtcaaaaacaaagttgcagaattcattgacatctaccatttttattttggtaatttttccatccgagttttattgaactatagaaaatttgaattttaaaatatatgaaattgaaataattttttgggtagtaaatgttttcaaatgaaaaaaactgtcaacaccaaatttgtaaaacgcatcaagatctacaacttttgtttgggtcatttttctatgtgactttgtttaaacagtttgaatttgaatttcaaaatatgataccttcaaacaacattttcaaatactaaatgatttcaactgaaaaagtcatcaataaaaaagttgtataactcatcaagatctataacttttatttttgtcatttcttcatccgacaaagcgatagttacattttttacaaaatttacatatctcacatatggtttcataagttataagagagatatgtaaattttgtgaacaatgttactattgctttgtcagatgaagaaatgatcaaaataaaagttgtagctcttgatgagttctacaacttttatgttcatgactttttcagctgaaattatttaccgcttcaaaatattatttgaagttgtcatttttttgaaatccaaaattttaattgataaaacaaagtcacaagaaaaatatggccaaaataatagcagtaagaacacaataacacaatagagcatgattttacaaacgtttaggaaaaagaatcatccaatttggagttcatatgagtgcgataaactagtcttaaggagctgcatgagaaaattaaggtcgatttttgcatacaccgtcaccctcaaccacaaaattggatatagcaaaattattaacactaaaatttggaaatgttgatatgttctattagaaaaaataatgaattatatttcttcgttgatttgtgatgcttagtttgaggggtttttatgttccgattaatattcgtcaccgtattcgtttcgtttcgtattcgctccgtatctgtattcgacaatattcgattccgtttttgtatccggggtttccgattccgattccgaaaaaaatgtgaaaatgaatatggtagagctagtttccgtccgtatccgatccgttttcatccctagctgctaagagatctctaagagcaagtttaatagtatagcccactactagctttaatttatctatagttaatttaatagtcaattcatacaatagttgtttactatactattaatatatggtcccacctgtcatacacatattgtgttttggagtctgcgactacagatatgtaacccactacttttctctctcatcttttatcttattaaaatatgtttacagctcactaatagtctactattgtacctgcttgaggatctgaatgaaactcaacgcaagttgagcgatataaactgaactttatcccctgcgaaaatcagaccgctacaagtctacaactggtagcggttcaaactgggcccttcaaaggtatagtaggcccagaaattaacttggaccgcaggaatcaggatcaatcgagcgtgaggacgacgatcagatgcagagctcgcgtgatttccaaggagtattcatgaattagttcccaaatcattgccgggaatctcagcgtccatcgatctagcattgcctgctgccgtggtatcatcgaaaccgatgggtctcgttgctgtttatctgaacttctttttttttttcatgtacaaaagaaaaaaaaaagagggccggggttgggggggggggatccaacatgacacacaacctcacttcatgagttgagttcatatatatatataacttgcaagtggtttaattttcatttaatttcgcatcaatcagagctgccgacttgtttaattttgtatgaacaagttcgttcgctttggtaaacccaaatgaactttaaaaagaagttgcaaaatgttgttcgaagatacaagaagatagaatggaagtcgctttgtgcttcgaaaattatacacagttgttgatttcagaatgtaaaatcggcacatcactaacacaaaaggtgaataaaaatatttaccgggcaccagaggaaatttacacaccaggcaaaaaaaccactgtgaattcagagaagaaaaagaaattaagctaggcgctagctcagggatcctcggtgatgcacgagaggtgcggctgccacggcgaggcatggctgccggtgctcatgcgccgccggtgttggtgctgctgcttctgcgccctcatcatcctcgtcgtctccggcgacgcgctgccggccgggctgcccaaccgatcggcggcgacggcgctgccctccgacttgctgcggacgtggtgcccgcggccggcgccgccgccgccggtgctcgtcctcctcttggcgtcggggacggaggcggcggggatgaggaagtagatctcgccgcgctccagctccgactccggcgacacgatgagtatccgccccgccgccccctgctgcgacgagcacggccggctcagaacgtggttggggtgcgccgccagcacctcgccggcggacacggcgcggccgtactcgtcgacgcggccgctgaggtgcacgatccggaccaggtccagcgcgccgcacggcagcacgcacgccaggcagcatctcaggttgttccccatttcttcttcgctcctcggtcgaacacttggcgatcgagctaacccaccacctacctactagcttagcttctcttctcttctcttcactgtgttgagctcggtgaggttggccatggattgtatatataggagaggacaaaatgacaaattaaggacttgtttagttcgcgaaaagaaaatttttaggtgtcacatcggacatttaaccggatatcgaaagatgttttcggacacgaatgaaaaaactaatttcataactcgcttggaaactgcgaaacgaatttattaagcctaattaatccatcattagcacatgtgggttactgtaaaacttatgactaattatggactaattagactcaaaagattcgtctcgcgatttccatgcaaactgtacaattaattgtttattttatctatatttaatgctctatatacttgtccaaagattcgatgtgatgtttttgtgggaaaaaatttgggaactaaacacgcctaaaagaagcaaaagagagagagatagatagagagagagagagagagacttaacaccattaacagtagggttttcatcacttcaccgtttggtgagatcacctcatctcacctcactactactcatcagtcatgtgtgccatgaccttatctagatcctaaacaacaattaggtttgtctaatcatggagagatgctgggttctactaagtactaacccatgttctaatgtttttttccttttttcaagattagcagctagtgccttaattagttaattgtgctgtgtttttttctttttttttcttctgctggctgcaatgattcgagcatcatggacacagccatgctgccttgctgtaccttggttgtatgctaatatgctatgccatgctaccctctgatgagtgtgcttccattgcatgcatgcatgcatgcatgagtgctgcaagctagctagccgattatactacgagtgtgaatgctcaattggatatataggagtttaggtagcatggatttgtttaagggcctccattgattagttgtttggtgccttcatctatataagttaattaacatatgaacctggccgtgcaacatcttaattttttttcgtagtagaattaaggtgaatatggaacagaccatatgctagcctacaagctaagaaagctatagtgttgttacttctgatggattgtatatataatggctacctagctttttgagacgatgattagttagtatgttaattcgacgtgctaccatacgctgaactaatcgagtgattagtcgagctgaacgcaacgacaagccaagctgtgacaaaaattattgtgcaggtagagtagtagctctctggcttagatcatcagtgcggtcaacgcattgcacgcgttgatgcttgttgccaccgtgtttcagctagattgcgttgcatgacaagtttgcattgctcgatcgctagctttacaatttagctcgacagatcgaccacagccgacgacctgcataattgttccatccatgcaagtagaggcagggcgaattaagctaggagaactattatggctcaacttcatatataaatgtatgacaccccttactactaggtataaattaatataatcttggtatttataaatatggttgtgtacatctaagtttgtgcgcaaaaaagaattacttaaaaatggactatacatgattaaaaaaactttttgaaatggaaagtattcatatattagaatatgtgtatatataaatacagtgaattttattgtaaaaaataaggtgttccacatgctgcctttcctgcgtaggaactgagcttttatgcggcacggaaaccaaagcaagcaattgacctataattaattaattattaactattataaacttaaaaaatgttcattcattttttttaaaaaaacttttatataaactttttaaaaattatatcgtttaattaacagtttggaaatatgctaacggaaaataaatgagagttaatgtttacaatatactacccctctgtttcaggttataagacgttttaactttggttaaagtcaaattgctttaagtttaactaaatttgtagaaaaaagtagtaacattttcaacccaaaacaaagttattatgaaatatatttaattatttatttgatgaaattaatttagtattataaatactacta

SEQ ID NO: 34130 - DNA, 6519 bp, Oryza sativa
  unsure (1)..(6519): unsure at all n locations
tttgcaagttcgggggtcaagatttctggtattgaggttgggggatacgatttagattccgtggtcagttgagggagtcaaagtgatcttattccccagcaagaagtgagtgtcattgccacgcgatttcaaaacaggcccaggaacagaattgtcattcccgtgataactgaagatttcgtcagctcagttgtgcctttccgggagctgtaaggcggtgttcttttctcaagaaaaaaaattaagtgttttattcaaaataagttggtatttacgtatgattaattgagttttaatcattacaaactaacaaaaatagattaatttggtattttatagtaactttcatatagaaagttttcatacgaaacgtaccgtttgactgtttggaaagtgtgtcacaagtattcaaaattttatccaatttttattggagaaaagaatagaccctaagattttctctttaatagaggaaggagctcaaaattaagcaatttgctgggtagtcaacgggtgaaaccaggttacctagctataattttctggattacatagcaactgattatcggaggttgcagctagcagagctcccaaacagggtttaggtcctgttttttttccaagagttggaagaagattaaggttttcatggcacgtttttcaagctgctaaacggtacgtttcacacaaaaactttctatataaaagttgctctaaaatatcatattaatctatcttttaagtttataataattaaaactcaatcaatcatacattaataccacatcgttttgcgtaaaaaatttagttttcatcttcaagagaaaagaacaccaccttagtccacgttcggttggagaggttggaaaccttttctctggacacggaaaacagggctatttattaccatatgattattaagcattagctagaaaataacttaaaaattgaattaatatgattttttacaataacttttctatatgctacatcttgattaattagttgataaaatggataaaattaaaggtgacaaccacctcactataaaacttgctcttaaaagtttcgggagaaggtacagctacaaaaagctccaattagagctttttagctcttgtttgtttcatagtcactcttatgacaagattctttctcgttttttaatccaaaatgtcaactgttcaaaaaagtgtggcgcaatcctacttttactagttaaaggtgtgactcacctttttttattagctaaaatttatacatgtatgaaacaaaagtatagaaaatgatgacaaacttagtatggcatccaaccagaagttttcggctaagccggcttagctgccatgtaagaacttcacacatggttcttccggtcccggcctagctgtatactcgaacggtatgaagaaccatgtgaagttttcgcttagctgcatgcctacttacatcagttctttctaatgttgagacgacgacgacgacgatcaatacagtcagctaagacaaccgatgacaattttgacgattagttgtgccgtagctttcgtgggtgagctactgactgtgaatgcacccagccaccacctcgtcgtagaggcatcctgacaggtctcactcactcacggcctcagacgggacacgggcatgtgcacaggggctctgatcgactcatgccgtttttgggtaaatccgttatctgtctacgatagatgcggttcgtgatcactgatcgccgtgttcttccaaattcgcgaaacacgctagtctgtagggctcactcccgtttgctttgcatttacgcgcggtactggctgttaattatcgttcgaagttgacacttgacactcacagatcaagttggtttgtcggtgcgcattgtgaacaattcaacgagatgaatttcgtacaaatttcataggagatcgacagatcgttatattctcaccagatcgaatttttatttatttttttaaaaaaggcaataacacttctggactattattaccgctcactaggttaattttcaagctgaagcctatgtccctttgtcaaagagatatacactctcgaggctagtttcttaacgtggtgtcttcgataatgtgtgtttggttgaaaggatattttgggataaaaaatgttgatggaacttttatgcatgtttggttgatgtgcaatgatggatagggtggtcggaaaagggaatatttcacaaaggtgctggatgagtgtatatgttcaaattaatcgattagcaataattaatatatttggttgttaattactccatccgtttcacaatgtaagactttctagcattgctcatattcatatagatgttaatgaatagatatatatgtgtgtctagattcattaacttctataaatgtggacaatgctagaaagtcttactacctccgttttttaatagatgacgccgttgactttttcgcacatgtttgcccattcgtcttattcaaaaaatatacgtaattataatttattttgaaatgagttgttttatcactcatagtactttaagtgtgatttatatcttatacattcgtataaaatttttgaataagacgaatggtcaaacatgtgagaaaaagtaaacggcgtcatctattaaaaaactacattgtaaaacagagggagtaataattaacatgtcattattaatgtttgattagatataactggtcaatgttgttatttattagtatagattagggttcaattagtgataattaacatattttgttattaatattattatttttatttcatccattctcatacatccaacgaataaaaaaaaattcttaaccatcccacgataaaaaattgaataaccatatccttgaaaaaaaaactgagacatcgtactcgtaagcacgatgcccctcatcatatcaggtcgtgtttagtttccccctattcccaactttccatcacatcatatcatatcaaaaaatttcttatacacataaacttttaacttttttttttttcaaaatctcaactttttttaaacttccaacttttctgaggaactaaacacacccacaatacactgttaataaagaaaacatagacctgtcaactttatttcatgtcagccgtcaactttgtcaaactttttgtcgggctgtaaagtcctcaaaatccttctacagtattttccctagcactagcctcgagcactcgatggagtagcgcgcggagaagcaatagtggcgacccaataggtttacaataggattttattgagaacgagaatatgtcacgggagtataccaaatgacgtattcacaggacgtgaatgtagtgttccaatctaaacaaatatataccatgcgagcaattattcaattaagcgtatctctcatcttttattaccagcaaggaagttttgtaataaaaaaaatggtttacatctccgaattgccaatgagcaaataattcatattcattgtgtacacgaggtaaatccattcaaaatactcctagaactacaaatctagacatgttcatgtctagctttatagtactagaatacgtcacatctaatcaaaatactttatatttagggatagagcatactctttctctgtccctaaataactcaaaccctagcttctcaaggagtttttaagaagagaaacaaaagaccacgatgcccttaattaatgtgaatattgtattgaataattggtaggtaagggtattaaagtaataaaatttctcattttgcggattagtggtaagtataagaaggtagaagttgatttattttggaataaatttgaactcttcaagttgatttacttcctcattagtatccagaaccgttttacttcccataaaacgtgttgttttgaggtttctcaccaaaattagtatccagtgcaaatgactgatttaccctcatttatttcattcgccacacacaaaacaaaaccgccgttggagggtggggggaggcgaagagaaagacgaagccgccgtcgaggacaccgccacaagcgtgctcctcggagtcgagcacaaagccaccaccgggatgcccgcgtcaaagttgtagccacctgcatgttgctcctcggtgagggagtagacgccgtcggcgccgagcgcccaaccaggacttcgcctgcaacctcctcgttctcatccacttgcctttgcttgatgcgcatcgacatccgcttccgccgcctgtccattgcgtccggtcatgctagccagctgcattgtgatctccacggcggcgacgaccggtgaatcaacgcgcgcctgccgcgccactcccgcgttggagaggagaggagataggtgagggagagtgggatactaggattggggattgcatgagggacggggagggggggtggtggcgatggaggagttgaggcgagagggatgacggagaagtcgatgcgagagtgcgagacagcgagaggataagatcgcattaagtggtgagaggtcgctcgctagaaaaataataataaaaaagaaacgagtgattgaaggaagtagacttgagccgttaaaaactcaaaagttcgaactgacacaggcgagccgtacgcactgtagttatgtggtgcactggtcggctccgctgaccacccgtgactcttaccacgaccccgtccccggtgcggccccacctaccagcgacacacgcaggcggcttctcctgggggcttttaactatttgtcactcttacggatgttgcttaacgatttgccactaggcccacatgtcatagacacatgaggacccacatgtcattgacagggtgtggcaaatcgttaattgccatgtcacacgagtggcaaatagttaaatttccccttctcctgagctcgcggtgaacccgaccacccgccgctatataaacgtcgccccccttgccacgacacgcgcaacgcccacccatccactcgcaccccgcgccgcacaaacacaccaagaggtggtgaactggttgatcgatgcttgctgctgctgcgcgtcgaggcggctccatcggcggcaaccgctgatcgatcgatcgatcccgcgggtttcgtagcacccgagcaggtgagcgagcgagcgatcccctcccgcgcggccgcgcctcgatttggtcgcgattggtgctggattttctctctctctctctctctctctctacctttcctgtttcggtgggggttttggtggggttttgtggctcgaggtggtcggggatttctggggtgatgggagaggggctcgcgtggtggtggattgttcgctggaatggcggggaatgctgtgccgtttgggggattgatgccatggtgatgggtcgaaatgctggatggggttgagtttgttcaagtggttttgaattggaatctgtggagtttggggggaaatggggaatggggcttcgagtgcgcaaaggttttgcatgtgcggaattgcagctcgaggttttcgctggatttaggcgtagcttctgtgcgcgtgtttgtttagcgattttagcagttcgtgggctggtgccgccgcgtgtttgaatggtttagcgctttatttaccgttacagttgatgtctgcggtttttctggtgatttatgccagtttttagaggtgaatcgctgtgttttgggggaattctagagcccagggttgggtttatgggggcgagattttagctgttggattttaatcctatattgcgagaagcatgggagaactgcgatccgtcgtcagaggtgaacgctttcgaactctgatggttttaatgtggcagatattgtgaagcttatggtagcttcgttaacttgatcgacgtttttacttgtgctgctcgtgcgttgtggtagatttggcttgtgagagagcaggtggatggggtagattcagattacagagtggtttactgcatgtagcgatgtgtttgagttgtaacttgtgaggctgtaagattaaaatgttggcatgcgtggggtttttgggggtaatattttgttttgtttttgtttttgttttttgctagtgttttgacccaatccatctcccccatctttttttagtggaaaaccgctccctgttggtactactcaagtaaacttaccagaattacaatcctccaacaaaggaataataccctgtgctgtttgttgtgacaacttatctgtacatgatattgctagtttgctactgcagtatacctacatgctcacttatgtttgtttcttttagataatgtcacttatgtttgtgttttgcataatgttgataatttctcgaagaatgggtgctggaaagaagactcagaccgagaacgagttccgtgaggggatcaatgcagagggggaggatctcctgaggaaggcaagacgcctccgcggagctaaggttcagcaccctttggactacgatcttgaagtcctcaggagcccaannnnnnnnnnnnnnnnnnnnnnnnnnnnnnnnnnnnnnnnnnnnnnnnnnnnnnnnnnnnnnnn

SEQ ID NO: 34131 - DNA, 718 bp, Oryza sativa
tcctccgcgccgaagccctaagcagggggaggcgcttgagagggtcgacaaatccgcggcgtcaccagtcgcgggtgatgcaggagaacgccgagatggggagcgtcgcctcctcgtctacggcgacggcagcacgcctcagggtgcgcttcaggctgctggcgcgctcctacgacacccgcctgtcgtccacgacccggagtctccagcccaacgatggctggaggacgtggccaacttggtcatgacggcacagcagcgcctgggtgctggtggacggtccgctaccaccaaaacctccggcgccgctaccaccggctccgtgtcgtccaggcggagggcgcggcgagcggcggcggctgcacgtcattcggctgccactccctcatcgacaccgtcgactcgggaggatcagcatggggagccggatgcccgcctcaacatcgagcgccggcgtaatagccgacgtactccccgtgcaacggagggcgcctcctcgtccagagtgtcacctcgacatggacgtgaggatcagccctccgtgcccccggctggtggtgtcggctgtagatcctttgtggcgagtcttcggaatgtccgttggcccccaaggttccggcccaccatcaccgagaagtacgatgggagcgtcaaccccaccgagtttctccaggtctatacgaccgggatcgaggccgctgggggtgacgacagggtc

SEQ ID NO: 34132 - DNA, 457 bp, Oryza sativa
gggcctacggtttcgaggcgaaaggggatcagtaataatgcgggggctcattccacgaacgaatagtacctcgaagagagagagagagatagaactcaaaatcatactcaacctgcaaaaatgtttaaagatgttatagataaattggtcggcaaagataatttgtagcctcatgaagtcatgaggcttattaccttctgtgactccatcaagttcttaagcagcatagtattctcgacacctttggatgtcaatgatccagactgcaagagagtctcatcaaaggtcaggtgagtaccctgaggtaactgaaaactcctgtaaccaatctgcagcaaaatttaggtggggttatgttaaaagtgattgttgaatgatgaaaacatcaggagtaacaaaattcttataagacaaacaaacaatatgttccttcctgattgggtggcctttctaggct

SEQ ID NO: 34133 - DNA, 871 bp, Oryza sativa
tgcctgcaggtcgactctagaggatcccccgtgtatacataaacatacaaggcgtgcaaaggaaaaattacaaattttgcaaacatgaaaataatataacaccatgcatgaatatgtagaatttacagattcaaaatcagttccaaggagatgccatgatctgcaatgcaaggggcatcaatttatatagattctaccattctagcacacccatgcatgctcatatattattctccatatatacttcatacaagcttaattaattaagcatataacactttggtgatagtaattaaactcttccataaatatcactccatgaaaaagccacatatatatgcatatggtaaatagaacactgttaaaacctgcaaattacaccccaagttgaaacagcagccgagtaacagtgacagacagcgtgaactacgaggcaagaagaggagaggctacgccgccttctgcgccacggcggcgctagagccgtggcgccgggcgccggcgccggcggccaccgacgagatggcgctcctcaccgtcatggcgacgcggcagttcttgatggccctgaagctctcgtgccgcaccctgaagcacgccgtcgacgccgccatgtcgtcgtcgccgccgtcgtcgtcatcgtcgtcgtcgtccccgaacgcgcggccgccgccgccgtgcccctgcaggctcctcatcgacgagcacgtcggcgactgcgtgctcctgaacgacagcgagtacgacgagtagaacgaggccgacgacgacgacgacgaggtggaggaggcgcaggacgacgtcggcgagcccgacaccggccggccgcctctccgcagcctgatcttgggcagcacgaacaacctgagga

SEQ ID NO: 34134 - DNA, 227 bp, Oryza sativa
cttgcctttgcttgatgcgcatcgacatccgcttccgccgcctgtccattgcgtccggtcatgctagccagctgcattgtgatctccacggcggcgacgaccggtgaatcaacgcgcgcctgccgcgccactcccgcgttggagaggagaggagataggtgagggaagagtgggatactaggattggggattgcatgaaggacggggagggggggtggtggccattg

SEQ ID NO: 34135 - DNA, 985 bp, Oryza sativa
tacgtagctgtgtattgcatgactgatgagatgaataaaaataatttactccctccgtctctaaatatttgatgctgttgacttttttaaatatgtttgaccattcatcttattcaaaaactaaactatatgtatacataaaagtatatttaacaataaatcaaatgataggaaaagaatcaataaaacgaatgatcaaacatatttagaaaaatcaatagcgtcaaatatttagagacggatggagtagcatatagaggtgcaatcgcctttgactacttggcgctaccgcaagagctgggcgcgtggagctacaacgcgaagaaacgatagaagcagcaccatcaacgataaattcaacgattacttaaaaaatataaaaaataaaattacagccctatataactaaaattacatatgtaaattaagttgatatgatatgtaagtggattgtaattttgataaaaaagatgtgtaagtaaatatgtatttgttattttttaaatataaaattacagtcctatataactaaaattacatttgcaaattcagtcgatatgacatataagtgtactgtaattttgataaaaatgttgtgtaaataaatatgtatttgtttttttgtccgttggatgtaaatctaaagttggaaaaaatttggatgatttttttttctagaaatcacccaataaatggatagtcagatccataaataaacatcaaaattatcccttatcatataagtagcaaagtactgatatagccttataaatcaacggcttagactattctactaatagtagagaacaccgaagcaacgactggctggcccgagtgatcttctgtaatccagctagcaacgtacgaatccgagttgcgagttatcgtgtataagaatgtgcgagggtatgcggtagaatcctccgtccatacaccgatcgatacaccctcttacgtatagcagcctagcaggaaacccaatcaa

SEQ ID NO: 34136 - DNA, 1455 bp, Oryza sativa
gtttccatcggaactcggaatcggtcgaaaactttccggaaattttctcggaatttctggaaatttcctcggaattaccataaattttgtgactgaaatacccttaattccttttttaagcactaaatagtgaataccatggtgtttggctgttattttttaaaaaaatatttgttatgcaaatctaaaattacataagaatattttttgtgctacattgggatttatcaacaacattactcttttaaacatagataatttatttaattagatttattagtttgaggggttttttattccgataaattttcgttaccgtattcgcgccggttcgttttcgctccgctttcgatttcgataatattcgattccgttttcgtatccggggtttccgattccgatttcgattccgaaaaaaaatatgaaaacgaaaacgataaagatggtttccgtccgtttccgtaccgttttcaccccctacatacatcttaccactatgagcatatctaactcttcaagaaattagagtgacatattttaagatcggtgaggttatgataaatgttattattgttaacatgctgctgaaagaataattattacaaatacgaacacccatttcatgtttaggacttgcggatgagcaagttccatcctaagaaatctgtaatcagctatgctatgttcagtttgcgtgagattttaaatattagaaaacaacgttatttttggtccagtgtattgtttaacctttttccaatcatcatgtacaaaaactacaaggttaaatttttaaatgaagtttattcaaaagataattttgaaacgagatatatctgatctattataattcttttatatatttagaaacatatggcacaagagttagtagtacccactagtacattagtacaaaagcgaactggtactaaaactttttaaactactcatttcaaaaccagcagcgacaagaacaaatggaaagacaagcatatcaacacaaagtactctatccgtcccataaaaaaccaacatagtacttactctgtttcacaatgtaagtcattctaacattttccatattcatattgatattaatgaatttagacatatatatctatctagattcattaacattaatatgaatgtgggaaatgctagaatgacttacattgcgaaacggagggagtatgaaatatgatacatactagtattttgaatctcgatatatctttgtccagattcattgtggtcttatttagatttcaacttttcttttcaaacttccaacttttccgtcacattgaacttttctacacatgcaaacttccaagttttcagtcacatcgttccaatttcttcaaactttcaattttggtgtggaactaaacacaaccggagctagaatgtgtcataaccagtcttatactatctccgtttttaatagatgacgcc

SEQ ID NO: 34137 - DNA, 3608 bp, Oryza sativa
tattaaaaaacggaggaagtatttgtttttttttgcacggagagagtatttcaaagagtccaagggatgcaaatgattttgtaccgtagcagtacaatctctgcttcaaggtcttgaataaacaagcggtaccacgctgtatcgcaattgaatgctactcatctgcattgcatccacgtacgtggagatgagcaaaaaataaataaataaatatagtaaaccgctccatccatggatggcaccacccacaacaagctagcccattaatttcccctgtttttctgtttggtccacaagtagatagggcacactcttgatctggacattcggtagtactaccgtttaattgcctgaattgaattttgcttaattgcctgaattcaattttgcaaatggttggatgtagtagctgtgttattgggcttcttttactctagctatgagcagtagtgtacatctctatgcaaggcattattttatatttcctgaaaaagatttatgcatattacataagtagtatctggacctatatatacatattgcagaggtccctgcaaggagtaattaatcaaggctgttttactcctatcacaattattaaagaatcatcatgaagtgcaagtctgcaggaactaaaaaaaaaggagaaaataaattgatatgtcctcaagatgatcatgtaatggcagtggcaggtatgaccattgaccaactgccttgatagttgataatgatcacacatacacagagggcacaaggagtaaatcataagataatgatctcaccactttctaatctttctaggaaccatgcattaaaaagagccaagcagaagtggggtttaggcattctgtacatgaacattgcacatgtgggttgatccattccatgcattttgattgatgaatcgtgttaattaaccccacaagacaaggcaattaagatcagtgtgtgagccatgaaggtcttaacaaaacacggcttttgtttggttttggggtagctggagtgctggacctctcaccaaacggcctgcacgctttcaatgtctcagggtcagggcgctcttggacagtagagaagaagaggctgtcagtttcagagttaattaattgcaaaattaagtactctacgttgtttgcctaaatctttgatgtatttggcattagctagattgttaattgtcgttttcattctgaaagggttggcaagtgacagcaaatgttgatcaactgaatatgtacttgtagtagctcggcttatacatatcaaaaagaaaaatggaaatcagaaaggaccaagatcctggacatgcattgggttcttgtctagctgctgcttcctacctacgcaagatttgcgtactgttgtgttgtggagtttggacaaaccatgcaaatattattctaacgctgaaactctgcaagtgtgccttgatatgtttgtaattctttaatttctagtggtaggatttggacgaagaagatggcgtagaatcaggagctatacatctactgtagaatctttggtttgagtgattcgtgactatcgatgcaagctaaggtaggtcgtccatctatggtgcgttcatctatatactcctatagtgtagtggtagcagatttccttagcctgcggataactgaatattaattgtgttcgttcagaaattggagagttccttcaggcttcaactgacctaggtaggattcatgcatcgagacgatcaccaaaccgatcgaccaatgatctctgtcaattgcccatccaaacaatgaacggacaacaagttaatttactgtaccttgcatttgcactgcacgtctgcacctagctgaagtctgaattctttcagatatactagctgggttgttctttgcacgatcagtcgggtagcacataagatagctggggttcactcaatggctctcattgcatgcacgccacggcagagcaactgctggctacgagctatcactatcatatgttgtcagtatcccgattcgtattctagtatcttacgatactacgatgttaccaagctgaaacgataccgatcccatctagcatcctaattttcatagtatctcgatcctactattcattactacacgatcctacgaaatcttaggtggtatcccgattctacgatccctacgatactacaaaatactacctacaaaatacgatccctacgatccctacaaagtattatttaaaataacatggtttgaatataatgtaactaaatatgctcaaatttatatgaaaatcagttaaatatatcaaaactaacgtgatttctcttgataaatgtctctatttgcatgacatatatcattactatatttttttatatagaatggctatatataatcaatataaatattaattaaacttaaaaaaaagaaaatctcatagtatcccgatcctacgatacgatattactttgagcaaaacgatactagctaatatcccaatcctaacaaacttacatcataccatcagtgcaagtgttctgaacttctcggcgagttcttgcggccattgccatgaaatgaattcgcagctagctgctatcgcattgggaagagggagcaagatagcagttgcagtttgggcggttgattggttaccttacctatgcatcaccaattcgccatggtcggcaattgggacttgggcggttcatcgatcaatactgctcgaccaccggccggctgctcccgtcacttcaaaatcccttatattagctagctctgctgctagtatttcttttgtcttgaaaaaaaacttttaaagatgatctgaacatatgcatacctttcatattatcatcagaacttgacttttttggacaaatgcaagttcagatttattcccagaagttatactccttgttgctactgctgtcacctcgtgtttctctcgtcttgtcatggcaacaaccaacgctaagtgcaggtgcagcaagcaggaatgggggagactggtttgccggttggtgtcgccgtgtctgcggtgatcggtgaggcgcagtaattggatactaccaaacttgatgggccgagcccgtgtcagcctgtcaggtcttggcctttttacaggcccgcttgcttgcgtgccctgacattcctttcggcccatcaaggcttacatttatagtattaaatagctcaattgtgccattcatgcaaagagtcgatatgtccgagtggttaaggagacagacttgaaatctgttgggcttcgcccgcgcaggttcgaaccctgctgtcgacgcatttttttccccttcccgtagtagggtcttgtgctgttgtccatatttatcccactttattatcttttttttcctttaactagacatgaattccagtcttcgtgtcatttatccttttgttaatattttttccctttaactacacagtaattctactcttgtgccatttatccatgcaatttattttgcttggactatatctccttgtattcttttttttttctatttcacttgcgatagatgtttagagtcttatttttagattttcttttcattcatagaatcttgcatcaaagattcgtgtacgcatagatctaacttgcaa

SEQ ID NO: 34138 - DNA, 1108 bp, Oryza sativa
gacattccttttgggcccatcaaggcttacatttatagtattaaatagctcaattgtgccattcatgcaaagagtcgatatgtccgagtggttaaggagacagacttgaaatctgttgggcttcgcccgcgcaggttcgaaccctgctgtcgacgcatttttttccccttcccgtagtagggtcttgtgctgttgtgccatatttatcccactttattatcttttttttcctttaactagacatgaattccagtcttcgtgtcatttatccttttgttaatattttttccctttaactacacagtaattctactcttgtgccatttatccatgcaatttattttgcttggactatatctccttgtattcttttttttttctatttcacttgcgatagatgtttagagtcttatttttagattttcttttcattcatagaatcttgcatcaaagattcgtgtacgcatagatctaacttgcaattacaatcagttacacaacacttgtacagagtgttagcacttatactcagttacatgtagttacactcagttatacatttacagtgcaccgatattaaatttttacaactatatttttttctagatttacaattttggatatgtttgtctctttttttatttcattcgaaacgggttgtatatattggttgaaattctgtaaaatttaaagctccaaatatgtcgaaagatcaatgggtagacctttttgcccttaaataattttaacatatttctatttattttttgagaaaaaagtatgctgtaccaaaggaataggagtactcctttttggcacgtataaacccgcggaacaaaatcatacaaaccagcatcttttggtcgaaattgaataatcacaaatctagccacgacagtgactttgcacttctattaggaaggaactgaagtgtttacaacaacctgttgtgtgaatcttttatctgatttttctttttcttatctcttcatcataactccaaaatcgaataaaaaccaaaaactaacttaggaagaggcaaacataattctgtctaaaattttgggggacaaaaaaaaactatctcctttctttttgaaaaaaaaaa

SEQ ID NO: 34139 - DNA, 16502 bp, Oryza sativa
aaattttagttaagcaaccggagggtaaatctgtctagtcaaccattttggggaaaacttctgcatgattgacctctgagatgcattctggtcgtctgatgcacacagcttcaactttcagttggatactttggagttttaactttccagcttctgtttctctaatctgcaattctgcaagcaggcaaaatgtgttccataaggagctttgcttttgtgctggtattagcattttcagttgcagtcgcggagagcagagattcatttaatgtattgggtaagtcatgaattcattatgagaatgaataatgttactaatattttctccattcttattttcatatcaattggtgtttctgatgataattctaagtagatcaagcgccgcaatggcaagcaatataacactctctacagttctaaaatataaaggaatacatttatgtgttgatctacattaattattccacatcacgttatatgcgttggtctaagattgcacaagcacataatagtaaaattggtatctgtgtgtttgctgatgacgaatgttatgagaattgcatttctgaccagtcttgcttgacacatctgctgcatatcagacatcatgagttacatttattttatctatttttgttttcattttgaaaactcttatcttcacctgtaataaaattgtaattcagatatcacacagtggtcaatatatcttcagcataagaatgattccgttctacaattttgttttcacttgaaaactctatcttcacctgtaataaaattgtaggtcagatatcacacagtggttatatcttcagcataagaatgatttcgttctacaattcaacttattagtttttgactctacggtcaatttgtcatgtatttcagctcataaaagctttccccttgaaaacaagaagacagggttaacttcagccaatggaaagctgtgtcaactatgcgagcagtactcaacggaagcactgttctacctccaacaaaatgaaacccaaactgagattcttagcatcctccaccatgcatgcgcaaacgttggacctctaaaacagcaggtctgaataaatttcaatgcccgccttggaatcagaacatgctaatttcgtcagactaatttttgtatgccaatggtttaccctgttacagtgcatcactctggttgactactacattccccttttcttcttggaggtttcgatggtaacacctgaaaagttctgtgaatcagtgcatctctgcagaaagggaacgatgcttcgcctaccatctcgaggagatacatgcggcatatgccatcatgttcttgttgaagttcttatcatgctaaaggatcctgacatgcaggtaactgccatcatttcagattttcaatggtcacaaccaattctgtattgctggggtcatacttaatcgaattcgtaattttgcagctggagatagtcgagatatttctcaaagcatgcagcaaggcagataattatgtacagcaggtaaattagtcacatttatggaaatacaaaataaatcagcctctactaaagaatcaaacacatttttcatggttgtttatacagaaaatcacttaacatcctgtaagcaaagcatttcaaatgctataatgcttttctcgaatgtgcttgcatataccgatttgagacattaagatgtcgctgatcaagcccagcacctagaaatttatctgtaattagcttagttacctgcaactttgtatcagctgaatggttttcctgatgaaatactgccattttaaccatttgcaaggcccatttctagttctgttcttctcatggcagtcctatttgtaatttttgcagtgcaagaagatggtccttgaatatacccctttgattctggtgaaatctcagaagtttcttgagacgacagacgtctgctctacaattcatgcatgcaaaacggggacacaagcatctgcagaaaccatgcttctgtctgccgcatcgtgaaaacaatgcaaatcaagaaattgctacttatttcccaagagattgaaccggtaatgaattgaagatcagatgcctgtgggaattctttactctattgctgaaacagtattgagtgaggcaaaaaaaaatgttgtatgtagagatttgtgttgtatattttgaacctacactgctctcaagtttgaagcatggagcagctgtaccaccgttcatcgatgatcgagcatacaaagttacaaactgtctgatgtcattgaatttggaagttacatgtgcaattatcgcattgtatcattatcatttgacaaacattcatactattattattcagtgtttctctgttgctctggctggtccaatggtaggtcaaatatatgaaaaaaagagtaaatattgcaagtgatacacggaaaattgtatgttaaaattttggctcaaagataattgaaacatggcatggaaggttcacttggttgataaaaatatttgggtgtccatccaatactagaacagcacttcaggctgtagaatttgctgaaaccaatggcaaatcggatggcaagcctgtaggtgcaagttcaattttttttttcacaggtattgcaagagatgcttttcaggtcagataacttatcaaatggcattgatacttccataggatcacagaagatgttgcagatccacatcttgatttagattttagaccctagtggtatacacataacattgggccacggccacaagtggattttacaagcacattttactgtgatctcatctcattgtagcctctccttcctgagcctctccagctccttcaccatctgccagtgctccatggagagactcttctcaccaaagcttgcagccattatctgtgccatcgttagccatctgcagatccacataagcagaattagtttagcaaaaggtttcatttcataatcctcatgtaaaagtaactggagatggtgtaggatgccagattgcccacactgacaggcatcagcggcacacacctgctaagttcagaacaacccaagctcctatcatcacgcatggcattgaccatttcatcttgaatcatctacaattaaggcgcaaacattatgcaatttaattaagtctgttcatgttcctgacaaacatatcagtttatttcttgatagagttgagcaagggataatcacctggtatgtatcagtttcagttgactgaggaagagacctaactgtggccaaataccatctccaactttcaagttcctcggagcttgcatttaccgcaggaacagatgatgggcggaaaggtactatcaagtcagaaggtaggatatttgattttccctcggagagaattagtagctgcacatcagttgccatttccaacttgtagaactcaaaatcatactcaacctgcaaaaatgtttaaagatgttatagataaattggtcggcaaagataatttgtagcctcatgaagtcatgaggcttattaccttctgtgactccatcaagttcttaagcagcatagtattctcgacacctttggatgtcaatgatccagactgcaagagagtctcatcaaaggtcaggtgagtaccctgaggtaactgtaaaactcctgtaaccaatctgcagcaaaatttaggtggggttatgttaaaagtgattgttgaatgatgaaaacatcaggagtaacaaattcttcataagacaaacaaacaatatgtaccttcctgattggttgtcctttctaggctgaagtgtggctgtgttgagatactcaattgacagaggaataacttgtgaatatggtagtagcctctggaacaaattatttagctggtttccaaatatagaaacactctctctgttaaagccagtgaaattcaaggagagcctaccaacggtaaccacatccaccttattacgaagctgcatggagattgagaaccaataacttagtaaactaatatgaactgtttttagcagttacaatgcaaagaaaacaacttgatgtagtatagatcagctgtgttagtgatatgacgtactctggatagaagatgcaacagtaaacattgagctgccagttcatctttccctaataccagagtaagatgtgagagcaaagattgccgaattccccttagcaggattggtgatggctgcatgataaaaaaaattgggattagttattttaaatcaacgctaaaactgttaaaccaacttctgcattcaagattcagtgctatgtacctcaaccgcaggaggccttggtagaaaatcatgagcagataagtttctccataccaagcagtgaagacggggaacctgtacaaatatttacaagcattagaagtcagaaaaaaatacaaatatgaatacactttcttttcattgttagatatgaaattgatcactatgtagtatgtacttttgatgcatgtaccttactgggaggcagctgagcggttacatcttccataaggtcaaacattatatcatccgaattatcgttaggagcagcaagttcagggtcaaatgtatatacacctatgaactcagaaacatcgttcagtttcacctgactttcaggcatatcatacacctgcaaagaatagttcaatccgtaaaccatagaaaaaaaagattgaatagaatgcatttcatgcagaaagcttaggagctctaccttcactaggcaggaaaaggagcttccaggaatatgatgatctcccccattcatctctgggacatgatgttcttcattcattgacatttctactgaactatttgagattttacaccatcatccttctgaggaaaagtaaggcagtttaaatcagattcccagtcagctaactgtatggattagatttagcatgaaaccaagcaatttggagaagcatatatgccataaatctactaagacatttaagttatcctactttattagcatgcagaattaatctacaaccaagcaaggcagttgcgagactgtgtaaatgttaggagactactaggaaagaaaaatcaatcttccttcttaccgtcttcttgctggatgaagaagtctctccactaccactttctgaaacctgcatcagtcaactcattagacgacaatactacttgttaggcagcaaagtgtcaaaagaaaccattgcaacaaacttagcaaaagcttacatccatggcgtcattatctgcacccctcttccttttctccctttgttcagatgtgaagcagcttgctattctgcgcaagtcagggccaggggacgactcgcgtgtccaagaattttgtccaggcacctgaaataaaccaatggcattgtccaggttgaattccaacataagctgcttatcagcaatgagtaagactaggattaatagcaaatgagcagcaggtgctcttggaagcggcaacatacaggcacacagtggaaaagatggcgctcccagagatgtgaatcacaagggtgtggcattgagaacggcgaggaatcggagaatttgtttgtcctccaagtggagccatcctacacaaataatggttcaaaataagcataacaagcactaaaatgcagctttacattaacttatgtactaaattccaataccttgaaagcaccaacatagaactcgttcccgagcatgtcctgaaccatcccccggaaccgaacaagggtattcggcttgatcaatccaagatttgattcatccaacaccggaacctggaaaggaaaatattcccacattccgtcattccctgaacttcctaagattcatttacacccacaatacaaaatatcctctttctctcttttttttgggacaagctcaacataaacatatgtgacattctaagtatctgaattgaaatgtttgcaagaacagcaaaaagcagttatctttcacccaacttagatctgagagcatagtacttcctaaccacatctactgatgattccaaatttaccctaagaaaacctttaatctccccgtctcatattcattatagacattcaaagatcactaactttgacgatattagggtttcagcgatctaccaaataacatcattttcagaaatcgacagctgcggcaaccatcaacacggggggggatcagacttcttaccttgtcaagcccgccttgctcgaagagaaaggagcggaacacctcggtggcgccccagtctttcccccggaacgccgccaccggctcgtgcccaccggactccgccgccgccctctcgaaggtggagcgcaccgcccccagggggttcccgacgaggtcgtactgcggccccaccatcctccctctccctctcctcgctctctctctctctcgttggggagattggggagcggagcaatggcgggagaagtggtgaggtgaggagggagaggagttatagcgggtggggttttcgcgccactggcggcggcgcttcccgccgttttctccccctcttcccgccaatgcgcgcctctcctggtacttggaccttggtgcgtctattgggcctaatgggccgtcctagcattcggcacgggagtgcggcccgtctgcgggtgcgcgctgctgccgggccgagatgcctccggcccatatgaggcctgcttattggttagcgatccaaatctggaaaaagtccactttgactcccttaaatgtaaaacgaatctaatttgtacccctcaaccagaaaaccggttagaacgactcccccaattactaaaaccggtacaaattgactccctcggtggttttgtaggacggttttgctgacgtggcgctgatgtggcgataccaacccggtcttcattccacgtggcgctgacgtggcgatactaatccggtcttattccgcgtggcgcctacgtggcattagaattaaaaaatatctgtgggacccatctatcattcacatataaaatatatcgtgggacccaccgacatgtgggacccactgacatgtggggcccaccgacatcctttctccttcccttcttcttcctcctccctccctcctctcttttctctcccccttttctcttccccattcggacgcatcagtggcggcagcggccgggtggattggcgacggatctgggcggcatggccgcggcccctgcgcccccccccctcttctgggcgtcggtttcctcgccttgtgtgataactaatactcccactagctgctactactacatcactagcttagctaatgacgtcgccaagcaaccaacaacactaaattaaccaactaaatacaagctaattaagctagtgtcgtcgtcatgttgcctagctagctagctagctaattactactccggtgagtggatggcgccatgctgccatggcggcgcagcagcggcagcacatgtccatgtcagcgtcgtcgtcgctggtgacgagcctgagcaactcacgcgaggggagccccgaccgcggtagtggccttccagagggtgtcggcgacggcgatgtccgcggtggagtgcaccgggacgatggcgacgccgtcgttgctggaagggagattcgggcggggcgggagctcgcggcggcggtcgagcctgaacgcgttcgacatcatctccttctctccggcaactccagcgccggcggcggaggtggagctgtaccgccgcggcagccgcacccggcatccgaacttcccaccgccgccgtcgcctcgctgcaggatacgcgacaacagcgaccgcggtgactggcagctctcgatgccgccgcagcgccgctctgccctgccttcgcgccggccttctccacccaccgccgcccacggcttcacgcactcccttgccgccctccgctccgccatccgttgcctcggcaagctctccgcgctgctcgccgacgggaagagaaagagagagataagggagagagagggggaggaagaaaggttggaaaggctcgccgacaggaagagaaagagagagataagggagatagagggggaggaagaaaggttggaaagagaatgatatcgggaccccacatgtcagtggatcctattataatttttgtgtgtgaataataaatgggtcctacatatatatatttttaaatctaatcttacatcagcgccacatgggacgaagaccaagtcaacactgccacgtcagcgccatgtcagcaaaaccgccctccaaaacaaccgagagagtcaatttgtaccggttttagtaattgggggagtcgttctaaccggttttttggttgaggggtacgaatcagattcgttgtacatttaagggagtcaaagtggactttttcctccaaatctcgcgcacgcgttgaccgttagatctaatcgtgtggttcagatcaagttgtggaacgtgactgagtgaagtatattttacacataggcccttcaattaatttcataatattgctagagagcgcgggccgatggttgagccgtccaagagcggcggcggcgcggcgctccggcgagcggcggccggagtcgctctcccggttggcgttgtgtatgtgatagaaggccaggaacccgcgccattgctcttctcaacaggagcaggtgagatctctgacctgtcaacggcaaggtcgtcttcctcgtcatggaccttctctccctcccatggcgtcgcccacctccgaggtctgtacactccataaaccaacctctcctcctcccataacgcagcgttgccggatctacgccctccagagtctgaacccctccgaatcctctccgttgcgtgtctctggggtaaagtaggctatggaggagcaacttgctttctatttacttcggatgctaagattgttcatctcaaattgctaatacatttcgcataaagaaattgctaatacatgcctccagatgccttttttttctcaagtcatcctactgagttggcgactagtaggtgttaattgctgctagttttcctactgaacatacctaacaatactgttatgggtgaatttttgtaggctcagattttcttactgaagaaataacagaagcaatcgatggaataactcaacaacatctcaggtgtgctccgaacctcactgccaaagcaaaattctattgttttcactagtaagcaagtgttacctataaatcacacatgccaactcgttgattcagaacatcactagtatgtaatgtaaactctgtatatcagtatatgatgtgtgcatcctactggcttgtgtaactctaaagtaaataaatataacaccattatcacccatacttacagtgattcaaatattatcttgcgacaacactgacatggccctgattacaataatgcactgcaagtgaccttgatacagaaaaaagtttatttcaatacatgatacagagggctctctgtcttactgtagcctgttttctaatgggtattccccatgatactacaacagcaatggccaacccaaggccgaatcccaatccagaaaagaggaacaacacaatatctacggatttcttcttggaagggatcacattcagaattgtcatgttgatgcaacctttagatagcggaggaccacacaaatcattattccccagaaatgagctgttggtgaatgtcaagaaatgaagtgattcaggtatttttcccttaagcttgttgtaggataggtttagcatttcgaggaagtctaaggatgctaattcttgtggaatgactcctgaaagctgatttgaagatagatccaaagcttccagctgcttcagcccaccaagttgagatggaattggcccagtgaggaagttatgtgacatatttatcccatgagttaaaacaagttccccaacaatttctgggatgctaccattgaatgcattattggagaaatcaatgaatacaagggttcttagtatttgagcaagtgtggtgtcatgacctttgtatgtgagtgaggctttatatctatatactagtcctacacttggcacagcatgatccatgaccaatgatgtatttgtgtctatatgtagcatcgactccaacttcttaaaccacttgtctttgggcaacggaccagagaagttatttgaggatatgtcaataattattgcatttggaaatgcacatgtgctttcttcatcggtgagagattgaacgacatgtccaaatagcttattggatttcagtacaagcacttggagtctacgaagtttactcatccagcatgggaaaatgtcatttatttgattgttcccagcatcaaggatctccaaattttgacaagcaagtagggatctgggtagctgtccttcaatcctattgccactaaaatatagtgcatgaaatgagcagccttcctttatagtatctgggatctccccatcgagttgatttgcatttagatttaatatttgtattccattaacgttctcgatcaaacaagatggtattgagccactaaagttgttgttagagagatcaaggtattgtaattcagttgcagtacagaaagatggtgggatttctccggagaagttgtttccaggggcattgaaaagtgtgacatgactaagatgggcagtgaaattaaaaggaatcgatgagaacatgttgtttgagtaatctagcaatcttgcagaaccttgaggtataggtatagtcccctcaaacatgttgttgctaagatcaagccaatcaatttgtaaaggaataaaagggttagatccaacactagtaaatttattatgtgctaaaatcaaactagcaacgccagaatcattccaagactcccatgcccacgatggtatagccccatggatttggttttttgaaaggtcgagccaaaggagttcatcttgactcctcaagaaatcagggaatttagtgatgttgcaacccgataaagctaatatttgtagtttagggatgtgtgttgatgaagaatcgacttttccatccaccaccacaagattattatcagatatatccaagtaacggaggtgttgtagtccccataatgatgcaagtttcattgtaccgacaagattgtttgaattaaggaagagtgtgctcagattggtgaagtttgagatattttgtggtagttttcctgaaaagttgcattcatacaacactaattttctcaatttcgttaacttacctaaaaaagaagggatagatccagttagaccacacctagagaattgaaggattgttaaagaggtaaggtttgtgatccatgatggtatggttcctactattgttgttccagaaatctccaacgaattcaatgatttaagccacccgattgatgagggcagctcccctgaaaactgacttgcaccgacgccaaggttcttcaaatatttgagatttccaatggaacttggtatttcaccgtagaaactagtctcagtgacaaatatattttccaaattactagcaactgagaaatttggtaacgaatcagatagttctagattattgtaaagatcaactgttactaatttcttgtgttggaagattaatggagatacctgtccttgaagaaaattgtgtcccagttgtagaacacgcaaagaggagaaggtggcgaagtttggaatgggaccagacaaatcattaaaccgtaggtcaataacagcaagcgagtgcatggcagaaaaggatccacaaataggaccagagagcccacagtttggtaagctaagaacccgaaggttaggagtggacgaggatagagcatcgcaccatgtcatcccgttgtcggacaagtccacagcgccgaggtagagctccctcaattttttatgatttgcgattaaagtttcaaagtttggctctttgagcacgctagattcaactgaatcaaaggacaacacagaatgaccttgtgtgaattcttctacttcaaatcgagtagataggtcgagagatactagatttgttaggcgactgatgctagcggtaggtacctggcccacgaaatcggagctggagaggttgagataggtgagcatggtgagccgctcaaaccctgtctgcgggagttaggatccattgaagctgttgcaagcgaggttgagggaggttagatggaagatcgcaggatcaagaccgccgctctccaatctacgccctcccaggtccagagacgtcacacgcccatccccattcctgcagtggatgccctcccaatggcaacagtctgtgccggccttccatgacccaaaggtggaactggagtttttggtgatggagaaagaacgtttcaaccggagcagcgccgatgcctggtccggcaagcatggaacaaccgccggcggcagggctccggtgtggttggcgtacgtagctgctgatgaagaagggacaataatgagctgggtgtgtaagaggatcagcatcaacggcaacaccaatggcttgtaacgggtcattgtggagtagcaactagcaagtacagcagtttgattgggtttactgctagtctgctatacgtaagagggtgtatcgatcggtgtatggacggaggattctaccgcataccctcgcacattcttatacacgataactcgccaactcggattcgtacgttgctagctggattaacagaagatcaactcggccagccagtcgttgcttcggtgttctctactattagtagaatagtctaagccgttgatttataaggctatatcagtactttgctacttatatgattagggataattttgatgtttatttatggatctgactatccatttattgggtgatttctagaaaaaaaaatcatccaaattttttccaactttagatttacatccaacggacaaaaaaacaaatacatatttatttacacaacatttttatcaaaattacagtacacttatatgtcatatcgactgaatttgcaaatgtaattttagttatataggactgtaattttatatttaaaaaataacaaatacatatttacttacacatcttttttatcaaaattacaatccacttacatatcatatcaacttaatttacatatgtaattttagttatatagggctgtaattttattttttatattttttaagtaatcgttgaatttatcgttgatggtgctgcttctatcgtttcttcgcgttgtagctccacgcgcccagctcttgcggtagcgccaagtagtcaaaggcgattgcacctctatatgctactccatccgtctctaaatatttgacgctattgatttttctaaatatgtttgatcattcgttttattgattcttttcctatcatttgatttattgttaaatatacttttatgtatacatatagtttagtttttgaataagatgaatggtcaaacatatttaaaaaagtcaacagcatcaaatatttagagacggagggagtaaattatttttattcatctcatcagtcatgcaatacacagctacgtacaaaattcaggtttcgcatacacctacaacaatcgacacagaatagagcaatcaaatatcaatacttgatctgcatccattcaaaaaaaaaaaaacttgatctgcatgggggaggaaatggatggacaggaggttatcttgtactccctccgtcccataatatagtaacatagaaccggatgggacacagtacaacgaatccggacatctatgaaatatcccatccggtcctaggttgctatattataggacggagggagtataataatatgctgcttcagtgcctctcacagccagaaccgctgcaaccacaacagccatggttgcgccatctccacgccttcacagggttggaaatttcggacattttggatcccttcgataagatattattttggtcaatttttttttaaaaaaaattcataaattttgataatatttattcaaatttaaataaattttgttcaaaattttgaaaatttcagaccgaaattttggtattttagtgatgtccgatcaaatcggctaaacccaaaagtttaaccctgtaccttcagtcactgatctgttgtcagttgtcaccatcgccccggacctcagcctcctcgggcaggctcctcgccctcaatcatggatcagccgccggcaaccgcaatagggaccgcgccaccattgccttccaataccggcagacgggatgcaccggctgaggagcatgtctccccgagctccgacgagccaccgaacgacgaaaataaggacgagcgatgtgtaaacgtataagaggacaacaaagacgcagattagcaaatggaggaggcacgaggtgggaggcggcaggtgttggcgaaggatgtccaggagcagatcagccgccgccgcctgcgacggctgcggtagccgcctccgcccccttgcttctgtagcgccgtctcgactgatatgcatatttacaaatttatccctcaacttctacttttcaatggacattttgccctctcacgtttctactcctgttaataagatggcagtataaatacatctagtctcttggataaaaaaaaatcaacggtttagattgatttttactataagtaaagagcaccgaagcatgactttgtggcgaaaatgatttagccagaagttactgtatacgcatagcgacttggtaattatttatttggttttgaattacttatacttttataaaatattattggattcctcgtcagtatatatgccgaggctacatatgaaacaacttctgcttgctgccccctgggcagaggaagatgtatccgttcacgttttgtgcttctaatatattaagttcttagaaaaaaacttcgacggtttatactccctccatactcgtaaaggaagtcgttttggacagcgacacggtctccaaaacagaactttaactttttatttctataaaaatatttattaaaaagtaatatatgtatatttttatgaaagtattttcaagacaaatctattcatataatttttatattttcaaactcaataacttgagagttattcatgatttatattctcaaggtttgatttaaacattgttctaaacgacttcttttattagtatagagggagtatatgtcttggtgtttcttaaatcttgcaaagcggcagatggaaaagtactaccagtagtctacatgcattgattggaagatggttaagctaaaaatgatctgatacttagggctcctttgatttgtaaaaaaagtgtagaaaatttgaaggattttaatcctatggaaaaattttctatgaaaccctttaaaacaaaggactgaatcctatactatcctttaaaatttctatggaatgggtaatcctatagagattttggaggaaagttagcaagaggtccaacctcttggaaaaattcctttgagtctatctctcttatccgattcctgcgtttttcctgtggtccaatcaaacggtcattcctgtgtttttcctgtattttccaatcctctgttttaaaatatatattcctgtcagaatcctgcgtttttttctattcctctgtttttccattcctgcgattcaaagggtcctaatggtggaggagagattaatgatgttgtttaatgggtggggactggggggaatcggaggggactttcgcctaattctgtaaagatttgtcaatccaatggttgaaattattgtgcctgtttgtcgtagatatagatagattcggtccatcgctacatacagacatgcgcaacgttctatgcacggcatgcatgggtacaatgctaattctctgcagatggagtagtaacgagtataacagggaggatgtcgtattcgtttcaaaatatttttctttttattggattgagtaaaacatatatatctttaccatgaattcttaaaaatatatactccctccgtactcgtaaaagaagtcgtttatgacaatgtttaaatcaaaccttgagaatataaatcatgaataactctcaagttattgagtttgaaaatataaaaattatatgaatagatttgtcttgaaaatactttcataaaaatatacatatattactttttaataaatatttttatagaaataaaaagttaaagttctgttttggagaccgtgtcgctgtccaaaacgacttcctttacgagtatggagggagtataaaccgtcgaagtttttttctaagaacttaatatattagaagcacaaaacgtgaacggatacatcttcctctgcccagggggcagcaagcagaagttgtttcatatgtagcctcggcatatatactgacgaggaatccaataatattttataaaagtataagtaattcaaaaccaaataaataattaccaagtcgctatgcgtatacagtaacttctggctaaatcattttcgccacaaagtcatgcttcggtgctctttacttatagtaaaaatcaatctaaacccgtgatttttttttattcaagagactagatgtatttatactgccatcttattaacagg

SEQ ID NO: 34140 - DNA, 1091 bp, Oryza sativa
cgactctagaggatccccataaaagtatacatatatcacttttcaataaatacttttataaaaacaagaagtcaaagttgtgttttagagaccgtgtcgctgtccaaaacgacttcctttacgagaaaggagggagtatagtttaacaacatgtgaattatatattataaaaatatttataatcactactacacaaatggttttttttttggcggccaaaacacatttttgctggctagtgaagataaagcatcttcactggcggtgaccaaccgccagagaagagatgttttcactggcagacggcttaaggctgccgtcagagaaaattatctttgctggcggcacccatacgaggaccgctgttggtgatatgggcccgggggtacgcaagatggagagaaagagcccttccgtccggccacgtagccgcacggccttcccccccccccccctcgggggggaaaacaagcggtcatgaagcggccaaggggcctcgggatgccctgccgcacccctcggggccctcgggcaagctgccccaaggcccccgctcggctgccacatggtggccgagtgggcggagagaggggtgctctcaagcgccttaaataagcatcgccccaaccgtcccccgccgcatttaatgtggcgtgggcggacgtgaggcgccgtccgattgatgtgcgtcaatcgggcttgatcggtctgtgaccggccaacaggcggacgggacggatagcagcgtacccacgtcccgcccggtgtcaggcggagtgggggcagataagacctgtcccatcggcacgtcggtgagcgtgctgctcctgtatggagtccaccaaagtcgccaacgaattaagggcgaatgacgggcgtgtcccccgtgtcaggcgggggacggcgctgggcccacctgaggatgagcaaccaccttgtttctggttgaaggcaaggacaacggcttgacccaagacatgtgggcccccacccaatgatggattgtgtaaggcggtgcatgtggtatccccttgaactataaaaggaggaccttacccaccgagaaaaaaaacgccacttgagaagcttgc

SEQ ID NO: 34141 - DNA, 1306 bp, Oryza sativa
  unsure (1)..(1306): unsure at all n locations
nnnnnnnnnnnnnnnnnnnnnnnnnnnnnnnnnnnnaatcgaaatcggaatcggaaaccccggatacgaaaacggaatcgaatattatcgaaatcgaaagcggagcgaaaacgaaccggcgcgaatacggtaacgaaaatttatcggaataaaaaacccctcaaactaataaatctaattaaataaattatctatgtttaaaagagtaatgttgttgataaatcccaatgtagcacaaaaaatattcttatgtaattttagatttgcataacaaatatttttttaaaaaataacagccaaacaccatggtattcactatttagtgcttaaaaaaggaattaagggtatttcagtcacaaaatttatggtaattccgaggaaatttccagaaattccgagaaaatttccggaaagttttcgaccgattccgagttccgatggaaactgcccttatcatttccgattccgtttccgagaaaatatttccaaattcgtttccgtttccgaaaaattccgaaaaaattccgaccgacatattccgttttcgaaaataggtccgaaatccggaaagtttccgtaccgttttcacccctagatgtatgtatgcgtttacaagggtgagtgtgcttacatgtttaagagcatctacgaatttgtacaatgttttaaaaaaatatttaaattctcaaccatttccattgagcagaaaattcccactgaaattctagctgggaaatcctactcctaataaatcctagtaggccaacaccaagtcaacagtcaactctgctacctcggatctgagtgagtgaagaggtgagcagcagtagtatagcaatagcaagcggattaattatattaagaggacgtgcaaattaattaactaattaattaaacacccaactaatctccactaataaaaccgtattactcccggccactgacaccgcagcgcagcataagaagaagccactcgccgccgcgctctctcgtcttcctcctcactctctccagcttccctctcctcgagctcgagatctcttcctcctcctcgatcgcgtccatccatggcggcggccaagaaggagaaggaggaggaggaggaggcgtctaagctccagctgaagccggcggggagcaaggtgttctccaagctgctgtccagggagagcgccgccgcggcgccgtcgttcagggtgtactacggcgtcgcctccgcgggctccgtgcccttcctgtgggagtcgcagccgggcacgcccaagaacgccatgtccgacgccatgctgccgccgatcacgccgcc

SEQ ID NO: 34142 - DNA, 9503 bp, Oryza sativa
tttgtagttgtttttgacatatttgatagtagtagtatataccttttgaacatgattcaaaaccatttacacacatgccggacttggtgtgcttaattcagtgtctctgaaatctgaatgatgctactctcatggacactttgcagttttgagtgtctgaataacgtcttcatgcatttgcactatagcttattattctgaaaacagaaggaaaaaaaaccatgtattgatacgtgcagaacatgatggcccaatctaattaattcaaattagctatgcatgttgaggagctgtaacaattaaggaacagtactgagtagggctatcagtacgtacaatttggccatagatttttcccccatctgaagggcatcaggacagtggaggagacattgcaaggacatttccaagaagacaatgatcaattatattaattttagacagctcacttgacaaatatacatgtatgtccccttacttaattaaccccggtcttaagagctaattaatccatcgacattagtttaactcacactaacctccgtcgatggcgccggtaagtccactctaattaagagtctatcaaatacattctttgaaagcaaaacaaaacaaatgaactccttgcatcaacgggctagctatcacgtgattctatatttttaaaccatttttaactctcacctgattaattagcttgtgagtaacttgattgtactactagctagtcccaacaagtgggtttaacggtaaaattaaactaggtagctaattggccgagatagatgtagtagcaagaacatgtattgctattgattggaattgatgattattgtcatagctaggtgtaacttggtttagttaagctagcacagtagtcgtatcttgcatgctttacaaggcacttcaaaggattggaccaagccagctagcagcattggcaaatggcaaatcataatatcaacgagaagctagcatgaaccgtcagagtgaatgagcactgcattcaatgtagcgtcgtcattttgtcagcaagtaatggtgttcctgcatgtgcaactactttgcaaatcgatccacattgcttcagataaagtgtgtatatagttaagcaccttcattaatctgtaaggtatggatcatgagagcacagctaaggtgtcgatttcaaagaaaagaaaagcatctcggcttatgatacatatcattgaaagattaaggtactccagcatcttcaagaaccaataaattacatctcataacgttccacctatgtaattcagtgacggtgaaaaaaaaaagaggcaaaactggcagttttattcaggcatgtagcaagctagctatattcaggaaaaaatcaggcagctgaagaatgaactgaatgtttgctgaatttacagacgtttcggatattgaaattcagtttactcattcagaaaaagtatatggcactgtacacgcttgaggttgtaagatgtagcagcaccaataaataactttgcttgttctaacaatctgtctcgagagtgcacctgaatttaggaatctgtcgctggtaattgcatcataatcgtgattcatgagcctcggttctgaatctgaaaatggttttaattatatatctgttcctgtaatccagtcttgtcaagtccacttttaatacctagtttaaatacttttaagacggcatgattataacataaagcagaattcaggcttaattaacctaactaacgaacaaaacgacgttcttttcatttcaaacaaccccatctaataaaactgtttcagtgagacagaaaatgatgtgagcgatcgatgcataagtcctaacgcccataaggacatgatgaaccaagccgtgctgatcgattgatgcatatatgctctgttcaggagagcacgagattttaagaagttgcatgagtagccagctgtggtaaaaattttaaaaaaaagaagctaactttttaaacctctaacttctaattttttttaattataaaagtattaccaaactgtttaaaaagctcgagattttttagaagaaattttagatgtcagaagctcaaagaaaaaattgtgaattttctttgctcgtcaactgaataatttcgctgcgtgaccggtgacggtttgcgacagtggcctgtgttttcgcatggcacaccattcaatttttcagagaccgaaaggagcaattcaacgacaaaaccacgtggaaataaagaaaccaatggatcgatcgatcgatcggccacactctctctccgttgcagactatgccaaatacagtgatggaataccagttctattatctttttaaaaaactgagaaataagcactgcttttcaccttttaaagaggctaccacacttttctaccgttaatttaggataaaattaagctttgtcataggcgtagaggcgattggtcttgtatattcccagcagtgtgtgcaggtgctattggcgcatgattgtaagctcggaggtgagcttgctgagttttttttacaggtttttttagtttctttctaattgtagtttttagggttttagtcttgtgttttcttctgctatatattgtaacatcgcacaaaattatgagtaataaatctcgacattcttctaaaatcgaggtacgaggcactgcgaacaattttttttttaaaaaaatcccctacataatactttcaccggttaaaaatatttgatgcatgggatataattcaatcaaaatatttaaaaaattgttcatcaactgtacattaaaataaattgtgaaatctaataggtttaaaacactattccttatcaagacaaatatgctcatgccgcattgtttttaggttttaaacaaaccatttgagaaattaccgatggtcatttttttaaaattttaattaaatcttgtcctaaatgaatgttaaataattttgactggaggaagtatggtagttgatggaactgtagtactacctccatattttaatgtatgatgccgttgactttttgtccaacgtttgaccatttgtcatatttaaaaaatttatgtaattatcatttattttattgtgacttgattcgtcatcaaatgttctttaagtatgacataaatatttttatatttgcacaaaaattttaaataaaacgaatggtcaaacgttggttgaaaagtcaacaacgtcatacattaaaatatggagggagtatatactagtaccctttataactcaatggagagaaaaatttgaaatgaaaaaagaataaataagatgttatgggtaatctaaaaaaaatattgtgaatgtgagttcctccgttcttaaaatagtgtagttttaacctaaaaaagtatcataaaagagtgaggttttagagtggcccactagagctctttaataccatttcatatttttcttctttttagtcattaaactaatagtagtaccttttattctctttttttttctccgaaggacgtagtaattttttaacctcatgcttaatactatgtttttactaactaaaactatactattttagaaagatggagggagtagttttgcttagaaatgtctgaagaggttgactacggccaatactgtataaggctacggccaaccatgtgtgaatcatacgttaacagtgcgatcagctgtcgctgtacatacgtaagtgtaggtagtttctggtgctagattgtcgtgtaatgagaagggacatatatgctaatgactgtcctgagagtgtgattagtcggtccagccagtgttaatgacgttaattaataatttaatttgaaatggacggcagcgtcctgaaaatgaggcttgttacatgcgtcactgtttgtgccccctatctgatgtgtcactttatttttaagaacttgatcgacaaaatttctctgaattaatcgactcaaaagtaacagatgaactgaagagttcgtaattcagacattcagtagctgctgtactgactagttcagcttcccttccctggtcagcataaaaatatgagacgtatatagtatctatttttctctctttttattaaaaaaaaattaaagagacacatacctatcacatattttatttaagaatttccaaaaacaccaagaattttttttttgaacggaaagaaaaaaacaccaagaatatttagtttcagaaaattgctggcatccattaattggtgtgtttctgcaatgcgtcggcgcaagttatgagggagaatgttggagaacagtggaatttatatgcagctgtctgagcaacggcatcaactgtgtgtcagtatcggttagcagttcaattccccccccccccccccccttttttcacattaattcgttacaagaattgtaccttgtgccagcttaggagtgctgttgattagtttcagtaaacagttctgatcttgacctcctttattttgggagaataatagttctggactgttggtgatgcatcatctttcatggctgttgatgcacaagttgcaaattgctaatttctagttttgatattttgaaatataagtgaattttcagttttctcttatcattttacgaacgcgcaaaaggattgcacgtcaatgtattagaagggaaaagatgttttgttgcacaacgcaatcagccagacatgcctatgccggaggaagggagaaaagacccaaatagaaaaggaaaaggaaactactgaaaaaaagcttttacgcggtatgatatgggagctaaagttctcaagtttaaatcatgcttgacgcataattaaataaaaataattatatcctatttctattccacgtttgagacttagggaccctctcatgagggggagtggaatataccaagtgattgcccgcttttcgtcattagtttaagttctttattgaactagtcaagtgcatttaacacaatatgatcattgatcattctacgagtcaggatttagcaggtgacatccatcttgatgcagtcaattacaattactgattgcttggtaaatgatttgatagtggacactaactaagaagaatggaaatgatactgagatccagtgatttcatttcacgtaagatccagtgatgcgatcgggatacgttgaaacttgaaagatcttgcctgtaccagtagccaccaagtggaggaaataaaatgagtgatccaaaagggaatcaaagatgaaaatatgagtgatcaagaaacagaatctttaaccggtgccatctatcacgtgtagcattagtagtaggtaaaaggatatattattagaggcaggagagagatatctgaaaaatagtcctccttttacactattcaactctggaatgttaagaaccgaacagttgtcacaaaaattgatgataattattcccaaaaaaaatgatgataattgcgagccctctaaaaatacactggttagtttacatgcttttataaaaataccttttttattggataaatctgaagaaatacttttatttcacagtgtcaataccatacacatgatattcccgaaaacaaaaatattcccgaaaatatcatacacatgaaacagccacattgctaaatcagaccagaaaggatgtacaggaaagggagcactcaggaacagtgcccacagtgggaagaacaaaaaccaaaaaaaggtaaaaattgacctaagctagccacacatattggaatgtaatttggaaacatgccttatccttgtcagtttttcttcactggtaggattgctatgtatcattacactttgtccttgtcatcctcttgcacactcatcatgccctccaattcagagctcacaacgacagtgacccgggttcttgtgtcgggttccagttgtcggtgagcaaacatccccctagcaaacgctcatacggatttttcgtccgcgaacagggtcactgacatgtgggcccttcaccgttctgatacactcggtgaagcatggctgtttagtctgaccaagaatgtgatggaagttttgtagtcttcatgaggtggggatgcaggatctggcaatttgtcatgtacagttgtgataatgagaagtttcatggtgttgatgatggtatatggctggcatgatgatgacctggtgacagttcttctttggtaacactgccaagaacaggtctccatgtctagatcttcagatccactgaaatctgcagttaatggcctagttagcaacaaactgatatcaatggaatggacagtaaactagcagttgatcagtgttaatatgctatactagtcgctgccgacaagagacagacaggattaaataaaaactctcagcatgtgagatttcaagcttacacacattctgaagttattgcagcagtgcaaccgtgtggcttgtcaacttctgcagcagggaggatgactcctattataagttcacatctagctcgaggaaaaatataatcagaagaacagatctggtttcatccaagtggtaagctttttagtagtaccagcaaaagtacactgcaatgagtttacaatgtgcagaagatgaactcctatgcaagaactggaaaccggtacaggacattctactgcgaatcttcagagggtcagaaatacacatggccaaggtggtaaatgggctggtaaatttctgcagctaaaaaacagagaagaaataaaatacttcctccagtgaaaaattacagctctccatcactaacattttctcattttatagtttattttcgtttgtccatagcaaatttagtttacattcttctgtcagccaaagtcttcagtgaatcacggcttcatgtcgctgtacatccttgttcaacatttataagcagagggtttggttgaagagctacagaattgcccatgccaccataatttgtgaatgcatccaaagctttccatatcggaaccatcattttgactggtggatacaccttctgcaaattaagggactccgtcagtcaacggattcctcgtagtgcacttgaaaccaactgaaagcaggaaaaatttaccttaaaaacacgcacgagtttgtcttcgctgtgtagaagcaacactaagctccagtaacatgtaataggggtcacatgctcattcaacactggctttaggagcttgccaacgggcacaaattgacgatgaactcttccactataaaaggtagctttgatgaagagaagataaaagaaaataaatctacgtgctgcagcatatataaaatctaagaaacatgggaagtgtctctgcaatgcctgtattcctgaaaaactttgcatgttcagtacattttctctcaaaaaagagagaagtatttgtagttatttaaattttgaagacttcacttccactaccatgatacccctatctatttgcaattgccaaagtccccttggggtgtcactaaaatttgaataagtaagagtggaacttattgcacccctgtaaaaatccaaattggatcttcatacctccaaaagtgttgttctagctgaacaccaaaggttggcatgatcaacaatgactctgcacaggattaaaatggtatcaatgaggagcacacaattgcacttccatataagcattcctaatcaggatcctgagtaacaagggtatacatctttatccttccttcaggtaaaaaaataactaaacaatcagtgcaaaatgcacaaaatagataatacagacactgcccacctacctttcttcacaggcttatattttaagcattttgcaacggcaaaagcaaatgaaatactccaaaaagaattgatgcatagactctcctgaaacatttgagcacagaaagtcagaaactcattaaagtcacaagcgtatggtgacacctttcttctctttctgaatcttaagtacccaaacaaaatcaacatcatgtgagtatcactgacaaggcatgtatgataagcttgtttttgaagaacctcacatatctattcacatcatgaaaaatgttggcattcagcaatcagcaaataaattttttgggagaatgcagtaggtcactgaaatagtgaagactcagctaccacttgggattatcatccgagagaacaacgacctttaacagcaaggcatgcagtacattcgcaaagaggaaaatttcgccgacataagagaacagcaccctgaatttgctcctcttgatgtagatttcatggatatcgaatcctccctcgcagtgatgtttatacgtgtacacgccactcgacatctctactgctcgattcttcatggtttcaggctttcagaacatcaaaacactcgaagtcccaaccaatggcgttcatttcagaagctttcaatccttgaacgaacctaacaagaacaacacatccgcccaaatgtctagtgaatcccatgatctcctaactgctgatatagagaaaaaaaacgcatcactgcaaattaattgcgcaaatttaatacggggagacacgaaaaaaagaagtctgtatttctacatagcattatcaagtatggtgatgaaacaacatccatgcccacatcaatgcaccccaaccacccaaaatgtacagcaaaggatcgacgtgagcgcgcgtacctgcgaatgaaacgcgagacgggtttggaggagtaaacgcagacccgccgccggcgacggcggcggcggaggaggaggaggacggctgaacgggtaacctaaccacctgcagctgcaggctgggatttctccgtgaattctaacgcgatgcatcgtagccgtccgtttgtagaagtaataaattgagtaaattacagtttggccaatttttattacaatgccaaagtttcactgtgaagtttgaaccaccattccaactaatgtttttattttataaactagataatttaccattgttgtactttaggccaccttacttttttttcgaacgcgtaaaagaattacacgtcaatatattagaagaaaaggagatttgttacacaacgcaatcgagcaggcaggcctatgctagagaggagggaaaaagaaaagggaaaaagaactagtagtgcaaaaagactactccaacatacaagagggagggggcggagcacactacactcctagcaaatccccaaagcagcaatgcccgcagaagaccacagacggccttccgagtgaatgggctcaataagcacagagaccgaggatagtgccgagtcaaaaaccctggagttccactccttccacagttgccaagagactaggaggaccaaggagtcgaagcctaagcgaagatgctcgggtaagcaagccctagaagatggccaccaatcctgaagcgaattgccatggagaggggagagggcagtccatccatgtggcgacaatgcacggtgtcatgtctaccgagtgaacacacgatcgagataagtcacttgactcttttttcaaatacatcaatgatctagattatgtcggtttcttgcatattgataaagttttgaagctttatgtagac

SEQ ID NO: 34143 - DNA, 1707 bp, Oryza sativa
cggttcaaagtagtgcaattcagtctagtaaatttgaagggcaccttggatgatggtgaatttgaggcatttgattatgtggtgttcttttatataaaaaaaaagttgggatggctagaaagagctagccatccgatggtattaagatacgagaagccacatatttttccaatccttctttaatccaggtggaatatgagcaggtcgagaggtcaaacctaggtctgctgggcgaaagcaatcaacccataccaaccgagctaggcacggttctcatggtgttcttttatctcgatgaaagatgggacatgtgaaaattttccgtaaaccgacatcacaacggcatctgattggttgagctacaaccgataagtcatagaaaaataaacgaagcaataaaaataatttatgagtaaaacttttatatttgtattattcatgatataagagccaatattggaaaataaactacgatgaaaagccctaaaatctctggttcttcaacagtttcatgtgcaactacattgcttggctcatgtttgacacttcctcacttaatcatatgcctttggtttaatcaacacgatatccattacaggtttataacgaccagtcaagtcccatgttacaggaattacaacagtcgaatgcaacaaatcctcatcccaagtcggagcttacaacttacaagtcacactcaatcaacactgctaatttgccttacaacagctagtaaaattttcaggtatacacggcacaagctacagattctacagaaccattgctctggcctctgggctagaagattgcagagtaagggcctgtttggtacagctccaacttctaaatataactccagaagttgagtttggagtggagttgtggagctgcctaaacccagctccacaactctagtacattttgtgagagagctccacccaactccactcccagttttggtggagctgaaactgtttggctgagctccagctccaggaggggtggagctggagctggagctgtgccaaacagggcctaaatcaactgaaatccacggctgattttaccctgtcttgaattcctgatgcgcttctccttcctccattcccatggtttgtcagggttcggcaaagaccataaaccaatttgactcgcttttgcctgattctcccactgaaaatttatgtctgtcagtaactcgtgtttatgcttgaaaaaaatgttcagagcatggtcttcagtcaagtaaacttgagctgtcaggtgttccatacttagtactggacaatgcattgcttaccctggcaagctccggtcgttgatcataggcaatgtagtgccatgcaagccctttcttcagcatgtgttccttttgaaaaataaagaataagcttaatatatttcgtattcaaaatgtcactaataactctctaaaatcagtgctagaaagcatgtgtcttcttcagcacaggaaattcagaaattttcttgcaggatttagatcaaagcttgtgtctgtagctctgacttatgctcttatcaaaaactctaagcatttcatgatcctgaatacatacatttcgttgtacatggaagaacctcaatgaaacagttgtaaacttgtgatcacaagactagagggcccaaacatttcagtatgctagacctttcggacagaactccagggcccaagcagaccgcaatggg

SEQ ID NO: 34144 - DNA, 680 bp, Oryza sativa
gcactgtaaatttgagtgagaaaatcgagtgagagataagaaaaaatctttcgagtgagatatagcaaaatcgattaaggatatatttgtttgttgagagataaaactggccacacttgattaactctggacgcggtggatgcaaatatattaagtattcactctgcctagctacgagctcaggattacatatgctcactattggaaagttgtacaaacttaatatttcctaggccatgctgcatgccaggaagccgaacaaggctctcctggtacagcaagagacgtattgaatcgtcgtccccgtcccccgagctgtcaatggaggccaccgtccggagagtgccggagtccgggtcgtagacatgagcctcgtgcgccgtggtcgcgacaagaagcttcctcttcttgtctcccggcggggagccaccaaggtaggtgagcgggacgacgagccacggtgccgtgagcagctggcgctggcgctggcccggcgctggcaggtcgacgcggtagtccagcgaccagctcccggtgtcgtagtcctgcagcttccatatctccaacagcacgtcgtggtcgctgcggtggcggacgtcgcgtaccatgcacaggcggccgtcgagctccgcgagcgttttcccaaccggcatggccactttcttgccgctcccggacct

SEQ ID NO: 34145 - DNA, 1195 bp, Oryza sativa
  unsure (1)..(1195): unsure at all n locations
acatattgcgcagtgatacacaacaagcacacaatagatcctagatttacagtgttaaaattatcacatcatcaatacagtcaaatataatcattatcctgcatagcatgcaatctaacagcaaagcatcaaccaaatctaacagtttgaactttaaccatcagtgagaacttaaacatggctaagttatataaggttatcagaatttttcaataaccatcaaagaaatatttaatatttttatatgcattcatgatctgtactgaaaacaaatcctacataaactatgaacatatctcaaaggtggaaaatagtctaatacccaggtaatgtacctaggccatgaaagattttcccataactggtggttctttcaaaaaaaaaagaattgttcctgcgatcagtattttttagtagaaacatgtaaggatgaaactactctgcaggtgtcctctaagttatcatggcaaattgcagcatgaatgcacacaaatacatgagaacattgcagaacaaaaatgtggaaaagaaacattaaaataatgcaaactgaaagacaggaaagacttacgtcggtaagagatacttgatgaacttgaataaatctgttttggggattttcaaagtcagcagattttagttgatcttcaagctcgtccatgagcaaatttgcatccctaagattcccttgtgatagatactttaaataaaaatgcagtatatcagaaaaacaagcatctgagcacgtctttttccccaaaaatttcttatttattcatcctataacgaaacactttcttaactttgatttttctgaagttagctttgatttttctggtccccagtgcaagaattttgacacttccttttaacatactatagtactataaacataataaaataatatattatgtaactatttccgaagttcgatcaaattctaatattttaccttggatggagcactttatagtgtgctcctgtatgtgcttaagtatccaaaggagatttgtatataacttagcaggatattgtattgatgcatattgaggaaatatatcctaatgcatgatttgctagcacattcctaaatatgtatattgtttactcattgtaaacagaacatgaaatagagaactccctatgaaattcggtttctgcannnnnnnnnnnnnnnnnnnnnnnnnnnnnnnnn

SEQ ID NO: 34146 - DNA, 291 bp, Oryza sativa
cagtctgtgtagatctttgatttgattttgtgctttatccatagtacatgattggtatatagatgatgaggacatcacttcatcggatacgctcataacttcacacgttacaatgataattccaagtccaagtccagttcggccttcggagacagtactgacttcaaacggacctagcgccttcatgccaactctgatttgggtgatcttggacttcgtggaaagcttatctcgctaccttcaaacgcatccggtctcatatccaaattcatctcgagtaaacgggaatag

SEQ ID NO: 34147 - DNA, 810 bp, Oryza sativa
tcccctttaacttgcatttgaccatcttgcttatggttgtctatttcagaactgcttagcatatgatagaaatcaaccattcactttttataacttaaattggatctgctaaataatatgagttgattgaatttagaatctttgttatacaatcttccgtctattatcatagttatttggctaatgcagcatcttaaaaatagttaatgtcaggattgttaggacattaaacaaattcaaagtaaaacaatgaccagaatgtttacatttgcatagaagcagtattactggatcctacaagtatgtttcatatgatcacaatgaaaaatgttattcatgcacaaaatggctattttctttgactagatttattgatttcttaataaaggaaaggggcatgagctttgtctgaaagatattgtagacaaaaagtgccaattcaggaatacaattttgattaattgtgtctcatatcttgcaggtatattgctgctcagaagtatttggaagccttggacatccttcagtcaggagctttagttcaactgaagcatgggcaggttctatcaaagctaaatttcatagatctaagtaaaaaaaaaatattcgctacatttgatggcaaagtaacacccctcccaaaagaaaagagaagagagagccaaccaaaagctcattgctcccttcgtaacgatttgttgcaaccagccaatggaccttgacgtgttcatttgaagttgtttttttaatgtgtgtattgtcgatgtggtggtagtgattcacatcttattatgggatgtttttattggg

SEQ ID NO: 34148 - DNA, 11874 bp, Oryza sativa
cacccctcccaaaagaaaagagaagagagagccaaccaaaagctcattgctcccttcgtaacgatttgttgcaaccagccaatggaccttgacgtgttcatttgaagttgtttttttaatgtgtgtattgtcgatgtggtggtagtgattcacatcttattatgggatgtttttattgggtgctatgctgtagttacatacatgtgttatcctagattggtgttttatatcattttaaaccttcacatttttgccttattggttaaaaattcctgatttcaggtaacttgtggtggtgaacttgctataatgtttgtggacacccttgtcaaggcagcgcttccttataatgaagaaacctttggtcagtcttctctcatagtgaaaagctactatttctttatatcattaacatgctaataaattgcatatttatcctgtaagtaaatacacatctagatttcatttttggaacatatttacaatattttatttgtagcatactcctaatgtccatcacttgtaaagttttgaagaatcaaagttgtttaaaatgttagtggaagcagtgtttactagtcctaattgtggctctagctttactttgtcttctctttgtttgtttaccttcagaagatcacttttcccttagattttaattgaattgaataagatacttactttattatgaatgagaacatgtttctagtttgatttgttagtatcacattttgtgattgtaactatatgtaaaccttagatcgtatcagaaagatgtacgacgccttccccaggatatctgttccacacttccttggagatgattatgatgacgacgggcagaaattatccgaagctatttctgcagcaaaagtgcgttctgagagttgttcatcattcctgagagctgctatcaggtaaggttgtactaattttcattaatccaagtaaattgagtagaaaaactaaatatccttcatgcaagcatcaaacatcttcatctaaacatggcagtttgtttaagtggatcttaaggcaaatacatcaaactgttgaatagcatctatactatgaccaggacttgttaactgtagtgcttgaccagtagttcattactgacaaaagtagaacagacaattgagcttatcatgatggtaaaaacaaatgatctgttctcgttgctcacttgcatataaaaatccagatgttgattgtgtaagtttgtttattacaataatgctctcagaaaaaaatgaaaaaggagatggtcacgaatttgtgattttaagatgaactcaaggtgtgcaacatataagaatcatttccatgggatctttgaatctttatgtttaactctgttaatggacaatgtggtcatctagttgactcttctcaattttctgcctgctatatttatatgccactaatagcatatcaatcctttattaaggtggtctgctgaggttggggcatcaagaagtggatctcctgagctgcatgttatgttggcggaatacatatattctgaatctccagaaacggtactgtttataaattatagaactatttttctgacatgaatatattgtgtttgttttagagctgaaattttatgtcttttcaactgttactctttaatgcctttgtggtttgctaaggttcgtgttgactgccgttggatgcaggacatgactaaagtgtcaagtcattttgtgaggggaaatgatcctaaaaagtttgcctctatgctggcgaactttatgggaaaggtaatggtttttagaaaataattgataatagacttgcagctgatgattgtctaatgccaaattctattgaacattcttctgttctctgagcaatgattaaaatgtcttatctgaatatgatcagtaggttcacattctttacaacaattttcattttacaacgggtctcttgcttatagtttttatttgagttggaggtcatccttctccgaaaatagaaacacggtgccagcaagtgattgttcaatcagttatctatatccatttttgggttggattatttcaagaccaacataatcttcgtgtaaagcagtattcatagatgttttttctcaatcaaaaaaatatttttattaatatttttcttactgcacagtgctaccctggtgaagatgatactgcaatagcacgtggtgtcctaatgtaagatataatttctttcttttttttttcctttcaaagagtgcattgttttgacactggcaaaatttctaaaagccatggaagatgtttgcatcttgcaatgcagaaaccgaatttcatagggagttctctatttcatgttctgtttacaatgagtaaacaatatacatatttaggaatgtgctagcaaatcatgcattaggatatatttcctcaatatgcatcaatacaatatcctgctaagttatatacaaatctcctttggatacttaagcacatacaggagcacactataaagtgctccatccaaggtaaaatattagaatttgatcgaacttcggaaatagttacataatatattattttattatgtttatagtactatagtatgttaaaaggaagtgtcaaaattcttgcactggggaccagaaaaatcaaagctaacttcagaaaaatcaaagttaagaaagtgtttcgttataggatgaataaataagaaatttttggggaaaaagacgtgctcagatgcttgtttttctgatatactgcatttttatttaaggtatctatcacaagggaatcttagggatgcaaatttgctcatggacgagctgaaggatcaactaaaatctgctgacttggaaatccccaaaacagatttaattcagttcatcaagtatctcttaccgacgtaagtctttcctgtctttcagtttgcattatttttatgtttcttttccacatttttgttctgcaatgttctcatgtatttgtgtgcattcatgctgcaatttgccatgataacttagaggacacctgcagagtagtttcatccttacatgtttctactaaaaaatactgatcgcaggaacaattcttttttttttgaaagaaccaccagttatgggaaaatctttcatggcctaggtacattacctgggtattagactattttccacctttgagatatgttcatagtttatgtaggatttgttttcagtacagatcatgaatgcatataaaaatattaaatatttctttgatggttattgaaaaattctgataaccttatataacttagccatgtttaagttctcactgatggttaaagttcaaactgttagatttggttgatgctttgctgttagattgcatgctatgcaggataatgattatatttgactgtattgatgatgtgataattttaacactgtaaatctaggatctattgtgtgcttgttgtgtatcactgcgcaatatgttgatctaggttgcctaggtagctttctgttcactgtaaacaaactgatcctacagtttcaattatccaagtttccatgcatctttcgaataattgatgagatagttttgcattttgttacttgtacgtgtataccaagcccagacgttattttatacaagcaacaagtttttttttttctcattgtttcctctggtcgtggttatattactgactgcatgctatgtttacaggctcgaaagagatgcttaccctcttttcaggacactgcggcagaagtacaagacaagtacagatcgcgaccctgtatttgaggaggtagctatttcatcaaatatagtgttagcttgctaaacagctgtaaaacatgcaccaaaacatcttattctttcaaagattaacttaacaagaactgggaaaaattatatttttcatgttccctgcatagttgtcataaaacaatgtgttcacaagagttatattagatcatgtaggaaactctacaatttaatccaccaacaaccttgttatcatgtgctgtccatagggaaatgtaaacagtgttgataaaggaccatctgcacttataatgtgcttaatatttaactctactagcagagtaatatgtggatagaacttccattacattaactagcagagtaacttgaagaaggtagttaatgctttctatcatatatgaaaaacaagctgaaacagagctcacgtgatattatggttgggtttcagttattagatgaaatagccgcaaaattttatggaatacggagccagagcgctttggaaggactttttggtgatatgttcagggtaagatttacatctttcatctatcattcattcatgccgattgctagtacattgcattgattacttttgaagttgagtacacaccagttgcttttcacaataactaccgtcgtatgcctttagttccatatcagtcatgccgaaattacgtttcatgaagtgcatatcatgtttagaggaaagaatatatatttctataatttgaaattgcagttgatctaagcattcaggaattgaagtgcaaattttatgtagcttatgaagtcacggatgtccacctgttacgtggtaaacaaacaagaaaaaaaatttgagttctttctttcagttataaatattgccatcttcattttgttttgttcaattcaccttttctgtacgttcatgtaatttcacgtatagtttcccaagtacaatgaagcaaacagataatcaatactaaaccattagtgtagccaatattagtacaatgactagaagtcggcaacctagtccgatacaagccattattgatcttgttctttgtattctgcaggtataatgatgagaaaaggatttcgtcataaatattccagcacaaagctcccgacgcgcatttcgttcgctaatacaaattgctgctggaagatgaacacccggcccggcccgaaaagagcataagaaaaagttctgttgctgccttcctcagccttgattatcctgaggccatacatttagctccaaactgcatatgatgatatatgctccagttaccactgatctcttgtaaaaccattcaactgttttgctcgtatcatggtcgtgttctaatgatattactattctttaacattttttgtagttccagttttgcagttttaaaacggcatttatcctgactggtctcacgttcccttcatcttcgcgtacacgattgtttggttagacagtgcggcccgtcaaaatatgtgggctgaaagttagggcaatggcctaacgttaaggtccatatataacagcttgaaacgggccgtgaattcaggccattactgggtaatgaccgagagatttggcccatgccactggccaaatgaggatggaagagttgcagacagtaggctaaaaaagctgtaatatactccaattgcacattaaacatatctgggaagtctaaaatatcatagaaatttaaacaacagacattttccccaattggatattggagtgagaaatacaaccatataattgcgtcagggctgttctccaatttgagaattgagtatcaataacttagctatagcacgtattactattttttttccctaaacgcatgtaaaatggctgtagaaatatcaaaatgatcaaactaagcctccatacacaactttatacaccggataattacaagtcaggataggcagcagacaccagatgctcgtaatctataattcataggctcatagcgaacgacgagcagatgtgcgtgttcaatgggattgggagggcagcatgacgctccatgttgaaacttgggacgctcaaacgccagcaggatgatgtcgtggtgggagtctaaccatttcctcgccagcaggatatctcgtgtccaaatccgctgatctgtccctccacgtgccaatcacgtcctgctcgcacaaaatcacataaaccatgcattgctttattaataaacatatgatgcagcgtgcgaattgccacctatggtctatgctatctactggtaaacactggcacaggtgactattatgcttcctctgtttcaggttataaaacattttgactttagtcaaaatcaaactgcttaaaatttgattaagtttgtaaaaaaagtagtaatattttaaacacaagacaaatttattatgaaaatatattcaattattgatttgatgaaattaatttagtattatagctattatactacatttgtctataaacttataaacttagtcaaacttgaaacagttgactttaaccaaagtcaaaacatcttgtaacctgaaatgtaaggagcagtcagcaattcacgaatttgagcatagaaagtacaatatactccctctgtcccaaactatatggcctatatttttttacacggttttcaataacatactttgatcattattttatttcattctataatcccaacaaatatgaaattagcatcacataaatgtacttcaaaatatgaatctagtgatataacatgcataatacatagtatagatatagttagtatgattattggtcaaaagctaccgaatatgttttttcttaaaaagggacgccctatcatttgggacggagggagtagtggtattatgcagtgcgcaacatgtttcattatacataatcttctgatgttacatgttaaatatgcagataatgttcaataagatggttgtgaagctaattcatcatgaagtgtacccgtgtttcttaacgtgcctcgccctaatgaacacacatgctatttattacagtccaagttttgtttaagaaagatgattgtaggcttatagttatagcccagttatttacaataaaaaatcaagatatttagttatgactagaaaaccatatgacaaagtgagtatcataccgtcgtatccatccatcattcgtatgccatgcagcatttatcaagactgtcagttgtctagtcgacatcgagcatccactgccataggcttcattctggtcgagtcctgaaacaaactacttccaatcaacgttatctcaagtgaagcactggaacgacaaagaaaaacatgtccgaaaaaataatatagttgtgcttgatagaactccgagagattccttacactgttctacgagcagcaccattcagagtacttcagccaccactgtcaccaactatttgcagaactctttccttcagatgctgaatcatctgcaagagatcaacagaaagtgacaataagactgtccatcttatcagaacaggatctctgtggtgtgaagaaacttacaggatgagaatttgaagcccatttttcagcagaagtggcagcctctttgagatgtgattttttaggtatctcgtgggagagactataggtggagctctctgtcgcctcagctacccacacgtgcctcatctggtctttatctcgcttgaccagattactaaaaccaacctgagaaacaaacgtaacagtgagttaaagttgcacttgcactacaaaggggtaaagctgaagaattatgtgaagggcctgcagaaaagaaactgggatatagctcgtctacacagaaaattacacgaggcactgtttaattcataactactcgcatttcatatgggactcatgaatttcggacttcaaagattagtcaacttgagatatagtcagtgcaatggaagatcacatactatatgtccagaaagggcataattgaagaatgcagaatcctcgccagtggttttggaagaaaagctaactgccagaagacagtcatcttgctcttcatacttttctccagagataaatttagatccatctgtcaaaaagagccactgcctattctggttgttcaataaataaacattcccaacatacaaaataacacctgcaatgtcaaattcgctgaaacaaaaaggaacggctcattataaaaggttcataatacaacaggagattcagcaagtcagcttgagacagggctgaccttgtaagtggcacttcaccaaaatgtgacaattcaactgctttacgaggggtgaaaaatggtctgcatcatgaaaaagggacatggttaagttttctaaatgcagtgcaaccatcatgtccaatgaggtctcttactcaaaatttgtagtctgtgcggttgctaaaggggtccatgctgtagatgatcctctaccactcaagtaggatacttctgtaaagtagcttgaagccaacagtcctgtgacagaataaatttgtccttccaccaggtcggatttctgccagtggcaatacagaaatgaaaattgttttaggtatatttgctcattagcacataactatgggaatattgcaaagaaaataggcatgtgcatcttgttgtcctaaagacatatagcaggtaacgctacacacaaaaatatatgacaatcactggcttgttttcttgatgacataacaccaaatcttttgttctttttttctgttcataagaaagaataaagatgatttctgacacttatatgctgtagaattattgtaccgtacttgcttctcggtagggttccaaattgttattaacccttccctgcagccagattttgtggcggagtgtttgctgataaggcccgtcaccctcactttcaaaaatggtgtaacatctcttgaactaagcccagcaactttaagagcattttcaaccttcttagctacttcattttgcctgacaatctgcaacataatggtgtagtttaaaaaacataaaatattagcagacagatgagatgctatagttatgcgtccagaccttttgcttttcttgataatatgagaaagacagcagctgctctgaattcatgctggacataagaatttcaggctcagctgccctctctagcattttgcatatttttgccccttcatcgttatcatcagtgttgtcgcagtgttctccatgttctgactgaatgtcttctgcaatcttagacactctgcataaggtaattattattattataattataatttataatggcataaaaagggaagtattggtgcaaatacacagtttgtgctactcatgaatattactacgtccacatttaaatatatgacgctattaactttattcggtctttgatgtgcaattttgaccactgtttttttctattataatattgtaaaagtacttataaattaaaaaatctacccatatgacatattttcaaactaaatattttgagagctattgacaaagtttcaaaaatttgagcaaataaagtcaaaagtgtcacatcacatttcagtgaactagactgatgatgaaccccaaaacatattgagaaagttttggacagaaaaaaaaaaggcaaacaggaagtatgcttcaagaaactggatgtatccatgcatgattgcttgtcttctattggaggtgtgataagcatccattgcacttaattgtgttaagtttactccaataggagaaataaatacctctggtgatacagctgtagtgcttttctttccatcctttcagacctcaccacaaaacgaccgtcagaaaacctgaaacaaacaattcagtgtgtgcaactgagagagagtttagtaatggatttatgtccagtagtacacctctccctgtacataacaggataaatccttgtaactccaaccagtgtcctaggaactctgccacctgaagcttttatgcacttgaatgccagtgggactccagcatgcttgcctgagatgcgcacaataggttataaaagacaacccagctgtataaaaataatagaacagaagtgtccagttttgtgctcaaattacatacataaccccaaagtctcatcccatcttgcacgataggtgccatttatgtggatcattaatttgacggtacccgatgcctgtaaagtgagatcaacaaaaaattgattatatggttcaatggtagtcaatgttcacagctaatgaggttaaaagacttagaagattagtcaaacctcatgaaatgacacaggcccagcccacccacatagtgaagctccccatatctgccaagatgaaatacatattaggtgctatgagtaaattatagtcatgtctcatgactagttgaaatagcacagtacccgaagcttctgtcctataaaaagttttcttttctctagttgctccaaaagtgccagatctaatgacgcatctagagaatacctgcgaaaaggaaaaggttctaacatctttcagcttcaactcgtgcaatacagagaaagcaaccacataccatccatcagttagttcaatctttgtaggcatgttccttttagcaggtctcaagcttttattctcactgttgtcgtcgtctgtatgtgccctatcatcctctggcttactgttgtttaggtcaggacaagagtaaatagcagaaatgcacagcaccatcatcaaagatggtgaagcattcccttccaaaattttctttatggctgagcggtggccattgttcacttctctgtcatacctaacatgcttgaaattttcattaatcaatcatatgcgtccatacagtaggaatggcagaaaaggcatgtcaactatctcacctgtacttcagctcttccaaaacattaccaacttttaagaatttgccagcagctctagttggatagcatctctccaatgaagcaagcttccaaacaatccatttgtagtggttgctgacccatctaaaaaggaaattttcgagtgttgatgttcaggatttaattgccatggagtctctcaaagaatccagcctaaatactatgatatgcccccaaggaatgcattatcacacttataaatcgcatgccataggaagaacatgtaaatccatttgttaatcctaacaatgttttgctatggaacagagacagaaaaaagaatggcaccgaggagacatgaaaaagatattcacaaattatgccttcactagaaaaaagtgaaacagtaaagtaataacaaacatgtaccagcatctgaaggccaaccttgtatagtgatattatcagtatgacaatgaaaaacgacgatcagaattaagaatgatgcttactctttagttgtgtatgtcaatgaagcaccacaggcaagaagcatcttctgaaattcttctgcaccagtatctgttttaaacttgtacttctcagccttttttgcatccatgagcttcacttcatctgttacatcttctgtctggtcacaagagttataagttaacaatgtgaagaatatagtgcacctacagaaattaactgcaacacaataaataccaaatatttgaagcatgggggaccaccaaaatactcttcacacgattttctttgatgttgaaaaggatagcatgaagatagctttgttcgacagggattaatctgaataggtagtttggatactcctgtgaaaattagttcaactaatcaagtaggaaggaattttcagaatgttctgacatgtctaggccatcagcttaccagaaggggatggattattgatgttgataggtgcgatgaacctaaccagtttcatcaaggatgtcagaagcaaggtagcaaggactttccaatttgctaacaatgatgcaaatcaaatcacctggaagaacgaggacgtttaaagggagatatggagtttcttcccccaaatcttctcttctcaccggccaggtagtcagtattaacagaatgtgtaccgatgtaattagtgatgtcaatcaatggtccagatggcatttggagtcttcgagccttatctttagtgtcacttgcattttcagttccaaatgaacatctggaagaaggcttggatatctttggaatttcattgataggatgaaaatctcttggcgcatgaa

SEQ ID NO: 34149 - DNA, 18146 bp, Oryza sativa
ggcttggatatctttggaatttcattgataggatgaaaatctcttgccgcatgaagcctgacggagtttccgttagccaaagtggcatcaggtacagcatattccaaggaatctgtgtgcttcctatcaggttttgctggaatggaaaattgtgctggctcagttttgctgttccccctacttttcaataaatcaggttcaccttcttttcgcagaccagttgaattttgtatattctctttacaagcagatgctgaagagtggcctaataaattatttggtgaaacctctaaatccgattcacccagaagatttttcgcacgctgaagtgcatcactagaaatagccattgttctgccgccagcagtgctgaacctgatagcttgctcactagaatcagagaacgttgttttagaaaatgcaaaatgctgatgtggatccataagtacttggttttcagctgggccagagcttatagggcagccaccagaaattccactgactgatgctacaccaaactggtgctctgaattttccctctcaacagttatctttgtacctagcttatcacccacatgtcctaaaagttgtgttgaaagggtattctcctccaaacccaacaaagttgcagctcgagaaacaccaactgaagatatatgtacagtccttgcatagcttgtcttgagaggtgaagtaaagatcggaatatatttgtccacattgctaagttgtttgtgattttctgaaaaataatacctcaaatcagaaatttctaaagaaaaaaaatacttatatgttgaaaagtgcataacaaacatcattttcaaatttgctaatactatttgataaactagccatattactacatcataacactacaacaccttattagaattcgcatgctgatcatactcatacatcatgcatttggaaatctgtactcatgtgaatattcatttactaacaatgacataaaagaagttgatacagcttcctcaaaacaactagatacataattctgattgaagagtgcacaacatcggttgctcattgctagttttctcctccagtgaagtgggcttaattttcaaccaaaaggcatagaaatagtactacaaatttcataacaataaccgcccatccatgatttaattattccacaaagaaaccacaggagcacagactagccacctcaacaatcgaacacacattcatgctaaaaatttatgaaataacagcaatctgtgatgatctagcagacactaatcaactcataactaaagctactctacttatccaaacaactgagaaaccccagatttcacaggatcaaagaagatgaattttctatcaagatgataatgcatctttaaatagaaatctgtacagatacaccctacttttactcattttcatggatatgaagtacagagatggcggagaaatgcaaagattggtggaaagatgtgaggtgaaacaagtggtggatctatttctcaaaaaaaaaaaacctcagaatatttccattggcattatacacacctttcttcatattgccttcttcctccagaaccacccttgccttctcacggagctgtgactaatcaagactgacttcccagatccagttcgaaacattggtggttcgtttccacggtctatgtattcttagaaaaaaggtgcatgttaatggaacagaaaacaaatatacctggtttgcttttattttttctgaacaaaaatttgaattaactgtgcaaagacacgctaaagcgcaacccagcaattaaaaatttaccttctttcatagagctcccttgctccatgagggtgatcgccttatgacttgagtttctattttggggtgcaaacttctgcattccagcatggagcattggagcaatggcttctccagtgtcattatttactgatatgcacatatgaaatcaatattaaactgagagttagctgtgaaaagctattcataccaactttttttgtgaaggagctatgaattgagaacatttatttaccattttttactggttcctcgccctctaagacaacgtgggctttctttctagaattttcacttgctgtgatagaccttcctgatccagttttgaacattggagtggcacagccatcatctgagtgagcttcatctaacagatgaactttttgttaacatgctacatgcctcctttatccttggtagactaataaaaacacatttcaatggcaaaaccacagtaagcaacatgttgagtgaaacctaccttccagttcttttgtaatgttccttggctccagaagtgcacttgctctcttaattgagcctttacttactgaaatggacctccctaacccagtttgaaataatggcaagtgaccatcagcctccaaaaaatttcctgttggatgacagtgattagtatggcaaatatctaaaacgcatcaacagtaaatatttttattgttccaaatttgactagatagtaacacaggtttaaatgaaatgaaaaaaaagccttttacaggaaacttcagaaaaccatgtaccttgcattgaaacacccccctcaggtgtaacagatctatcattcatagtcaggccaccactcatcagaacagacgttggtgtttcagtttgaaaagtagtggtggagacattagtatctccatgtcctgaacccaatagaaaaataagcaaagctgatgaccttgtgcattatgcagtaaaaaaatacaagcctgcacacaaagtttcttaccacttcttttggcacattcttgatctaatactgtccttgccttttgaattgaggtctggctcaccacaacaggcctccctaaccccgtttggaacactaggaattcacggtcagaattcaatttccttcacacagagaagaaatcactaataacaacagctacatttacataactccaatcttaccaatattttcagcacctccatccttcaccacagagctagatctttcactgatcaagactggtcttcgcgaaccagtttggaaaatcagagattggtcaggcctaccaaaatcttccgtgttttctactatgggaggaaagttcattacaaccagaaggcgcacatttctcaataattaggtagaagtatttaactcaaaattaacaagcaggacaatctaatcttatcctcacctgtattattttgctccaggacagccttagctttctggatagatgctacactgaccgatacagctttacctgaaccagtttggaacaatggaaaattttccttgtcatacacatctgccacatctcctgaaagatcagccgttcaaaaagtaaaggcatgattagaattttgtgtaaaattttgctagatgaaattatagaatattctgtcaacagaataaccttgttttggatttgtttgtccctccaaaacagtcattgcattatcagtggagctcctgctgactgggtctggcctaaccaatccagtatggaacatagactgtacagcaatgacagaagaattctcggcatttcctgaataatagattacgaagattcattatcatgatagattgtcgagtgctacacagctcaaactatcctaaattaattagagccaaatatatgtcaccatgcccaaagaaatgaaacattctgcgtaattacacagaaagtaagcagatgacaaacttcctaccttctaaaacagctctagccttctgaattgagcccttgctcagtgaaaccattttacccgatccggtttggaacatcggagacaaactatctttatgtacaccacctgaatttcataagatgcaaaggcgaattataccattgaacctcgagaatgtgtaactaatcagaactttgtacttctacctacagttgaatcatccaacctgatctccaagaagagagattgaaacaaaacttacctttaaatgaaacattactttctcccaatccgcactccaaattagaaccatcaccaaatggttgccctgcaatacatacaagtatcagcctggtatgcaagtcttggagaaagagaacagaaagacattgaattccatgctatcaacaaagcaagaaatgcaaaacttcagaaaagataggcagcaacttttaagaaaaagaaaagtgtgtgggtatcttcatctagtagtagcccgaggaaatcatcacagcaactaaagaggaaagggcatgaccagaagattggaaataattcaaatttattgctccatttttctcttgtttgtttgtaattcagtggactgcaatgacttgttgtcttcgtttcttctaatatatctaagatgtgcggatattatgtgtccccaaaagacaaaaggagggccacaagaccaataaaattgttgtgagaatgtaacactttgaaaaaagcaaaccgcaaaacctcttacttctctcattacttatctcctccgcgacctccccaaccaatgccttggccctctctacagccctctcgctgacggcaactgatccccccaacccagtgcagaacaccgcacctttccctgaatcctcgatcgcttcggccattccatcagcagcaaccagcttatccaaagctgcgatttccacatccacagcaaacaaacatgacacttagtacaatgcagtggcataacaagttcgtaaatgggaggcaagcacgcgcgtgcccgcacacggacgagtggagatgagatgggtggacgaggcggcagtgcggcaccttggttgaagaggtcagccatcgacgggacgctgcatccatcggcggcgccggggcctagggtttcgaggcgaaaggggatcagtaataatgcgggggctcattccacgaacgaatagtacctcgaagagagagagagagagggagagaccgaaccttcgggaatcgcatcgccggatcgcgcctctcccagctccgtcgcagccggctgcggatcgggacgaggaagcggcgcctcactggccgccgccgccgccggtggcggcggcccgtcggaggcgggtacccagacgaggctcccgtcgggcttcccccacacctgccacctcctctgcatcccggcggcacagccagaaatcgctcgcggcggcggcggcggtgagaggatgaggaagagacgagcaaaaaaaagaaaaaaaatggagaggaaaaaattcaaaacgggaggaggcgaggagggaaaggaaagcgcggagcggaaatggcgaagcggctgtcggtgggtgggctgggcccgggtagattcgagacgggccagcccattagcgggggtgggtgacagcccatcaacatccatttggctggacgccgccgccgccgaggaggattgctagggcggcacggcacggcacgacgcgtcgcgtctgttgcgtcagcgtgaacagatcagccaacccgccgactcgtctcctatcaccacctgtaccgaactgccgccacgtagatcagcggccatggtatacacatcaacgctcaacgcaacaaccaggtcaaacgctatatcaacagtccaatttgcaccctccgtattattaggcataactaaaatttaaaattttaaaacctatttttgtgtttatttgattatttatttatcgtagtttattttttatcatttgatttttaagtcatcagtacacacaatatataaatgttgtactcataagttcttttcttgataatgtgttcgctaccagggatgggaactttgcatagtgcgtacggaaaacggggcggcctattagcacgtaattaattaagtatttgctatttttttaaaaaaaatggattaatttgattttttaagcaactttcgtatataaactttttgcaaaaaaacacaccatttagcagtttgaaaaacgtgcatataaaaacgagagagatgggacgagaaaagtggcatccgaacacaccctatagtcttataatcaactgtagacgaacgaaacgtaatgattttccccgttacacggaaaacatacaacaccacagatacctattatacgcgcacacagtcacaaaagtatacccttttacacacactcatttttctttttttaaaaaagaacatactcccttcgtctaaatataagagcttatctagattcataatactgtaaaatgttcaattttagatttaactgcgatgcattcgaagttggaatttttcaaggatgaatcgacagaccatctgtcggtgatatgggaccgggagtatcatgaccagaggcttgaggcagacgcaatcgcccacgtggcctggcaccttcggggacgtcgggcccgagggtgaggtgtccgccctcctcgtgatttcccccgagggggggtcgggttgcgcttgccccggccccgagggccgaggcaccccgaccccttaaagaagtctgcgccacatatatgggataagtgagcacagctgtgctcacctaacagcatttattgcagtctggtcaagcgtgtcacgctgcgtgcaacgcagtacagcacgctcttttatccggtctgtgaccagtcacagaccggtcagatcaacggttaggtggcgactggcggtctgacgcacgcctcgccccgtcccgtcaagacgagtgcctctaggcacacgtctccaaccgaagctagcgtgttacctcttagagatggcacgttagccctggttagatgaataccaggcttcatcctaaccattacaggcaaggtgttacacgaagaagggcaaacatgcacgttgttaatctgacgcgtggtggacaagaatgaccggtctgacactggtcgcgtcagtaacgggcagccacgatctcacgttgcgcccgtctccgccgggagtggaggtaggtgtgggctgtcccatcgaagtgtgattcggacggcaaccataccagtctctgttcataaagagaagaaaagtccagtttggaaaggaaagggtgcatgtggtatccccttgaagtataaaaggaggaccttgcccacagagtagagggttgattcttttccagattaagagcttagaacaggggagaagggggcggacactttgtagctcattcatacacaaattcacaaaaacacaggagtagggtattacgcttcgcagcggcccgaacctgtatacatcgccgtgtctcgtgtgtcttgccggcgagtaatctttccacatacagagagagcttgagattgcaccctaagcccccggccgaaccggcaaaggggggcctgcgcggtctcccggtgaggagccacgagctccgtcatctggcgcgccaggtagggggctcagcgtgtgctttctgagctctcgcactcttccgtgtgcgccaagtttcccttgttctgcctaatggccgagcaagcaaaggcgcacgacctctctccgagtgtgagcggcgacgacggggagccaaatccacgccgtcgagctcgtactcccccacctcctccgcgccgaagccctaagcagggggaggcgcttgagagggtcgacaaatccgcggcgtcaccagtcgcgggtgatgcaggagaacgccgagatggggagcgtcgcctcctcgtctacggcgacggcagcacgcctcagggtgcgcttcaggctgctggcgcgctcctacgacacccgcctgtcgtccacgacccggagtctccagcccaacgatggctggaggacgtggccaacttggtcatgacggcacagcagcgcctgggtgctggtggacggtccgctaccaccaaaacctccggcgccgctaccaccggctccgtgtcgtcaaggcggagggcgcggcgagcggcggcggctgcacgtcattcggctgccactccctcatcgacaccgtcgactcgggaggatcagcatggggagccggatgcccgcctcaacatcgagcgccggcgtaatagccgacgtactccccgtgcaacggagggcgcctcctcgtccagagtgtcacctcgacatggacgtgaggatcagccctccgtgcccccggctggtggtgtcggctgtagatcctttgtggcgagtcttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggttggctaatgaacctgccacccgcgtcggtccactcctgggaggatctgtgccagcagttcactatgaactttcaaggcacatatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaggaggaagcgtggacatggaactccttcggttccggagtggcagcttcggccgcccccggatccgccgctcagactgggcggcgtgacaggaggaggaagaagaggtcggaccgttccggcgacgagggtcatgtcctcgccgtcgagggcgctccgcgggccacccgaaaggggaggcctgcgagcgacaaaaagaaagaggctggtactcccagcaaggagcgccccgccggcaggtggtgctccgtccacaacacctccctccacgatctcgcggactgtcgcgcagtcaaaaatttggctgaacgaacgaggaagtgggaggaggacaggaggcaggaacgccgtgagggcaagtccccggcggttccttccggcaaacggcgaagtgaggccaagcagaaggcccccgctgttgacatcgatgatggtgatgatgacctaggtttccaagaacctggggccaccatcgccaccgtcgatggaggagcgtgtgctcacgtctctcgccggagcttcaaggctatgaagcgagagcttctggccatggcccctactcatgaggcgacgcgtcgggcgcggtggtcggaggtggtcctcacctttgatcagaccgaccacccaccgtgtgttgcccggggagggcagattgcgatggtggtttcccccaccatctgcaacgtgaagttgggacgtgtcctcatagatggaggagcggctctcaacatcctttcccccgcggcctttgatgctatcaaggccccggggatggtgctccagccgtctcaaccgatcatcggtgtgacgccggggcacacgtggccattaggtcacatcgacctaccggtcaccttcggtggacccgccaacttccgcacggagcgggtgagcttcgatgtggcggacctcagtctgccctacaacgcggtcctagggaggcccgcgttggtgaagttcatggcggcggtccactatgcctacctccagatgaagatgccgggccccggtggccccatctctgtccgtggcgaccttaaagtcgcgctcgcttgtatggagcagcgcgcggaccgcctcgctgctgcgtccaagcccgagggtggtgacgagaggcttggcccctctgcccccaccgccccgaggcagcggatggccacatgcgacgaggtcccggtcaaggaggttgccttgggcgacggcccatccaagaccacacggatcggtggtcttctggatggcaaataggaagacgcgctcgtctccttcctgcgggcaaacgctgatgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgaggcttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttatcatcagatttgcatggctagggaggatgaggaaaaaactgcgttcattacccccgtaggaacctattgttatacatcaatgcccttcgggttaaagaatgcaggtcctacttttcagcgtactactcgaatttctttgggtagccaaataggacgtaatgttgaggcgtttgtcgatgacttggttgtaaaaacgcgcaaccaagaaactttactttcagatctagcggaaacctttgagaacctccgctccgcccgcataaagctgaaccccgataagtgtgtgtttggtgtacctgcgggcaagcttctcgggttcttggtctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaggcgttcggggccgttcacttggacggaggaagctgaaaatgccctcgcccagttgaaggcgtatctcagctctcctccggttctagtcgccccggagccaaatgaatccctgctactttacttagcagcgaccccccaagtagttagtgcagcgttggttgtggaacgcgatgaggacaatcctcattctgcgcacccccattctgtgctaacttggcccgggagcaagcagggaggagaggcccccgagtcaaacggtggcctaaggcccctgacgaccggagacggccctctgcccgcttgtcagacggtgctgggtgcccccgaccctcaggaaggccccgaggccactgcgggaaggccgcacttaacgccctttgaccccgaggctaaccctgtgctgactcgacccgggaaagagcagggagaagaggcccccgagccgaacggaggccagaggcccctgacgaccggagttggccctttgcccgcttgtccgacgatgccaggagcccccgacccccaggacggccccgaggccactgagggaaggccgctcctgtcgtcctccgaccccgaggtcatcggcacagaagacgagtgccccccgagaggccacttggacgaagaacgccccgggggtacggcccctagcagagaggatcggccccaccgaagggtgcagcggcctgtctactttgttagtgaggccctccgggacgccaagacccgatacccacaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatgcccgaggccagcacgaacccctcacagctgcctcatgccgcccactgggtgatgcaattcgacggttctctatctcttcagggcgccggtgcaggggtcacgttgacctctctgaacggggacgtcctcagatatttggtccgtctcgactttcgagcgactaacaatatggcagagtacgagggactccttgccggactcagggtggcagctggactggggatccgccgcctcttggtattaggcgactcccagctagtcgttaaccaggtctgtaaggagtaccggtgctctgacccacagatggacgcctacgtacgccaagtgcggcgtatggagcgccatttcgatgggatagaacttcggcatgtacccagaagggataacatgatagccgacgaactctcacggctcgcgtcctcgcgagcccagaccccaccgggcgcctttgaagaaaggctgacccagccgtcggcgcgacccgatcccttaggggagacggatgcgcctgaccggcccccgaggcccgtcggagtccaggcctcgggacccgaagggagcgctccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgctgacatccatgagggcgagtgcggagcccattccgcctcgcgcaccctggttggcaaggcctttcgtcaaggattttattggccgacagctctcaatgatgcagtcgatctggtccggcggtgcagagcgtgtcagttccacgccaagcaaatccatcagccggcccaggccctgcagatcataccactgtcatggccatttgctgtctgggggcttgatatcctgggaccgttcagacgggccccgggcgggtttgaatatctgtatgttgcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatccttaaaggcctcaaaaccaagaccttcaacattctcaagaagcacggcgattcatggatcgaggagttgccagcggtgctctggacgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcctgcggcgctaccatcagcgccacgtccgggcccgatcactctgcgtcgacgacctcgtcctacgccgcgtccaaacgcgcgctggattgagcaagctctcaccaatgtgggagggtccgtatcgagtgatcggtgtcccccggccgggctcggtacggctggccacgggcgacggcacggagctgccaaacccgtggaacattgaacaccttcgtcgcttctacccctgaaaggggggggtcgggtgtcaggttttggctcgggccaaccccgcacccccctcgggtgtgcggggttagccgggggctaccacacatgcacatatattcctttcagcatttcaataaaagcagtttcaatttcctaaaggttgtgtctgtgctgttctttccttttgaagaatcttgacttaaaataaggtcactcgtactcaaccttgccctcgggggttcggttcggtcagctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgtggatctccccaggcactagccccgacccgagccattcgaggaccgggacttgggcgcgagcccttatttcaagctaaggcgcaaaaggaccatggcacagatcatcctcaactcatatgcatagcaaaataaagttaacatagaaaatttttcatcatttttgattgcagattaagttgatctatacacaaaagaggcatgaaggccttagaagaaagaaaaagaaaaaaagtaaagattggcgggggcctgggggctcattcaaatgcacccgggtcgctggcctcgtcgccaccgtcgtcctcgccgctggcgtcgccctcctcgtcggaactgggggcgaacgcgagccgatcggccgagccctcgaagccgttgacgatgtggtcggcagcatccccgacccgcgcgcgcgcgtcatcctcggtcccgggagggaactcctccagcgccatccagggagagaagttggggtcccgggcctggtaactcgctagcacgagttcgaccgccccccgggcgaggtccctcgaggatgccttaatggtcttctcgagctcctcggggagttgctcgagaacccaagccatcctgttgaggtgcggagcgaggccttccagattggtggggggcaccgacgtctggcctccccagagtcccgcttgccgaccggcgcgcttcatgcgggagaccgcatcccaaagcatgtcgggcccaatctcgcccgccaagcgaagggcctcggcctccccggtggaggagtccagcgctcgctgcatctccgcgacggtgtgttcggcagctgcgaggcgggcggctaagccgctttcgcccgcggccgccccgccgataggcgccctcgcgtctagctccttctcccgtgcctcgaggccagcagcccgctgctccagcgcggctctctcggcgcggacgcattcaagattgcggcgcgcctgctcctcctgcgccgcctcgcgaagggataggctgtccgccagccgtttggtcgtagcctcggcctcctcgagagcccgctcccgctcggcgagtgcatcctcgcgaaggcggagcgcggactcctcctcggcgcaggcggcctcgtgcgccgccagcgtcgcctcccggagagcagtggcggcctcgcggtccgtcaagcccctctccacggcgccggcatgttcttccagcgccatggcacgggcctcaagggcctcctcgcgccgccgggacgccgcttcggcttccgttgcccgccgctctcgggcagcggcggagtcgagaaccccttgggcggcgtcgagcttgctcttcagctccgcctcccagcttgcgtgctgaagacggagggtgtcttgcgcctcgaccatcgcggtggtggcgacgagggcggcctctcgctcctcctccacctctcgggcgatctccgccagcgccgccttgcgggcttcgagctccgagatatggcggcggtgagccttacggcccacctccaccatggcgtccaccgagcgccgcccctcctcgacgcgcgcccatgcggcctcgagctccgctcgttccgctcgcaaggcctccacctgggcgctaaatccatctagcaccgcggtgtttgcggcggccaaggcctgcataatgggctcggcgctcaccggggcgacggaagaggaggagaaaagccgccttggagaaaaggcgacgcggcttggccccccggaggatgcgctgggctcggggatgtcccccgggcccgtttggtcctgggcgtcgcccggtgaggtaggcccaggcgatgcgcccgcggcctcgtcgcgagccgcctcggaggatgtcgcctgagggccgcccgagggagtgggcccaagtgacgctgtcgcctcagcctggcgagcccgggcggcctcctcccgggcagcttcttcggcttggcgggcccgggcggcctcctcccgagcagcttcctccgcttggcgaacccgggcggcctcccgggcggcctcttcagcttcccgaaggcgggctgcggcttcacgccggtcagactctcgcctccgctcctctgcggccgctggatcttcggcctcggattggccggacttggggtggcgggaggaatgcgacgggacatctctgaagcagaaggaaaagccagaagacgaacaaagtgagcaagaaaaaacttctttttggagaaagatggttgcaatgagagtgagacgaacctgcgagggggtcggttgaatgaccaccttgggggggaaattaggtttccccgggctggttccgtctcccccatcttgcggagccgcttcttcttgcgctccccctcgggctgagacgtcggcgcggccccctccgggcgccgaccgctggtacgcaccgccccgccccctcggggaggagatgggggaggtgttcctcccagcttcctcttcccttgggcgtcggcagggcggctgctccccgggcccccgacgcgaggcccagaagcacgaccccctcctggggcagattgtttcccccggcggctctcgcccgcgccgtcgtggcccttaggggctctctcctctgaggccccgacccccaacataatggatagaatggagacgcggtcgggatcaatgcagagggggaggatctcctgaggaaggcaagacgcctccgcggagctaaggttcagcaccctttggactacgatcttgaagtcctcaggagcccaatcccatctggctccctggtgggtccgcgtgtagtcttcaggcccagtgtactcccaggcgctccgggcgcgccgttggagcggcgcaatccggcgacggaggtaatcgccgaacaccatggccccggtgagcccctgggatcgcaggcccgccaggcggtcgaggacggcgtcgtactcctcccccagatctaccggcgcccgccagctggagacctgcgccgggggctggcttggaaggcggaggcgcgcttcgtcggcaaggggggtgtagaaccagtcgctcttccagtcgtcccacttcttgcggaggacgcaggggatatagcggttcagcaccggcccccgcggctggaagtagcagccgccaaccaccgacggcggtgacaccgactgcacggtgaagagccaccggaacagctgaagagaggggcgcaccccaatgaacatctcgcacaggtgcgcgaagatggccagtgtcatcaccgcattgggggtgaggtgcgccatctggagatcgtagaactccagaacatccatgaaaaaatgagaaaatggcgggaccagcccagccatcgcgaaggggaggaagaagatggaccgccccgggtagtctggtgccgggcgcccctcgcccagcatcactatctcccgaccggtggcggactccggcatgaagcggcgcggcagtccggcgtgcctctcgttcacgatgcgggaaggcggcagcacactgccgtcgagcagagcagagccccgtgccatggtggtggaggaagagatgattgggaacgagcgtgtgtggcgaaagtagggcgtagcagagaaagagttagagcttaggcagcgaaggcaagaggaacaatggcgaaaggaagggagcaaatccttttctcgatgcttttatacccttgccatcgctgggcctggctcctcgtttctcgcgcccactacttcgctccctcgtatctcgctatctcgctccctcgtatcccgcgcccacgcttccactaatcccattcgcccgtttacggcgcgtgaagtggatatgcggttgtggcaatcgaaacggattgtatcgtgcgcgcgttaattacgctcgccgaccgaagcggcgttaccgtatatccgagcgagacaaatctgctcacccagattcgcgcgctgctcaagtgatgtggcagtcttaaatagaccgcccattatggacaaccaaagttaccaataccaatgtgcatggattgagaccgttgggtattttgcccaactacggagaccggtcccacctgtcaccaggctttaggggtggcgtcacacctgaccgcttcccttgggaagggagattgctctggcataacgccgggggctactgtcggtgatatgggaccgggagtatcatgaccagaggcttgaggcagacgcaatcgcccacgtggcctggcaccttcggggacgtcgggcccgagggtgaggtgtccgccctcctcgtgatttcccccgagggggggtc

SEQ ID NO: 34150 - DNA, 4230 bp, Oryza sativa
agatctctttcttgttcccgctcgatggagcggggggaggggaggaggggagattgctccgtgcaagtgaggtgagctgggattttcttgacttgttttttttattctttttttctctcgtgatgaatctctgagcattgctgagagcggcgctgcttgtggttgttgtggagtagttgcggcatggaatcgatgcatgcttgtgtgcttactttttatcggtagtaattcttgttatgaacatgttgaaagtagaataaggctatctgtttgtccgtctaattcgtttgaagaatgtttttgtttccctttcgtcaagtttattattagttgggaattatagctggatgagatttcaggacggcgtctagtagctttcatgtgttaaatcgggtggaatagtgacacccttgaaattgaaattgagtgggaaatcttctgtgttcttggcggtgcacgtgctgttgcttgtggaatgccatcgtggcgcaacatgaaaaagaaaagaagtattttattcttagggccgcttaccgttgattgctgatagcctccttgatttttggacaaatgaaaaggattccgcttttggtttgttgtttttcataatttcaattgcatgctgtttcgatttgtgtcttgcaatgttcagcttgtggaattattgagttacctcattgggtcaggaagaagagaacgcgaaggaaaagcgatggccctgattcaatcgctgaaaccatcaagtggtggaaggagcaaaaccagaagctccaggaggagaatagctccaggaaagcgccagccaaggggtccaagaaagggtgcatggctgggaaaggaggtccggaaaattcaaattgtgcttaccgcggtgtcaggcaacggacatggggtaagtgggtggctgagatccgtgaaccaaaccgtggaaggcgcctatggctaggatcatttcctactgcgctggaggctgcgcatgcatacgatgaggcggcaagggcaatgtatggtcccacagcacgtgtcaattttgcagataattccacagatgccaactctggctgcacatcagcaccttcattgatgatgtctaatgggccggccactataccttctgatgagaaggatgagctggaatctcctcctttcatcgtggctaatgggccagctgtgttgtatcagcctgataagaaggatgtgttggaacgtgtagtccctgaggtgcaggatgttaaaacagaagggagcaatggcttgaaacgtgtttgtcaggagcggaagactatggaggtatgtgaatcagaagggatcgttttacacaaagaagtgaacataagttatgattatttcaatgtccatgaagttgttgagatgataattgttgaattaagtgctgatcagaaaacggaagtacatgaagagtaccaagagggagatgatgggtttagccttttctcctattagagtagtagtcatgctgcgggtcaataggaatatttcattctagctgctaggggatacttcaaatatcgggaacctgaagctttgtagtcatttacggttttcgtcttactgggtaatagctttatatatactataagccaactggtacaagaagttgtactgtgtgttgagtgcactgtggtaaaaatgaatctatatttaatgagcttactctgtcaatatttttgcttattttagtgtggttaaactcaggttagatattcaaaacgagtggcagatacttcaaggactttaggatcgaattaaattctcaaacaggtatattaggaagtttatttctgcatgcataaaagtatgacaaactatgatagtacaattttgcatgcatatggaattttaaatacttaaacatactactatcgcattatagcgctctatggtcattccaagtaccaaaagatacatcatggagatttcataaggggaagttgcagacattctctgaattcaagcctccttgtttcactgtgaaaggtcttctgtttgttaggccagtaggtcagccaaatccagcctctaatctcccagtccatggtcttccctaatgctgcaccacagatcttccaccagacgctgtctccatattcatcacgtgcgaaaatgacaccacccttcttcgtgaatgggcgatacacggtcgagtacctgtcacgaaaccaggcccgtggctgaagcagggagagcttggaaggctttgaagaataaacctcccttccgtttacaccatcatggagaaaccagttcaaggttgtagtgtttccatgcacagactgttcaaatttccagggtttcatggtcagtgtgaggctttcgctgaccgatgcctttagtccaaatgtgtttgggggctcgaatgaaccttcaatgcccttctcaaggccaaactcatgcgtggggttgtcggaggacttgctgactgaaaccgacaggacatctgattgttgcataggtgtgatttgcagcataacacgtgatggaaagtgcttctcctcagagccatgtccacgttcagtcatgaggatctcggagaccaaagagtccacatcacacctgagatgaatccactgtaagtgccgctcttggttttagatgatacacgtatggttgtttttttttccttgtgcagttaattgtaactttgaaacaattcagtttgtagatagactgcttttcaaggtctagaaaactctgatttaactacctaaattgagttcttcttcagctggtatacagggagaagcatgttaccgaactatgcataattgcttgctcaatgttaccttactgtaggcaccaaccaaattatttgctagttaaacctttagctttttttaccaaacatatgcagctacgctttgcatgccgcaaacttaattggttcccccgagtgatactactgtcacctcaggatgagtaggttttttattttcacctaaattagtaagtgtgtatacagttcatatgagatagaatcaaatccttgaataaattactgaccttatgttgtccacctttatctcgacatcaatccagttgtcccttctgattgttttgtaggcgagctgaatcacaccttcaagttgctgataagtaagcgagaagagaaggcgctcatcctgtgttggcactgcaggatcttccatgctcatggcaatgagtgggcagtatagctggaccttccagagcccacttgctgaaagagcatatgagaacagtggcgatggcaccccaaatgaatggtgtgaggatcgttgctcaacaatccagttagtcactgcaagattcattgtctgcatccattgctcctcaaggtttgctcccaacattctgacaaaggtctttgcagcatctttgcactttggcccagtcagctgagtcctcagggattcgaggcatcgacagcgaagagcatggggagcctcatagatgcaaactaggaaggccagggacaagaaaactatgttaaacacgtcctttagattgccatgaatctgtgccctgggaaactgaaaggacagctttttgtttggtccggatctcagcacccagtccacaatgtcaacaaacaactctaacatctcttgttcgtctagagactgctgggtgtatgatttcaggtggactggttttgacgtccacagagaaattggcacacggtaatttgcaaagatggagaaggtgacaaaggagggctgggtgggaggggttttgacaactgataggttcaccgatggctgtgatgattctgatgctgatggtgtggggcagatgcaaagggacatggcgttggagcgccattgggagaacggaggcaggttggtgatccaaccccatacatcaagaggtaagctgtgagccattacgttgttgaaaacttgagcttgttttgcaatgtgggagtatcccagtattggtgtggttttatagatggaagagatgatggttccgcagataaaattttggctcatccatgactgagtctaatgaagcacggcataatttttggtaaagcggattcttggttgttagaagaggaaatcaagtcattgagctgaggaatctttgttgttaattggagtttgaagaatcttcatttgtgctttgcacaggtgctaaagccaaaagttaactgctatacggtaatatgatatatcaaacccaagttggttggctaatgttgtagtgaagagaatataacgtggctct

SEQ ID NO: 34151 - DNA, 5298 bp, Oryza sativa
agcatttggcaacaggaaaaatggctctaatgaacccagaaatgcagaaaagcggttcgcgtcatggtcctgtttctttcagcttgggattattataatccagattattagtagtaagctgaaagaatcagacaacttattgaagtagcttattataatctggagcccagcttattataatctgataagctcatttaggtgagctttttctagattattgggtgaaaaattacccaccatatgccaccccactccctcattatacttgcaaactcaataatctaggctctaataatctaggaaagaaacaactaacagcttattctactatagattataacaatctagtttatagtagattataataatttcaagctgaaagaaacagggcctatagttagagagaatcctccacctgaatttcgtgtactacctgcctctgaaatctcgtacacgcagcttgtccttcaagctcgagcaaaacctttgctcctgtgctagtactaggcagttaggcagacctgcagctgcaggttaggatatgagaggttaggctcatattcgttgcttagcatcgttgcactgcattccacaccaacacacgaacactgcattgttccacagtccagattccccacgaactgatctgcctctgactagtacacggcgcaaaggagaattcagcaccgccaacagtagcagtaattcactggattactggcgaaattgttgcagctattattcccgcctgctcccagcaagcagaacctgaaaagttgcttcaaaaaaaaaatcaaaaattataccagcttccaagcctcccatatgtactgctatcaccagctaaagtttgttcattcgaacttctctaagtaactagtgtcctgtagacagttcagtttgctccgctacaatcaggtgacaaccaacaacacctatcttcagtgagaaacaacaacgggcagagttaacgcataccagaactcgctacggtgttgtttctaaaatgtaaaaaccgtatgactgggatgcacagaatggatgggccgtcaggcgtcagtgctcagcaatgagcggcaatatttcgcttgagagaaggtaatactgtgaggcggggttggggactggtgctgtacaaaaccggcccgggggttcatctgcacttctgcaatcctgtcaaatggcaacggcgcatgcgaaagctctcttcccggaatgccttggaaccagagatggaccagccttggccctccttgtaaacctcaacctgtgaaataaaaaacaaaacaaaataaaacgagagaaggatgtgagagttcggcgagttgaagcaacagcaatggatgatggagagagtgatcttgggaaagaactcacagtttcaacgtattcttcactgctttggataccaccaatgaggtatgcgttgccgtccaatgtaaccgcacatccgtgtgctcttgggacgctgagtgggctcccccttctccatgagttggcacgggtgtcaaaaatctctacgctggaaaacgtggtatttctattcaggccacccagagcatgtctgaaaatgaaattcccatgttggatgttaagtcgtatattatcaggtttatatcgagacgtcaaataaaagatagtgatataaggctaatagtagcatctaactgccaggtggaatctgtgtgtgtgtttttttgaaatcacatgacctctctgttgattacacacacagataaagcgagcgaaactcacagtgaatcccccaagacaactactgaatgggatcctcttcttgtccgcatacgtggaagttgggtccagaagccttcccttggatcatacctttctgctgacctgtgcatatgaggatcaatcattcaataggaaggtctcagaatcaaaatcaagtaaagcatggagagaatggtgagggtggatcgtaactgtaagtacatgttgccatcataaccaccaattacatagagaacgccatttaattcagccgcagcaggagcacatcgctggaacaataaaatacatgttggtgaggtgggtatattggtcaaaaataaaaatacattaaaaatatgggataatatttcatgcaaggtgaactggaaagttacaatgtatatgcctcataaatcccatgaaattacatgaattgcaatttgcattccataatttgaaatagcctgaatttgaaaaatatttattgcctattcaagtgctcaaaatgtagcttagattagatttgcaaatggtccaaccaaccctgtaagactagtgctcaagcgaatgtccaactcacagtcagcttgcccactactgctcaaacagctatctaaattctaaatcactcagcatagttcaccacgagaacaaacttttttactgatttacgacacgtaagaaatgattgaaataatagtagaaactgttctgtgagcagcactattcatcttgtaaaagattaagaacccaaagatgtaagtgattataggaaatgcagttcaaacagcctctcttcacaacatgtttttttcctgggccatctaataaatcttgagccttatcaagaaaatcacagtgagaacatagcgaagaccaggaccctattaaattggccaaaaaggctggtacattctactctatacaagtgttataagggagtagaagtagaaccatacaggttgctgcatggacaaactgtatatccatttccccactgctggatcaaacatctctacttctgaaaaagactgagacccatcacccccaccaatagcaaatattttaccattcaaggtagctccagcaagatgccctttctcatgattcaagcagggcaatcctatccacttattggctcccctgttgtagcactccactgcaataaaacaaatgcagatggtcaacagcttgcttatatagagcactacgtttggcatgttgaagaatgtttacctgtgttgtaccacaaactgcgaatgccattccaaccaccaaaaatgaagacatggtcctttaatgtggcaacagccgcatatgcacgggctgagctcatcggcattagagtttctagtatgtccgttgcagggcaatatgaatcaagggatgacagccagttaatgccattatggccacctgttaggagtattgatggcccttctacatcatcatttgttacaccgaagagtggtgctgaagagctatgcgatttctcaagctgctgttccagatgttcaacttttctttccataacctttaccaatttcttcaacaacaaaatttcttgatctgaatcaacctagaacgttcaaaccataatcaagatcggagtttgcacacttgaacagcgtaattaactcaatatcaaacacatatatactagtttggttttccggttaaaatttgaacatggtttaaaacccacaaaaccagacatactgacaagagataaaaccaattaggaaaacgggttcatctatttataccttttcttctttaaaagagaagatcctactgattttaagcaagaagaaaagtaccttcatcttttccatttcttcggtcttcttggataaatcattgataatttgatacagctacagacaaatgccaaaaagcaggccataaacatcgcaccaaaatatataagttgtagcactgaaatatggtgcgtaagggaaaatggtaataagggatggaatagcttaaggcacctcagcatattcatggcattgcacaaaggatgtatctttcaatgatgtgtcacattgagatgtggcattaaatgaatctttggggagagtagcagcaaaccgtgtatcttgacgtatgctttgagctgaagtagaaacaggagcatcctccaagaaattggcttccttctgttgtaaagaagacagctcttgcagctttactggtaaatccattttagcatgctggtcatcatccacagattctttatcttccttgatcaaaccagcaaccaggtcatcacagccagaagcatctttgttaaggttgctccttgatgttgtacttgtgctagcaaggtcgacttctacatcaggcaaggtatgaggaacaatatcatgtgagtgtgatgaaacattgaactgatccacatccttcacattggattcactcttcactttatcagaaacaacaggtgcttttgctgtaagaaatggcagaggtcgattccatggatttggaacagtatgagcggtagcaggaggttttggaatactaagtttgttttgattagcgcgaacaggagcaggtagaaacaaagaaatcaaatctcttgtttgtcgatggtctagctcaaaacggaagtggctaggtttatccttgcgataattgtttatgattacacttttgtatttgctttctggaagtggagggcactctgtcctggtagagaagcggacctgaagaacacaaatactcacaatgcttatgaaactataaccagaacaaagaccagtatatgttgtttctattatacctgtgcaggaaatggtgttgtctttgcatttgtctttgcatcattagactgttcagacatccaagcaaatcggtcgatattaagctggccagtgcttgtagccttgaaaatgccatgcaattgtctgttactataattgaacagaaagagaggcaagccaggtttaacattcttcacatacaagatattgcgttgaggcaaacctatcaaacaaaaggcaaacgaatggattcccaattaaacgagaagttcaaaagaatgttgattagcaatgtcaatgttcttgaataaaagtaatcacacgcgtatggattttacatatcatttagatgaaattaggacaggcgaaaagggacttttactaaccaaataactgtttagtgaagcattcatcgaatgtgttgttattgcaacaaaagaccacccctcctagctccttttccgggagctcacggaactcgttctcggtctgagtcttctttccagcacccattcttcgagaaattatcaacattatgcaaaacacaaacataagtgacattatctaaaagaaacaaacataagtgagcatgtaggtatactgcagtagcaaactagcaatatcatgtacagataagttgtcacaacaaacagcacagggtattattcctttgttggaggattgtaattctggtaagtttacttgagtagtaccaacagggagcggttttccactaaaaaaagatgggggagatggattgggtcaaaacactagcaaaaaacaaaaacaaaaacaa

SEQ ID NO: 34152 - DNA, 1120 bp, Oryza sativa
  unsure (1)..(1120): unsure at all n locations
acaggggagaagggggcggacactttgtagctcattcatacacaaattcacaaaaacacaggagtagggtattacgcttcgcagcggcccgaacctgtatacatcgccgtgtctcgtgtgtcttgccggcgagtaatctttccacatacagagagagcttgagattgcaccctaagcccccggccgaaccggcaaaggggggcctgcgcggtctcccggtgaggagccacgagctccgtcaccatccatccaagttgtaagttgtatatagttcatgaaaaaaattaaaaatttatgtgtagaaaagttttgaatgtgatatgatgtgatgaaaagttaaaagtttgggtaattgaggtgtactaaacacgagcagccgtaagtttcaaaaatttccggcaggagaattcgtaatgaaattcgattatcgaaacggggacgtgttgtcaccgacacgaggacgcgaacgcgagagggagatgccgtgacaggacgcggttgcgggtgcccgtggcacaactcgtgtgttgacccgcctcgcgctcgcctgccaccaccgccaccgccagcgagctggatgagccagcagccgcccccgcccgcggttgcttcccctccccaccacgtcaaaacccaaccccaaccatgatgctcctgcgccaccaccaccacccccacagcggcgccgccaccaccagcagcagctgcagcggcggcggcggctgttagagaggagggcacacaccaccaccgacaccgacacgctcgccatgccaccaagcgaggcggcggcgtgaggcgacgcagatctgaacggaggaggaataggaagaagggaggaggaggggagggagaggagttggaagagttggaagaggaggagatctctttcttgttcccgctcgatggagcggggggaggggaggaggggagattgctccgtgcaagtgaggtgagctgggattttcttgacttgttttttttattctttttttctctcgtgatgaatctctgagcattgctgagagcggcgctgcttgtggttgttgtggagtagttgcggcatgnnnnnnnnnnnnnnnnnnnnnnnnnnnnnnnnnnnnnnnnnnnnnnnnnnnnn

SEQ ID NO: 34153 - DNA, 1044 bp, Oryza sativa
aatgtagatcaacacataaatgtattcctttatattttagaactgtagagagtgttatattgcttgccattgcggcgcttgatctacttagaattatcatcagaaacaccaattgatatgaaaataagaatggagaaaatattagtaacattattcattctcataatgaattcatgacttacccaatacattaaatgaatctctgctctccgcgactgcaactgaaaatgctaataccagcacaaaagcaaagctccttatggaacacattttgcctgcttgcagaattgcagattagagaaacagaagctggaaagttaaaactccaaagtatccaactgaaagttgaagctgtgtgcatcagacgaccagaatgcatctcagaggtcaatcatgcagaagttttccccaaaatggttgactagacagatttaccctccggttgcttaactaaaatttctccatatggccaaaagaaagcctcaaatagatcccttcctcctctctcacattccaaatctagtgttagatcttacaggaacgcttcagaatcccaatacagtggatttcagcccatctcaagaccaatttttgcacaaaaaaaatcaacaaactcggtaacgctggattagatttctagattagatctcacacttccacaaacaatgcatacacgagttgcgcaccaaatcagccagattcagcttccccaccgaaacaaacgctagaaagatccaaaatttacttccttttcatcactacagacgctcgaattcgtaaagcataaaactttctcttccgctactaacctaccttggttcgtgggagatgaaatcaacagctcatgatactcaaatcgaaccccccatggttacggaatcgaatcgggcagagaaaatcaagaaacagcgagtggttgctaagaataagctaatatggatcaaggaatcaagcatgggctcaccttgttgcttcttcgctctctgtctgctttgttcttggaacggggtggagaagtcaggagagcaagggaatcttcttgaa

SEQ ID NO: 34154 - DNA, 812 bp, Oryza sativa
  unsure (1)..(812): unsure at all n locations
gttttgatgttctgaaagcctgaaaccatgaagaatcgagcagtagagatgtcgagtggcgtgtacacgtataaacatcactgcgagggaggattcgatatccatgaaatctacatcaagaggagcaaattcagggtgctgttctcttatgtcggcgaaattttcctctttgcgaatgtactgcatgccttgctgttaaaggtcgttgttctctcggatgataatcccaagtggtagctgagtcttcactatttcagtgacctactgcattctcccaaaaaatttatttgctgattgctgaatgccaacatttttcatgatgtgaatagatatgtgaggttcttcaaaaacaagcttatcatacatgccttgtcagtgatactcacatgatgttgattttgtttgggtacttaagattcagaaagagaagaaaggtgtcaccatacgcttgtgactttaatgagtttctgactttctgtgctcaaatgtttcaggagagtctatgcatcaattctttttggagtatttcatttgcttttgccgttgcaaaatgcttaaaatataagcctgtgaagaaaggtaggtgggcagtgtctgtattatctattttgtgcattttgcactgattgtttagttatttttttacctgaaggaaggataaagatgtatacccttgttactcaggatcctgattaggaatgcttatatggaagtgcaattgtgtgctcctcattgataccattttaatcctgtgcagagnnnnnnnnnnnnnnnnnnnnnnnnnnnnnnnnnnnnnnnnnctagaacaacac

SEQ ID NO: 34155 - DNA, 505 bp, Oryza sativa
  unsure (1)..(505): unsure at all n locations
atagggcgaattcgagctcggtacccgttagatctaatcgtgtggttcagatcaagttgtggaacgtgactgagtgaagtatattttacacataggcccttcaattaatttcataatattgctagagagcaaatatatcgtgggacccaccgacatgtgggacccactgacatgtggggcccaccgacatcctttctccttcccttcttcttcctcctccctccctcctctcttttctctcccccttttctcttccccattcggacgcatcagtggcggcagcggccgggtggattggcgacggatctgggcggcatggccgcggcccctgcgcccccccccctcttctgggcgtcggtttcctcgccttgtgtgataactaatactcccactagctgctactactacatcactagcttagctaatgacgtcgccaagnnnnnnnnnnnnnnnnnnnnnnnnnnnnnnnnnnnnnnnnnnnnnnnnnnnnnnnnnnnnnnnnnnn

SEQ ID NO: 34156 - DNA, 746 bp, Oryza sativa
agctacgtcatgcgcagctaccggttggagtccgaatcttaaagtagaaaatggaaaaacacatgtttggtgcacccaccgcgatggacagggaaggcgcccacgtggaccccgggcccacgtgacgcacacgtgtcagtccgtggcgcgacggatccgatcgggcacggtgttttccttcccacgtgtggacaaacgtacgtgcgtggccgtgcctacgaacgtaccgttcttcgtacgcgcgtacacgagcatgttttaaactcgcaacttgccgatcgatctctcgcacagctcaaacacagtaatgccgcgatcgagctaggaatctactgcagtggatccacatgagtagccataacaatactataattagattccgttctactccttccgtttaaggttataagtttgactaagtttataaacaagtatagtagtatttataatactaaattaatttcatcaaataaataattaaatatatttcataataactttgttttgggttgaaaatgttactacttttttctacaaatttagttaaacttaaagcaatttgactttaaccaaagttaaaacgtcttataacctgaaacagaggggtagtatattgtaaacattaactctcatttattttccgttagcatatttccaaactgttaattaaacgatataatttttaaaaagtttatataaaagtttttttaaaaaaaatgaatgaacattttttaagtttataatag

SEQ ID NO: 34157 - DNA, 587 bp, Oryza sativa; identical to SEQ ID NO: 3521

SEQ ID NO: 34158 - DNA, 588 bp, Oryza sativa
  unsure (1)..(588): unsure at all n locations
nnnnnnnnnnnnnnnnnnnnnnnnnnnnnnnnnnnnnnaaatcgacagctgcggcaaccatcaacacggggggggatcagacttcttaccttgtcaagcccgccttgctcgaagagaaaggagcggaacacctcggtggcgccccagtctttcccccggaacgccgccaccggctcgtgcccaccggactccgccgccgccctctcgaaggtggagcgcaccgcccccagggggttcccgacgaggtcgtactgcggccccaccatcctccctctccctctcctcgctctctctctctctcgttggggagattggggagcggagcaatggcgggagaagtggtgaggtgaggagggagaggagttatagcgggtggggttttcgcgccactgacgggggcgcatcccgtcgttttctccccctcttcccgccaatgcgcgcctctcctggtacttggaccttggtgcgtctattgggcctaatgggccggtctagcattcggcacgggagtgccgcccgtctgcgggtgcgcgctgctgccgggccgagatgcctccggcccatatgacggctgcttattgggtagcg

SEQ ID NO: 34159 - DNA, 243 bp, Oryza sativa
atagatggacgacattctcgtgacctgcgagaactgccccctgatgacaatgaagacaattaggaattatcgtagtcagaggttcgactcctggacctactaccttgtcttccggccctctagaagtctggggatctcgagtttcttcgtcgtcatgtgatgtcgtgatgtcgttaaccttgtccgttgtcgtccttatgtcattagtcctagacaatgtcgtcctagtgaaaacgacgatcc

SEQ ID NO: 34160 - DNA, 1135 bp, Oryza sativa
  unsure (1)..(1135): unsure at all n locations
ctttctggctacatgaagtggagttactaatatattgctctatgaagtgaaagtttcttcttgctcaaaaaactactcctataataaaatggctaaatatgccaattttctaccactactgaatctgaagttcaactgatgtgcttcattcccatgttagccttgatatggtcagccaccagtattaatattaacaaatttcctgtcatatttgagagaactgaaaccgcttctttgaaatgggatctaattgttgaaatatgttttttttttcatgtttgtgcatgattggagtatctcttttttttcggctgtactgaaatttggtttgtgattaacctgtgaaagtatctgtttgcactgctcgatatcctttattttgaaagcgacatcccgaggaggaaggctcttgtgctaaagaaaatctttagttcctctccttccaaattttttggttcttctttttgttttgattaatgaaagcagaaattcttgaactgaaggaaaaacaggtagctctactgtgtttatggtctttcctgtcgaagtaggaattcataggtgtgtggcaatgctcagcgattgcacaaggttggttctccacttctctgcatcagatcggatatatttcaattggttcgattctgatctatactgactcccttttagctaaaaccctgattactgataatatatatgttctactcagtgaaggggatgcaattagacttggaaatggagttagaaggcttaaaggttgctaatgtgatctgcatgatattatctcatgaaaaccaaacattgttttgccccttttatatattttgcccttaggattgaatcaatatttcagaatggacgaaggcatatatcctcttcaaagaatgaggtctcaagggatttggttgtcaatgtaaaatcacagatgaaacaatctttgttggtaagtaaatgcactttttgctgcattgactgggataatctcgatgagcaatgatgttgtttgctactttgattttaatgtagatcactgaattgccattctactatatatgaagcaatatttttaatgtgtaaaatnnnnnnnnnnnnnnnnnnnnnnnnnnnnnnnnnnnnnnnnnnnnnnnnnnnnnnn

SEQ ID NO: 34161 - DNA, 1477 bp, Oryza sativa
ccttctatatccggtctacgggtatccaccgtcgacaatccataatcctaaaaaaacaacacatcaacatcacattcatcgataatacattcatgaagaacacacattcatcaagaatcaaacatattcatcaagaatgaatcggttcgaggaggaggatgccttcatcaccaccgccactgcggatgaagaggagggcgccaccaccaccgctgccgcttacgaggaagccaccgtcgccacctcccgccgctgagccgtagtcgggccaccgccgccaggcgccacgccgggccgtcggaccaccgccgcctcccctcccgccaccgacccgccgccgccgcatccccttccgtcgtcgggccgctgacgccacctcccctctcgtcagatctggcagaggggagcgcgtcacccgtagctgccgccgcctccctcccgccgccgccctcgggtgcagagagagagagagaggccgagagagaaaggagagggtgagatagagagaggtcacgggtgagagaaaggataaggttgccccctcacctcccactcggcaagcggataaggccgtctcttgactcggctcgtttggtagggtgtcggtcttctaaaaaaactagcacctttaatatattataggtgtcagtttttagtgaagacacaaaatataataggtgccagtttttatttagaatcgacacctataattacttaaaggtgctggttttttgcgatttcaacccgcggaggtggaaaaaggtctataggtgccggttttagtactaccggcacctatagtggcgactactatctctatcggtacctatagtggcgactactatttgatgtcttgtatgtcttgtagtagtgcttcttgaatgttagaggagccggttcccccatcaaccatatccatgtaaatattttacctcatcttatacctaatcttacaatgggtaccaaagtttttattctcaatatctctgctgaacaaaaaaaatgcttatattttgaaatgaaggaaatagttatatttagaccattagctcatcaagctagcttagctgtaggaaaatttttcaaataagacggatggtcaaacgttggatatataaatctaaaaatggagtctttgtgggacggaggaaatattaattaaactgtcagataagtcaaaattttatgtggcaccaaaattaaatttctgttcgtactagtcacaaggctaagcatgagagtttgagaggagaggaaaagagaaaattgagaagatatgcaaaacgagttcgcatgatttgttgagtattaactattttaaattgtaaaaatggattaatatggttttttaaaagcaactttcccatagatttttttaaaaaaaacacatattttagtagtttggaagcgtacatgtggaaaacgaggtcttttctttttcgatttcccagccacgaacaagttagagatgttgatt

SEQ ID NO: 34162 - DNA, 1815 bp, Oryza sativa
atatactagtcccaatagttcacttgccctttcactttgacccgtgaaaggtgcctttgtcattttgccaagtaaacaagattcgcatgtctcaaatgattcaaaatcaaaagagtgtagaagtccatctctatgaagcttctccatgcgtttctcatttatatgacccaagtgacaatgccaaataaaagtgggattcaaatcattaggacgttgcctttttgcattaatgttatagactgaacatccatcaagattcacaatgtataagccattcatcatgggtgcatggaaatagaaaatgtcattataatagactgaacaaccattgtccacagatctaaatccataacactctgcttgcaaacaagaagcagagataacgttcttacacaaagctggaacgcaataacaattatttaactccaaaactaatcctgacggtaaagataatggcatagtgctgactgcaacaacaacaactcttgctctattgcccacgcgaatgtccacttcgcctcttgctaagctcctacttcttttcagcccctgcaatgatttgcatttgtgagcaactgacccggtatcaaatacccaagaatcagtagaggaagtagcatgattaatttctataacattaatacctgaggtggaactctttccatcctgctgcttctgcttgagctgctctaggtatttcttacagtttctcttccaatgatctgcctccttgcaaaagaagcactctgcatccttagcgggccctgtcttttgaaccttggtcttagagttgctagtactcgtgatttcatcagagtttagctttctcttttgaccactcttcttgttgttgggcttgcgcttatgcataaccatcacatggttggagaatcaaatcaatagccaactctcggctaaaggaaaaaccaagcttatccagactctcggtgtaaccaatcattttgatcacatgtgggttcactggattaccttctacaagcctgcacgcaaacaaggactttgaggtattaaacctctcagctcttgcttggtcctcaaacatgttacgtagtcccgtgattatcgtatgagcatccaatgcctcatattgactttgaagctcaggggacatagtagcaagcatgagacagcttatatcaagataatcattgcatcgcttttcatgctccctacgttgagcagcagaagcattgttgggcaagtcagctggaaaaggctgtgtaagtacaaactctttgtgctcttgcctgagaacaattctcaggttgcgataccaatccatgaagtttgttccagtcaacttctctttctccagaatagaccgcaagttaaaactggatggtgcaggagctgccatgatctacaatagaaatatatgtatgcaaaatcagcaccatgtctacagttaacttttcattaaacaatttaacaaaatactcccactatgtattgtaaaacaaaattccttctagtaacatagtgagtcaagatcctcattttattagtgtctagtgagctttggcatcacaactagacaactatcaaaataggtaagcaaccacccttgccttaattccacaatccataatggtggacttcctttgttgcttgtttggggggtggaacattcttctcattgtcccaaaccccaaaccttatgcccccaaaggtcaaaaaacggttttgataccccttgccaagtcacccaataatctccgcatatagatgtgtgacatctatcctattttatcatgataaaaagtgactctgtgctatggcaaacccatcacttat

SEQ ID NO: 34163 - DNA, 3456 bp, Oryza sativa
atctccgcatatagatgtctgacatctatcctattttatcatgataaaaagtgacactttgctatggcaaacccatcacttatgatcacaaccgtaataggtgcaattattggaagagcataaattacacttaatttttctgagggaatctatcctaccatgtcatatcaaatatacaacagcaataaagtaagacacatataaaaccccaagcgaaatctcaggggcaatgcacacggcggtcccgcgggtttcagggcagcgccctgaaaagttcacagggtacatagatctcatctatgattcgccatgtgaaaaccttaacggcgtaatcaaattatgccgaaaccaagtcaatctcattggctcctttttgtcattggcgtgcggttccagtggacattggactatccgatgaacacaatcacgctcggccttggtgagtactagacattccagtgaagtcaccaacacacttaccgattgatctcatcaacccatgcagctatcggttcatctcatgctccgatcacctaaaaacttatatacaacataatagatctcatctactacacccgcatatcaactatatgcaatgatctagatcataaactatacaagggggctctgataccactgttgggatacacgtaggctacgatagcataaatcaaaattttctatcgcgtaaaccaggaaccatgcaagtattagatcatagatcgttaccactcgacgcgctgcgcagcgaaacaaggtgctaagaagtcgaaggaattctcgcgaagtagagcgcgtcgatgtagagaaagtagtcgatcgcaccggctcgaccttcccctcctcgtgcgttctcctcgccgtactcccccgccgatcagcaccgcaaaccagtggcgcctctaccggtatccacacgtacagggatggaacgccacaggcagatgtgctagtacccgtgcgcggctagggttttgctcggggagggaagtgatggctagggtttctcacgtgatgcaatccctccgccggtcacacccctcacgaatatataggatccatcactcgggcctccaaggcccgtaggactcctattcagatccctatccgaattaagcttatattggacctccattcaatctccttattccggcctattaagcgtgcgaccctgtaggttcatgtacactcggctgtaacccgaaaactccttttcggtccacgcgtcaatagcggcccctagcagaacgtattgacccaccgggcatacatagagatcatatcggctgaacctctagtgtatacttgtatgaacccctttgcctcacgatatcaattaagctcaaggctagatatgtgccatcctctaatagctcaatcattcactcgaacctgttgatagattatataacttgtgattgactcctcagtcacctttggcatggctatgcacttccataatctacaacatcgagagacccagagatatctctccataggaggggcaaatcccatcttgattattcatatcccactacatgtttcatagcatacccgaaaagtacttttataactacccaattacggagttgcgtttagtagttcttaagtaagctactacatattttgggaaccatgacaatctcaggtctaaggattcaacaccaacactaaatgagatcactgatgacacaatacatatggctcttgcagtgtctcatgttgggtctatccaacaacatgttcgccaacatgtgtccacattattaatttagtatctctataccatgatccatgagacatgatcatcaattaatacatgtgctgattatctaaatatatttgttccacatatgatatttgatcagggatcctttagaaataacagcatataacataaagagtctcatgaaagaatcacatattcattaactaataatgagttatctatttcaaggaacaaagtcggataaatatgtaaatatagtatgtgatacaatcatctctatgattgcctgtagggcatatcactaacactagcttggtgaagctgtatcaaattaggatgatgcctgctgctaggatgccacaggttgtcttggccgaccggtgtgatcggcctacatgagtgcattgcttgtagagattttgagccgtttccacattctagtaccataacagacaaaaactagttattcggtcatcctctaatctgtgagagatccgccttccaaactctgttatgaaggagcagtattattttgatcaaaagtacacgcaatactgttagtcatataacatcatggtgtttcgatctagttttttttactgcacatagtagtatttttaaaccatccgcttgcaggagatggcgagtttgtgataggggcagagtgagcccaatggggaggaggactcagagttcagcattgtcggagatgcaagacggtgaccaggattggaggaggcgatgcatggacgaagctgactcggtgaaacctgacatccgacgggccaacgatatgggctgcacagcccaatttggatcacgctcaggacgtgtagtgtaggctgctcaatgttgcagtcccattctcattcatccaatatagtcgcgtgttgtaatctattacagtctactcccttgctaaggaaaaaacccgcttatttcatacacgaatatggacatagatatcttatgttcatatatattcgtgtataaatgttatggttttttagagagggtatcttgtgtattagtgtctatactatataggcaccatctatgttatgatatacttttttttagggtgggatttaagatatactctttgttggctcaaattttatatttatagcaagctgaaattgaattgggatcatgccgactacttgtaacctacctgttcgtactaatacaaatgtatgtgtacaatctcctctggatataaaagaagagctgaaagagtgaagtaggaataggggaattgtgtagtgcaaactcatatgtaggattaggaagcatcgtgaagcaaagtatggcatagctagttggccaaccatcgaacctacaaaacgtatccgccgtatgtatatgaaaacctgatgatatatagtctccatcatgtatgcatgacacaactagtgtgggagtacataatgaaagtaaatcagtcatcagtggtagcctacacttggacctgtttgttaacatgccaccgatttgagagtttgagacatggtggtaaagatactgccactaggaagaaacatgataccaattctacttgaaggagtgctaaactcagctatatatggtagacattaattatttggtgtgactattagtttttccctatgctccatgtgttcaagaagttttgaaatacaattcaatgtatattattgaattgcatatgtggaaaaaaagagaagaaactgagttcttggactgaa

SEQ ID NO: 34164 - DNA, 4843 bp, Oryza sativa
ttatttcttcttaattattatttgtgctctgaaaattcaagtaaaattggaggtctccttttagaccaaggagaatttaacaaaaattctccggaccacattcgaattcttctggcacgtattttagtgtttgccaatttcttttcgaattttaattaattctattattccttttagagaatgatttttatttcgggatgaatttatcaggacgtgacaataccttgcaatgattagtcgtatgagaccatgaattatgccatttgcaataacttttcttgcccaattcttcagccgatggaattgtatgaccagcagaaagttgaatctgcttctctcggagtagcaagtcgaaaatcttgtcagccttagtgatatcaaagtcatacctctccttttttcctgagttctttacccattgccattttacaacctttttactccttacccactcgtctgtagctatctcaaaatcatcatcctcatcgtccgacccatatatataaggacatacatgattaacctttctagaatttttcctagcctctgcattcctttgttcatgcaaggctaccttctgtgtaaggtgtgacaagctttcaaagtcttccgatgagaacttctccctaattggagggatcataccctgaaaagccaaatcggcaaactgggcatcagtcaaactcaagctgtaacatttatttctcatctccctgaatctctgaacatactcatgcattggctcatcatgcttttgcttgattgacattagatcggacaatttcatctcatgaatcccactatagaaatagctatgaaactgcttttagaaaatcagcccaattgttaattgatccatatggtaaagaagaaaaccaagtaaaggccgatccagccaaagacaaccggaataacctaaccctcatggcatccacagccaatgcttcaccgcactgagctaaaaatcggctaatgtgctcataagtcgatgtactatcttgccctgagaactttgaaaaatctagaactttgaacctgttaggtagaggaactttgaaccattcaggatacggctgtcgatataggtttccaacatctttcggcctaagcccaaactgctccttcgtgacatctgcaatcaaatcggcccatggtcgttgttaaggtgttccttgaggttgttgtggcatgggctcgaattggttgtattgaggaacaaattggggttgagccgatcctgcatgctggtactgaacattaggtgatggtggctgatactgatagttcaaattgccccctggtaattttggaggtctggctgaatattgcgcaacaaatgttcaggaataacttgaggaacaagtgtgccatctggttgtacatgatgaactaagtgttctgtgacaacctgatttgcggtatgctgcacaggttgaccaccaggtgttgcaaacccagccaatgcattcattggactttgttgctgaattggctgaacaacctgttgcctcaacggtgtctgctgaattggctgcaagacctgccgtcttggtggcgtctgctgaactggttgcacaacctattggattggcggtgtttgctgaattggttgcacaacctgctggattggcggtgtttgctggattggttgcacaacctgctgccttggcggtgtttgctgaatcggctgctgctgggctggatcaatggtgtgttgaggatgtaagaacatagacgcaacctggtcttgtgttagccgactcacattctgtcctgcgtgctgtggttgttccctcactaacaaccggggattgattaattggcctggagccgaaggcggtgtagtaggtgctggagccgatgctggtgccatcggctgagccgacggtgcattaagagggactgactggacgactggtagattatcggtgactaatggccgataattcgggaacactcctccttgtaggtaaaccagtcctgtagcttgatattcagccatcgaaccatcaatcattgactttaccttgtttgccaaggtgttggtcagtatgccagattggttgatcaaagcatggtgtacggcatagtcaatctgatcttgaaagttgttgaactgcacctgtgccacattgccatcttgattgaaacctccaccttggactccccgagaaccatcaccttgaatcccttgagaaccatcaccttgaaccccgtggactccttgagagttgtcacctagatttgctagggaaccatctgtagcacctttgtcactcggttgagccgagccatctggagcttgtttcccttttccatccttagaggaaccagtcccgggatcgtcagcaaccacctttattttatacttctaaacaagcgttcccttgcgagtctgcatcaatgagtacaagaactgatctcgtgcttgctgcatcatcgcgtcaaaatctttcttttgatcaggtgtgaacttttctggatcgatggtcacaaggttcccttcatcaacgtctgtgaaacctaacttctggaatctgcttaactccagtgcaggtccaaaactcgccttcgggtatgcaagtgtgccagttgatttgatcctgcaatcaacaagaaataaagatgaagaaaccgcggttaaacctataaacgatagccgatcggctaggtgccgatgacatatcatttatctttgagccgatgtcatatgtaaatcgatcggtagttataaataaataacaaagaactaaatctactcgatcggctgtagatatcaacaatatatagttcttatatcgatatatacttaaatcaagtgattgggatagatcggtcgccatgccgagacagtgtaaatcacttaggtcgaagtatatattaataacgagacaatatgtgtttataaaatagccgatcagatagatctagcatgtatcggctaatacaccgatacaactctatgttaagatattaaaacaagcagaatatacccaacgaaagcttaatatgcttagatgcgataatatctttacataaagggcagatttaacatgtcaacgaagtatatagagcaaatatagttaaatcagataagattggctgaaactccgacactaccctaattggcaaccaggaagcaggatagagattgatattctaagcacgacttaatagataaaactcaactgatgcagcattaagtatgaaaagaagaacaatatctagacaatcaagccactggaagtttcatagagtggtagatatcctatataatctaaatcaacgtcattgtctaacctaaccggctaccctcttccaacagatgttagccgattgtaggttagatagcgatattgccaaagattatgtaagttatatgataactcgatggattacataaacaagattagagtatcataaagatggaagcactaatcccgagaacacaagccgtcataacaagttttacctctgtcgaagatcgaaaccgatgcagctcaacccgaaagcaagaactcgtcgaaataaaactaaagcaaaagggtggcgatgcgccgaaattgtattgaacgtgtgcgttaattgattacatggggttcggggtctatttatacccgaaaattacaaactatgtccataccggatacgactcttatctctaacaaactctaagataccataagtctttgcggcaaacttttgcccaaacatatcactaaggaaattacataaaatatcctaattaatagatacagttgccttctcaggactctatccatgtacagtaatcatcttgaagtacctcaattcaacccgatgtcaaacaccaagtcgtattgtcggaatcggctgcatcggcttccctagtccgactcagactcagccgatcctaatcgtaggcgatctggactccagcggactcttgctctgttcttgaatcgttctccgccttcgaatccacttcgatctaatcttcttttccgatgccgatattaccaaatttggttattaacagtattaccgacctttccagccgtcacaaccgtcatcgggaagctataaaaggagctctcatcctcacttcactcacacacctcaagcaatagctgtctcatttctctcaagtttagttttgtagtatctagctggtggaataggaatagagtagaaatcaggagtctagaagcctttggaagagttcgggtatggctctagtagcttttcttttcccttttgtaagctttgtactttatttagaatactcttctatatatatttatggtattgaaatactttctaagtatatgaatgcctactttacattatgttcatgttatactgaatatatggctagcttatctgggagatgctttggtgcgggtataatgtttgcatatgcaattactctatgtcatgatgatgatattagagtagtatctggtagtttagacgtggtgtctagattacgggatatcattatttggggttatatattgcggatgagaggtgggccgctgatggagacagctcagtacgggtattcctccgcgccggtatataatcctaagttaattccctggggagggtattactccgtatttagccccggttgtatggtcatgacgggctgtcgtaaggaactcggcagtcagggatggcttctcgaagtaccaggagagcatcggatagagggtattagctagtatatcggttaactagaacgtatatatactatgtatattagaagtataggaatagattttctttctcctttctttccatttagcttagataatatattatgagaataagaagctaaagcttgagtattctatagtgt

SEQ ID NO: 34165 - DNA, 2147 bp, Oryza sativa
tttctcctttctgctatcaaataggatcaatgaattgttccgtgaatgctaattatattatgagaatttttccccgccaaaaaataaacgaatgaaatctgtagaaatatgctatatattaatcttgaatttgtgagaatgtcaacattcaacctttcgactatgaccctatgtcacactgattcattgtcatatctgttgatttccaaatttgcttaatcgatacatgttaaaatgcaattccaatatatatgaaaaataacaaaattgataaaatgtttgattatgctctggaaattatacaaaatgaaaagctcaatctatatgtaaatcattgattctgggtacttattcaactacaaaaggcattgccccagatcccaactttcataactttattagtttgtcatttttgtttttgatccttgcacatgatgacagtacctctgaggtattgtttcactttcaccctaaatttacatgaaaaatcctaaatgcaatttgttttacctatgtaaatgatgcaagatgcaagtgtaggagctgaaaatttctctttcagggaccaagaagaatacaaacttaacagttagttataatcataagattatatattgtgtttcattttattatcattaaactgatccacatgatgttcaagtgattacagaaatgcatagatttttttaaaagttgggtttgatagatgtgtagaattccatgccgccatcagtgatgcctcgcaagcaagccacaatgtctgcacctaggccttcagcggctccagctactgcgtgctgcagatggtacccttccattacagtgagggggtcttccagattagctatcacggtggttccttggtgtgcccatgggcatctcaccaactgtttgatgaaatgcatggtcgaggtgcactcctgttactgtttgaatccttattattatctcatatttactctattttgcactgtatgttgtgattgaaagctctgcctatgtaaactaaaactgaattgttccttggtctccaatacttcatatgttgcaggcaaatatttcatttctgcagggtagaacaccatattattttagtgtatagattttactatgagatccttgactttttaatgactattggagtcatgtcagtatgttaatagtgatatagatatgttaacctgtccaattttaccttatattcccaacacaatagctttgtttcttgactgagatttatttgtctcatgtttctactgcattcaaaagtttgcagatcaattcatatttcataatcaatcagcaaacctggacattgtttcaagggacatgtggacttggctacagtatatctatttgcttgatctttagttgcatgtagactccttttgagatttatttattttaacccacaaaaaaggagattatttattttaagatatgtccctttattgttcaactgcaactaatttggaagttcatagataatgagatgtaacagatgggccattaaaaactctctgagtccgttctatgaaatgtaaagtaagatgccatgcccttcccagtattaccttattactgttatctgccttcttttattgataaaaaaaagtcatgtgaatcttggagtggaatattaaaaaaccactgcatacaacattgcattatctggatgagttatcatcaagcatcatactgctatttctaatcagtgttgcacatgtatttcatcaagctcctttgttactttctggctacatgaagtggagttactaatatattgctctatgaagtgaaagtttcttcttgctcaaaaaactactcctataataaaatggctaaatatgccaattttctaccactactgaatctgaagttcaactgatgtgcttcattcccatgttagccttgatatggtcagccaccagtattaatattaacaaatttcctgtcatatttgagagaactgaaaccgcttctttgaaatgggatctaattgttgaaatatgttttttttttcatgtttgtgcatgattggagtatctcttttttttcggctgtactgaaatttggtttgtgattaacctgtgaaagtatctgtttgcactgctcgatatcctttattttgaaagcgacatcccgag

SEQ ID NO: 34166 - DNA, 2306 bp, Oryza sativa
taatatatatgttctactcagtgaaggggatgcaattagacttggaaatggagttagaaggcttaaaggttgctaatgtgatctgcatgatattatctcatgaaaaccaaacattgttttgccccttttatatattttgcccttaggattgaatcaatatttcagaatggacgaaggcatatatcctcttcaaagaatgaggtctcaagggatttggttgtcaatgtaaaatcacagatgaaacaatctttgttggtaagtaaatgcactttttgctgcattgactgggataatctcgatgagcaatgatgttgtttgctactttgattttaatgtagatcactgaattgccattctactatatatgaagcaatatttttaatgtgtaaaataccctaggtcatgtgcatgtttttttcctaagttcatgaataaaatctcacttctatatgttagggtggctactagatccaatcctttggttttgtgtttcttatacacccaatgatttttttttttttttaggcttgggtacatgtacatgtttaatttttcttaatgtcaattagatatcatttgccaattaaaattcatgtagaaatacacctacctgaaccaacatattcaatttcatgtagaaatacacctacctgaaccaacatattcaatcatccaatgcatgttacttcacaattttcggagctaggaatcttttagagctggacaaatccatttacattgagtgtttattataaaagaaatatattttcaatcactaagataatgataaaattctattatgtgtttgccgataagcccaggtggctgcccggggttgccaagcggtgtctccacctctgactccattcatgtaatcatgttcatggtctgctccattgagtttatttttactggatgcacatccttccattagtagttcttgcaagaaactgaaataagtaacagtcgtatagcattatgctgccagtatcttcagtaaagaatgtattgtcatttgcttacctcttttgtgttttcttcttctgatgcttagagacacaaaaacaagcgtgtacaaacgatggaaagagaataaactgtaattagtgatcaagattgcaccgctcatcttttgccacaaacactgcaagagagattgatttacatatagtgaatgaatcaattctacagtcttgaagatttagctctcggttttctttagatggaatgtgcctcagatttagatttatgtacattttaagttgccaaaataaacaactaaatgaatctttacgcaaccacgccaaaggattcacctagatgcttcagtcaacatactatgacaagcagaacaacgtttattcttatcttttttatatagtaatatgcccttgctatataaaaataaaagcagaactacaatgtcttaaaagaaaaaaaaccatgttttttagccttggtctattgtcaatcatttgaatatgctttgcttataaatagatggttcatattcatacaatatttgctaatacgtgcattgcacgtgcacgattactagtaaactctaaagggtgccagttgagaaaccgctttcggtgccggtttttccaaccggcacccaggagacggcacttattacctaagaaaccagcacctttaacacgcccatgagcaaaaaaaaaaaatcaactcaatgcatcgagccgatgcattgagccgtcaagacgatccaatctaatacccaaatcctaaaatttcctcaaattcataaacacaaacatagtccatgtcagggttacggataaggtataccctctatccttggacgtacgttgcatactgatacggtatacccgcgtggataccgataattcctgtgtacgttaaggaaatctatcacgtgatagaaacagaatccatagatggaaggagtcctacacagacaagactgggtttttaccatatcgtgatgggtccgatatctccgagttctacttggagatcaactgacccgtggtataaaagggaccccctgggcaggacctaaggcatcgaatctcaccgcccacacatccgccacagcctacgaagccggagcctacaggagcaaagtcgccgggtgatctagtcgaaccaactcgactacggtctcgtcgatatcatcgagttccgctattcccattgtaatctgtggtttccatcatataatcccttaccaactggattagggctattagctatcaaggggcctgaaccagtataatccttatcttttgtttgcttgatgtcgtactacgtagatcctc

SEQ ID NO: 34167 - DNA, 723 bp, Oryza sativa
  unsure (1)..(723): unsure at all n locations
nnnnnnnnnnnnnnnnnnnnnnnnnnnnnnnnnnnnnnnnnnnnnnnnnnnnnnnnaatccagcccaaagctctcccttcctccttcagcccgctgccaaagtctccttttgtatcatacccttcctcctctccctctctttctccaccaacctcttgggccatcctttcccgctgacccaacctcctcttccctgctccttcccacgccctgcctctcgcgccttgtcgatcgccctcgtgctctagcaggtggggcccacgtgccaagcgcgtaccctagctgcgccatttcactctaccggccaaaacccttgtgccgcccacgccgatctgcctcctcccagtttgtttgctcttccaattgattgcaaaaattggttctcctcctcctcctcctcctatcatttcccagtgtttctccctcttaatttagcctttattacccgaatttactctccgacgaactgttgccattgatggcaggctggagagctcccccggcctttcctctcctccccttggcttacaaagggtaggcaacctcctctccccctcctttggcattccggaggtctgttgctctcttttcgtctcctcacatctatacctcgccagcgaactacagctgccattcctcatcgagccgagctgggcaggaacccggtgccaccaccctcggagtcgcagccaccttctcttccccagtctcacgtctggttcg

SEQ ID NO: 34168 - DNA, 15694 bp, Oryza sativa
aatctaaaaatggagtctttgtgggacggaggaaatattaattaaactgtcagataagtcaaaattttatgtggcaccaaaattaaatttctgttcgtactagtcacaaggctaagcatgagagtttgagaggagaggaaaagagaaaattgagaagatatgcaaaacgagttcgcatgatttgttgagtattaactattttaaattgtaaaaatggattaatatggttttttaaaagcaactttcccatagatttttttaaaaaaaacacatattttagtagtttggaagcgtacatgtggaaaacgaggtcttttctctctcgatttcccagcaacgaacaagttagagatgttgattcatgtaatgtgcaaatgggatgttcaggacaatggtaataatacttttagaacaatcttccccttcccaggtggagttccatcatatgatggaatgggggggcagtaaatacaaaggttgtaaaagcaaagatggtgatagtagagaggggatttgggaatgagatcaaattgtgatgcaatcttagggattaactaaagagttgagagaactttttgttcatatgggttgttggttctattcttggtgttagatggtggatattgtcatgtcctgataaatctcaagcactaaaatatgcctaagaaatattttaaagtcgctttgattatttttcttaaattctccatgctctaaattggttccgcaaattttatttgaatttttagaacacctaaataattataatgcaacatcaacaaatttcaaagtttattaaaatgaaaaaactaaaactaatcatctccttcactttgggccgaatccagcccaaagctctcccttccttcttcagcccgctgccaaagtctccttttgtatcatacccttcctcctctccctctctttctccaccaacctcttgggccatcctttcccgctgacccaacctcctcttccctgctccttcccacgccctgcctctcgcgccttgtcgatcgccctcgtgctctagcaggtggggcccacgtgccaagcgcgtaccctagctgcgccatttcactctaccggccaaaacccttgtgccgcccacgccgatctgcctcctcccagtttgtttgctcttccaattgattgcaaaaattggttctcctcctcctcctcctcctatcatttcccagtgtttctccctcttaatttagcctttattacccgaatttactctccgacgaactgttgccattgatggcaggctggagagctcccccggcctttcctctcctccccttggcttacaaagggtaggcaacctcctctccccctcctttggcattccggaggtctgttgctctcttttcgtctcctcacatctatacctcgccagcgaactacagctgccattcctcatcgagccgagctgggcaggaacccggtgccaccaccctcggagtcgcagccacctcctcttccccagtctcacgtctggttcgccacaagaccgcatgaagcgtgctcggccctcaactagtgaagaacatcatccttctccaccttcacagccattctccgtcgagcagggctgtgccagcccgtgccgccactgtcgacggttgcgtcacgccttccttgtccttggcatgccctttcccgagcctagatgccaatgaaacaccagcccaccctagcttttttcctctacctacagcccctcccgcatcgtcggagcgtcgtcccgctgcaccatcgctgtcgccggtctttctctcgttgagttctccctagtctatgccttcaccaagctccgccagcaccggagcttcatcctcgccatcaacccaagccggctatctttcctactccatcaccgtaacctcctcgcagaccaaagaccttaggaacgccaccctgttgtcgtcatcttcctccgtctgtcattcctacctcgtcgaagcgccacccgtggtcatcgtactctccatcaagtcagcacctccatgcgcatcgttgtctacctcttcaccaggcccgaagatcgtcagagccgtctcctcatcaatcttctccgttcatcgccgccacagcaagctcatcaacgattgccactgttaatccctcaccgcatcgtgattgtggtgagaactctcccctagccgtcctctactcgtcctccccatataggcacagtttaaggtaatttgatcaactagaaacaaaggaaaacaaatgtggttttcagtctgtaaatgcctgcagatcaacatttctaaccaggctatgcttgttgctttagcaacatgcatgctagaaaattattctcaaacgctattgaacctgcgttgatcgaaaccatattttcctaccctgctgcatcagttagtcttctagcacaccaacttgataattggttgtcgatcttagcataatatatccagatccgttcttctggttacatggaggtagtcattaacactgatcttgaggcatgccgtgttgggtttagtcccagttggtaattgatgatgggggagaatgacttcgatggtgggagtagtcctcacccatgagactagtcttttgagttgtataggcctaggacctaaagtttgtggcttcggttgggcctatggtggagcaggcccaatgtgatttgggtggcccacggttggtgggccgagctgcgcactctaacaagtggtatcagagcccagtttcgaaatccggaacgatttccatagctcacatggtggagaggccatgtaacaagtcttcggaaccacatgggttgatgtgacgggggagactgttacgcctgatgtgtcacagaggatattgttcggtttactcccacatcggtaattgatgatcgggtacatgacttaaaaggtgggggcagtcattacccatcagactaatcttttgggttgtatagtcccaggatctaaaagttgtggctccggttgagtctgtggtgaagcagacccaatgtgacttgagtggcccacggttgttgggtcgggctgtgcactaacatgccacgaatatgtcagctagaggatgcaatgggacaatgccgaagtgtatcttggattaggctagatcgcctgcgcatacttcatgcatgtggctagcttggatgagcacaagccggtagcgagattgtggtatgactgatgatgacgtggcggtgaggggaatatcaaaggggacagaagatacaatgaacatgagtaaaattgacattttgagcttcttctccttcgagaaaagtacatacaatgaacatgagtaaaattgacattttgagcttcttctccttcgagaaaagtactaactgctggattgatggattggatagatgtctaaagctcccgttggctcattttgtcaattttgtaatcacttctgtacactttacttcttcttcttaatttcctttttgcttaattcagataggccttagtacagatgccatgaccactgaagagcactctaagaaaattaagtgcaaacagcatattccggtataagtcgagctaaattttgtaactcttggtgtatcttccgctaaaatgcttactcctgatccctccggagcctaggagtctattgaaatcttcgaggttgaagttacacctactccatacgcaaatttgtgttggtttaccaaaagcagtactgcagaccaacagccaaattatatcacaaacaacttctacattgtccaagctctgaaattctcatgtttcaagaatgcctccttcgtactgaatactgccaagttatcacattgaagtatatttatacaagttcagtgcccagctaacattggaagaaattatcaaaacaggtctcatgttgggtttattgcaagcacccatgtgcaaatggctgtgcacgcctttgtgtgaggaaatcttcgagttcttttttaatttcaaattttgttttttcagtgactttcagctgttacattttgttggtcagaccatttgggaagtggctaataaacgcacttctttttggttattacggaatatctatacttaatgatcgatccctcatcgcccgagacttcattaatcatttctatgattctctgatgttaatttcttttcttttcttgaatgcacaacaatttatgtatcatttcattcagaagggaaagaaaaacataatcgggaaaagggagcagtgtgcagcctcacctgaaccaccaataggacttaggcattacaagaaaaaaaaaaacacaaaacctcacccaaatagggctaacgagctagtaagaaactcgctaagaaaattttaggatcccattttacatttcgtacatgggcctcaaatttctaaggaaagccataaatagtgaaaatggtttacatcttcggcctttatcaacaggcgcgaagccaaattccaaactcatatattagcatgctctttttgtcaatgcgctaatcatgttcctatgttcagataccataatcagagaagagcactctaaaaaaattaaaaattaagtacaaacaaaatttaacgatacaagtcatatatactaaattctgtaacttctgaattatctttggctacaaatgtgccttctgatccctgccgaccatacgagactctgttgaatgctttcaggttcaaagtacacctatagtccatgcacaactttgtgtttttttgaaaaaagaaattagaagaggctcctacagtgagcaaatatattaaaatttaaaaaagattacaaattacatatgtacgtaaaaaaaaatcaaagattgtctagctattctaacataattaaggggtttgagactatcttttgccctatggataaccaaggaaaaatctttttgaatatatccttacatacatgaaaataaggatttatgcctctaaggccctgtttggaggagcttgtcccagctgcagctttttctaaaagctgcttccgctagaagctgccaaaacagtccacagcttctgagaatctgcagttacagattctgaaaaatgaactaagaagccaaaagttgaagaagctaggtttaaaagcttttccagattctcagaagtttgttaccaaacagctgctcagaatctagagctccccaaacagtccctaggcctcaccacaagcagcacagcagaccagtagcaaagcatgtcagtagcgaaaggtgcatacgtggcatatttttatctatatggtacatttaaaaagattaacggatttatgcactttactcctctctatattgtatggatacaatttagtgcggaagccaaatgttctcatccgcttaatgatattgctattttcatactctctggtgcaatcacatcaacataattgatgttatatatcaattttatcaatttccgccacaaatttgcccaagctcaggtacatgtttcttctcaggtttgatctctagctgaagctatatcagattaggaagcctccgagaactctggctcaatctcttcccccctagcaacaatgaatgaaaactatgtagtacaaaccacatatatagagcaaaccggaaaactaatgattgatatggaaatggatatatgatagatttgtctatgtcattctgagttaaacttttataaagttttcagatccaaaagttttacacagggtgacgtggataaatctcatacgtctattcttagattcttttgaagtacatatcatgtttgcactactttttaaaaaaattttactacgataataagaacatctggtactagccgctgccaccaccggcaatgaccagagcaaacaacatcgcctttatatatcaatatctattcaatacaacttcgtccatgcttctcccctcgtacaaggcagcagtcagcctacatcctcccactaatggttcttcgtgtgtataatttgctttcgaccatatacttcttcagcaaaatacgtaccggtagtacatgtttcatgcaagagaagggaggcgtaagatgtgcagcatgtgggcataagagagcggtcgtcacactgaatgtgggttgcattagtgggattctggaaggtgctaatgtgtgtttcggttgtatatgacttaattactcccccatcgcggattagagggcgtctatttttattttttttggctttccacctgttaaagtgattggaatcggattaaacatactagccgtcaacccgtgcatttcacggactatttttttataaacatcataaagatttaattacattggcttagattaaaataagagttagtaagattaacaacttgctaatcaatagaaaatacttgatggacagtcatatatagcttcatgtcaattaattcttattaattatggatttagtaattgctaaattttggaaaagccaataataaactaaattttggaaacgccaatactaaacaatctacgatatttttaatgccatgtttgcattcatacgcagcacgtacagcttgcgtaactccactaaagctacaaatgcacatgcatttaaattccatttttctttcattgcatgaccacatatataatgcgaagtttattgtgcatcaattgaataaaatgtgcatggtgtaaaatggtctcaaacaatttttagaacttgaatttggaaacttttaccaaataacgataaaaactttatagagtataattaataaagtaaatctaatattagtaaactacgtcacaaatacgaatgatagaaaattaaaaatatattgtaatatcaatatataagctagaataataagaaagttagagcgcatacagacaagacagatggctcgtacctgaattgcaacgaaaattagtccgaaaatatgcagcggagtacatttatgaattatgaatatggtgaccatcgatcgatgggcttattagttgcaaacaaacttgttgatttgtgaatcaacatccgaatatctaaaatttacatgattagatgatgtatactgacggactcagtgaaccctaaatataaagggcgttgttgcagatgaaaagattgcatgtaaagaaaattgaattggaaattagacattcgaataaataataattgaaaaggtagcaattagaactcgatcacctgtcgttgtgcggtttgagtggccggccgaccttggcttagtctgggcagaaatcatctctggtcatcacgatgcgagcgacgtggtttgtgtgcgccggccttgcgagcagaacggcatggacgaaggatgtatgtgtctgtaccggccgctagcttcttgctggccgccgccgacgtttgcgatggccatgcatgccgtaccccattgcagttgatgagatgcgtatacattgtacgtgcaaaccaatagataatctagattagattgtggcccaatatcagtttaattgggctttttatagcacatgataatctatggtcaagatattataattaatcaaatcaacggtcagatttttctaattaacgtgagagcttttaaaaagtgcccgattagtataagtatagatagatagatagatagatagatagatatagaagtatagatagatatagatagatagatagatagatagatagatagatagatagatagatagatatatatatatagatagatagatagatagatagatagatatatgtgtgcgatcaattagggggtataaccgcgagaatgctagctatcgtgcatctgatgggataacgaaatatcatggttttcttttctagccacccgtgactccctctctctctcacacccccttttctctctcccacgctcacatgggagggcgaagctgtttctcttccctgtgcgccattgggaacccctgagtctcgtcacccttgcttcatcaccaccaacaccgtttctctggcctactgctgctaccggtgggaaacccctagtcccatcacccccgcttcattggcaccgacatcgtttcgctagcctgctgctgccggctgcttgatgtttcgtgttccaaaacgaagtgtttcaatccatgattcaacagtgtttcatcattttaatagtttgaaacatgtgttaagctagtggtgaaacattcttctataaatactgaaacatcgtctgatttttaggatgaaaatcatgtgcccgacttgtagttgcctgcgcataacaatagcaaactacttagcgattgtttggtttgcaatgccaaatcataggcaagtttttgtaacatttgtatagtattggcaagtattagtagcaaacaagacattgccaaaattactatttaaaatgctaatattttggtatggcatgttttggcttcaaaccaaatcagcccttaatgtgttctctccttagcgttagcaaaataagtgaagcaccatctaaacatgggatggtcggaatttaataagaaagagagtcaatgtaaaaattaaattactatagtggacttagggaaggactaaatctcagcatgcagtatgatcaaatatcaccagtgtcagaattagggtatcaaccatgcatgtagatattacgcaaattcaaaactcgtgctttttgtattgctatagcctaaatgttttgtgcgcccatttaagatgtcctcaatttgcaccaagtaaataatacgacggaccaagtcatcactgacgggcttaaactgtcctcgtcagagatgttaagtggtttgtgatgacaaaatctcatctgtgatggatgaacacctgtcgatgagtcatttgtgacgggtgtataagtcatctcttataagtcgtaacttatcacccgttaaaaataagggcgtgttaagattgatgtcatttcaaaccataccatttcttggtagagttgccaaatatatgcatccatttagtttcttatcaaactttagttttttcttacttattttctttgcttttcatgtgaagacatcactacgttggtgtgtcaggcataacacatagacacatcacaccactgtaagaaaagaatagaatgagtagatggcatggggaccaatctatcccatacccaaactattaactccgtacagtgatagatgtatcatgacctaacactcacactaggacaacctcacttggcattgggaaaaaaaataaagagtaaaagtcccctcctctaaccactttgcattgcctatatggaatcaaagttaccaattcttataggatacaacattaattacttatataaaagagattaacacaagttagacaagttagagccatgatcaaactagtttaactaaggtctagggcaactaaaactttatcatgtacactcacataccactcattattgcaactccatgttgttctccataatagctttccgaatatagttatgcgcaaacgttaatatccacactatacactgcaccaacgaatcaaaactaaataaatttttttataccacctagctttacttaatatacaatcagatcttattcgtagaagagcatatatatctagtaacaacaaaactctagaaatcacaaatacaatgacttagagatcagtaatcaataaaataaatcagaagtgtgatgcaatgaatgacccaatcccattctactgtgcaccggtgtgtcaaaattttaaattgttaaggcccatctcatgttttgtgttaatccattaagcaacttaaagctctttttttttccaaaaattcactaagcagatttggtcaaagttttttttagtcaaaattatttattctctcccatggacctaccgcccgctctgataccaactgtaacaccccaggtattcttttacctagaatactacacactacggtacagaaaccactaagtcctaaattcaataaaaatttcgatagagtctcccctgtaaatacggacattcacgataggcaattataaattaaattaataataacatcattcccgtaacgctatccatccatataatccatagaaagaaactaaaagatatctaaagtattattaccaaaccggacctaagcaatatagtttgatagtgtgtagataaatgtgtatataagggagctacttcccgcccatgcgtgtccatctcaatgcatacctaaaaccaaataaaacacaagaatgactataaaaatactcagtaagtataatatggaattagaaaacacatatacacatcattggcaataaagcatgaacagaaggctttctttctttgataagaaacacattttcaaacaccaagtcaaagaagatagtagttcccatcccaggcaggcatgaattgaaatagtagtttccatcccggataatagtgattacatcctagcatttgccggcaaagtcgagtaagcgtgatcagcgcatacccataggaacatgaataaaaaccagatagcacatccatgactcgcatggaacatgagtaattaaaaccggaatcaaagaaccaaattgaaaccatattggacatccaagacaagcagggaacttgaattatttaaccagaaccagaatctggaatactgaaacaagaataacatcgtaatcatcagacaaagttgaaatctaaatggcgtgaataacaatctgaacataagcagtagcatatcacatataaatataccggaaataaataggtggagcagacaatccatgaatcacacaattagttcgtcatgcacttgcctccaataaaaggttggtatcatacacgatcttaaggtccaccacctaatcacgaaaaaaaccttagcaaacacattcaaacatgctataaaacaatgaaaaaggtgaacctactgccccatcccgtcaaaatggaataacaaggaacgccgcttggactatacacaagactgctgcttcaaacctttatatcttgaaatatgaaaaggctatgactaaaaatatatacattttgtaaatctacagaatagtacctacaacttttatgtagaaagcatatttttattctgccatttaaatggtctaacttgcgcttgaaagcaggcttcagaatctgtccaaaatttcagaggatacatacaaaaacaactataactggagttctactcatccgatcgaagtgtactttaccaatatggaaagattggagaaaaatctacaactttttctataggcagccagactgattccgctgtttaaccccctccaaaaatagttcaatctactactatccaaattatgacataaaaacaaaagttatactaaaaaaattatatctccgataccacttgagataaaatcacgccctttggtcagaagatagatccaaacattatcgacaacttcctggtaatacacttttgtagaaaataacatttagaaccccgaaacatcgaaaaactgaagcactgcaaatctgcccacatgcagaactacaacaaaccgaaccgcaacaacccaaactccttctctaaccttccctaaccacgaattaaagcactaaagccacgctaaaacaactaatacaacaaggggaaaaagcctcacctagggtttctttagagaacttatgaggagacactaggggagactccgatcaaacccctcctacccctctccttctccttgttctgtttgtccacttcgcttcttgatccaagttcttggggtggagatctatgagggcaatttgctgcagaggggagagatgcggacacaggaggaggggaggaaggaggcgtcgttggaggctggccacggagatgggtggcggcaccaagaggggaagtgggattcggttcccctctctctaggttttaggggagaaccagtgggctgggtttatggaacttatcatgttagcccacttctaaaggtatttttcctttatttatttctgttaacatctttattttaacaagtcaacccaaactaaaaaaacctaaatatcttttaatataaggggtattacaattattttaggatggaggtagaacccataaatccacgactttcctagcaatgtagacatgcgtgcatttatattgagtctcaaacatgagaccttgctctctatacagagcacacattacttattctttcaataatattgtttttactattcctatccaaagcacatgtaacatatatttaacactcaaaacgacttcaaatgaaaacatcgtcaactaaaaccttttttttatcttaacgtgttctacaacttttctatagggaatatctccatccaagatcgtttgaagaattcaaaatttttgtttttccaaatatatattaccatataatgcatatttgggcatgtaaactgtctcggatgaaaatattatctaatataatatcatagatctggttgagctctgttacattgatatagagcttgtttccatccgagatcatttgaaaatttcgaaatttcagtttttaaaatgtagacctcatcacttgtagtatgtgaacggtctgtaatgaaaatattgttagttataaaattattgatatcgtcgagatctacaacttttatatagagcatatctctatcccatatcgtttcaaaattcaaaaatttgaattttcacaaccctacctaatccttatatatttttaggccaaacatatatagaaattgaactcaccccactttaaacctcgccctcaaattttgtaggctaaaaagttagagcgtagccagtgctgccctcccaagaattaaggactctccagcagacggcacaccggattgaacggattgaactgatcttgcagccctccacactcgatggaaatgtactttacaatcatgatttaattacagaaaatctatcgtatggtgtcccatggctgtgcggatagtcacggaataaattaaacgactggataacgttttagttcttatccattccttttctcttctctatccaaagctttggtcaacaccttcgcgtttgggcaagccaacacccgccattccagccgtgcatcgttgcaagagaagctcaagagagaagttcccggcggcaagatggccggctgctgcgtgttcctccgatggccgtcgaccctgccctcagtcctcggctaccgcttcctcgacgacagcaaggtggccggcttgtcgtctccagtagtgacagtcgtcgtcgagaaggagtggtaggtgttctccgtcgactacctcatgctcgacagctacccatcccggttgctcctcgagacagcggtgaggaaggatgagagcaaggcgacgctcttcgtcaacgtcaccatccttttcttgtcagtgttatgtgcaaagtaaatcacgacttgatacctaggtatcaagtttggtaccaagtacaaggggtcttggggtctgtacggcgtacgccatcacgcgcatgtacaacgtcttggggtggatgaggcctagccacgatggcaagaagaggtggtcgcacgggcggaatgtggagcgccatgctgtgggcggcgctggtgttcgtgttctccgccgccatgctgatacagctggtaccatacctagtacctgtgacacctagtacccaatacttgtgatacctagtacctaatacctgatacctatgatacctggtacccgatacttgtgatacctggcacctggtacttgtgatacctagtacctgatacctgatacctatgacacctggtacccgatacctgtgatacttggcacctagtacctcgtacctgatacctgtgacacttggtacccgatacctgtgatacctagtaccctatgatacctgacacctagtacctgtgatacctaatacccgatacctgatacctgatacctacagcatggtgtacgctaattaatcacacattaaaattgtcccgtgacttcagtttttcacggtatcccgtgggctagcagccctctttaattaagtgcaagaaagaacagaaagaggaaacgtagacgacaccgaataatgacgagaaggaaaacgttgtaatataccaaaaggagaacttgacaattagttgcatggagatagacattaacattgatctagaggcatgccgccaatattatctagtgggacatgaccaatgtgtaccacaacaacattactgtggtaatgctagatcggctggtcaaacagtgtgcaggtgacaagactgtgctacgactgaggaccatgcggcagtgtggggaatatcaattgggacagaagatacaatgaagatgagtaaaattgacgttttgaaattcttctccttccagaggactgatggctggattggattggaaactaaatactgaactcaatgtctagagctcccgatggctcctatgcctatctttatgtttgaaaggagaacatgttcgtatgggattatcctgcggcaaagccaaaatatttcattctcagtggaatgcccagaaataatagtagttgtgtggtgaggtactcggggtatcaaatgttgacagtacgccctatgtggctttgccccagtgctgctcttataagaagttagttctgtagaataattgacataattatctgtaccaaagaccgtaaatcttgattcttcgcaatcattagaaagaacttctcttatatggtgacactagcaatttccttgatcacaaatatgcattaaaaataaatttgactaaaatatgcatctcctataccaatctaattttttttattaatggaaatggtttacaactctggtttttgccgatagtttacacagacaaattcaaaactcttggcctaatatgctcatttcgtcaatgtactattcacctttccacaatttccttgttcttctcccctttcatttagacagactgctcaattcagacaggcatttagttcagatgccatggccactaaagagcactctacaaaaattttgtgctaacagtacattccgatatatgtcaatccaaatattgcaactttccaggtattttccgctacactgcttcctcctgatccctcccgagccaaagagtctgttcaaatcattgaggttgaaattaccccaaggccagggcaatttcgtgttggttcaccataataagcagcactacaggccagtcttgtgtactgcctaacatctgaaattctcaagtttcaacaatgtttccttcctactgaatactgtcaaatgtatcacactcatgtatatttatgctggttcgagactagctagcattggaattttggaagaacttgtgtaaattggtctcatgctgggttcattgcaagcacccatgtgcaaatggcagtgtgggcacctttgccattatggaataccttatcaacacagttaatttccgaacggttgattttgatcgccatcctgtttccattgagttaagaatcttcttttttcattcgttggccggacagcttcaggctaaacttgaagtcatctctagttagcctttgctcttgtttttgtgaagagattagagatatcccttgctctggttcgcaaggcagctttctttttatccccctttatctccttgtatcactggcccttttttggtgtgtgctatcagggaatgatccactttagcagcgatgggttcaagcaacattcccgatgacttttggcaacctattggtaaactatttaaacgagaacgcaccatagtttaagcttgatcaacacgttctgacgtcca

SEQ ID NO: 34169 - DNA, 6157 bp, Oryza sativa
  unsure (1)..(6157): unsure at all n locations
tggagtcctctaccatcgctgacggtatctgcctcccccctcaccgagaaccttgcaccagcgctcaagccaccgccgatcctagggccacagtccccgccgccgaggaagtcttctccccgaactaccaggctaccgccgccagtggccgctgcgtacgggacccacctccgtcggatctgccatctcgtagctgaggattggttgttgacgcttaggctgtcgttgtccaccgctagtcgcgccgccatttgaagggacgccgtcgtcgacacttcgccactacccgccgccctcccgatcaactttactgccgtcaccgacctgcacaactagactcgggcacgttccgcatctgtcctccaccgcccaccttcccgatatctacaccgccagatctatgggcagtaaccccaaccccaacgcctccccctcccccctaccccctcgcataagggagcaaggtcctcaccaaggaagccccgcctaggggtggcaacaaggcggggtgggtccaggttgagctggattgccccgcccccaccctcctacgggtatccccgccctcggccccacaatgaaagttggatgaaaagcatcacccgtcccgcccccacgggagacccggtgggtgaccggggccccgtatcacttggatggagttaatactctataaaaatattgcaatacattaaataatagtatgataaaatttcaatagccccagttgtggggcttgattgaagaaaggaaagggattacggttgagaggaactagggtgttgagcttttacatgtcaattctgaatgggcctgttgggtctatagtattgcaatgggctacttttagagaattaactcacatccgggtccccccggtcacccgcaggttaattccgatctctgccctcatccacactcacccactggtgagaattctccccctgccccggccccgtaggggcgggtcccaagccccgcagccgccttcctcacagctggttggcacgcaggcggtcttcttggcggcagcaaggcagcggagaaaggagactatttcttcaacatgactaatggtcaagcaattacacaccacacgcccgatgcgtacatatagcattgtccagggagctagtaatatattactatttgcgccataatttgattagtagttagtttcatatgagtataccaaattatctacaataattgtcgtatttgctgagtattctctttataaggctagttaaatttatatttgcagtgtgatgcatcggtcatgtgtgctagctatagcatttaggttactaaagttgtaccgatgtcgctgagatcactgtgcttggactgatagtatatatgtgcagatggcatacaagatgtacatacactggctgtttgacatgcatgggaggacatgtgcttggattatttgctgcagtcaaggagcttcaggctgatcatatgcagcagtggatcagatggtcatgtctaggagccggaccgcagcggcagcagctgaactagtaaagctgtggcgtgccgttgtgttgcattgcatgcaaggaaggtggccgagacagaagcagagcgtgggtggctaactggctatacaagatagagatactttgtagtacttcctccgtttcataacgtaagactttctagcattgtccacattcatatagatgctaatgaatctaaacatatatgtgtacctacactactatatgattgattttcctggacgcctcccctttttgtttccgtgcggttcgtaagtggaaccgtacagaaaaattgagaaccggcgctggggtgtcgcccgcacgggaaaatcgattttcccatgcgggcgtcctaagccaaccgtacgcaccgcacgggcccaccatttaacccctcccaccagccaccgcccactcccactccactcctctcctctcctcccactctcctctcctctcctctctctccctccctctccctcccctccacgacagcacgggtgcagcgacgggaggagagcatgcggcggcggcggcggccgccgtgggcgacagcgacggtggcgcgcgccccctcgcctccttcccctaccagatccggcggagggtgggcttgggggcggcggatccggcggcgcttgccccctcccctccttccccttgcagatccggcggagagggcagcggatctggcggcggcggccacgggcgacagcggcggcggtgtgcgccccctcccctccctccccgtgcagatccagcggaggggggggcttgggagtggtggaaccggaggctgccgccccctcccctccttccccttgcaggccggcgacgcgcggctctctcccctcccttgcagatccggcggagcggcggcatgcgtcggcgaccagatctatctctccccctcctctcttttttacttgtgtttttttgtgtgatttgttcatgtgatgtgtgttcttgtgatgtaagattcggcggcgggcgacggcgacggcggcggcgggcctcggctaggcggcggcggattagggttagggctagggtttcttttttctttttttttgtttctttttttgttgctccgtgcgggcgacttaagcgcccgcacgcaaaaatcggttttcgcgtgctggcgcaccacccgcacgtgaaaatcgcgattttcccagacgactgggtgcgtgcgggccgtccacccgcacgcgaaaatccgcccacccacacggaaaaattggcgctgtagcagtgctagattcattagtatatatatgaatgtaggcaatgctataaaatcttacattatgaaacggagggagtagttgatttgatagtactcatgagagtttccatatttacttaggactgttgtttaagatgtttcctatatatattaggctatactaggtctctttaggcggaaaacctaatgcgcgaatgttcgctaccagcgaagtcagcgaactaatccgggtttcagtttataggttcacgcattattttcattttctgttcacctgctgcctgcatgttccctcgctgaaaatattacatgtgaaagggtgaacataagcacatgtaatctaatcttgttatttttctctggagtggcctatcggccttaatgatcctaacataaagtttctgcaaattattttttaattcgtttgaaatttatatgtgcaaagtttataggtgcagaatttacatgcagaaactttctatgcataaagtttatatgtataaaatatctatgtataaagtttctatgtatagattttttttcacgtataaatatttttttagaaagggtattacatactgtagcattcatttaaatttgtatgtacaaaatttacatgtacaaactttctatgtataaagattacatattgaagtattgatgtatatattctaggtataaatatgttttgggttgatcaagacgttgttgggctaaagcctggtaaaaaagaaaaggcaggttgaaacccatgggctggcttggctagctcgcagcgttgcacgctggttggaaaccacgtatgaatgtacaagagcgataggctattggaatattcacgggtcacatttgttcgcgtactagacacgcccctgtttaggacccctgaaaaattatcaatcaactatttcatctttttatttttctattttatttttatggctgagctttagcaaccataaagtttggttaatcttcaccattttacgctgcaaaatggtcgcgcttctccacgaaaatttaaaggttattcttactagtttgctcagaaattagtctttcgtcatcatgtaagtatgatatttatttttttttctttgctaattttctcataaattagtcgctcgattccgtgaaagtgaattcatttggaaagtgaattagtcgctcgattttgattcttcgattttgacgattccgttgattacaccttaaactgtgagatcgatcgaaaacagcaaattttatcgaataccatctacctagtccagatttcattgcaaacataggatttggctggtgctcctcggcaaacatatcggcagcgccctctacatcacatttcttgtcgccggtttcgtggagatggccgtggagctagaggtactctgcgtagtgaggctggaggctgcttgtatgtggctagggtgacttgaacaaatgcttgttgattgaaggggatagaatatagggaaaacattgacatcttcaaattcttcaccttcaaaacttgggactaatggctggcttatgcaaaactgtctgctgaatcaaaatttcccaatgactccaaaacctatctttatcttgtaaaaccgacttgctcatgtgcgacttcttatggcaatgccaagatactttatcctacataatcggaatgcaaaaatagtgactttggattggcagtgacctgtgaggtggtggggataacaaatactgccagcacacaatatgtatatttcgctcaagaccggcttggtgcagtagcccagcattgctatgcagagagggtgagacagaagaaataggtagccaatgacatgtgggcctacataagcattcgatataaagaaactaagatggaaaacgaagacgtcgataatgatatgtgggtcaacatgaggataggttggtcattttaccgaaattcttacaaattcctatcgtgctaatggcatggcaccgttaatagagatatcaatcacggtggcataaaatgagaccaatttaaatcaagtggtatatgagttaactcacattctgaatggcaaataagcgatcggaataattttcagtggcattacagtggcttacaaggaattaaatttttctcgtgaaaaaaaaaagaaatatacaacaatttattctagtttcaccacattatatatactcattctgacttactaaaacaacgtcccacctcatatgccagatttccacgttcgtatgaatcgatcaaagagtatcatactacagctatagctaagtattggtctgatccagttcaaccaatgcaattaggactttcggttcctttttttttcactgaggtaaatacgacatttttagttaggtaaaatacggtattttcgaagaacaatgactatttattgaactttaatcaataggacatggctatgctcagtgttcactgtttataaatcacaaaacatccaactaagcaaatgttaagcaatttcagcacacctgatccatacatgtcttttccagggagctagtgaagtattactagtagaacataaccatgtaacttctcgtataaagtagctgctagtggtttaagagatcacctacagtctgatttttttcgtgaaaccaaattttccttattttttaccacaaaaacagaatatgaaactaccaaaacatcccaaataccaaaccggacagaccatgtggtaattgttcactttcttgccaaaattacccctactaagttttggtaattgttaacattgccaaatcttacctccattacaaaattttgataattctagatttttcctactgttatgtatttacatgctaatgtgctcctatggaaccttttgatcctatactatggacagtgttgtagtctcaaagtctaactgctcagcgaccaaacaacgcactatttcctctgattcgcacagcatcatttttattggcacagacaggaatagaaattggtgtccttccattgctccctactgccctccgcgatgtgtgctgacatgtcccattctcataggatgaagcacttgtgttacagtgaaaccatatatatgtttcactgcatcaggactttgagaacgaaatgctgttacttgtttaagcttggatggttggccaacgttctcaaagcatgcactaacccttttgtgagcgaaaattttacgaagaagttctcagatgccctgtccacccatgtttttgtctattgttgaagcaagagatgcaattatgcaaaattaatgtaccattgtacacctttgtcataaagtccataaatttgatgttattcatctgggcgcccagacaaagcatgttgttggaagcaattggatggaagtacaannnnnnnnnnnnnnnnnnnnnnnnnnnnnnnnnnnnnnnn

SEQ ID NO: 34170 - DNA, 2260 bp, Oryza sativa
cctccccctccccctctccctcctcctcccacggtggcgggcagggatggcaccctcccctccaccggatctagcaggaggggaggcaacggcagcccagcgtccctgcaacgacgacgacgacggtggcacccttcctttccggcgtcggcgtttttgtgcttgtgatgttcttgtgttatcgttgttgttgatgaaatatgttcttgtgatcttttagtagtgttttctctaggattttgtgatgattccgatttgtatttggattgggattgggattgagattgagattgagattttgtttttgggttggattggatgtgggatgtgggatttggagaggaggtgtgccatgaatcggatgaggaaaaattagtccgtaaaacgcgatgaggaaagcgcgatgaaggacatatgtgacgaccgaaaaaatccgaatatatatatatatatatatatatatatatatatatatatatatatatataaccacaacacaaatgggcttgtcatattcctggtgccttccaaccctaagaccctattgatgctttacatcggcaataatttatagggctacgcacgaagtctaaaagtggatggatgtacatagacaagtgtttgagacaggttcaaattctgtcaatgagagataccctacttttgtttaggctgggataacgagagatacccaacggtggttatgagagctttcttagagtgtccaattaatataggtgtccaattaacgagagataccctacttttgtttgtttaaagtctattagcaaaatgctcgtgcattgatccgggtaatggtgggtggctgaagtttgatttcaattatttattgaaacaccatgccccaagcatgatcataagcatcgatgatgtgtataatgacaaaaagtcaagtttgttctcgaacaattaatttgctttacgttttacgggatatggatgatgctcatgacacgaagccgatggttgtagcatatgagaggaacaaatgggtgcacaatgcgattgcttttgttaaggagacgacagatggaaatatgtgtgatgaacgaaaaaatcaatattttcttaaagtagataaatataacaaaaaataagaggaattgacgttgctacatgatgaaagtgcccgagattgaactgatcgacacatctaaatcgtggcacaacgaaattatattttcttatattctgtgcatggtggtcgtcattggttggtcaaatctgattataagccataacgactcattagcgaccaaaatatattttgcggataaaaattttatatacatgtaaaagtcaatgctgaacaacaaactacattaagaaaacttcaaacttatgttttaaaaataaattaaaattcaaaattatatacgggcaaatacgattttttttcatttatattcctagcaatatatatgtgtagtcgttggcttcattaattcaatattcatgtacacccgagtgtacatgaaactacagggtcgcacgcttaatgggccagaataagaggattggatggagatccaatatgagcttaattctaatagggatccgaataggagtcctatgggccttggaggtccaaggatcctatatattcgcgcggagtgtgaccggcggtgagattgcatcacatgagaaaccctagccgccactcccctcctcgagcaaaatcctagcagcgcatagacgctagcacgtctgcgcgtggcgttccatccctgtacgtttggataccgatagaggtgccgctagtttgcggtgttgatcggtgtgggagcactgcgaggagaacgcatgaggaggagaatgtcgagctgttgcgatcaactacttcctctacaccgacgtgagctacgtccacaacgttccttcggctacttagcacttactttcgctgcacagcgcgtcgagtggtaacgatttatgatctaatacttgcatagttcctgatttacatagtagaaaattttttatttatgctatcatagcctatgcgtatcctaacagccaccgcgccctcactacagcatgacacaaaatccccaacggaaaaatcggttggcaaagaccacattcatatacaatttgtcgatcatccaaagttttcctgaccaacttcaacagtcacaagaaatctagtcagcaaagagatttcccgaccaacatatttttaccgaccgaccatcagaccccaatgatagagatttgccgacaaacattattttttctg

SEQ ID NO: 34171 - DNA, 4525 bp, Oryza sativa
tggaaatgttcacatctacaaggcacgattggtggcaaaaggtttcagacaaattcaaagtgttgattatgatggaactttctcgtcagtcggcatgctaaaatctattcggattattttagcgattcctgcctatttcgactatgagatatggcaaatggatgtcaaaacagctttcctcaatgaaaatctcgatgaggatgtgtacatgacacaacccaagggatttgttgatccacaatcagctaaaaaagatatgcaaattgcagaaatccatttatgggttgaagcaagcatctcggagttggaatattcgttttgacgaagtagtcaaggcgttgggctttgtcaaaaacgaagaagagccttgtgtatacaagaagattagtgggagcgcactggtgtttctaatcctatatgtagatgatatattattgattgggaatgatattccaatgcttgaatccgttaagacatcgttgaaaatagtttttcaatgaaggacttaagggaagcagcatatattctgagcataaggatctatagagatagatcaaggaggctaattggaagccagagtacatacattgacaaggtgttgaagaggttcaacatgcaagattctaagaaaggtttcttaccgttgtcacatggtattaatcttggcaagaatcagtgtcctcaaacgactgatgagcgaaacaagatgagtgtgattccatatgcttcggcaattggatccatcatgtatgccatgttatgtacacgtccagatgttccatatgcacttagtgcaacaagccaataccaatcagatccaggtgagagtcactggatagctgtaaagaatatcctgaagtacttgagaagaactaaggatatgttcctaatttatggaggacaggaagagctcgttgtaaataattacactgacgcaagcttccaaaccgacaaagatgattttagatcgcagtctggatttgtgttctgcctaaatggaggcgctgtgagttggaagagttccaagcaagatacagtcgctgattctacaacagaagccgaatacattgccgcttctgaagcagcaaaggaggctgcttggataaagaaatttgtttctcaattaggtgtgatgactagtgcttctagccctatggacctctattgcgataatagtggtgccattgcacaagccaaagagcctagatcgcatcgaaagtccaaacacattttacggcggtatcacctcattcgcgagatagtgggtagaggagatgtgaagatatgcaaaatacatacggatttgaatgttgtagatccgttgacaaagccactccctcggcctaagcatgagacacactgtcggtgacatgggaccgggagtatcatgactagaggcttgggcagccgcgatcacccacgtggcctgaccccctcgggggggtcgggcccgagggtgatgtggccgcccctccttttgtctccccgaggggtcggaccgctcccgtttcggccccgagggctggggcgccccgaccccctgtgggtttggcgccacgtatatgggttaggtgagcacagtggggctcacctaaccgcatttattgcgggttgaacgagcgcgtcacgtcgcatgtaatgcagcgcagcgcgctcgcttatccggtccgtgaccgggcgcagcgtgtgaccggtcacagaccggtcagatcgcgggttaggtggtggcaggtggcctgttacacgcctcgccccgtcccgtcggattgatgagagcctccaggcacttgtccctagccggagacggcgtgccagctcctgaagatggcacgtcggtctcggtcagatatatgccaggcttcatcccaaccattgcaaggaagtcattgtatgaagaagggcagacatgcagcttgctaaactgacgcgtggtggacgagagtgaccggtctgtgactggtctgacgcctgtcatgtcataggcagacaaccgcgctcccgttttgcacctccttccagcggagtggaggtaggtatgacccatcccatcggagggtcattcggacagcagccattgcaaatctccgcccatttatgaagggatgacagggtgatctacgggagcagacgagtgaggacgcctggccacactgaagaacaagctgtgttttagcttccaagagaaggtgagccaagttttggtgaaaatagggtgggtccccacccaaaagaaaagtaggtagaagtggagcatgtgggatccccttgagttataaaaggaggaccttgcccaccgaagaaaaagagaaaaaggaggaagataactgagagaacacctaagctctctagctcttctgctctctgtaattccttcacactcagatccaccagaacacaggagtagggtattacgcttctcagcggcccgaacctgtctacgtcgctcgtgtcttgcgcatttgctctctcgcgaaccattccacagatcaagggcttggaacctcacttagcgcccccggtcgaatcggcaaaggggggcccgcgcggtctcccggtgaggagccccacgctccgtcacacacactagggcaatgagtataagatacgttcatgattgactctagtgcaagtgggagactgttagtgatatgccctagaggcaatcatagagatgattgtatcacatactatgtttacatatttatccgactttgttccttgaaatagataactcattattggttaatgaatatgcgattctttcatgagactctttatgttatgtgttgctatttctaaaggatccctgatcaaatatcatatgtggaacaaatatgtttagatgatcagcacatgtattaattgatgatcatgtctcatggatcatggtatatagataccaaattaataatgtggacacatgttggtgaacatgttagatagacccaacatgaggcactgcaagagccatatgtgttgtgtcatcagtgatctcatttagtgttggtgttgaatccttagacctgagattgtcatggttcccaacatgtgtagtagcttacttaaggactgctaaacgctactccgtaattgggtagttataaaagtagttttcgggtatgctatgaaacatgtagtgggatataaataatcaagatgtgatttgcccctcctatggagagatatctctgggtccctcgatgttgtagattatggaagtgcatggccatgccaaaggtgattgaggagtcaatcacaagttatataatctatcaacaggttcgagtgaatgattgagctattagaggatggcacatatctagccttgagcttaatcgatatcgtgaggcaaaggggttcatacaagtatacactagaggttcagccgatatgatctctatgtatgcccggtgggtcaatacgttctgctaggggccgctgttgacgcatggaccgaaaaggaattttcgggttacagccgagtgtacatgaacctacagggtcgcacgcttaatgggccggaataaggagattaaatggaggtccaatatgagcttaattcggattgggatccgaataggagtcctacgggccttggaggcccgagtgatggatcctatatattcgtgaggggtgtgaccggcggagggattgcgtcacgcgagaaaccctaaccgtcacttccctccccgagcaaaaccctagccgcgcgcgggtactagcacatctgcgcgtggcgttccgtccctgtacgtgtggataccggtagaggcgccgctggtttgcggtgctgatcggcgtgggagtacggtgaggagaacgcacgaggaggagaaggtcgagccagtgcgatcgactacttcctctacatcgacgcgcgctacttcgcgagaattccttcgactttttagcgcctttttccgctgcgcagcgtgtcgagtggtaacgatttatgatctaatacttgcacggttcctggtttacgcgatagaaaattttaattcatgctatcgtagcctacgcgtatcccaatagctagttcatcaggtttggtgattcctctgcttgactgactgggagttgctctcaattgccctctgcaatgcatgatcatcttgttcaatgtgcatagaacgttgtacctgtaaaactttttacaaacaagagattttttactgtattctgagttcggaatctcaatgctgcaacttattcatgcttggatggtctccgaactcatagtccgttccgttgcttcctggtgcctctaaatcccatatgtatttagccaaggcacatgctagcgaagcagcgaacctctaattgtcatggcaatctcatagagaaagttatcagttgccttattatttcttttttttcccctccaccctcgtttcgttttatgtactgctgaagtagcaatgcactaagaatatgtttatatccatttgaaatggtaaatgatacatggcaaaagttttgaaagtaaaagttttggcattgcaaaagtactagttggtgttta

SEQ ID NO: 34172 - DNA, 809 bp, Oryza sativa
ccctccccaaacctcgcaggcgccattaatggcggccgggtctcccgcgcccgttccccatcttccggccgccctctctcactcccaaccctatataaaccctccccgagctccccaccaccgtttccgccactcaccgccctctctccccgccgaaatagagctcgcgccgtcgctctctctctccacagtcaccgccgagctccggtccgccgccgtcgtcgccccggaccacctcccacctcggcgccgcctccttcggcttcgccgcgtccccgccgacctcgtccacctctccgtttcggtcgccgaccgccggagcaccgtcgaccccgtccacccgagccgcgccgccgtcttcctccgctccggtcgccgtttccgtcgtcgccgtcgaaccggggtgagccgtggaccgccgcttcgtttccccctttccctcccctctctcggccgctgctccgccgtgcctatggccgccgccagcgaccataggggcgcgggcgcgccgcctcccgccgctgcgccggcgtggccgccttcgggcgcaccgagcggctgccgcgtggggcccggccgtcagccgcccgcgccctcgggtgcggctgacgcgtgggacccacggcgccggccggtgcgagccccggtgcgcccggtccaccgtggaccgtgaggctgccgcgtgggccccacccccgtggacccggtctgcgcgccccctcccctcggctgacgcaataaaccttttttttaattaaaatttaaatgaagaaattcgcaaatattcatttaaagagcatataaacttc

SEQ ID NO: 34173 - DNA, 1512 bp, Oryza sativa
  unsure (1)..(1512): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagagagaggaatgtgaaaagcctgttctaaactctcgagctctaaaaagctttgacaggagatgtccttattcttagcaaaagagaatagggagttcatttcatcttgtaaaaacttgccagaccagttatctttccagaaaagggccgtgtccccattgccaatagtgatctttgagactgctctgaagatgggaatcaatctaaaaatgtccttacaccaaaaggatcctttttatgtgtgagcatgaggagagtcagacaaagagtattacttgttccatattagttttacctagggcaggtcttttttgttgaagaacttgtccagatgtttggtcagaagggcaatgttttacagttccaggtttataatgcccaaaccacctttcttctttggctggcatactaggtcccatgtagccaaggagtggatcttagtgtttggatcatttgacttcctccaaagacagtgtcttcttgctctgtctatgtgttgaatcactttttttgaagcttaagagtgcacatgtagaaattagggggagcatatagaacaaaatttaccattgttagtctctgaccatgattgagaaaagcagctatagatgggagccatctctccactctgtcaaccagaggggcaaagtcaataatctttggttttgtggtccccattagtaaacctagataagtgaagggcatctccccacttgtgcagccaaaggttctagcaagaacttccattttttgactgtcaacatttatcattcccatttcggaggctattctgatttatttctagggatggaactttctgagacaaaccgatatcgatgtgccatttcagagtttaataaaataacagacatttatcattattacattcaattgtgtgcatataatattccaatgactaaatcccttctttataaagttatgacacactaaatgcaattaagaccctaaatctcaaacctcaatgttccacgtcatcatcaattctcagccgttggatcactagattagattacattttaggcgttggatgaacaaaacgcaatagccaccacatgaggcccatgtaccacgtgaagtacttagggtttcttctttgattagtagggtctccttgtggagttgtggtgctagaggcagctggttttctccattgatggcaagtggtgccctggcgtgcctcgcacgtggtgtggcactggcctgatgaaaaaacaacatgcattannnnnnnnnnnnnnnnnnnnnnnnnnnnnnnnnnnnnnnnnnnnnnnnnnnnnnnn

SEQ ID NO: 34174 - DNA, 15870 bp, Oryza sativa
  unsure (1)..(15870): unsure at all n locations
taatttgcagggctcatgtgtgctttttttgtttacactgtatctatttgaccatttgattgtttaaagttagttgtttcttctttgctttgtagatccaaccatatgttgtcggatgattcaattttctgttacatttgttccatggaaatattttcagatgtgcatgtcatatgttcagcacactgcctgaatgaggatcatattagtgaacccctatgatcttagcttcattagtatcttttcacaacaagtttatgatttttattattgtggtttcttaacctaattgcgtagtatagttaatttttacctacatgtgcacactatcatctcactatatcgatcaatttgtatcatctgacatgattctattgtaaaatcaatgtgtgttttgattatattttgatgatgaacaattggcatggtaggttattggttttgatatttggagattattggcgaagtggtttggtgctaattatgtgctctggtcaggccggatagactaggccggtcagaccggcgtgtgttgtgcggtcaaaccgaccagcctgacgatctaactggctggtttctgactggaatcggttttgggttgtttaattggatatctgtgattattgttgatggtcattaagtgcgaactttcactatcaactcctacataaaagaataccaaatataatatcaaacttattggtaggggtttattactaactatttcctctagtcttggtaaatagtggtatgtagttgatttctgaaggaaaacacactcgtcatgcgattaaatgtacctctgaccaatcatacgtaagcacaaggatcggagagcccacatgtcagtcaaaatcgactaaatttgagctaatccattgccaaccgccataatcactcacctggcatacactagagaatgtgggtggctagatgcggtgtgcctggttcgatcgaacgaggggttcgaccaaaccaaggttggcaccaccctcctcccctctccccgccacctccttgcacttggcgacccactattggttgttgatggtggttgtgggtgcaccaacctccacaactgtcattccaaccgttatatggaggctataaaaggagaggctcaactcacatccaaaacacacaactcaagtgaagtacaactcaatttcatattttaggcatcactttagtatgtggaattaggtagatagtaaggggaagctctagaaggagtgtcccaaatatcgacgttctctctgggaagtccggaggagtgccgggttcgttgacattgttccactggaattctagagaagcgcatgtgttgttggccttcttgtcaagcttgttcctcgacggatgcttcttttaataaaataagtattcgagatctccttatggtatctaatttatttgcttgagtgagacatattcacatcgttatgggttcctcgcttagttgaattattaagtgctctagtactaggactctggataaagaaggaagttcctaacttcctatgcgaggctagagtagtaatcaataacttaggcatggtgtctaggttagcggttacattcatttgttgtgtggtccacggaaagtgaggtaggtgctaggtggtgacagctttgtccgtcctttacatccctccatgttcagttacatcatagagtcataggccgaactcagattgacagactaggggagagccagtgcccaaagcaatcgatagggttttacctttaactccagtctagtaaattaacccataggaatcctctttagccttagcccatcattagttgttgtccttgaatagaattctactcttacatatacacacacgttccctgtgattcaatacccttaaaatactctgaggtcaagtgctacagcggtctccatatgcttgcggattgacctgtgccgtatcaaataccaacaaacatttctagcaccgttgccaaggaacggttgctatatcatattcgaacctgattcatcctcgtatcttttcatttctcttcttacctaccatggagcacctttcttttcaaaatctttctattccaagggccaagttatgtgagtcacctttttcttcaaaacctatccattcatctagctataaattccatactgattttatagccatggttcgggaacaatccttcttaggacgtgaaatcgaaaatccctaccatcatctgcgttagtttgagcaattgtactcatgcttgacaatcgcgggcatgacacaaacaagcttaaattggaaattgtttcccttctctcttatagagggggtaaagcaatggtacacccataccggaagaaaactgcatggtgaatgggaggaatcaaaaggtaggttctaccttgatttcttcctgttaacccgtgtagtctctatacataaggaggttctcaacttttgacagaatgagaaaaaaatccaatggtgcagtatgggctcttttgttcttgttaactcaagacagcctagatttgtctgcacccgatcatgcgttgttataacactttcactcgggtttagataaggagtctgccatgtatctcaatacttccaccggaggttcgttcgcacacaaaacgacgttagaaagtagggagctcttggattgtatcctagagaacacctccttcgttcgttgtgaaaccgtcttgaaaataaagaatacacgtgaggaaccatcgacgaccgatattggattcgaccgttgaattctcacccaaacctcgagaactgaaggtagaagaaattcaacctttgaaattcccattccagtttgatgatgatctttttgaacattatggaaacacctcaaattattcctaccaaaagagaccaccggtcccgtgtaattctcccgcaccactcgatgagaatctcttcaaagagacggtgcagaaattaactaccatcatgagtgatgagtggttaatggagatggaggtttcttctgaagtaattcatattagctcccagtccttaactattccatatctgatgagagaggccatggtgcaaactctatataatcccactgttggtgcaaacattatgtctacaacctttgcattaaattgcttcgggggcgaactatttgcgccaacaaacaaaaacttctggagcccctctagtcccatcatcgaaggttatgggattcttcgtagagtgtcgatccagcacaatgatgtcgaagctatcctcgacttcaatgttttgaaagtctcttatttcgatcttttcgttggccatcccatagagaaacttctccttgatgtgccgcataccggagtccttgacattaaactcgggaaaatggtgtttttcattttgatcttgcgattgaaaaattctatgatggaacccattcctgattccgagccaattgaggaagtgatggctatctctccttttgaggcccccgaatccctcctcgaaaatgatgccaatgcattcgtcgaggagctaggacgatcatagagagatgatcgagttacccaaaactgatccacattcatgacctccagatgagctcaaatctcttctttcaggctttccttataccttcttgcatggtgatacggagtcgcccgtcaccatcagcgacaagctgtctactgacgagacctccaacctcaaagatgtgttagaaaagcatcgctctgttctaggctactcacttcaagacctgaaggggattggactggaccaacggtcaacaataaccggagcctctttgttggtctggctggtcgaggccccaattcaattctcaaggcgcatatgcctaaccattgggattcatcgtcaggtcgcaggggctgagagatgcgcgctagctaacccaccgtctcatcgcttctgttggtagcaaatattttattaccgactatctaaccacttgaccagctaacagagagcttgtttagtttattcatcaatccggacttaataactatgatatcataaaaaacataacagtatgccacctggtgtgtatattttttagtgacagaacggtacgtggtaccaaaacggaattaacaagcttaactatgagcgattcctttcctgctagttcatgcgcacaatacataattttagcaatatatattttttcacactctcaactaaatgatccaacagaaaaatgtagataaatcacaatcatatatgcgaaatcttagtattaaatattatgatcaccggaggtgcccatgcataaataaataatatgatgaatacatcattaattgccctcaattgactgatatgtcaatttcgttacttttttggaacgagacagaaaccgcgatgttatgagatagagatccgacatgactcatgagtgtcatcagcaacaagatattcgactaaatttcaccgtaataatgatcattattacctaaactaatatatgaaaaatttcatatatataacccactaaactttaaatggaagttcatccaacacctctaaattaaaaccagataaccaacccttaaacttaataacaccgttcatattacccctatcttctcctctaactaatgagattttggacagttaaccgtgtcatatattaaaaacaaaggtagtatatttttatttgaaaaatagatgtagttcgtactaaataatttaccttttttatgtataagtgcactttgtgaatcaaaccgcctgtctacaaattactccctaacatattatttggatatttagttttccataatatgcattacttgattttttttctcaacttccaagtttaagttatactcagcatgtaactaccgaataaatatacacttggacttttcaacttgcctttgtctattcagcaataatttaattacatggaaatactatatataccaagttgttggtaaactaaaagtcactagtcgtgtgtacaaaatattctctttttctagcaagtacaattggcatagaccctaatcacatcactctgatcacactagcagtccagcacaagcattcacacgtgtgcatccttaatatgtacacgcttgaaatattgtcaagggcttagtgtgtactcctaaaaacaccccatagcttagtcatgcacatatccactgaatgcgcaggcgtgtgtactcctaaaatacatgccaaccacacatcctagctactggatataaatatctgaatttacattaaccagatttaattttcagcctttcatccacagacctcatgtgctaattgatcatgatgaagcctcccaaagtatgcaaagctgcataactaaaaaaaaacgttgtaagtttattagcgataaaaaaaatattttatgagtaaaatttttatatacacgttttagtaacttaaaagccaatgctaaattacgatgaaaaaattgaactctaaattaaattttggttgcggtcaagtttacttaagaagcaaacgatggagctgtgtctacatcgatcagtccagatggagacattatatcatgtgtacgacacaatttgaaatggaacagcgctagcggtcgacctgcaaacgaaattataaatctcatgtacggattagcacatgcaaattaagattaagaagcgtgcaattaagggaaaaccacacttaactatgtggcgaactctagaccaatacgaatctggacatatatagccagattcgtattactagaatgtagcatccagtactagtactagtttggtttttatggaataaaggaagtaggtaggattgttttttttttatttgtagtattatagaattgggatactaccataagatctggatagttccagattttacaaagtatatatttttatgtaaaatatataatatgttgtataaattaaaacatataaattgattttaataaatttaactggtttttaatgtaaacttaagtatatttattcatattattttcaatccaccttattttaaaaaatattttgtaggatcgtatggatcgtagaatcatgatactacttaagatttcgtagaatggtgtgtaaataagtagtaaatcgggatgctatgaaaattaagatactaggtgggaataatagcgtgcttagtaggatcgtagtatcgtaagatataggatacggatcgggatactgataaccttacactagacttgtcttgtcgtatgacatcattgacatggatagactaccaggaacaacagagagatttatcacgagttaataccccctgaaaatggtatatgtacctgctgcaaatgtatatgccctgaaacctgaaagtgtcaagtagcaattaagaaggtggtgcattatgtggcatgccttagaccagaacttttttttaggaaaaacatcaaacaataacttgcttgataacaatggatcaaccaagaatggtacttgaccaaaagaaaaataaatggtttgggtaaaagaaaatgctggcatatttgtttaggcaattttagttactttttttagcatactataaataatgcccgtgcgttgcaatggataaatgcatttttttagcgatacaacagctattaagagccgaggaataaattgaaacatcaatatcactatatacattataattgaaaaagtgttgccttctacctcccttcactttacttgcctctccttaacttccggaagacagtttagtgcccgtccaatgctggagcaaataatcccatcaaatctagccgaatatttctcaatctcctaaaattaattgagggcttttgatccacttaatctcttaattcagtttttcccaaatcggagtgaatccataaactcgtgataaaaatggctaagagaatatcgccggccgacaaagcttaaatctaatgaattaaagccgaattgaaaggggaaatcatgggaaacgttaacaatggagattaaatctggtgaagtaaaatggaactgtaggaggaaatcaaatgatgaggggtagtggggaatcaatttttgcaattaattagggtaggaaacgcacggagagactgatcaatgttacggcggcgctagggtttggccggacaacagcttgctagggtttggcccagcaacagcttgagattaaatcctagcgacggaaaaaaaaaccaagtggattaaaaaacttaatcctcaccgcgtgcaaaaaaaaaatatgactacaaaaatagtgacagaaaaagcttatgaaaaaaccgaaaaaaaggcgaaaaaacatgcaaaaaaaatgatgtgtaaaaggtagtggaaaaaaaagaaaaaaaggacgaaaataaagcggacagaaaaaacgaacaaacagcgtcgaaaaacattggactgaaaaaagggagtcggacggaaaaaaaaaaaggaaaaaggtcgaaagaaaaaggccggacggaaaaataaaagaaaaagggttaaacaaaaagaaaaaagagtgaaaaaatacgacggacaaaaaaatcacggaagccttacattttttttattacatttttttattagatatagaattacgagctccaatggttcggcgacgatgttccagtgtgcacaagtctattttcatatctcaattcattccctcagctcttctctcttaacttttgttttggttttcttttttacttatatatccattaatttacactaatatcttctttttttaagagtcaagtaagatgatcacatgttttaaagtctcatttctttcatgcaaccaatatttgtaaaatttagtgtaaattatacatgttaaagtgtgattgttttttatgtttaaatctttgaaaaaatattgacaatcctagatatatatatataaaggattgttttgcagtaggtagtacgcattcataatgaatcaaatctccaagatttatatatgtcatgtatttattatttactaagctaggacgctctaacatcaatagacaaaagcataaacaatatgaactgttatattaattgtaactggttgagattatgatggtgtagattataatcgacataactatacaaatataagtggatatatataataagctgaagcaagaactatgtatataattcagttatacttttgaatatatatcttcacatataattacaagaaaatcagctagttagtctaatttcaacttgtggataaatcattgaagactaaaaggatagcaaaaacaagtacacctggtatatttgttaggcctagtttggtttgttggccaaacaaaccgtatccaaattttggtatgcgaaatgttggcccattttggcatttccaagtaattttgggatgtgtttggtttgatgcagttgctaaattttggtatagttttaagagtaaaagatttcagaagtactaaattttggcatcatatatagcaatggttaatatgtgtttttgtttgttgccctaccaaaatttgatagtaccagaatttggtaaggttaattaatgaaaacatgatcattgggactaattaaccatgtttgctaagtgcggaaggatttcaatgccgatgattaaatgtgatataatgattcatccatcaagaagttattcatcccggtgattaataaatgggcgtctaagatacatactaaaggtaattatccagtcttcaacaagcaaagtgaagattaaggactcctattcactagtttaccacatcgaaggagttgggagtgatgtagtcattgaatagggttttactccaaactataaagaggggtaaagttagtagattgtccaggaagctagtgttagtaactcatgttactggaccttgggttgaagctactagcccactgtggcccatccgattggaagaatgacaatacaaaagaacaagcatcagtcagggagaggggatcgatcgatcagaagaaccggacggcggcggtggtggcgacctgaaggccggtgggctccttgtcgatttcttctccaccattcctcctacctccacccccttagttctagaaccccttctagaacttatatcccttttcttcttcccattttctccaccaaacaaagagttgtactgaatatttgttgcaatttcgcttagagaagtgggtctctaagggtctctaacagctaggtgtgatgcacactagcgccgtgtttagttccaaaataattcttcaaacttccaacttttccatcacatcaaaactttcctacacacgtaaattttcaacttttccgtcacatcgttctaatttcaaccaaactttcaattttggtgtgaactaaacatagcctaagcctttttctagcacaatatctatgctttttccctagtggagttgagccggagcaaagtttggattgcgaatcattaattgtccttgagtctcagtgtaccggacggtccagtgccacatcaaacagtccgtctaacggatcatgtgttgatgaaagcatattgtgtgtacgtgtcaggtaggccgttgttgactagatagtccagcatgttttcttccaactggaccatgtgtcgatccaggccataccgtgtgtacggtccagagaatccaactgcgtgtcagactgtctggtggatggatcgttcgaccagaccatgtgttggtcctgaccgtgtttgtgcacatggatcggacagtccgacagatgacggatcgtgtggccaaacaatgtgtttgtctgagttaagacattacatttactggacagtatggtgaaaatcaggcaatccactcaaatcacatggaggaggcctaaggattatatggattggacaatctggtatgcaaccggatagtctgccttatacatgggtcggatatatagttttgatatgagtaaattgtccggctttttatggtctaacggctagttacatgtgatgattgaaaagtttatataaagggacaaacagtcctacaatacatcggactatctaaatctatgctttttttttttttgcaacacacttgcaacgactagtttgagtggttagggttataaatacccaattgtttagacttcccctctagctttctagatatagtgttaatacaaggaagcatcatcttgttattgttggcatctcgatgcgcctaaacggttgtggaggtggttcctgtgatctctcaagaatattgtggaagactcgggtgacgtgtggggcttggagctcgctatccaaagttgagaagagctagctatctctcgatagtgctcgacttcatgaccatgagacttttgtgtacagtactcaacgaggactagtagagattgccgaatttccgatatctcaggaaaaactcgttgtgccttggtgtttgcaatatctctttttctgttcttcacttgatattcttattagtttcaatatttagcttgttctagaattgttaggatttcaactaggttgtagaacttgggctaactagcttttgaacctaggcacataagctagattttggagttgctcatattgatgtcatttcaaactatactatttttttaaaagttatcaaatatgtgcatccatttagtttttttttaccactctgttaaaaacataagaaatcataccaagacttagcaatattgccaaaattttgacaatgctaaatttggtaaggtttatttgactataatctgaacagaccctttattttctgaatttaagtttaaattcggccacatctttgatccacgtcttagagcatatatcgttattccccccctgacctacccttttctttgtacgcgttaagcccaatgtgttgggctggtccaaagttattgtaaatactccctccattttaaaatgtttgacaccgttcactctttagtacatgtttgaccgctcatcttattaaaaaaaatttgtgaaatatgtaaaactatatgtgtacatgaaagtatatttaacaatgaatcaaatgatatgaaaagaattaataattacttaaattttttgaataagacgaatagtcaaacacgtgctaaaaagtcaacagtgtcaaacattttgaaacggagggagtatattttatacacagaaattttatatgtatgacaactttatgcatacaatgtatgtataaactttgtacatatatggaaaattcatacatgagtagtatacgcatatatacgtacatttttttacgtacaaatttaaaacataaaggcacttagaaaaaaaaattaattactgtaacattatatccgaactttgcacgtataaataaactttatacttatggatcttaaaaaattcaaaatttattttgaaaaaaaaaacgcgcaggtgggctaacctccctcgaattcggtatgatctgtaaacactaaaaactgccaaaatccatatagaaaataaaaaaaaaagcttgatcgttaaacacgcaaaaactaaatgtggcccaaatagcgcgggcgaaaaaaaaagaataagttcatctgaggtcccttaacttgtcaacgaatccgattttcatccttcaactgaaaaaccagtgcagatgaggtccctcggcggtttggatggtggttttagctgacgtggcgcttacgtagctaatttgactcggtcttcatctgacgtagggttgacgtggcgcttacgtggcaattcgatctgaaaaataataaatctcatgggacccacatgtcagtttcacccaaaaaaataaattaaaaaatggtggggcccacgtggccccacatatcattctcacccctcctgttcttactcctctctcaccatctctcccctctgctccctccaggcgccacggggccacgggaaggtccggcggcggcggccggcgacgcgggagaagggcagtgggcagggcgtcgncggcgggagcgctgggtcttcgctcacggcgtcggcgcggactccgcgcgggggctcgtggaggagatcggggccgcggcgccgcccgtctccgatgaactgagctcgtgcgagcgcggtgccgggagctgcacgaccgccgacgagaagcagaggaggttcgaggtgtacaggagcaacgttgagcttgttgagaagttcaactccatgggcaatggctacaagctggctgataacaagtacgttcgccgacctgacgaacgaggagttcagagccaagatgttggggttcagacctcatgtcgcaattcctcagagcaatgcctggagagagcagtgatgatattctgccgaagagcgtagattggaggaagaaaggagcagtggtggaagtgaagtaccatgaagattgtggtgtgtgagaaatagcatggtaaagaaagattcaaacctgtaaaaatgttggagattaatcgatggaaatctgggtgttgtgtggatgcaggttcttgctgggcattctccgccgtggcggcgatagaggggatcaacaagaacggcgagctggtgtcgctgttggagcaggagctcgtggactgcgacgacgaggccatggggtgcggcggcaggtacatgagctgttagagttcatcgtcggcaaccacggcctcaccagtcaccacggaggcgagctagccataccacgccacgatcggtgcgtgccaggcggcgaagctgaaccagagcgcggtcagcatcgtgggctaccggaacgtgacacccagcagcgagcccgacctggcgagggccgtggcggcgcagccggtgtccgtcaccgtcgacgccggcaacttcatattccagctctacggcagcggtgtctatatagggccgtgcaccgccgtccgccgacgtcaaccacggcgtcaccgtggtgggctacggcgagtcccccaacactcctgccactgacgccccgcccttccccgcgtcgtcggccgccgccgccggacctcccccgtgaccccgtggcgctggagagaggagaggggagagatggggagagaggaggggtgagaatgctacccaccattttttaattcattttttttaaactgacatgtcccatgagatttattatttttcggatcgaatagccacgtaagcgccatgtcaatgctacatcggatgaagaccgagtcaaattagccatgtaagcgccacgtcagccaaaaccgccatccaaatcaccgagggacctcatctgcactggttttgatagttgagggacccgttgtatctggtttttcggttgaaagacgaaaatcggattcattgacaagttaagggatgtcaaatgaacttattccaaaaaaaaaaacaaagaatcagagtgatcgtgcgtgcgggccggcggctgatcgcgaaagcgatttcgctatttagaggctgagttggactctcttcgctaactttcagcttaaggaggtaggaaaaagtacaccgtagttcccttaacttgtcatcgagttgcaaaatcgtcccccaaacacaaaaccggatacaacgcatcccctaatttacaaaaccagtgtaaactaggtccctcggcggttttgactctggttttgtccgatgtgaaagctgactcagcgtgggacccgcgtgggcccacaagtcagggtgtccatgtcatcatcatctctttcctcatcttatctccctttctcctctctctctttcccagttttctcatacgggccgaccatgggtgcgaggaaggaaagggtcgccgacgacgagtggtgtggtggtgcggcaacaccggagaaggggcgacgcaccagcggcgagtgagatgtcaagaccgctcttggcgagatgacacaagcgacgggaagggctctgcgaggttcactggcacgggggacgacggcggcttgggggcatcgaggcgccacgctcggtcagaggccacctcagcgtgcgcaagcaggaggagcgctggcacaaggtggcgcgccgagagcggtattgcccaccactgccactcgcccaccgccgccacactcgcccgctcctctgctccacccacgtccagagccgctgcttacccaccgtcgccgctccgtagccgcgctcgcccgccgacgtcgccacttcgcccgctccggccgtgacctggcgcccactgcagctctgccgagagacacgcggtgacggacagggagatgagtggaagagcgagcccatatgagccacagtggaagagcgacccatggagaagagctcgccattgtcgtcgaagtcgagccctaatgagcagccgctccggccgtcctcctccgtccttgcgccatccctcccacccctcaagctctcagcggcggcgctgcttgcacggctccagtagcggctgctccgaccacgggcggtcctcgactggccgcgccgccgccatgttcaagcccgtcctcggtgggaagcgagcgttgggattggtgcagcgaccgacggggagagggcggcacgcttcatctacaagccggcgccgtctaatgttgtcttcctctccagttgcgctgcccgacgtcgtcctcctctcccattgcgcagatcctgttcgtcggccggcacctccaatgagggccaccaccgccgagttgggagcggcggagggcgcagcacccagggggacacgtgggcgagcgcttgagtcgcctctcatcgagcagagaggagagcgaggtgagggcgaggccatcgccggtggcgccgccgccgcgtccgtctccacctccgctcctctccccgcctgtcgtcagccacgcttctcagtcctcccacgccaccgattgccagaagagaggaaaggaagtagtcattgacatgtgggacctacgtgggccccatgctaactcagctgccacgtaggacaaaaccggggtcaaaaccacccaaggacctagagtgacccaattttgtatgttaagggatgttatatatctgatttttgggttgagggatgatttttcagtgtactttttcctaaggaggtataaataggcagcccattagagttcgctcttacttcttctgctaagaactgggccattaggtagatgggcccatttcctgtttgggcaagctgggccagacacagtccacctatgggcctattgggccttctcggggccttacctaagcctgggcctcgtctaccctaacccaccacgggcccgcctccattgcctcctcgctcgccgccgccgccggcgaccaccaccgccaccaccaccaccacccgcaaccgcagcagccgccgtctcttcacccgccggtgccgacccatccagcaaccctcacggccagccacgcgccgcaagagagtccagatctccgcctcgatccgcgcgccgccgacgccgacgccgacgcccacccggacccggatctgcgcgccgccggcacctccccacgcgacggtgcgctcccgatccaattccatctccataccctcctcactctggtgcgaccctctgccctgatggtgtgtccacgccgccaccgacgtctcccgctatgtgaatgggagaaagaaaacgggagttttcttggtctattattagttgcagcaatcagatgacagcgacctgaaactccgggaattcacacgtttttctgcagaattttcttcagagttattcttttcttttcttttcttttcttttttgctaccatggatgctggagttttttttcgctatggaagattcagtctctgcatcttaaccagttatcataccagtgcaaaaaatttatgatacacttgctttggtttggttggagaaggcatcagcctcaagccatcaacttgctgaatttgacggtgtccaagctctgaagcattctattgcttccactggatggattgatggatggnnnnnnnnnnnnnnnnnnnnnnnnnnnnnnnnnnnnnnnnnnnnnnnnnnnnnnn

SEQ ID NO: 34175 - DNA, 5499 bp, Oryza sativa
  unsure (1)..(5499): unsure at all n locations
nnnnnnnnnnnnnnnnnnnnnnnnnnnnnnnnnnnnnnnnnnnnnnnnnnnnnnntagttggctgctgctgtagttgacttatggaatattaaaatgctgttaatttacttatcccaagctgtacatgatgctgttacatgatgctgttacatgtagcttcatgggttgcatgtagacagccatttcggttccccatgtctgacctttagttagttgtgtacaccgaatggcagtagagatagatgcgtaagatggtggcaaatctgatcacatgctgttcaattataccataatgacaaagcaaccattttttaattagctgttcttttttcttaattggttagcttaaagaggtttggtggtgtgtcatggactcatgggaaccttttttgattagtggaggtttggtggcctcttggcaaagcataagaccaactcacacctgctcatttattccagatttctgaccagccttgacacggtaaatttttcggagggggggtagatctgatctgctgggtttgtgggaaggggcatataaggagctgaggcctccctctgagtgcatatcgtaggcagcttccctctgcatacaagaggctgcctcccatttctcttctctgtcggtgttctcctcaagatctgtcttaagttcttgagatctggtaagattcttcatgatctcgtgcatacttctgcggttgatctgtagttcgagtatggaccatgcaagctgtgtggtttcctgttttagttgttcatctcaagatacttaatgctgtgaatctctgaatttgcttgagattcatgccttgcacatatatgatcccttgctagattcagtaacttgatttactctgtgtttgtgccattaaatttgtttcctttcacccctgtttggaactatttccttttattttactgcttgctacagtgctgtcgtcgttgatgaattagaggcattattattctgctcgtaacttgaattcgttagctaaactttttgttagtgttgttgtggtgacggatctccatctgtcattctcctgatgcagtttgacaccaataggcacatattattatcatgaactgctcattggtttatcagtttaattgtgttcctcagaacctgactaaatgtatttcacagcctagcagtctttgcatgtttcttttgacatattggtcattgtgcttgtaaactgtgtatctagatagcttctattaactcaaaaatgctgcttacaagttctgatctatataattacttttagtgcttattcttcaatctcctgaaaatcagttttcattatcacagtttcagaactaagctgagaagatggtgaagatctgctgcattggagctggctatgtcggcggcccaaccatggccgtcattgccctcaaatgcccagcaatcgaggtggtggttgttgacatttccaagcctcgcattgatgcctggaacagcgaacagctcccgatctacgagcctggcctcgatgaggtcgtgaaggagtgcagaggcaggaacctcttcttcagcactgatgtggagaagcatgtcgccgaggcgaacatcatctttgtatctgtcaacacccccaccaagacccgtggtcttggagcaggcaaggctgctgacctcacctactgggaaagtgctgctcggatgattgctgatgtctccaagtctgacaagatcgttgttgagaagtccactgtccctgtcaagactgcagaggccattgagaagatcttgacccacaacagcaagggcatcaactaccagatcctctcaaacccggagttcctcgcggagggcactgcgatcgaagatctgttcaagcctgacagagtgctcattggtggccgggagacccctgagggcaagaaggctgttcaggctctcaaggaggtgtacgcccactgggttcctgaggacaggattatcaccaccaacctgtggtccgctgagctctccaagctcgcagccaacgcgttcttggcacagaggatctcctctgtgaatgccatctccgccctatgcgaggcgactggtgccaatgtggccgaggttgcttactctgtgggaaaggactccaggattggccccaagttcctgaacgccagtgttggctttggtggatcctgtttccagaaggacatcctgaaccttgtgtacatctgcgagtgcaatggccttcccgaggtggccaactactggaagcaggtcatcaagatcaacgactaccagaagagccggtttgtcaaccgcgttgtgtcctccatgttcaacacagtctccggcaagaagatcgccgtccttggctttgcgttcaagaaggacaccggtgacaccagggagacaccagccattgatgtgtgccacggtctgtgggtgacaaggcacagatcagcatctacgatccacaggtcaccgaggaccagatccagcgggacctcgccatgagcaagttcgactgggaccacccgatgcacttgcagccgaccagccccactgcattcaagcaggtgagcgtggtgtgggatgcatatgaggccaccaagggggcccatggtgtctgcatcctcaccgagtgggacgagttcaagaccttggactaccagaagatctttgacaacatgcagaagcctgcattcgtctttgatgggcgcaatgtggtcgatgccgagaagctcagggagattgggttcatcgtctactccatcggcaagccgcttgatgcctggctcaaggacatgcccgcggttgcataataattttccatattccacacctgaacctcatagctctctacactctgctggtgctgaagagagtctgcgtcgaagaggaatttggttgaccatcattttttatagctcgttgttcgtctttacatacaggagaggctaccattttgtcaaacagaaagttgatttctgttagtatctttgttcaagtttttcttgtgttgcaccattgtagatctgaaatcttcaggcctctaccgtttgagtgccaccctcaatcttgtatgatgacatgaattcttatagccgatttattcttcaaatgtattcttgtgtcgctaaagattaatgatgcaattttttcttggccaaactgcagcagtcttgtttgctctggtttcattgtttttggctcggcaataaatgtgtaatatgctgtaactgaatgaaaagattggtccaatttttttggtgctgcctctcctctgaccaaccactggagaagagagccggagatgatccggtgaccggagctagacagcgacaagggtcacaacttgcctcccaattcttgaccaggaggggcagctctggtacttaacacaaatgttttcacaaataagaaaagaaaacccggaacaaataacggagttggacggtagtgatagaaaagggaacacggcaaattcgagtggtatttaagtgtaccatggaatttcatgaaattttagttccaggtatataaggacctataaatatagaaatatgttaggagaaaaaaaacattaacggcaattagacgtgagcaggggcagtaggctaacatataaccacttgtttttttaactgaactaactgttagaataaatgggctaggcccgatttttctattaaaatctcaagggcccataataaatgttaaagaaaataatatcgccctgagaattaaaagtggagtatctcaacttaaatagagagttattggaggctacctgttaaccggttgaggtggggatcggaaagccacacgcgcgcgcgccgagccgagccgaggccgtgggcgtggcgaggcgtgcgtgcgtccgcaacgggtgcggattcctctccgacgctattaggaaatagagacccccggtcagatctctacgctttctcccatcactggttcttcctccgatcagatctctacgctttctcccatcgctggttcttcctccacgcttgcgcctgtgctgcttctgcttccccggttctgattgcttgcgcgcacgaatgatcggaacgagcagggcctccgaaaccacaccttcgcctgagatctgcaccgggtaggcgggtgatcaggtttttaaggagtgcttccgtacaactgctctctcttcatcatcgtcggtggttctgttcggtatgcgtcgcggcaatgtctactggtggcggcgtcaacggaggtgcgccaggaactggagtcgcaccgatcgacaacaccaacggaggcagttctgtctcacaatccagcggagggacctttacagggtataccatcctactgctatctctgtttttgttacatctgttagtcgcaatgttattgcgttctctaaatgatgttgatgcttattttatcttaagcatgctcctggttatgtttaattttatcactagatcacctcacattgttcatgtcatgtttattgtcttaatattttggattaaaatataccgatatatgaccatatttccaacactaacacacaaccatccgaaaattttcaatccaaattgtctcagttaggtcagaaatgtgctcacaaattacttctatagtatcctacaatcccttgaaaataatccttatcataggtcataacatgtgactttatgtgtataacacatttaaatatatataaatatttggttaccagtttgacgtgtagtttcatattaaattcctttattttaaatatgctattttctaaaacaaatcctcataagggatgtatgtaggctacgcatatagatattctttaaataattattaaatggtggctcttcactcaatatttttactttggactaaaaatttttatatgtgttttactttcgaccacctcaactttcttcgttagtgacatccactctctcctctatcaaagaattgatgtggtttgcacgtaagtgaaagacaataatgtgcaagtgttattgtactttagactgttgatgtatttgagatgagagttggggtgatccaaatttctaaaaagacaaggtactcaaggtgaaaagtaaaaggattgattaagttatgatccagagtgaaattttagctataacagttagcccaaactgcatttcgattagagtattcacacttttcatgactctggttgatcacaaagtcctagcatgtctaatagtcaataaattgtagtagtatttcatctctggaattccaaattgtagtttagatcaagttttatcaccaaaatttatccattgtctaatccttttatttcagactaggtacttttgttattttaatttactttggatcaccctgattatcgtttctaagccatatttagcaaactatatagcttgggcacataggtgaggggagctcgcaagcatgttgaagctgatcgtcagaccagtcattgatgtgttcaagaagtggtttaggtgatcagaactactaccatacatctgtcttataataattgtatttctaccatttaaat

SEQ ID NO: 34176 - DNA, 2350 bp, Oryza sativa
ctggaattccaaattgtagtttagatcaagttttatcaccaaaatttatccattgtctaatccttttatttcagactaggtacttttgttattttaatttactttggatcaccctgattatcgtttctaagccatatttagcaaactatatagcttgggcacataggtgaggggagctcgcaagcatgttgaagctgatcgtcagaccagtcattgatgtgttcaagaagtggtttaggtgatcagaactactaccatacatctgtcttataataattgtatttctaccatttaaattttatataaaaaaagcatttgtaataagatgaaacccatccaattagtcagatagagatatcctgccttctgtcctaccatctttccatccccattggcgccaacctttcttttattcagtatgttattatagttatccgtgtttactaaattttataatgcaaatattttagaaaaaaggtagtagaaaaacagcaaaattatctagtttaaaagtgaaaagcttggataaatagtaaaattttggtaacgaaaaattgataacaaaaatgacctaaactaattgttgttttttttaataataattaaaaaagtgctgagttgccgagcagtagtaagctcccagtccaaacatttctcctcctcggtctggagccgctcccccctccccgccgccgctgctctcgacgccgacgccgacgaggcagctaggccggcgacgaacctcgatctcgatccgctcgccgccgtccgtcgccgatccgcgcgccgacaccgacaccgaccttgatcctgatccgcgctccccgcgacgtacgccacggtgggctcccgatctgaccccatcctccatccaccctcctcactctccgccgtcgtagtatatctcaggagggctaccagctgagccgagggaggagaactggatgcctcgtgcgcactcaaaggccgcagctttagcctttaagcttcttttttttttctcttactatggggggctagttgtttatagttagttagttagctcgaagcctctcctgcgtctgcggttgcaaccgattcgatttccaggttggttggttggttggttgtttgcactgatgggaataaacctttatgcataaatagctttgcgtgacttgcactttgtgcagctaaatgtgacaacctgctgttgctgttgctgttgatgttgatgttgctgttgctgttgatgtgcgttgtgatctctgaccaacctgaaattaccgggaggccagggtagatccagttgttttgtggtgagttgtgtggttgtggagaggagggcgcatgatataaagagcttggggtttgctcccctctgaatacaaaagtgacaacttggggaactaggcagtgcctctgcatagcatagatcttcctgtcctttctttcttgtctagtggtgagatctggtgaggattttctcctcaagatatcccttttttcggtttgtagtttgttctgaacatctgtagtttggcatgtccttccatgatctagctgttcgttctgaagatccataaagatattgatacttactgtcttgggaactgggggatatcatttccctttcacccatatgtgaatcaaagtttattttatttagtttacctcttagattcgtcatttcgcttgctgtcgattttgccttctttagctgtgtagtcatgatagaatcgttgcagcaatggatttggtattgtgtccttaggacttaggagtagtttgaccgtcttcccagaactactgctgtttctttctccattcagttgggtggtagctttctcagaaccagagttcacagtcctgcactcttcacatgtttatttcgggatcctggctggtgtgcttgtgatctgcgaaacacggctgcttatgttcactcagaaatgcgcacattcctttcagtttactactctgcaatctccctcaaaatctaatttatatggcaggtttgcagtaagcaggaaagatggtgaagatctgctgcatcggagctggatatgtcggcggcccaaccatggctgtcattgccctcaaatgcccagcaattgaggtggtggttgttgacatctccaagcctcgcgttgatgcctggaacagcgaccagctcccaatctacgagcccggtcttgatgaggttgtgaaggaatgcaggggcaggaacctcttcttcagtacggacgtcgagaagcatgtcgctcaggcagacatcatttttgtgtctgtcaacacccctaccaagacccgtggacttggagcaggcaaggctgctgacctcacctactgggagagtgctgctcggatg

SEQ ID NO: 34177 - DNA, 16086 bp, Oryza sativa
  unsure (1)..(16086): unsure at all n locations
tggtctgctgagctctccaagctcgcagccaatgcgttcttggcgcagagaatctcctctgtgaatgccatctctgcactatgtgaggcgactggtgccaatgtgtccgaggtggcctatgctgtggggaaagacaccagaatcggccccaagttcttgaatgccagtgtcggctttggtggctcctgtttccagaaggacatcctgaacctcgtgtacatctgcgagtgcaatggccttcctgaggttgccaactactggaagcaggtcatcaagattaatgactaccagaagagccggtttgtcaaccgtgttgtggcctccatgttcaacactgtctctggcaagaagattgccgtccttggctttgcgttcaagaaggacaccggtgacaccagggagacacctgccattgatgtgtgccatggcctgttgggtgacaaggctcaaatcagcatctacgacccacaggtaactgaagatcagatccagcgggacctttccatggccaagtttgattgggaccacccaaggcacctgcagccaactagccccacggcttttaagcaggtgagtgtggtctgggatgcgtatgaggccaccaagggagcccatggactgtgcatcctcactgagtgggacgagttcaagaccttggactaccagaggatctttgacaacatgcagaaacctgcatttgtcttcgatgggcgcaatgtggtcgatcctgagaagctcagggagattggcttcattgtctactctatcggcaagccgcttgatgcatggctcaaagacatgcccgcggttgcataattctgaatccccacctggagcgctctgctggagctgaagaaattcgataaggaaacagaaccggtcgaccactattttctgtagtctgtttttgcaggagacagctaccattttctcagtcgtaagttgaatatctgttagtatctttgtcgaagttttcatgtttgcagctttgcgcctttgtagatctgaaatcctcaagcctctgatctaagagtgccacccaaaatacctcttgtatcacatgaacttcttatagccgatttattctcgtatttcaaagacgctacagattaataatgcattttttttgccaaataaaggctgtgtttagatccaaagtttggatccaaacttcagttcttttccatcacatcaacctgtcatacacacacaacttttcagtcacatcatcttcaatttcaaccaaaatccaaactttgcgctgaactaaacacagccaaagcagccgtgtttgctctcatttcatggtttctttgctgtcatttcgtagttttatgcctgagcaacgaatggcagcagatataaactggctgtgcacagtatgctgtaactaaatggaaagagattccttttaagttttgatgctgctaattgctgtgtccagccagttttgtgctgctgtgatcttgccgaccagctttttgtaaaaatttgtgcaagaggaatggatggtatggtaaaaatttggttacagtggtctgctgaatcggttaaggttttgcatttgtgagcataaggtgctggaacttttatcctctcaagaattcagtgccaaaagctattgcaaccttcagcggggccttcacacttctacaggatttattttcaggttgatccaaatatgggaatatattagatcacacatgtttcaactgcataacatgtctgttcgatatgtaaagaaagagcatgctatgcgggtgttttctgttgtgggactggcatagttctgcagcttactgaaaaaaaggggataagcagttttcctttgcgtgtaaatgaattatgcgcattttgtttttgtttgattttcttcaatgttgtcatgctgccctatatgagagcaccacattcacgtgtatcagattttgaaggactggtcgatcaagatgaccacacgtaacggaaaacacaatgtcaacgattagttcaattaagttgctgggtaaacaagattctgaaccaaacaagatgttacttaaacattccaatgtcaagatttctgacaagcagcaaaactgcacggtaaatagatgtatgtgtatcatgctttgctagtatgaaaactgcaatacatgtctatggtgaatcaacggcttcgccagcaggaatgaatgatcacaaccgagatccgttacagatcaatagctgcggccccagaatgaccatttcttcgcaggctttccagaagcaaagcatgtggttcctgaattttggtgcaccgcatcagaaaaggttagttacaagtgcatggaagaatacgttgcaagaaatgcagtaaaagaccgagcaaaagagattgtgaacccaggctatttgtggcattttagctattgcctgcaaagcataccttctgggagatctggctgttcaaatggtgtacacaatgtcttggcagctcccaggtcaccttttgtccgagccttcacatccttctcaacttcctgaaccagcacgaaaatggaagatgcccatgttgagtagaaaatgttagtaatccagtgtaaatagttcataatgttatgttaataactagtgcaacacaggagtatatttggtagtaactaacagaactccagatatcacagtgcaataaattattttgcaggtactattgaatgtgaccctcgaccaagacattgcaaacctcattgagtctccttgctatcccatttcgttctccattctacttaactcccatctttgaactaagctcgacggtgctttaaacttctattggtcactggtgttacccctaccttcccattctccctccacaatcaacagatataataaagatatacaaatacgccttgccccagcaatcaaaagaaaactttgtagaagagaacatgaacacactggatattccaaatagttaactagtgctaaaaaaataacatggtgagagggagatctcataaaaaggtctcacgtacctcttcatcacaccatggagccaggatcaattttttgtcattcagagccactatgaattcatcccaggtgttaacaaccttaaggcaggcatctctcttttgtttcgccgtctcaaacaagtttttctgaacctcatcaagtaacccattaactttctcaaccaagtcagccgtaggaatatcagcttttgcaccattgtctcgcctaacaacacgggcctgaaaagcagatgatgttttcattaactccctccatttcataatataaggcacaactactttttaaagttgttccataatataaggcatgcatgcatgcatgccattaactaacccatcttctctactaaaatattattatttaaattctccaccatcaagatctctaattttattgggtgcatgaattacatttattagattaatccaaactataaggtgataataattatttcttggtctttgggctaagggtagctgtgctttatattttggaatggagggagtattagttggaataaaggttcagggaatagtagcaaattaaacagcacaacaaaatgaaagttactccatccatgccaaacctatatgagaaatggttgagggcaccattcagtcactggaaaagatgtgaaagttgcttaattgaatcaaattaacatattttaagtagaaagaggagaaataggttattaaatgaactagccaactcatgcattgcaacgatctaggataaatataaaatctgaactcaagaacaatatatagacttcggattgatcatcagttcacaaatgatcctattattacgaaccacatgtgcaaatgatataattattcagataaaagaaacacacgtgcatgtatgcacagaacccatggtgatggtggtggtatggcagacttaccatcaccaccaccaccactagctctttttctctaacagtaaagatatagcagttttcaggaaaatgcatgataacaaaggtgcccttagtttatatattcattagctacttactgttttgatgccattaattaatcatattttccatagggaatagagaacaaagaagccatttacacttcatcttatgctaacaagaaaaaccaatttatacaagtacactgatctactaataaacttgtggattctatcatggatatggaaggcattattaatttatcattaactactttatgaagagtcctagaagcattatagtaattaatgtgccactgatcaatgaagttaataaattaaatggtgtgacctctgtacctgattgtttgccatatcttttggacctatctcaattcttagaggaacgcctttcatctcccagtgggaatacttccatcctggagaatagttttcgcgggtatccaagtctgctcgaataccagctttctccagtgtctcaacagtctttttgcattcgtttacaatagctgttgtgtcaacatctttgtatggaacaggaataacaatgacctgcagaggtgccacccttggtggaagcactaaacctttgtcatctccgtgtgtcatcaccatcaccccaatctgcaaaacaagcatagggtcaatactacaaatgtgaacataatttgggtagagaactcagcaactggaaataacagatacatagaattaaagtaaaaataataatttaaaaaactagcgcattctgtattttaaaattaccagagagcttagcactcaaagctagctcctcattcacaataaaagcctcatttcttttgtaaaacattaccacttcaaaagggcaaaacaagaagaaaattccaggtacattccaaaatttaacaatatatgagaattaccgagcgggtggtgtatgcccaagagttctgccacaccatggatcttgagcccttatcattctcaaaagtgatatcaaacatctttgcaaagttttgaccaagacaatgtgatgttgccccttgtacaccacgtcctgtgtttggaatgaaggcctgcaaatatgataaaattttattattactaaatataaagataagtactcttcttcatcagggtaactacagaaaaactaatcgggtggaatgaagcaaacatttcatattaatacctcaacacttgttgtatacagtccaccagcaaatttttccatctcacttttcctccctttagaaactggaactgctaaaaattcttcataaatccttcggtagagttccaaaatttggagaacctgaacattgtcatggattaaaataactcagcatccttttaaattaacaacacgttactcattatttctgttcgctccatcagatattctacaaaatagttttttgtgccaagcaaccactggagataaatacaaccttttcacattcgaaaatgtaaaacaaggttcaggaagtgtaatgaaattgaaatattactgatgtcaaaacgactatttacactagcagtataatatcttcttcctagaatactatgcattgatattgggccagctgttgcttcacactagccaaaagcaggacaatagtacttaaagatagtttacaacagaaacaccaatatttgttaaacaaaagatgctgcttatttagaaccaaaaattccctgagcaagttatggccagctgcaaatggcagcagattgcccattagggaggcccatggattatggagattgctcatatggcaaggcagcagcaaaaatgctagtgctggaaaagtagcttaaggttaatttagcacatcttgattggagagctaatttcttagtgatcatttagttctgacagggagaataatggaacagtattctcattttcctaagaatccccccttcatccatgcattcgagcccacttcaatatggcagttaaccctgatgaactgcggttgcaaaaacaagtacagtacctcttcgtcagcctcctctttagttgcaaaagctgtatgcccttcttgccaaaggaactcacggctcctgcggagaatagttacagaatgtgtcagccagagatgatgaatatatccctattccctagtgcataggtcaaccacctattcgccatcatggaaacaggtggtgtatgataatgctcgtatttacattcactaagaaaattgagatcatcctgactcattgttatgaaactgatgaatgacataacatgcaggtgacaacacatgagcagtataggaatatatacaatattggatatcatggatatcatgcagaaccatgttggagagtgggacatgtaagaaaaacctaacctaaaaattcatatgaacaccaaagttgcaaaaacaagattcccttatcttcctttgtcccttttgtttcaagtaatgtcgagcacaattagaaaagagctatttcatgattttcttgggaaaagagaaaatgataacccttgacccaggattacagaatatttgaaagcatatcatgccactcatttcacataaaagaatccatattcttcctttgcaaaaagtttttcggatttgttaggatgcaggcaatcaggcactattgaggacaaagcttgcaagccaggcactagaggaaatagggcagggaggggtttataaacaattgactaccttatgaatggagttggattgctaaactcccatcgcacgacgttacaccactggttacacctcaaaggtaagtcccgatgacttcttatccatttggagaagtatggatacatgacagtctcacttgtaggacggattgcgataggagcttccagatcagattttcctgatttagtgacccatgctacctgcaagatgaattacaaaagactatgttactgtatcaagttccaacaaatagcctaaaagtaaaatgtgtatgcaacagtttataacaaacaaaacagatgctattgaacaaataatagttgtcatcagcactaccacgtggcatgtccaatagatagtacctctttttacttgacattttagacatcggcacagttctaacaactatgtcaactcaattattcagtctcagtgattatgatcatactccaggaaaaagtgttgcatgaaaggcagtggcctgtgccaacaaattgcatgactagcacaaaaatagttaggtggtcatacaacaggtttacaggccatgtggttcatgtgattaagagcatcatttcatatggcttgggtgcttgaatttgaaatctatccagaactaacctttaggaactttataagagaaacagggagtttcttcaggagaaattatgggtcaaacattcaaagccctgaggtctagtttgcctcaataatcaaataagagaatgaatagtgtcatagcttcataggtcagatagttcgcatgcctatgaatttatgtgctatctcacaaattaattgagaaatattgtgggttatctcacaaacgagttgagaaatattgctcaggtcaagcaagaaaaatcttttgagtgttcagacttcgggctgaaaagggaatcgttacaaatagtttttgctagcttcatttcatgaaggtttgtcaacatgctcaaatgacagacgtacatcctaatgggtaaaatactgaatgatggagtaaatagcatgggaaaatacacacctctggtgcaaagccctcaatgtggtctttctccttctgtaggacattctcagtgacaaacaatgggaaataataaggtttcagcttcagcttttttatttctgcatcaaagaattcctgcaccaaaccgcataggacttagggaaaaagaacatgattatagtaatgccattttacttaataaactgcaaacaaagaaacaaaggcaagatccttgatgctaagaacgacacttttacacaactcaatcagaagttactgatgatataaaatagacatgttgagataaacttattagtccaaaagggcatcagaattagcatttgaaaagctgatttgttaatgtgatgtttgcagtaactgtcaatcagggaaaaggagtgcataaggttgacaagataaatacttcaggcaacactctagaccaacttgtggacagagattactttttgttatcatcactgatgcttaggttacaagagtacaacaggcaacaatgactacttacatttcattgcaaagggaaataaataaaaattagcatcttgattaattgaatttaagcaggcattgagaaaaaacttactttaagcaattcccagatctccatcgcccatggcctcaagatataacaaccggatatgtcatagtactcgatcatttcactgttaacgacaacctgaaggaacaaaaagtaaaaaaaaaaaaaaacttctataagccccctagcaagaatgagatatattttgaatttgaaaaaaaaatgtttgagcttgttgttttgttttggatggcgattaataaatggataaatcaaccaataacagtttagaaacagaatctgtgtgttccattctccagtaacagctacgaaataacttatatagttaacataacagtatcatatccttggagattactaattctctcttcagcaacagcatttgaatagagtaaattgacccagaacagtttcagaaaaccagcaatagcaatagcaactaacagaaccaccaacatttgcactgatgcagaagtaaatctctgttaataaaagttcaaacgattagctaccaacactccctgccagaacttgtcacacgcatctcgaatacatcaccacctttaaattcaattccacacatgaacacctcatcgcacccacattacattaaaattcacccaaatctaccaacaaaacctcgccaaaaactcatgaaaggaaaaggcgagaaaaaccaacctcggagtaccactccccgaagttgtcatccttcttgtacgccatcccgagcttcgtctccttcttcacctccttcttcttccctgcaactcaaccgccaccaaaccccccatcatcagttgaagaacaaaacgcaaaaacccacccaaatcttcaacccaacccaacccaacccaaccacgccgaaccttcgccttccttgccggcggctncaccttccttcccggacgacatggctccgccctgcacggacgaagagacagacaacacggaagtcaaatctcaaaccccggaaacgcacggagaaatggagaaacagcttcggtttcgtggatccgggcgctagctaagcttgcctgctgctacgacgcggcgggatcaggcaaggcgagcgagggcgtgggcgaggcgagcagctagggttttagtagtggtggcggcggcggcggaggaggaggaaggagatgaggggagtaggcggagtagggcgcaagtagccaatggggacagcgtggcgggcgcgccacgtgacgttgctgacgtggacggaggaggtcggggatgggcccggcgtgtcagtgagtctatacacggggttaacgggagtagacgtgggtgtactgctcgtacaattgtggaaaattggtggcctaacacaaaaggtgctttttttttcaaagaggtgatttaattttattaattttaaaatgggcaaaggcacctcaagttcggccgaaattttatattcgaatcctttagcaatacttaattcataaatatacccctacaaaaattaatttatgagggaatggatcacacgtttagctgctactgtgtatagtgctaatggtaaacatcacagcaacaatggtcttatttacccctgatcccgatgcctagagccgaagcagctagcaaactgatgtggttgtgtcaaggttacggatcagacatacatcctatcctatggcttatggaatatacgagtattgtataccttcacgtacacgggttgttttcgtatgcgttgtaggaatccatcatgaattatggaaaatatctctacgggtcgagtgattaatttacaaagtcatactctgtagggatagagtttctattataacatatgggatccgatgtctccaagtcttacttggagatcaagatgatccacgatataaaaaggacccctgggagggatgcaaggcattgaatctcatgccaacacacccaccatagtctacgaagccaaagcccacagagccaaatcgtcgggagatttcatcgagtctatcgactatgatctcgtcggtatcgtcggatccatctactcccattgtattctgtggcttttccatattaatcccatataaactggattatggctattacctgataaggggcctgaaccagtataattcttgtcttatgtttgcttgatgtcgtaatatgtagatcctcgttccaacgtaccccaataccctaatcatctgttctacaagtatcactcgtcgaaggttgacaataacatcaacgaacctattattgaaccattgattccaaaccctaaatcctgaagttagatatatcccagatcttcaatttggtctcaacatgtgttgtacaggggtatgagcaaaaatggagaagctaggtagctactcttctgatgagaaataagacaagggtggcaatcgatgatgttaataacgacatttttaagcctaggaggggattgaggcacaaggccattattgtaggactaattgataaggtgaatatgagaagtcgagcacctaatatctcgatgtacgccgatgacgcggtcatcttcctcaagtcgatacaaggcgaaaactgtgctgatcaaagcagcacttgacctatttaggattgctactaggctacacgccaacttgtcgagaagcgccatcacacatatccaattctcggaagaacagagaaacttgttcagaatgtgctaattacatatctgggcttgccattatgtgtacgtgaaccaacaaaacttgaattacaacccatcctagaccggttggcaaagaaagtggctgttgggaagttgaagttactcttgccagatggtggcatgtgcctgatcaagtaggtactgatggcaatccctatgcatgtattgtcaatcatgcaactaccaaagtgggctattaaggatgttgagggaatatgtagggtttttctgtgcaaggggcaagaggaagtcaatggtgggtactatctcattgcttaaagagcaatctgtatgtaaattgagaagatgtctatatataaagcatctagctctttttggaaaagctcttagcttaaagttggaagtcaaacgaactgagcagaaggggaggccgtggaggatggtaggatggaaacgaaataaggatctccaagacatatttaactcaacagtgatacatgtggtgggcaacggccaagatacaaacttctgaagagggaattggttaccaaacaggggcagcatcactggtaacatgtcgagaactggctaccgagaggtaacatcgttggtaacatgcctacgctcttcagctttgtcagtaggtcaagactgatagtgggacaaggaatagttggctacagatgggggagagatctccaaggatcgctctctaacagagccttggcagagtatttattcctttgggatgaactctagaatgttcacatccaataggggatggaggattcaataatttggaagctgacaagtaatggctagttcattgtctacgctgcttacaacctattctttatggcgacgatgaaatgtccttatggtgaactattttggaagattagagtgctagcgagggtcagattctttatgtggttggctgtaaaaggatgatgcttgatggctaacaatcttctcaagagaggatggctgttcgttgtgccaatctgagatggaagattgtgaccatatgttcatcaagtgtcgtacaccaacagagtatggacaatgctacgagattggatcaatgtggcctttgacccacctagtcagcaaggtcttctatgtggcataatggtgacagcaaacgcaatcttgttttcgagcgagctacatgaacatgctcgatatgcttttcatgatggtgtgctggctcatttggaaggaacgcaacgggatagttttcgagcagaggttaaaacaattgcagagaagctctggagatattaaagaggaaatagccatttggagaactgctggcatatttcaatattgttatgaatagtccgttttagctaatgtcatgatcaatcgctataacatataacacccccttacaatctcaatgaaatttgattggccaatctttcagccgacccgcgaaaaaaaactccaaatacagctacatcaacagtatcatgtatggtgaataagatccatatcagggagtaccctggatacaatatcgaggcataccacaccgtgaccaaatggtacctacaaatttatctgagttaacctaagtactggtgaatgtgatacgcaactggtaaaagaaacgttgtgtgaaggtgatgcggcaagagatgaaatgtaggatataatagcctcgcactttgacccaaccccaagggcattatttcagttaaatctgagtatggaaactgtgaattctaatggccaaagttcaatactaaagaccatgtcaaaaactaatcacttggtattttccaacggagggagtaaccgctttgactttggcaaaattagcatagggcagtttcatcgaatctgtgacagaattaaacaaaccacaagaaagcaaaaaaaaaaaacataacatcataattaggaatttaggatatgcattatgcattcagcaccatagtaacaaaatagctgaatgcatacagataaacaccgctttactgaacattggtagcttgctttgcaaagaatgaaaattcctgcgactcctcgaagtagcttcttttgaagcaccacaagaccaactcatacagcatcaccaactgccagcatacttgacattgagcaaaaataacacgcatccaaaccatcagatttgcagcgcctttggaagtctttcagctgagagacaaggaacacctgcatcagtgatcacaagtagtctgaaggtatatggctgcacaaggtatgcttcattgtcctctgtcgactctcgcaagcatatgtttcgcatgctttgcatgggaaagcatactagcgccttcaaggctgcaagtagagcatcatgaatttaagaggcttgacttgcacaatcccaattcatgtgttaaatccacccaaaagtttacatgaaaccaaatatacagaagaaacattttgcatttcgattggtgatggtaggatgcaacatactactacattaaaagaaaattccaagatatttactcaatgaaacgaaaagacagaacaaaatgttctacggtgcatcaaggttgccagctaagaatcagaagtgggaaaaacaaaaggagtgattgatacttagacagtccactgcaatgagtaattgatctaacgaagcagcaacccattagtaaagcagaaacagactaatgattaagaatgtgtagttttgctttggagtacagaagctccccaacttatctttattggaatattaaatattactaccagcaacaaatcgccaatcactattaaggacctatgttttctcacatttttcttggttctcatacacaatatgataacaagggcacgtgcaagtattagtgaaggtccaatatactgagtaaaagcatcaaactacttatcttttggcatgactattcaggttttacttactttcaacatctccctgcaaattaatttgctaagctcccaaattgcctgttccattcttcataagttcccagttcacttgaggaaacagaaggtctaacctcctgcaaagcagtctcaaaatcctacagatccaaaattcaaaataagcttttaaaatcggaatgctacattttgggaatgattcatcgcaacaaaggacacacttatttgacaatgcaatagacaatgcaatcattgtttatccttttagtgatcataagtgcctagctatctagattccagcacttatttgactagaatagtagtaccttgagcatcaccggccgcatgtcctccttgtttagctttgttatgccaacaccctgttgaagagcttcccttagtggtcccattgaggcatctttcacaagatttttcatgtcagatcctgagtaacctgcagataaccaatgatgcagaaatatccagaaagatggcatgatacctcagaattagcagcaacaagaagaaacctggatgattatgagtaccttctgttaacttgcaaacaatatttgtttcttcctctgtgagcttgaaaaggccatccttctccaatagattgcgaattatccaggcccgtgcctctttaaaataaaccatggaacaatgagattcctgaagttatccccataagaacagaaatagaacattacctgatgaaggaaggggaatatatagacgttttgtaagtcgcctccgtgctgcttcatccagttcttgaggtctgtttgttgctcctgccatcattttttctccatgacatcagcccaatctaagttccaccattggttatgaccccacatttaacatccacctcatagactatgcaacacaacttcaaagcataggcctttaggcaaagatggatatgcaataatgcatttcacaaggacaatagaaaagcacatactatgttgatgctcaaacctcatacatataaatatcctgtaattcctaccatgacatacattaatgcatatcacacttgatattttcatctttttaacgcatgaggtacctataagtaaaatttgatcatttccactgtcaaaaccttccatctcgattagaaactgtgttttcaacctcctacttgactcatgttcaccatctgatttgcgctgaaatcatgtgtaagggtgttaggtgtcaactgatgcaacatgtatgtgcataacaaaaacaattcactaagaaaaacctgtgatagtagtgaatcaatctcatccacaaatatgacagctggctgacgacaacaggccaccccaaatagtgctcgaactagcttttcaccctcgccaatctgcacagcaggagaattaacaatcattatcaatctaaaggtatgccttcacattctatgtcataatgtatttttttttgaaaaaaaaagattgcataattactgtgcacaaaatgggcaaacatagtttgacagagattaggatttctactttctgaggagagggcatataaaggctgggatgagagaattagcaagtgagagagatcacaaacaattgtagggagtacaagcatgttccacgcttgtactaaatcttggttctaatccatatagactataattctttgaaaacattaataagatggatttattagcatataaacaaatgaatttgttttccgtagcacctttatgattgattaaagatatgcagaccagaaagatgtaactagccttgactttataggatacaaatggaactatgttgaaaattaaaacaagcagcagacagacccatttgcttgtcagtgaacttgcagaaatgtagaaaaatgttgccttggcttcaccagctattgcttttccaatcatggttttgcctgttccctgtggaaattaatgcacttatctttaaattgaataaaatgggggaagagcaacataacgggatcagataaattcgacctgcaggcatgcaagcttatagaagacctcttccaggagaccgacaaccgtgaaagatgtctggacgtagcagtggccatatcaccatttccgtcacgcacttctttgcatgttccaaaccagctattgcaggttggcatgaattagctacaagacacaagttctgaaagtactagaatgcaattatgtacctatgtcatcccagcggacattaggatctttatccattatttcattactgacatgctcaattaggcgaggttccagatttctcagcttatcaggaagctcaccatcaggtccacannnnnnnnnnnnnnnnnnnnnnnnnnnnnnnnnnnnnnnnnnnnnnnnnnnnnnnnnnnnnnnnnnnnnnnn

SEQ ID NO: 34178 - DNA, 3789 bp, Oryza sativa
gacttaagttgtatgaagatctcacttttgccacttattgtgctagccccagtggcaaaaacaaaatgcacagggcaaaagtgagatacgatctttccttagtggcaaaaaaacaaccctggtttccatgcagatcttaagcttacgattactgatttaaaatgcaaattgaaatcaatgcaacaaatcaatcatatgaaaaccaaaaatatgtttaaagcgctacacatcatactatacagtggctgcagcagattgtagcaagaaatagaaggcctcagtggacccggaactgtacatagagccacagacaactgttgtgcagacacaactacccccggatcatgaccgttatatcagggctacacagagttatttaaaataatggcctaatgggtactccatatgcttgtctcacattgggagttcaagattagcttgcactagtggtcaaggaatttcaaacacactgtattaatagaaactagtagtagtttttaattttttttttcacatttagcaaatatctattatcatactaatgctgctatatccacttgatcaattcatactcttgttctgaaattgttaagtgacaggtaatattgccatccagaaatttacctagttctttaacacactacattgactttaaagcaacgtctacaacaaggatacccagcaaaaaatgcaaaccagtgtccaaatcaccaaacagatgtaagaaaggcaatcatactgaatatgatagtgataatcttagtcatctcaattgcaaaacaaaaaacacattatggcaatgaagtcaaagaaatgtatctcatgtactttgcttctagtaccaataaatctgagtcttagaaaaaaaaggaaaagatgtagtcatgctaaacataagaaaagcaacgagataaatagctatgtaaatgtcatgtaaattgttacaataacatgaagataaaagtaaattcaaatggtatcatatgatcaagatggaaatacagaccattttcttgttgaatctcccattgaatcatcattttttccaatgacccgtgaggtcatattggaagtggatcctccattatttctgataggaggaacaaaattaccacgtaatccacgacgagaattccaggttggccttacaccataattccggttatttgggttgttatcacattgtggggatacagaagcaccttgagtaccattatgcccatacttttgcacagaatccatctcctagaaaacagaagcatcagctagtgaaggttacattgacaaaatattcaacataaaccagaatggccatactaagctctcctaataacgataccacagcaaggcagatgccacatagtgcacaaaaatggtttcacccaaatgcaaactttgtgtgtttagcaccaaaaaataaattataattctcttgctaaaagagttttcttgaaaattttatgatttcagaagaaacaccataaggatctggaaaattgtcgtttttacaaataaaatattcgcacagaatatgctgcaatacatatcatggtttcaagctatgccataagtagaactttatttctaactttagctaactgttacctaatgatgctttcttaggtaacgtgtagaatgctcaggactgcagtgcatgcagcagacagagaaaagtaaaaaaaaaaaaagaacagttaaatgatatggatttgccatcaaccaatggtcattaagaaatgcacaggatttggcacagtggcaaaccagcaagcataaacgagcataacaaagaagctacccattttcaaaactatgcgatgctaaaataatagaaagagtcttggcacgaatagtaaatgcagaagttaaatacacctactatcatatgccactagtgcttacgatgtctttttgttggaggatcatagaataatagaggcactctaaatatttaccaaaattgtacaatatagaataaaagcactgagcgtaccaactttgtcctggcagtcacaaactcattggcaggggcatcggcttcatcattacttaatggagaatttgcatgttcgcagattgggcttctgaatcctgcatgctttcgctttgcattctgcaacagtccacggggtctgtcatcatcttcaagatccatataagcagtatacttgttatcagtatgatttgttctgactccattttcgacagcaacactctcattagatatgttactcactgatttgaacatattcccatcttgtacaacatttgccttcaggggcttatggctacgcagtgatgttagttttctttgcattactaattttgaagccctgatgctaagcttctcattttccatatcagttgagttttcctctacatgcggaccttcttcaatggtggactcttggcaatcagtggtcttctgtatttcagttcatgtcacaaaaagagaaaatgatgataaaatcagccagcaaacaatgacaatttgcaaacaattaacattggaagttgaaagctatgtgtttcttcatatggtgcttcaacaaaaaaaacattaaaaagagttaaatcacctttcagaaatgatgttgtaaataaagaattaagaaaaatggggcaatggttagatgtccctcaagaaggaagaaaattaagaatgagaagtacgaacaataaggtcttttgagcacgtaaagcctaacaacataaattgaattgtaccatttgttcagcagcatgtcctttggatttctgaagaagtgcttgaaaatactttgaacacttgatcttttcaatattaacttctcctgtctttgcaaaaacacaaccaacatccttttctgcaagcttaaacacagcactgaaatcgaaaacatctaaagtgaggactgacaccaagtatcacgatagtatgcatcagagcatcacaaataaacttgaacagtgcagaacaaagctaaagtaatttggtttaacagacaattatttgttctagcggttacattgctcaagtagcacctctacgtcctgggttcaactccccaagggagcgaatttcagacttaaataaagaaaaatataccgtgggggcctccctcactgtttccggtcaaaaatgaaatagacaactatttgttcaagattaaacccaagaagccactcagtttccatcagtgatggcaacttaatgctccaatgcatatggtatccgtaccaccaccaaaaagaaatcacatttccaaaaatttactagtccagtagtcctgaccctgataatatctgctactgctaccatctctactataaaattattttgactacaaatatcagaagttggattcatccttgcagaacttggttcgatgttgcggaattttcacaaatgacactccttaactttcatgcttacttgcttagccctgacagtgatttctgcaacgccacaatcgttatttaccagatcgcagcacattaataatgaagacatgtgtatgtcctgcaacacttatatctgaatctaacttgtagtggtatatgaatatgttagtcaattcaaacatgcttagcacatacatggaatgatctgaggaccttaaaattgaaccaaaacacaggctgatgtcaaccattgccgcagtggtaacctggtgatttcttcctcacttaaacaatgagcacaaacaaaaaggcaaaaatatttcagtacgcaatgtgcaacataagaagaaaaaatgttcttggccctatttatttagacaacaatttctaaacttgagtcaaggt

SEQ ID NO: 34179 - DNA, 4902 bp, Oryza sativa
cgatagtatgcatcagagcatcacaaataaacttgaacagtgcagaacaaagctaaagtaatttggtttaacagacaattatttgttctagcggttacattgctcaagtagcacctctacgtcctgggttcaactccccaagggagcgaatttcagacttaaataaagaaaaatataccgtgggggcctccctcactgtttccggtcaaaaatgaaatagacaactatttgttcaagattaaacccaagaagccactcagtttccatcagtgatggcaacttaatgctccaatgcatatggtatccgtaccaccaccaaaaagaaatcacatttccaaaaatttactagtccagtagtcctgaccctgataatatctgctactgctaccatctctactataaaattattttgactacaaatatcagaagttggattcatccttgcagaacttggttcgatgttgcggaattttcacaaatgacactccttaactttcatgcttacttgcttagccctgacagtgatttctgcaacgccacaatcgttatttaccagatcgcagcacattaataatgaagacatgtgtatgtcctgcaacacttatatctgaatctaacttgtagtggtatatgaatatgttagtcaattcaaacatgcttagcacatacatggaatgatctgaggaccttaaaattgaaccaaaacacaggctgatgtcaaccattgccgcagtggtaacctggtgatttcttcctcacttaaacaatgagcacaaacaaaaaggcaaaaatatttcagtacgcaatgtgcaacataagaagaaaaaatgttcttggccctatttatttagacaacaatttctaaacttgagtcaaggtctagtgggttgaatcctactatagggagcaacgaatcctaaacaggatatgcaatttgaattatgtgatccacatgtattcaacatatacataccactaatcatggtggaagatagaccatcacctttgagtaccctttgctttgaaaaattactttcccacaattacacatgactttcggcaccattatgcctgctctggtcaatattgttttgcttcatagagcatgcataaaaaagacactatatgctaagaggaagagcagcgtgtattattttatttccattccagcaaaatataatgtatatagcatactaatattacattagatggcttaatgtatttggaaacaaataaaagcaagctcccgagaaccacccaacacaaacagtggaggcactagtacttagcttgcttgtttgtgcacacggtaccagttcatcttagtcacggcaattctccaaaatccacagatttctagagctatataaataccacattaagtgaatactacagtatcagctaatggctctatatatttgcacaatctgaataatagcgaaagcaaatccatccaaatcgctcccactcttcgcccgaatcgaatcgaggagaccctcgtaaacacggcgagccgtctcaacgcatgatttgggcgaaaatgcgggagagcgcgcggggtggcgtggctgtgtttggggggggggggggggggtagggttttgtacctgtctgacctcccggcgcgggcgcggatggcggcggcgacgctggatgacgccgcggcgcggatgggcgcgacgaagctggcctcgtggcccgccgcgccgccgtcgccggggagggcctgcgagtcgaggaagccgaggaggcggagcgcgagcacctgcgcccccgcggggtccttgcccttcagcgcgacgtccgcgccgaactggagggagtggagccgccgcagcctatcgtccgcctccttcctccagttcgtcggctccccggagcccgcgccgccgccgccgccgtcgccggcgtgagactgctccgccatttcgcgtgtttttcttttttgttttctttttttttcctttcgccgcgcgtctctgctggtttccttcccgctcgtctgaggaaggaagggggttttagagctgggctttctaagtggtagtcatgggttattgggctttctatatgggccggcccattacaaatttacagttatacttatatccaacaaaagaacacttattttacaatttacaaatactcaatagaactttcaaaaggaaaaaaatacttttttttaaaaaaaataacgatacctttgatcttactgtaagtggtagttttgttggttttgggaccaatatatgcattcctaattctgtgcacttttaaatacttattaatatattaaaatttgcaaggtaacggaaagtgttgttttgcccgaaaaataaatctcattcatccatttcatattacaagatgtatttttttaaatcaaaatttttaaagtttgatcatgtttatataaaaatatagcaacatctccaacaccaattaagcccggttcttttcttcaataaaaattggataaacttttagatactcgtagcacgcttttcaagctgctaaacggtgcgtttcgtgcgaaagctttctatatgaaagttgttctaatatatcagattaattcatttttaagtttgtaataattaaaactcaattaatcacacgttattaccatctcgttttacgtgaaacacttaatctttatctttatctttatgttcaggagattcaaacaccaccttagtttcattaaacgtaaagttgaatatattttatactatattatttttgtgaataaattgcattcacgatgcatcaacttggtaacgagggtgcaatttggtgcaaaaatttgagaaatgagtatccttatgcaataacttagtatatgggtgtaattagtgtaagaactttataagtgagcgataagttgtaaagttggtgcaattttggtgatgcgataacttaattattatgagtattttttatacaaattcaattttaagtacttatttaaactttactatatagaaaatattataatccgatttagatttgagaaggtgaaaaaaaaaatccaaaccagtggtgcaaaatggatttgcaatgtaattctaatatccgtaagattgctatgtaatgccatattgacatttgagaaaactcacctagcactcgttaagcaaaacatcacatacttagctaagttgctgtaccaaaaatactacattatcaagttcttactagaatgtactcacttaccaagttgttccactcagacgtaattctcaaattaaattatatcataccccaccaagcaagttgttaaaccgtggttgcaatctactcgttatttttcattgttgctatatatacaacatggactttacggtgtttaagaagatacgtacaggctagttccacttctttttatggcaaaatctgttactcccttcgttttaaaatgtttgacaccattgatttttttagtacgtgtttgaccattcgtcttattcttatttattcttttcatatcatttgattcattgttaaatatactttcatgtacacatatagttttacatattttacaaatttttttaataagacgaacggtcaaacatgtgctaaaaagtcaacggtgtcaaacattttgaaacgggggagtatatttcagcacatcgggtcttgagatcaaattttacactatttttgtaccctctcgatacctaccatagaatgcctgcatatatacaataatatttaagtcacgttcgtttcaggaaaaaaaaaaggtcaccaataaacaccatgcactacatgatccctactctctagttttccaacacgacacgtatgtctcatggaaatggatcactcaggctataggcttgcatatgacatactcccccgtcccataaaaacccaacttattaccgaatgtgtaatattacgaatttgaacatatatatatatatatgtccaaatttattatactagaatgtgtcacatgtggtcctagattcgtttttttataagatggagggagtatgaaatgcctgagacggagggagtatgaaatgcctgtatagctttggtcggcgtcctggtgtgtgttcgtgaaatagtatcctgacctgaccgacgctctggccatttgatcgattaattggccttggctcacaggctcagggctaaaaaattccaacggcaggcaacggtgagtgagaagacagtagagtgagtgctttgccaatgaaaatgaggatcagtcgaattcagatgccggcccgtttcatttaatttttgttggagaaagttaaaagttgacacttgtaatgtacaataatgtactagccaaggtttgtttattgatggctggccacgtggcaccgtgctggaggcctggacctggagctacaactacccgcgggcgtcctcggcgtcgcgacggcgtcagggtgcgggcggtggcggaaacaacaacctactggtggtgccgccgcctgcggccaagcagagggcgctgtcgctgatgaggaccccgggcctcggcggggagagcgcgagccgcgaggggagagatcgagcagaagcaagctgtagcttttattgctactcacaaaattaaacgaagtttaatgaatcaatgaggaagaatagctactttagttagtctctaaccttttaaatgttttaaagaaatccttaacctttgtcataaaacctaaaatagtcctttgggtccaccaaaatcatcatatagatatgccatatcatcattcatgtaaaatctatgatgaattgttcaatttacccttacgtatatcatagaaaagtaaatataggggtgaattagatataaccataggaaaaaaaatacttcttttttcacccttttgatgtatatttttgctcttacatatatcatatatatatatttttaac

SEQ ID NO: 34180 - DNA, 685 bp, Oryza sativa
gaagagattagagatatcccttgctctggttcgcaaggcagctttctttttatccccctttatctccttgtatcactggcccttttttggtgtgtgctatcagggaatgatccactttagcagcgatgggttcaagcaacattcccgatgacttttggcaacctattggtaaactatttaaacgagaacgcaccatagtttaagcttgatcaacacgttctgacgtccactgtctcaatttcctggatctctaccgtgtgctatcgttttttaatagattaaaagtttacttcagccgacgcgaccttccgtagtttcctctagaaatatccgaatgatcattatgcacaatgtggagtaacaaaaattatatgatacttcctctgataatccgacaagatccgtttccgtttcactggattcctagacctccaccgcccctagggccgccgcctctgctggagtcctctaccatcgctgacggtatctgcctcccccctcaccgagaaccttgcaccagcgctcaagccaccgccgatcctagggccacagtccccgccgccgaggaagtcttctccccgaactaccaggctaccgccgccagtggccgctgcgtacgggacccacctccgtcggatctgccatctcgtagctgaggattggttgttgacgctaggctgtcgtt

SEQ ID NO: 34181 - DNA, 554 bp, Oryza sativa
ccatctcttttacctcaatctcgcatataccctgctaccaacaatccccatactatgcaaaataccgtagtcgtcatatgaaacgtcgacagtggcgcgccaggtagggggattttggtgcttaaaggtttcgacgagatgggtataagagatggattctccaacaacaagctactcgacgacttcggctgtgggtagatccaacccgaccggagtatgtcttttgacgagatcggaaccatcgtcatcaacaatttgatctatcgagatcgtccaagcctctacaaaggtacgcaatgatgtcaaactagtacgcaacaagataattggtagattggttttgaaattaatctactaatttcatagatacatccggcatgtatctacaaaggtacgcaatattctatatgtgatttatcatagctattcttcagatcaatacaatattgtcagatcaataatttattatgtctacctagagcatattttttatacaacatctattgcacgagtgtttccgatgttaggccaactacggtttaatgctgggggct

SEQ ID NO: 34182 - DNA, 7999 bp, Oryza sativa
gatctatcccctgaatcgggatgattgcgccggtctgaccagtccagggctcggtctgaccgacatccagaggcgcggtcagaccggcttgagtcccggtctaaccgccggggtaatacccggtctgaccggccatttggccggtcggaccgatggcgaagtcgcggtctgaccggccatcaggcccggtcggacaggccatctgcgccgctccatcagttctactacttgtttgatctgtaggagcttggctagcactagtagaggctttatcttttaacataaaatcggccatgagagggccgaatttagttcttaaaaactcatcaaatcgaccttcaatagttgcgtctaacttatttttaaaaataaccatggatgaatctattgcagatgcatcttgttgttggatagattgtgttacctcttcattgcttaccaaatcaggagtgagcttaggacgtggcccaggcttgatgatcacgccttgacgagtcctagtgcacgcccttatcaacgcctcatgtgtgatctccttaatgtactcctccatggacttgcgatcttccccttcgaagtcatccaatgtgattggtatcacattggtcggctccacctccgccttggatgacgactgcttcgtcatggcaaagtcgaagttgagttgacattgaacggatctccccagtggagtcgccaaaaatcgtgttggcaacttttttgtgacaagttgacaagcacgatcgtagcaccttatgccttgcggtgatcctagagtcgccaaccaccttgatatagcaaagagctaaacctagatgggtttttacaaataaactggctagcggagccgattttagataactacccgtctcgtgggcaaaacggaaggttttcaggacaaacctacaaagagatgtcgcactctcgcagtggtggcgaacggtttacgacgcaaaccgacaaagatggacaaacctacaaagagatgtcgcactctcacagcggtggcggacggtttacggcgcaaaccgacaaagatggacaaactaagagaaaactaaaagcaatatgaaaaacgattcgattgattgattgtagattggttgttacaatagaaccggccatgtcccttatataggggttggtcttaccctttacaggccctcctccacatccaactcggggtagaaaccaaaggaaacctaaagcatgccttcccgagcaaggaaacctcgagacccgaggaaacacagtccgactcggacctgccggtcagaccggccacacactgccggtttgaccggccctcaaccggtggtcagaccggcccactcggaggaaaccggtagacttccaaatcttggcaatctttcctatattaatcctaggtgccaaatttgggtgtaaacgttatgtattgtgtcttacactttttttttgttatcgattgcaaatggacagaagttggatgtactatattcaccgttcgacactagagtatggggaagaggtcactgcattcctaaattttcctaaattttgcacataatgacaggaaaaataggttgagcaaatatatgttgtgtccatgtggactgtaagactaataaaatgttcgagaatagttcataggtgcattctcatttgatccttagaggattcatggagcactacagatgttggatgtcacatgctgatacatccatctcaaactaaaaacggaaaagtccattttacgccctcgaactcttatgcttgtccaaaatacaccctcgaactacaaaatcgaatataatacacccttgaactgttaatactgacacttaacccccctcccccgcccaagcctgtttttaccgtggtttatgacacgtcggctgctacgtcaaccctcgccacgtcggtgtggagatgcgagggcgacggtggtcggcaggtgctgcgagggcggcagttctaaggtcacgcctcgcctgattccgtacccatccattgtccgccggcctaaggttagagaaaacggggttgctcgcccatttggatgagctcgacacagagctcgtccccatgcccaaggtcgaagaaggttgccgtagcgacgatgcagcgcagaggcgatggcgaaggcagacgaggtgggcggggctaaggtcgcggagggtggagctcgctgccacctgcgtttcctatccacctcaagctcatcggcatccgggccatctccaaccaccaagaccgcccaactacctatgccagggttatggatactacatacccaatactaatcgactaagcttggcagggcccaccacataccatgtcttatacgcaaataaacctagtatatagaaggagttttggataaggaaggaaaaatagagttctacatggaaacgacaaggactactcggattgtatccatattggtctccctagttttacttggacaagggggcatctatgggtataaatacaagccccctaggaggagagaggactagccacaagacatataaatcaacatagatcaatacaagccaacacatgccaagataagccgcaggatatcgatattagagataagtctagacaaaccaaatatggtgtctgcggaggccaacaagagggatctagcgctatctctgatttcgctgagtgcggattcgaggaggaagactaccctgtcgtccactttaagttggatatccataccgccaagttgacgatagctagataagttatcccaattattgtattggtgcgattgtgatgaataagagcaacaccggcttcagccaacaggaatagggctattacctgtcagataagaggcccgaacctgtataaaaatccttttctccatctcttttacctcaatctcgcatataccctgctaccaacaatccccatactatgcaaaataccgtagtcgtcatatgaaacgtcgacagtggcgcgccaggtagggggattttggtgcttaaaggtttcgacgagatgggtataagagatggattctccaacaacaagctactcgacgacttcggctgtgggtagatccaacccgaccggagtatgtcttttgacgagatcggaaccatcgtcatcaacaatttgatctatcgagatcgtccaagcctctacaaaggtacgcaatgatgtcaaactagtacgcaacaagataattggtagattggttttgaaattaatctactaatttcatagatacatccggcatgtatctacaaaggtacgcaatattctatatgtgatttatcatagctattcttcagatcaatacaatattgtcagatcaataatttattatgtctacctagagcatattttttatacaacatctattgcacgagtgtttccgatgttaggccaactacggtttaatgctgggggctcactctattttcttatgtctaaatcatgcttgtttacggtttacataatgtctgatatgtaatctactcattatatcctaataatactagaagatttatgcaattttttcagtacatagtcgatattctctgctatatatcttgtcttcttgacaatatttttcaggaacaattgaacacttgagtaggatatggtcgagtacaccatattatcgagaacgttctcaaaaaatgctgagttgtcgcacccaaccttccaacgtagaccgacgacttatctcatgtatagcaccggctccggctggactatttgagaaaaggttgttaacagataattcctcgcgaacgttgtcggcttgatcacccaacatgattgcgaacagagatcgggatatgctataagttgggtatgtgagtcatgttggccacataagatgcacatgtaataaccaactctagcacccctataggtgattaagagatgcctattcctagttatcaactagactgttgtagcgacatttcgccttctatcaatttaaatttacttgtggaccattgaactccatatattgttgtcaaagactctacgtctctatggtcttacaccgggatcgaccaagtgagtacagcaaatattgataaggggagtcgtggataacataagatgctttcgtgaatactgtttgtttccgtatgcctatctgcctataggtgatcgagatacgcctacacctggttctagaccagtagatcgtagtgatctctcatcatctaaaaattcatcttcaggtgatcgagatacgcctacacctggtcctcgaccagtagatcgtagcgatctctcaccacctaaaaattcatcttcaggtgatcgagatagacctacacctggtcctcgaccagtagatagtagcaatctctcaccacctaaaaattcatcttcaggtgatcgagatacgcctactccctgtccttgaccagtcggttacaggaatctctcgacatctaatgcgacaatcaacatcatcgtaatagcaacaatcaagaccgactggatcgtcgttttcactaggacgacattgtctaggactaatgacataaggacgacaacggacaaggttaacgacatcacgacatcacatgacgacgaagaaactcgagatccccagacttctagagggcccgaagacaaggtagtaggtccaggagtcgaacctctgactacgataattcctaattgtcttcattgtcatcaggaggcagttctcgcaggtcacgagaatgtcgtccatctattacgctggattcccttcaaatggtcgagatatgactacgactggtcttcgactagcaatgtagcaatcatcgaggatcatcgcaccacgacttctaatggtcaagatatgactacaattggtcttcaaccagcaacgtagcaatcctctgtcgcgcccggaaaaattccttttccagaacgctagtgtattaatccccgtcctaggaaaagccgaggtacaccaaacaaacatgatacaaaaggcacatctttattatatcaataatatttacattattacaaaggcacttcaggcctgacaaacaaaaataaacaacagcggactagcgggcctacggctccatcttcacaggcgctcaacaggggtataagccaggactccacctaggacttcttcttcaaagcttctcttactgaaggggggagagatagagcaagaatgagtataaccacagtactcagcaagtcacactgggagatgcatgaataatgcaagggggtacaaggggtaataatatagggttaggttttgcagtaaacagcatttaaaagtcacttagttgcccaaagctattttataaacacgatcctatagctacacaatattattaatcaaggccgtgaaccctggcaacccgaactgggtcccagctcatcccaagccaacctaggccaactattacacattttagttgttaagtaagttttaagaattaaaccactaacttgggtacattgctaggcttgcccataaccgagggcgtggctattcgaatagatttactctgatcagaggtgtacatctttacccacaagacacatctttactccgcattctatggccttggaacccgtcataaacatgtgacataacccttcacccatccgagctgtgaacaaaagtaccgacctatcccagcctacggccggtattctggacaggcaggccaggattgagcccctagcaataggatcaagaccgggtgcgccacacacataggggtgagaccacccgcgtactagtccagtgccatggcatctcgactaacgggcaccgtcccgtgtagccttcatttgcctagacatctcgattaccgagccacagctcatgtagccttcatttgcctcagagatatccaccgtcgcaacgatttcatccacctctatccgtgtccttttgttcaggactagactgagcaccgagttaagccttacccattagacatgtggttagtacggtagtgctttgcaatagaggcccgaagactggtccttatagtggccgagatgctactagcaaaaccatgcacctcgagcccagcctaaaaccattttgggagttttgaatagaggggggaggtgtatgttcaattccatcacaagccaatgtcgacccccgatattgtaaatcggaaatcttctgtgtttatcagtaccaatccctggatcagtagttggtacacacatacatagccgaatcacaacatatcacaaatgaattcaggctaagagagttaaatgcttacattagggccaggcaggccgacaactatcagagaacaacagcggaagacaaaataatacaagggcccggttgatgtcgcgaccgagaaaattgccttttcccgaacgctagtgtattaatccccgtcccaggaaaagccggggtacaccacacaaacatgatataaaaggcacatctttattatatcgataatatttacattattacaaaggcacttaatgcctggcaataaaaaataaacagcagcggactagcgggcctacggctccatcttcacaggcgctcaactggggtataagccaggactccacctaagacatcttctccaaagcttctcttactgaagaggggaaagattgagcaagaatgagtacaaccacagtactcagcaagccacaccggagatgcataattaatgcaagagagtacaaggggataataatataggggttaagttttgcagaaaacagcatttaaaagtcacttagttgcccaaagccattttataaagacgatcctagagctacacagcattattaatcaaggtcgtgaacccacacgagcctgccttagcccaaggcctacgatgattcagaccgaactagcaacccgaccctgggtcccagctcgtcccaagccaacccaggccaaccattccacattttagttgttaagcaaattttaagaattaaaacactgacttgggtacattgctcggcttgcccataaccgagggcgcggctattcgaatagattatactctgatcagaggtgtacatctttacccacaagacacatcttcctcacgtgtaaacacgtgccacataccaccacggtatacggacggaagacgtgacatagttcccaacccatcctagccataaacaagattaccgacccaaccccacctacggccggaacccccgagacaggtaggcaggactgagcccccagcagtaggacaccggccctgtgccatgacatctcgactaccgggccgcagttcgtgtagccttcatttgtcctaaagatgtccatcgatccccgacttcgtccatctccatccgtgtacttttgtttataaccagactgagccacaaactaagccttacccactagacatgtggaagtacggtagtgctttgcaacagaggcccgagcttagtccttatagtggccggggtgctacttcccacaactggcatgcacccaaacccaaccgaaaaacaggttttaggggctttgaaagaggaagataggggtatgtccaattccaccataagccaaccattccatagtatccaagagatatgaatattcccaaagtctaaagttataaaaaccacctaatgttgtccttttaaccagcgaagcatctacctaaagtcatactagtggtaccatgagtagagtgtccactagttggggttttgtttaatctagggtgaacaaggtaataataacaataacaataataataaggtcataacaaaggtaaataggcatggctagataaaacagtgataacgcgggaatttaaataaagcgataatgcaataatttaaagcaacataattttataagctgggattcaatatgttcaaggatgatgtgacttgccttgctcgcttttccaaacgtcggcttcaacttccacgaagagcggatcttccgaagctgcagcgtctacacaaccaacggaaaagaaaaggcttttactctaaataacttcatttaacaagcaggaccaaagcacaaaaa

SEQ ID NO: 34183 - DNA, 14048 bp, Oryza sativa
ataaatacatttgatctcagatctattagaaaatactttaggtattgtatttttaattaaactacttaaattgttctaatttaagtgtatattattaatcagaaggtttaaaaatctatatgatttttttcttaaaaatgtatggattggatcagtgaacaatagctagtccatagattatatatgacccaaagtaatgattatttagattttactaaataatctaatggtgtgcaccaataaaaagtttgctatatgatttagataatataattgtttaaaatttatcataaaatattttttccatctaactaaatgaggaaaataggagataaaggatataggtggggaggtacatacgcacaaccagatgttttgattattctcataatttttattatttttctaatttaacaaaatgtcacgtggcagcgtagaagtgtttgtagaagtactacatggcggcttgagagcgtttacataatgtttaatgggcaaatagctaaatttgcttccatgtgataattttcaaatgaaaatatagttaatatcaaatatagtcgtagtattttccctatatacatctaattctgataagtttattagggtcgggtggatgtttcttgtatgtataaaaattcgaggagggaagaattgtccgtagtatgtacatacccaggagattttatttttctcagtcgtggatagtagcacgtattatacatgtgagaattttttcattttttttgctgagcattacgtatgcacggttctctcgttgcaattaggtgggaccgtggcatggccaatccttcttcttttttttcaatcataattatgtattttgttcctttttttggtgagtagcaaaatacggaagtacatatatgtacgtatatgtcacgccccgatttttgtttgggattaaaaatcattaaataatgcatttctagaaatttatattaaaatttaaatcaatttaatcaagtaaattattgagggtatttaaaatttgctttaaaaatcatggccaggaatattttataatattctatgtgccctaatatattctctggaatttcctgcgaatttttggagctcgagaagtaatttcaacaatataaagttcatttaaccaattaaataaaaagaaaaactaataaaaaatctcctctctccctttgggcctcttccggcccaaggtcccttgttcctccctcgcagcccgctcggcctccctcttccctccttacagtcgggccggcctctccccctcggcccgaccctttgccaagtctatttcgcctcctcccatcacctctgttcctccctcgccgacaggtggacccatgggccctacctgtaagttcttattcccaccccaagcccgtctccaaccgctagcatgccgccattgccgcccccacgtcgccgcctctcccgctcggttccgcctcccgcgctcgcaaccgacggcgtggaccggcttccctccacctccttgaccaaactcccccgctcgtcccacaaaaaaggaggcggccgagccgctaccaccccacgtttgcgccccacttcgctgatcgttgccgccacgcccggccatggttttccctccctgagcctataaaacccttccccggtgtctcctttctcgtttcccctaactcccgagtttccccacgctaaaaattgcgcccacatcgccgagcctatgcgccactgcagcgtcgtgaaaccaccaccaccggcttcgccgctccacgctacatgccggccgctgcaccacctcgtcaaaatagcgccggagctctgtttccacctccaacccgagccaccattgccattcgcagactccgatctccgattgtcgccgttaccgaccacctcgcgccgccatcatcggtggccgtccgggcaggccgttgccgccgctcctgccgcgcgcctctcccgcgccgtcgccgactatgctgggtcgccggctggccgcctccccttggtcccagccgcagccgatctgggccatcggatcagcctcggtctccatccgggccgtccgcgtggcatcccctctcagcccagcgtcggtgcctacgtggcgccacgtgggcgccaccttctccatgctaggctgccgtggccgccacgtggctgccacatgctgctcccgcgcctagtgcgcgcgtggaccgggtccaccgtgcgcccacctcccttgagccactgatagatggggcccggttgtcggcgccacctatcccctcggtgacatcataaatgatttaaattgcactataaatcattattaattctagaaaatcatttaagtagctcaaaacttctattaattcatatctaattcatacgaactccaaattgagccgttcaactggcaaaatgcatctaaaattgagttctacatgttcgtttacttttcatgcactatttgcttttttttattagtgtttttccttatattgcgtgccagtgtgtagtttctgccattttggaagatcgtggtcgcgaggaaaagatataaggttgttttgaagaagcaaggcaagtcacacattccccttgagcattttgatcctagtttacaaatgttttatcgttatcaaataaatatgcatgttttgccaattacatgagaatagggtttacctatctgctcgcttgtgccatgtttacttgttacccgtccttgtcaaccttgggtgataatttatctagctcgtgatactcatgttgacctagttagaactatatgcttagcaatgcttaattaccactagctcacttgatgggataattgcagtattagtccttttagtatcatggcgagctgcgtgctcgagacatccggccatgtttcattggtcgtagttatccaactaaaatgcgactgaatggtgagctgtgggtgcatggttttctagtctgtcacgaccggaaataacccaacaggcgttccttacgtgcgtgcattattccttgtcccaggaggcaaggtacaccaaaagttgatacagttcagagtttaacaagcggaagcgtaaatagataatttattacatgggcagcgaaggcccagcacacacaaagacaaacgagaaacagcggaagactagggcgacgaccacaggcgcttgacggcaggcacgagctagacaccaaagccttcatcttccagggactcctcttctgggtttgggaaaaattgagcaagactgagtacaaccaccgtagtcaacaagacacacccacaagtgcagaataaatgcaagggagtacaagggagttataatataaagggttagggtttaccgtaaacagcattaaaagacacttagttgctcaaagctattttgtaaatacggtcctagagctatacaatattattaaacaaggccgtgaacccacacgagcctgccttaacccaaggcctacgatgattcagaccgaactggcaacccgaccctgggtcccagctcatcccaagccaacccaggccaaccattccacattttagttgttaaacaggttttaagaattaaaacactaacttgggtacattgctcggcttgcccataaccgagggcgcggctattcgaatagattatactctgatcagaggtgtacatctttacccacaagacacatcttcctcacgtgtagccacgtgccacataccacctcggtatacagacggaagacgtgacatagtttccaacccatcctagccatagacaagagtaccgacccaatcccacctacggccggaacccccgggacaggtaggcagggctgagcccctagcagcaggacaccggccctgtgccatgacatctcgactaccgggccgcagctcgtgtagccttcatttgccctagagatgtccatcgacccccgacttcgtccatctccatccgtgtacttttgtttataaccagactgagccacaaacaaagccttacccactagacatgtggaagtacggtagtgctttacaacagaggcccgaagaccggtccttatatggccgaggtgctactatcaaaaccatgcaccccgagcccagcctaaaaccattttggggattttgaatagagggggcggggtgaattcaattccacaataatcaaaccattccatagtgtccaggtgatgagaaaattcccaaagtttagagttgtaaaaccacctaacgttgcctaattaaccagcgaagcatctacttaaattcataccagtggtaccaagagtagagtgtccattagttggggttttgtttattctagggtgaacaaggaaataataacaataacaataataaggtcataacaaaggtaaataggcatggctagataaaacagtgataacgcgggaatttaaataaagcgataatgcaataatttaaatcaaaataattttataaactgggattcaatatgttcaaggatgatgtgacttgccttgctcgctttcccaaacgtcggcttcaacttccacgaagagcggatcttccgaagctgcagcgtctacacgaccaacggaaaagaaaaggcttttactctaataaactccatataacaagcaggaagaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaaaaatggatttattgcgtcagccgaggggaggggcgcgcgtaccgggtccacgggggtggggcccacgctgcagccccacggtccacggtggaccgggcgcacccgggctcacaccggccggcgctgggggtcccacgcgtcagccgcacctaagggcgcgggcggctgacagccgggccccacgcggcagccgctcggttcgcccgaaggcgaccacgccggcgtaggcgggaggcggcgcgcccgcgcccctatgctcgccggcggtggccataggcacggcggagcggtggccgagagaggggagggaaagggggaaacgaagtggcggtccacggctcaccccaggtcgacggcgacgacggaaacggcgaccggagcggaggaaggcggcggcgcggctcgggtggatggggtcggcggtgctccggcggtcggcgagcgaaacggaggggtggacgaggtcggcgaggatgcggcgaagccgaagaaggcggcgccgagggggaaggtggtccgggacgacgacggcggcggaccggagctcggcggcgacggcggaaagagagagcgacggcgcgagctcgattccgacggggagtgagggcggcgagtggcggaaacggtggagggaggcacggggagggtttatatagggttgggagtgagagggggtggccggaggagggggaaacgggcgcgggagtcccggccgccattaatggcgccggcgaggttaggggaggagtttccaaacgaatccgagggagagagggagggaaaaatggggggaaagggggaggggatcccggggaataattcccccctattgattgcgcgcggggcggacaggggcggtgggattcgcggcggtggcggcgctagggcgcggggaaggcggcgggagcggcgggaggaaggggatgacgggtgggccccacccgtcagcgagggtggcgggcgggcccgctcgtcagcggcgcgcgcgcggggagaggccgaatgggccgcggggagaggagagggagggggaaggagatgggccgagccggcccaagagggagagggggggaaaagggactttttagagcttttctttttataaaaccattttaactttgtttatttcttaataattattatttgtgctctgaaaattccactaaaatttatttatgcattttagactcttatgaaatatacaaaaatcctccaagccttatttgacttttaactttgcaccttttaattgttggaggctttcacacggattttaattattctaggcataatttagaggatgtattttagggtcgttttgggacgtgacatagtcgcacccatggcaattaagaagcggttcgcgggatgcactagaggacttaccgcgcttaccacaagcgggaatgggtgactgcttgatctgtagtatagctttcctctggctgacgcatccaggcaagggtaagcgtgatggagttcagatgggccttgcgatggcctatgcggcttgctgattcgcctagccacgaggggggctgctcattgcctgttgaggagtgggggtgaaacctgaggtgtggtgtgcttggtcagagggggttatatgaagggtctcgtcacaatcactcaacatggtgacgtgtccggccgggcgcgttgacatgccggtggattgtgtcttgtgagtacagttgtgcacctctggccaaactaaaactattcaaatagctgtgcccgtggttatgggcgatcgaccagaatcaccgtgattagtctcactcttaataaatcgactcaatgcataggttagttcaggtgggatggttggtcatgttcaacgtggtgtagcgttgttcagtgcaggcataatattatcttaattaatcgaatgttctattgtttgctcaataaaatgctttgcaaccacctttatatcaatagccacaaacccctctttgtatccccttgcatgtctgcatcgattgttggtttggcttgctgagtacggtggtggtactcagccttgctattattctcccttttcagaagtgtagcgcttttgagctgaagacgaagttagaggaccaaggctcagaccctagttgagttttgcctgtggagtggagctgaagccccccgctaggatcgccttttttcgcttctgtcactttcttttcggtgtgaggactaaccggctcttctgtaagtatttacgctttatttacgtttggatctatatattaatttattgttttgtgtatcctggctgattcctggacagagatttaatacacaagatattccggaaatttgggctaaatttctgtgcgtgacagtatatatacgtgggatgtattttaaataaatctatataattgttttaaaatagtgggtccaccgaattgaatgaaaatcgagggttggatgtttttcttttttctcagaatttgtaagattttttcttctttattagagcgccacatgacatcttagaagcgtttgtaggagtaccacatggcggcttgcgagcgtttataggaagtttaatgattttttttatataataatagatagatgctgattctttttgaaaatttttttgacatgattctttttagaattttggtatcccagaaagttctcactccaaaaaattaaaacgtagtacgtattctggtaatgatatatagctagcaggttttcatgaacagttatgcggaaagctaatcgtcaagagtagaattcaatttcttgtaatttctctgggttgataatatttagagcacggtctttaaaaaccaattttgataattattttctattataatatgtataaaactgttaacaaatactccattcgtttcatattataagactttctagcattatccacattactatagatgctaatgaatctagacacatatatagaactaacgtcttacgttgtgaaatggaggaagtatatgattttattaaaatattttttaagactaatctatacacgtagtcactatatttgaatgaaaaatattttagaaatgattcataattaaagattctaaaatttaacctcactcttgtatagaacgacaagtattatcggcccagagaaaatatactatggattctattccaataataaatatataccaatctataaatatattctataccacatacaatccagagttctagactcgccataattagtatttaaaagtggtgctcataggggtagggtttgctgtgtgccttcatagggttgagtctacgtgtgttgtgagtgattgcgttgtactgcgtaaattttttaaaaaaaattaaagaagagttgtgctgcgtttcagacctctacttatagcgcagtagtgccatcatcccattccgaaggaaaaggaagaccgaaaaaaaaaaaaacattagtgccctcactgcattacagcaatggcgcatgctaagagcaatggatatcaagccagtgatgccaccagctcgctcgacgctctgagagagctctacggcaacaccttcgccgtcgtcaagtccatggctctcaaggccgccatggacctcggcatcgccgacgccatccaccaccacggcggcgccgccactctgtcccagatagtcaccagggtcgcgctccacccgtccaaggttccatgcctgcgtcgcctcatgcgcgtgctcactctctccggcgtcttcgccgtccagaagctggcgcccggcgatgccgcagcccctgccgacgaggccgaggcggccgtctacgcgctcacgccggtgtcccgcctcctcatcggcgccgggaaccagggacacatgatgtccatgctgctccacccgaacttcatcacccccttcttccggatcagcgactggctccagcgcgagctgcctggcccgtgcatcttcaagcacacccatggccggagcttgtgggagatggccgacgacgacgccgcgttcaacacggtcgtcaacgacgggatggcgtcggacagtatcttcacgatggacatcctggtcagggagcatggcgaggtgttccaggggatcagctcgctggtcgacgtcgccggcgggaacggcacggcggcgcaggccatcgccagggcgttcccggaggtgaaatgcagcgtgatggacctcgcccacgtcgtcgccgaggctcccggtggcaccggtgtcgagttcatcaccggcgacatgtttgagagtgttccaccggcaaacgctgtcttcctcaaggtatattaattggtctcgcaattctctcaagtacatttccgtttttttctaaaaatttggcgtcacacatatttaacacattttcagtcatttttttatgtgtagttgctatctctgtatatgtttatttctcgtttagctcctactcgacgtaattaattaatcactttcgatcctattctattacatgttgtgcattagaaaatttatagttttattacagtataaatgctggtgatttaaagtttaaagcgatttgttttgttgaaaaatatggcaaacccccttatttttgttgttcccgtattgctgtaacatatgtctaccaaggtacgtgcttttgctatggacagtgtcgtacaaattgtcgatggcgattgcaattaaagtcacgcgctttttttataaacattactgcgtaccaagctttttcaatataattagcagttgaattttggatataatgttcaatcattcagcttatttataaaaatattactcctacgtagacatcatcatttattttgctatgacctattgaaggtacagaggactttaaacatgacttatatattttatagtagtattggagaatactattattgtaaagatttcaaagttggaaaatatcatcgcatatgtccttgacacgttggtcagggactcacatttcattctcacaaatgatggtatttttcaactcatacatctttatgatggtattctcctaatatttgctatctgctatatatttatagtaaatttttaaataaaataaatggtcaaacattatgtacaaaagtcaacagagatatattctacaattatgggagtactggttagaggtttcgtaaaccacacaaattaatactagaagattcagaatgatagaaattcccttgttataaaatatctgagaaattttcatcttaatatattaaaatcatgtgcgtccatacataaaaattgatggctgagatggaaaatccctaccatcaaatctgtttaagatcaaatacaaatgggtcataaattaaagctattcgaaggcaagcatatatattatcagaataatatatgcctgatcaaaaatgaaaattagatacaactgtttagaaaaaagaatttcgtatatatatgcctccactgaaattcactaaatttatcttcaaaattgaatgtcactttcggtgcaaattaaggttgagaccagtgcaatgctaattatatttttgtaattgatgtcagactcttaaattttgtgtaagtcattatactttggttccaccgataagttattcactattacacctttaattcacattgggaattttagaaatgtccaattagtacaaggttagatgtacatacagatacatatatttacagaataatatatagttatggagggactgttatatatttaccttctgtctctcctgatataaatttattatatatttagtggattatgcacgattagggtgacaacgactgtgtcaagatactggggaactgtaagaaagccatcccaactagagacaagggagaaaaggtgataatcatggatatagtggttgggacagggccgtccgaccaaaagcatagagatgtgcagatcttgtatgatgcatacatcatgtttatcaatggtgccgagagagatgagcaagagtggaagaagcttttccttgaagctgggtttagtgactacaagattatgccaattatgggattcaggtcaatcatcgaagtctacccttgaagaagttgctgattcttccatgagcaatctgtgtgtgttgcttgggttgtttgtgaaattgtgatcagaccaatcaaataagtgtgtggtgtagccccaatcaaataagtgtgtggtgtagcttcatatctatgtattcgcagttctacttaatttgcctttgaaaatttcatgaaaatagtaggaataatgtatgtaccccaggacataaatatccgctcacctctgatggcccatcagtgacgggccaaagtgctagtcacggatggccgtcacatttgacgcgttctagggatgccgtcatcagtaagccctttgtctgtggcctgtcagaggtgtggttcagtgacctcaaacgggcaactgtcaactgctttcgattccaacccagtgcactattcacatttcagatgggacaggaaagagggcgattgtttgctggaaatcggaggtaaaaaagaactgtgaaaattattattttctaacgtgtactatgtgttggcaactttttgtgacaagttgacaagcacgattgtagcaccttatgccttgcggtgatcctagagtcgcgaaccacctcgatctagcaaagagctaaacctagatggattttgacaaataaaccggctagcgtagccgattttagataactacttgtctcgtgggcaaaacggaaggttttcaggacaaacctacaaagagatgtcgcactctcgcagcggcggcggatggtttacggcgcaaactgacaaagatggacaaattaagagaaaactaaaagcaatatgaaaaacgataatccatttaccggccatagtaccttctaagcgtcttgccaaactctcgggaagtatttcttcaagtatttcccgttgattgctcgctgaaaacgctccccttgaagtgtctccaaaaaatatgcgttccctcgaacaatgccgcatacccgataaggacctttccaactaggagaccacttaccgaactccctggatcgagtacccgaaggcaaaattgtcttccaaaccaagtctccaacttgaaacaactttgctttcacccttttgttgtatgcctaggccaccctcttcttctctttgtctatctcttccaaagccttcaaacgcttgtcaatgacatcatcaaggtcttaacaaatgtcttgtaatcttcacttaacaaatcatcttgcttgatataacgaagagaaccaagatttacctcaatcggtaaaacaacttcttgacaataaaccaactcaaaaggagtgactttagtggcaccatgtttagatatcctatgcgcccacaatgcttcggaaagcacttcatgccacctctttgggtgttcctcaatcttctttttcactagctttaacaatgtcttattactcgactcggcttgtccattagcctgagcgtagtaaggagaagaactcaacaatttaataccataagattcggtaaaactctttacttccttagacataaaagaaacaccttgatccgtagttaatgtttgcgggataccgaatctatgaataatatgcttcaaattaaaggcaattacctccgtataagtcatattcttcagcggcacagcttcggcctacttggtgaagtaatccgtagcaactaccacgaacctatgcccctttgatgacgaaggataaatttgaccaataaaatccaaagcccaacctcggaacggccatggtttgattatagagttcaacacggcggcgggcaccaattgaacattgccgaaccgctgacaagcttcacatcccctatagtatttgaagcaatcctcaatcatcctcggccagtagaaccccgctctcctaagcaaccaattcatcttgtgggccaattgatgagttccacaaattccttcatgtacctctcccatagccactttagattgatcttcatctaggcacttcaacaagacaccatctatatttcgggatataaatcttcatcaagcaacgtgcatttgagtgcttgccaccgaattttccgatcaaccttaagtgtgggatcttttaaatatcgaatcaaaggaattctccaatcctttaaatatcgaattttccgatcaaccttaagtgtgggatcttttaaatatcgaatcaaaggccggtcagaccgctcggggtcgccggtcaaaccggcggcatgtggccggttataccgcacttggtcaccggtcagaccggccgcgcaacgtcggtcagaccgcccctggtctccaatttcgccaatttcgcacagagatttaaaatcaagcaccggctcttccaataccagaaataatcccttcttcacattatagccagatgcttgttgagccaagtcatttgctctagaattatcatgcctagcaatatgtctaatagtaaaattatcaaaattggcaatgatatccaagcatgaatcaaggtacctatttagtgatccgtccaagcatttataaaatccggcgactcgttgcaccaccaattccgaatcaccaaaagcttccacgtgcttagctccaaccatctccatgatttgtaagccgaataataaagcattgtatttggcttgattatttgtacaataatattccaaacgaaccgatgcttcataacacatgccattaggtgaaaacaaaactacccctatgccttgaccttctttgcaagaagaaccatcaaaataaatcttccaaggtataacttcaactaggcaaacctcttcctcataagcaatatctacatgatgttctactataaaatcacatacattttggcctctcacagatttcaatggttcataagccaaatcatactctatcaaagcatatgcccacttgccaattctcccacttagaattggcctttgcaacatgtgtttaataacattggcttgacaagcaactatgcatgtactagataacaaataatgccttaatttggtacaagcatagtatatgcatagacaaagtctctctataaagacatacctcgtttcggcatccaaaagacggcggctaaaatatgtaataatatattccttgccatcttcctcttgtgtcaaaacggcaccaatgactttgtcttcggaggcaatatataaccgaaaaggctttccagctttaggcgcccgcacaacgggtggagtagataaatacctcttcaactcctcaaacgcttcttgttgttttgccccccatgtaaaatcggcttcttttttcaagcgaagtataggaacaaaa

SEQ ID NO: 34184 - DNA, 3810 bp, Oryza sativa
agccaaatcatactctatcaaagcatatgcccacttgccaattctcccacttagaattggcctttgcaacatgtgtttaataacattggcttgacaagcaactatgcatgtactagataacaaataatgccttaatttggtacaagcatagtatatgcatagacaaagtctctctataaagacatacctcgtttcggcatccaaaagacggcggctaaaatatgtaataatatattccttgccatcttcctcttgtgtcaaaacggcaccaatgactttgtcttcggaggcaatatataaccgaaaaggctttccagctttaggcgcccgcacaacgggtggagtagataaatacctcttcaactcctcaaacgcttcttgttgttttgccccccatgtaaaatcggcttcttttttcaagcgaagtataggaacaaaagcatcgattttacctgctaggttagaaataaatcttctcaaataattcaccttacctagcaacttttggacctccttcttgcatgtcggcgctttgaaatcacgaattttttctatcttcttaggatcaatctcaactcctctctcatgcaccatgaatcctaagaatttccctgccgtcaaaccaaaagcacatttaagtgggttcatcttcaaaccataccggcgcatcctctcaaaagccaacctcaaatcggctatatgttcctccataccatccgatttgacaacaatatcatcaatgtagacttctaagataatacctagtaaatcatggaagatcaaattcattgccctttgatatgttgcaccggcgttcttcaatccaaaagtcatgacaacccactcaaacaaaccaacaaatcccgggcacctaaaagtcgttttatatatatcctgttccgtcataaagatttgattgttgccggcattaccatctaaaaaactaatcactttatgacccgaagcatcattgatcatcatgtcggctataggcataggatattcatctttgggagtagctttattcaaatctctaaagtccatgcaaactctaatcttaccacttcccttcttctccaccgggactatgctagaaacccactccgcataatgacatcgcctagtaaaccccgccttcaacaactgatcaatctcctctttgactcggtcatatagcaaaggattaaaacgacgaggtggttgcttgtaagggctaaaacccggtttaattggaagccgatgctcaacaagctcacggctaagacccggcatctcatggtactcccacgcaaagcaatcaacatactctttaagtagctcgattatcttaaccttttaatcggctctcatatttttgtttacaaaagttggccttggtttagttccatcacctatgtctacttcctccaatggatcggccgatgtaaacccttgtccaagtttctccacttcatcgaaatcttcaatagtctcaccaatatcattctttgtagaccgatattcttgcaccctcttttgtaaccactctaaattagcccctttactcattatacaaatttatatggcttagctgtgctacactagccggctttacagaggtagatacaaatttgccatcggaaatactaataaaatcatagctagaaagatccatccccgataagcattgaatattcccatgatgccactcaaaagtagcatcagccattgcaacctcggccgatgtatccgcttgaacaatctcaacatcatcgctgtcccattgaattaaacattgatgcaaggtagaaggcactcaataattggcatggatccaacaacgacccaaaataacattgtaattaccttgcacatcgacgatgaagaaagcggttggtaacgtcttgtttcccatggtaagctccaccgaaaagatacccttcgcctcctttggttcaccattgaagccattgagaatcatgttggtcttcttcaactcattatctccacgccccaacttattgaacaacgaatacgacatcaaattcacggcggtacctccatccactagcatcctagctatggtctcaacgcccttacgaggtagtgatgagtttcacgcgctctaagcccggccagcgcgcagttaggaggattggccgctatctgagcggtaccacccatcctaccctactacctatagggggccgtccgtcctacagccgcccgaaaaggaactgcagagaccggcttcccatcaatatgacccttgagatagagaggcttcatatgacaatttgactcatcgggtttctcaaaaaccgcatctttaggacctagtgaaaattgagcaacctcggcttcatccatagcacaaaactctataggcaacatatataccatgttgatatccatgtcttcttttgtagatggctcatctttagcaaccgattgttcttccttctcctctacaacaaccggttcttccttctctatggatttacgcctccataccggtggtggtcgcaactcattaaacctcctatccctttgctcttcggccttttgctctcttatttcttgggcccgaagacgttgcaaccttctcctttgagtagccgttaaatacttaggtatccacctaggtttcagctccgttccaggaggtaaatagtgccctctattgagtttacttgatgacgataaagcccccgcattgcccttagcaaacctcctgtcaaactggcgctggagcccggtcagaccggatgtagaccaccggtcagaccggccagatacgccggtcatatcgacatttggtgggcggtcagaccggcctgaggcgtcggtcggaccatcgtcgggtcggcagtcagaccggccagatggcccagtcagaccggccgtatgattgcggtcagaccggctagaaggcctggtcagaccggccgactgcgatgagctggtacctgcttcgggtttgttgcttgaggactctccaacttcatctcaagaaggtattggcacatcatgagatcccacattgatggtaatcacttccgaagttcttgcctccaccttaatacgctttccttctctcttttcttcattggcccggttcttaccataaaaccagccattgtttggtgaagacaaatgctcatggattgtcctccttggtcctccccacccttgattgaattgtattggaggcatatgattgaacattggcggtgttgccccccatggcatgtagtaaggataagtataacccgacggcggcattggatatggaccccatgacatgttttgagaacaattatattgaggtgattccgaccgtcttggtgaatgaccaaattgctccctaggaggtgatcttggtcttttccctttgttgcgagctttctcaccaccttgtttctcgtacttccccaaaagcatatcaaaggtcactttggtcttcctaggggttttagaagttgaagcttcactattattttccttccaaacaccaacctccggtttctttggcactatcatctttggcctcggttcaccaatgacctctccttttcccttagtagattcggcttgctctggccgaatcaacaccttcttatcattgaaattaattgtattcatcggaaaaggatcatgatcaagcttcatcttggaaccatcgatgaacttcaatcgtccttcatctatggccgattgaacctgtcgtcgaaacacattgcaatcattagtagaatgagagtgagaatcatgccatttacactaagctcgacgtttcaattcttcttgagatggtacgatatggccttt

SEQ ID NO: 34185 - DNA, 689 bp, Oryza sativa
tgtaaaagataatcaaagatcttatcacacttggccacatcaaaactatatttaacctcactttgccgatatttgcaaggagtcggcattagattagaacaaacaaaaggcttgtttttgttagtccatgaccactcagcaacatacatatcatgatcatccttaccctcactatcactagcctcagggtaatcaataaaattaacattaggctttttctcatatggtctaacaaattttttattatccttaacccagctttcctgagctagagccttttgcataagttgactaacatcaagaaattgttggccatctaatctttctctaagaggagcaattaaaccattaaaagcaagaccagccaaatctctatcagttatattcaagctataacattggtttctaacatctctaattctcttaatataatcaacggcaggctcattatatttttgcttaaccgatgtcaaatcacataacctaagctcagtttctctagtacagaaataatcatgaaatctttgttctaattgagccaaagtatgaatagaatatgctggtaaagaagtaaaccatgtaaaagcggtaccggacaaagataaagaaaacaagtgcaatttaaatgtatcactattagcctctcaccacattgcgctaaaaattgacctacatgctcccatgttgtc

SEQ ID NO: 34186 - DNA, 1287 bp, Oryza sativa
tttacaggtttgaatctttctttaccatgctatttctcacacaccacaatcttcatggtacttcacttccaccactgctcctttcttcctccaatctacgctcttcggcagaatatcatcactgctctctccaggcattgctctgaggaattgcgacatgaggtctgaaccccaacatcttggctctgaactcctcgttcgtcaggtcggcgaacgtacttgttatcagccagcttgtagccattgcccatggagttgaacttctcaacaagctcaacgttgctcctgtacacctcgaacctcctctgcttctcgtcggcggtcgtgcagctcccggcaccgcgctcgcacgagctcagttcatcggagacgggcggcgccgcggccccgatctcctccacgagcccccgcgcggagtccgcgccgacgccgtgagcgaagacccagcgctcccgccgccgacgccctgcccactgcccttctcccgcgtcgccggccgccgccgccggaccttcccgtggccccgtggcgcctggagggaggagaggggagagatggtgagagaggaggaagaagaggaggggtgagaatgatatgtggggccacgtgggccccaccattttttaatttatttttttgggtgaaactgacatgtgggtcccatgagatttattatttttcagatcgaattgccacgtaagcgccacgtcagccctacgtcagatgaagaccgagtcaaattagctacgtaagcgccacgtcagctaaaaccaccatccaaaccgccgagggacctcatctgcactggtttttcagttgaaggatgaaaatcggattcgttgacaagttaagggacctcagatgaacttattctttttttttcgcccgcgctatttgggccacatttagtttttgcgtgtttaacgatcaagcttttttttttattttctatatggattttggcagtttttagtgtttacagatcataccgaattcaagggaggttagcccacctgcgcgttttttttttcaaaataaattttgaattttttaagatccataagtataaagtttatttatacgtgcaaagttcggatataatgttacagtaattaatttttttttctaagtgcctttatgttttaaatttgtacgtaaaaaaatgtacgtatatatgcgtatactactcatgtatgaattttccatatatgtacaaagtttatacatacattgtatgcataaagttgtcatacatataaaatttctgtgtataaaatatactccctc

SEQ ID NO: 34187 - DNA, 635 bp, Oryza sativa
atcccacttttatttggcattgtcacttgggtcatataaatgagaaacgcatggagaagcttcatagagatggacttctacactctattgattttgaatcatttgagacatgcgaatcttgtttacttggcaaaatgacaaaggcacctttcacgggtcaaagtgaaagggcaagtgaactattgggactagtatatactgatgtatgtggaccaatgagctcaaccgccagaggtggttttgggtactttattacctttaccgatgactttagtagatatggttatgtctacttaatgaggcataagtttgaatcgtttgaaaagttcaaggaattttagaatgaggttcaaaatcatttgggcaagacaatcaagtatctacgatctaatcatggtggagagtacttgagccttgaatttgccaatcatctaaaggagtgtggaattgttccacaactcactccgccaggaacacctcaatggaatggggtgtctgaacggaggaatcgtacattgttggacatggtgcgatcaatgatgagccaaactgatcttccgataagcttttggggttacgctctagagacagctgcgttcacactaaacagagttccatcaaaatcactgaataag

SEQ ID NO: 34188 - DNA, 321 bp, Oryza sativa
aacagtctttttgcattcgtttacaatagctgttgtgtcaacatctttgtatggaacaggaataacaatgacctgcagaggtgccacccttggtggaagcactaaacctttgtcatctccgtgtgtcatcaccatcaccccaatctgcaaaacaagcatagggtcaatactacaaatgtgaacataatttgggtagagaactcagcaactggaaataacagatacatagaattaaagtaaaaataataatttaaaaaactagcgcattctgtattttaaaattaccagagagcttagcactcaaagctagctcctcattca

SEQ ID NO: 34189 - DNA, 139 bp, Oryza sativa
ctagggcatggtatgataggcttaagaactttttgcttgcgaaaggttttataatgggaaaggttgacaaaacgctttttgttcttaagcatggtgataatcaactgttcgtttagatttatgtggatgatatcatctt

SEQ ID NO: 34190 - DNA, 553 bp, Oryza sativa
atatatatatgtacaattcattttctcactagctatagctacgacttcgacgccggcgttacgtcagaagaggaaggaccgacgttatgaattgtcgatccgtcgtagtagaattcaccatcgggattaaagacttcttcgttgatgaaccccattagttgttcttgaacagtcgtgataaaatccttgtgtgggagattttccctcatgtgaatacgctatcattcgaaaaataatgacatatcaatatatgaaattaataaacaacttaacaaatcgatacacaatgaaattttgaatggtttatgtatacgtacatcgagctctcgtgtggtgtatatttggtttgataggcagtgggcatactcgcatacgtagtagccgcataagttagttccctggtcctgctttgcacactacatgagaaacgatgagagatttaatatactctttatattaactataattatagattcaattcaatataattttggatcatgcatgtactcactggaaaataaaacctccgtcaagtttttctttccaagtcccg

SEQ ID NO: 34191 - DNA, 342 bp, Oryza sativa
gtccactaatgctgttgtttttaagattgagaaagcttatgctctttaagtgagatatctcatttggcaacattccagtcatgttgttgccttgcaaactcaagtatttcaatgggcttaaataacatcgtggcaacttctcaacaagctccgttatgttcccagatgatagccccccatcaagtaacagtgttgtcaattcacaaagattttgcaagtctactgtcattgtggctctgttaccgttatcgaaaaaatatagctcttggagggacctcattcctcctagtgcctcaagaaagggaccatcaagataggtttgagagaggtcaaggatcttaa

SEQ ID NO: 34192 - DNA, 631 bp, Oryza sativa
accccaagctagaatttctgcagcttaagcacaatatgttctctggaagtattcctgacagcatcaccaaccttggaaagctttctcatttggatctagccagcaatggtttatcaggtcccctgcctcagcatttgtcaaatttaacaggaatgatgataaaccatgataccacaaaatatgaagagagactatctggatgtgactacaaatcttttgtgaacatgaagggacaggaactacaatacaaccaagaaaaagtaacagttgtgacaattgacttgtcttcaaattttttgactggtgtaattcctgaaggcatagtttctcttgacggaattataaatttgaatttgtcatggaacaatttgaatggaaaaattccatacatgattggggccatcaagtcattggaatcactcgacctctcgaagaacaatttctatggtgaaatcccacaaagcctatctgatttaacatatttaagttatttgaacctatcttataacaatcttactggaagagtaccatcagggacacaactttgtagcctctatgaccaaaaccatcatctgtatgacggcaatgatggtctttgtgggccacctctccaaaaaagttgttataagta

SEQ ID NO: 34193 - DNA, 636 bp, Oryza sativa
gaattcgagctcggtacccccgatagtccaactgctagagatagagatattagtgtacaccacgctgacatgtcaacgtgttgtgccacgttagttaaagtggcagaaaaaaatttaagaaatagtcttatctctcccgtctgctaaatatgtaacaacaaatccaaaagtgttatttgaagagtggcacagtttggtattgtaataaatactgtagttaagccccccacagtagctctaataaaaaggcagccagtatatatactggatatagctggtcgtcgtctttgcattgtctccttgtccggtacgttggttggctctagcttagctggtgctcgatcgcgaacatcatgtggaggctgaaggtggcccagggcggcggcgctttgttgcggtcgacgaacggcttcgccgggcgagcggtgtgggagttcgaccccgaccacggcacgccggaggaccgagccaacgtcgagagggtgcgccgcgacttcaccgaccaccgcctccgccgcccggagtccgccgatctcctcatgcgcatgcaggtatgtgttgtgtgctcctccggcttgataataattgtcgctttggagaaggacacggtcatctacagaaaacaattttgaccaa

SEQ ID NO: 34194 - DNA, 198 bp, Oryza sativa
atttcctaaatcgatagcattgttacaccatggaatcgcctgctgcgcgacaacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagaccac

SEQ ID NO: 34195 - DNA, 757 bp, Oryza sativa
  unsure (1)..(757): unsure at all n locations
cagggtttganttcngattgcggnctactgcaagnacntcatcagtccaatgtgaaattaattctagttgtatcttacgatttgattttattcggatttcagaactgtttttttcaggttagtagtactacgttctaagcatgtgttcttttcctcgagtttttagccatattgtccaagttgattacttgtaaattaatatcccctctagctgacaacattgatatcttactgtaatagcaaacttattaggccttttatttgtgtacaaacaatgactttcttttttactttttgccgaatagtttatcgaggtcactatctcctcttattggattcgtagtaatgcctgacgatgatacatcaaggagtattcctgaaaagagaaatatctacaaccaatatcgtttaactattagtcaaaacttttaaatattgactttgtggaaaacaaggacgccttgtttttttaagacagagggagtactactgattaatcacacatgtcaattaatttcatttgcggattttgaaactggacttatacgtaggctgcaaaattcagagttgctcgacatatatttgggttacttgtatacaaaacttatttgaattacatgcatatgcatcgattttgtgtaagtcaactgtgccattcattatgactattatgcatgttagccctctttggttctgtcaattaatagccaaatagagtcaagtgtacaagtactggtaattaatcatcaagctgcan

SEQ ID NO: 34196 - DNA, 746 bp, Oryza sativa
ccgctacttgtagttcgactccgctctactgcagtggaattcctcgagcaatttcctcgtcactggcgctccaatcgcctcgatgggcttctcctccagatacagctgcagatcctgggcgggcacaccgttgagcgtcacctcgtagtgcagattgcactcgttgtcaatggacatccaggccatgccgacggcatgtggattctgtgcatccgtgtgctcctgtcgcttcagcagaatgggttccgccgagtcccgagcatcggccactggacggggcactaggcggccacggatcaggctcgtctcatgctcggtggccacattaacgcccagttcgccggcatacagcgactcgaggaccttgggacccaacttctccacactaccaatggcctggttgaagttgaagctcggcgtcagatcctccagcttggccttccgcttgccctgctcctcaatcaaactgatgttgggcctatcccgggtgttcacgtgctccgtttcgatgttgtaggccagagatccatcggtgttcaagtagacccacgccaaaccgctgctcttggtcgaggattcggcactgtgcggcgccagcagggtctggaagatttcgcagctggctcgggtcacgatgtgtccctggatgcgcagatgtgggtacttcttggactccacggtcagcaggagtttgccacgcgacatcagtcgaagattctgtatggaaatgggcgaccacagttcca

SEQ ID NO: 34197 - DNA, 1227 bp, Oryza sativa
  unsure (1)..(1227): unsure at all n locations
ttattgtttgggttctccggaaaacttttaaaggtgtattattttgggcgccctttgtgaaataattttcccggctccagatggggtcctttcccaggaagggctccagaaaaaataaaaccgttgagggcggttttggctctttcggcaaaacatcggctttttttttgcccaagaagaaacatgaaccttgtcgcaagatggttttatcggtgattgttgcagcccccaattttccggggtatttataacctaaagtcccgcaagtggtcccaattatgtcctccagatacaccgttcatcacaattgaatgcacgggccaccgattcctttaggttaaaggagtagaataattcttttgtgaacagaagcggcggtgccaccacatctgcggatgtaggtgtgtacatgacttcattccctcaccctgaggaaatagaaggtgcggcccgttagcacccaagcgtaatctataaatagggatcaaatgaaaggtgaagataatccaggtgttagataaatacaatagttctcttgttaattaaatgtagaagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgggtaccatcgggtaggtgcaanntgaaantcaaagtcccacg

SEQ ID NO: 34198 - DNA, 768 bp, Oryza sativa
  unsure (1)..(768): unsure at all n locations
agtgattttgactgccagtcggacagnaccncatcatgtcgagaacagtttcgccgctagatcggtttgtaagaccccaactcgtgagcttaatcattcatctgcaattttgattgttttctatctcgttcttgtttgtgttcttcgattggcaaacagggattagccttctcggtgaggtcatccgcgtttcgacacgggtgataaccagaggagacgtggtgctgcgattgcggggctcaagagcatgcgtgttcaagaagtcggatcaatttgtgtcgcgactccgcccaaatcgttgtgtatcagaacctttcggaagatcgggaaccctagtgcacatcaagtggtatcagagctctaggttcaccgtcaggttcgcttagttcctttaccctagattagtttttgttttttcgcatttatcctagagtctatagaaaagccaaaaaaaaatttagtcgttagttaccttaacctataccgtttttagcctttgcatgattctttttcagagtccgtagtgttgagtttgagtcctaattaaagttcctgttgctggtctagtgcgtgtttaactgtgcccactacaacaagaacctcatttaacaacacatctatgtattgctagaaatccaaataagtgttgcaagggtctacaccaacgcttttagtatgcgttctatgctggtgttgcaatggtagaaatatatgatcatgtgttagtgacactaaaaataagcgttgcaaagttgcaacagataactg

SEQ ID NO: 34199 - DNA, 968 bp, Oryza sativa
  unsure (1)..(968): unsure at all n locations
acaaatgacctacccgatggtacagnagttcatcatcccccggtactggtcgctccccaaccaaacgaagaccttcccttatacattgctgcaacaccctattcagtaagcacggtcatcattgtcggaagggagaaagtgcacacctagtgtactatgtcagtgaggccctccacgacaccaagacacgttatccacagatccagaaacttctctatgttgtggtcatgacatcgcggaagctacgtcactacttccaggcccacaaagtgacggtcgtctcatcctttcccctgggagaagtcgtcaggaataaagatatcatcggtagaattgcgaagtgggtcgtagaactctgccagttcgatgtccacttcatactgagaacaaccatcaaatcataagttgtcgctaactttgtagctgactggaccatccccaaaaatagaccagttagccagacggataatgagacttggaccatggcgttcgatggcgcactcaatagccagggtgtaggagcaggcttcattctcacatctcctacaggggataagttcaagcacacaatacacctcgacttcagggccacgaacaacacagccgagtacgagggcctcctcgcaggaattcgagcagcagcagcacttggcgtgaagcggctaatagtcaaaggagattctgagctagtcgctaatcaagtgcgtaaacattacaaatactctaatcctgagttgaccaactatctcgctaaagtccgatggcatcgaagtgtgacatgtgtatcataaggataacgtcaaacccgacaatttagctaggcgtgcatcacgaaatggaccccctcgaacaggagttttctcgacgtgctgccaaagccatcggttaaggaantcccatgangagggaaactcncgacatcggccaatttctttgtgaagctgggaccaactaaatgttggtatttt

SEQ ID NO: 34200 - DNA, 850 bp, Oryza sativa
  unsure (1)..(850): unsure at all n locations
ccttgagatgcacattggttcatcagacggcccaagaagccaccgcccacaatgcagttatattgcaaaacattattcatgattttgtttgtatttttggcactgtcaagtgcaggttgagtgtgcctgttaagcttgaaactgtaggatcgaatcacaagaactaagccaaccagaggggggatgaatggttgatataccccaaaaccaaaacttttagcggaaataaaagttaccctcaaattcgatgtaaatcggtctgaccgaagttgatccgccagtctgaccgcgctcgtgccgccggtctgaccggtgttgatcactcggtccaaccgcctgaagatcacctgccgcgtgtgaagttgccgccggtctgaccgcccttgcgcatcataagaagaaatctcagagtaccacactgcctcacgctcaggacaaacactaggacaatcgttattaaagatgctacttacatgaatacttttcgatgttcccggataagttcaaactgattgaatctcagttatcttgttgtagcatcagtttgaatttgatgtaaaatgtataaacttgcatacttgataaaaatctgcaattgatccatatgtgcacacacaaacatccatttactaaaatgtgttttgccaatgtgtgcacaagtccaagtagcatacttgcaattattgtatggntttattgtttaaacactggtcactattcttnttatttatatggaatggnggatcgaataaatttttaacctagagcacattggcctttgtaccaattttttttgtgaagtgtcctctgtgtataaggtcactttaggcgccacatgatatgtccagtt

SEQ ID NO: 34201 - DNA, 793 bp, Oryza sativa
  unsure (1)..(793): unsure at all n locations
atgtattgattgcaccttcgagatggtacagtagctcatcagtcatgagctatcctcctcagcgttcagtacaacagccgctgggaccagtagcggagccatgataaaaacataaaaatatagtgggggctaaaccaaaagtgaccaataaaagtcaagacatctgtactccacaagatcaatcccatataaactggagtagggtataaaccagtataaaaatccctgtccctatgtttgtacaatgtcgtttggtgtagatccttacaccaacgtaccccaataccctatttatccggtctacgggtatcatccgtcaatagtggcgcgctaggtaggggaacttggtgtttaaggttcagcagacatgacttcaaggcatcccgacaacggcctctacatcagcctcaccctaggatcttcaatctcgacaccgctggtatgggcttgcgtcggatctatcatcttcccgatttacgtccctctgtccatctcgtctagcctagtctctagtttagagaacaacgtcgcgacaatataccctcctgccctggcaaagaagggaacagcgactacagctaccacccgggggcgacctcaatgttgacggtcgttatcgactaatttcgaccgtcagtttaactaaaattggggagaactagctatgcttacaatgcatatttattttagaataatctattttcacttgtacttgtaaatatttgcttgtagggataataaatcaaaatggagaagatatatggaggaaatctcactcttaagccagcttgan

SEQ ID NO: 34202 - DNA, 3508 bp, Oryza sativa
  unsure (1)..(3508): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtttgctgttgctgagatgagccaagtcaataccatgccatgtcttcctgttctttgcctcccttcgtctggatgcttcttcaacttcattacttgcttcatcttttatagagcagctttgaatagtttatggctacaactacaagggtcatgtgtggtgcaacttgggctgaagactggggtctggggattcagactcaagatcctgacgatgatggaatggatgacaatccccttttatgcgatagaaaggttcagatggtcagttcttttagtcgcatttttcattaggctttttatattattaacttcttatttgtaccaaatactaaattgttcaaatttcaaatgtttgtcccaaaaaacaccagctggattgttgactgtgtggtttgcatgcatcattggaatcaatcaaacattagcatccattaaaaaacacagtgaactttgaaaaatcctccatggtccaattcttgctggaaagaaagcaacaagaatgcagcactagtgtgttgtgaaaacgaagcgtctgctttgtttccttccctttgacatggtcaatactgtaactaaaaatttccaggccggctgtaacattgtcctcttgtgaacatgacctggagataacgtagaatagcttgagcacagcaaaccgaccaatgttaccaatgcacaagcacaatgcactgtctcatcaattgatttattttggtcactttacatacttttttctgggtggctgctatgggggcttgccaagcacaactttcacgctactgccatcggtcactgaaacctgttttggaataatgtttttgtaatcacgataataagctttggatattataaaactttaaagcacgttttgagacaaacacatgatttttatgcagcaaaacataaacatttaaataggcatcagtgtttaaagctttaaaattttgattaggacatattcaaagctgaaacatgttttcattactggagcgagtacacatcagcttggcaaaaagacagtgttatacatatgcgtcagatgacatatgtatgcatgcatttgttctactagtcatttgtacgtttgaacttagattttctatcatacagaaaagattttttaaaaaacatagctttagttatctttagttgcttcagtctgtaaaagaatgtgccggtaatatggtggttatctctctaccacttcaaaatttgagttgtggtttttttattaggagggttatgcttgtatatgttacataggatcttgtgttgaggattggacctctgggtcatgtatgtcttgcacaaagattcttcatgtatttcttattcatcatctgcaaactatatttcgaatcgaaaattagaatgaatcaacattgcatgttgatactctgaattcagagctttgtgaaccgtgtacatttatttaaaaataacagggtaacttcactgtaattaatagaacattaattaatcatcattgcaaagtgatctatggaaaattccattgaatttaagaataataggtgttgtgaatatcagttatatactagtaagtagttagaaataggatgattatgagcaatatttagtaaactaggatttttttactttatttccacaatttctccaatccattgctctctttgttttttggctaattacaagtatatgcacatatgtgtgtgtatcatcacgtacacacgcttaaacagatgcatgcgtagggataaatccatgaaccattaaaatttgccatcgaagtgcactcatgtatgcataatttgagacaccaggatttgaactttgatcaaatgattttgaaattggtgggggtaaaatattgtcaagagaatatacaagcatagctaggttgaagtcctacattgcatacatcacccctgttgacactaatgagaatcaaaatagtttagacctacctccagatcaccactgtgaacttgctatgccataccatcgaatgtgaacctcaaattgaggtatataattattaacgtgtatacggtttccccacagctagctggccaaagtaatatcatacatagacatgacactgctatttcaagttagcgtgtaactaaccatgcgttgcataaagaattgctacctaatgcagaaggatatattttttgaagtaaaattcagaaggatattgcgtgggggattggatcgctgactcatgtgtgttgtacagagattgttcttgcattgcttgcaaactactacctatgtttggaaatcccataattggacttgaattgacactgcatggcattctcttaatttagaactcttagtgtaccatgtacagttaaatatttgaaaattgcttcatcacactagtacttggctagtaattaatagaaaatatcatctaatcatcaatgtagaagaaggattttagaacggctatctttggtgtgggtatcgttgatagcagtaggaagattatgagcaaaatgtcacacactcacactagcaaaatgactctatacgagtcattagcttcccctcccctgtcgctgccaccattaggcactactggagaaatgatctttgctcggtcggctgatttccataatagtcccggatctagtaaaaaccgggactaaaaattgtttttagtcccggttataaaaattttgatctttagtcccagttggtgatgatctttagtcccggtttataccctgtcagagccatgttaggggaccgaggatctttagtcccagttgatactaccaaccgggactaaagattatcactttagtcccggttgatactatcaaccaggactaaagattatcactttagtcccagttggtagtaacaaccgggagtaaagatcatttagatctttagtcccggttggtactacaaaccgggactaaagatctatctttagtcccggttgaagttactaaccgggagcaaatatttttctcccatctctcatcgattaagtcccagattaaatatttagagataagatcatccctctccaactcccctcagatatcgccctctcccaactcccctcagattagaagcctcctcctcccctcccgtatcgtccccattttcgtgatgaacgnctgcngcagagcgcagatctcacccact

SEQ ID NO: 34203 - DNA, 5729 bp, Oryza sativa
  unsure (1)..(5729): unsure at all n locations
cgcgggttttgagtnnnnnnnnnnnnnnnnnnnnnnnnnnnnngccgtcggccgcctgggccgtgcccggcggcagcgagcggccggttttttttatatactctgggattattgagatgtataattttgtgattcattggacatttgtatggatctgagatgtataatctgtgatgtatttgatttgtttttattttttaggatttgtgatgtatttgatttgtgtgtatgagtaacattaagatttgtgatgtagagttgggatgttatttgatttggggatttggggtttgatttggggatgtgcatgccactcgattcgggagaaaataaaaaagaaaaagaaaagaaaaggggaccatctggactgcccgctaccctctctttagtcccggttgataacaacaaccgggactaaagatccctcttttttactcctggttgttgttttcaaccgggattagtcccggttatttcaaccgggactaaagatacccatctttagtctcggattgctactatcggttggaaacccgggactaaatgagggttaccaaccgggagtaaagaatgtttctccaccaatgagggttctggtggtatcacggctcggattgagattctctaacttacttccctctagcttgtgtaacttaggcccacatgtcagtgtctcaaagtcagagggaagtaagtccgaggatcctcttccgtcggggctctctttctgccgcccaccatcaggtccgtcttctgagcttggcattcgcctttattttctacaatgtttccaacccatttttatttttatccatttacaatataagcacacctatgcgcattcaccatcacacatagtggatggatgtcatggataaattcatccaccaaaaagattaacatcgaagcgcacctgtctgggtgcaacctgattgaatttgagctttgatccaacgatttcgaaactagtggggtaaaattttgttgatatatataactatacaacgacgaagtgtcatcaagttgaattaatcctaataagtgccgacatcacacacagctattgtaacagataacatcaaaatagtttagacctacctctagatcaccactgtgaacttgatgagccatgccagcgaatgtggaccattaatggatcaaattgaggtatacaattgtatttgtgctgtattatttacatgtatatacagttgccacacagctggccatctcaatacataacatacccatgactgctaattcaagttcgtgtgtaactaaccaagtatggcatcaagaattagactaactaatgcagaaggatatcattgtataacatttcaaaagctgtcatacaggtagcatatttcactggattggtgtcccaagtgattaccacgtgcttgtgggcgcagcagtcaattgattttgtgaactcggtacagttcacatgcatacctaaattagactaagttctaggacgtttaaacaaatttttcgataggaatctttctgctgccactctattacctacgtacaagtcaaagcagtattcttgagataatcttttggacaagtagatcacttagtttttggagtaaattgcatatatgacctagctcttcgatttcctaaacttccaaaagctaaccttttcaggaatcaggagcctatagctaattaacctttttcagattaaagttgtataagggagtagaggttgtgttattatgacaatatatgtgttgggatacgcgtaggctatgatagcataaatcaaaattttctattgcgtaaaccaggaaccaagcaagtattagatcatagatcgttaccactcgacgcgctgcgcagcggaagaagacgctgagaagtcgaaggaactctcgcgaagtagcgcgcgtcgatgtagaggaagtagtcgatcgcaccggctcgaccttgtcctcctcgtgtgttctcctcgccgtactcccatgccgatcagcaccgcaaaccagcggcgcctctacctgtatccacacgcagatgtgctagcacctgcgcgcggctagggttttgctcggggagggaagtgacggctagggtttctcacgtgatgcaatgcctccgccggtcacacccgtcacgaatatataggatccatcactcggacctccaaggcctgtaggactcctattcggatccctattcgaattaagctcatattggatctctatccaatccccttattccggcccattaagcgtgcgaccctgtaggttcatatatactcggctgtaacccgaaaactccttttcggtccacgcgtcaacagtggcccctagcagaacgtattgacccaccgggcatacataaagatcatatcggctgaacctctagtgtatacttgtatgaacccctttgcctcacgatattgattaagctcaaggctagatatgtgccatcctctaatagctcaatcattcactcgaacctgttgatagattatataacttgtgattgactcctcaatcacctttggcatggccatgcacttccataatctataatatcgaggggtataatatcgaggggcctagagatatctctccataggaggggcaaatctcatcttgattattcatatctcactacatgtttcatagcatacccaaaaactacttttatagctacccatttacggagtagcgtttagcagtccctaagtaagctactacacatgttgagaactatgataatctcaggtctaaggattcaacaccagcactaaatgagatcactgatgacacaacacatatgactcttgcagtgtctcatgttgggtctatccaacaacatgcatgttcaccaacatgtgtccacattattaatttgatatctctatagcatgatccatgagacatgatcattaattaatacatgtgctgatcatataaacatatttgttccacatatgatatttgatcagggatcctttagaaatagtaaatacagcctacaagcggtgtgtggtgtgcatgcatgcatatgtcttttaattaattggcctaattaaaagcttcggctcgaattaccctagcaagctcagtagcaatgtactgatccagtgatcctgcaattaataattaagctgctcaactcttctccagtggtttcatcaacattcaggatggagagggactctagatcttcatgagcaattttgtgtctattaagtctgtatttaagaaaaatgtttattttgtatcccaaagcttccattcatgcttaaatttaatccctaaatcaaaaccgaacactgttcatccttgaagttttcatatcgttcacatttcattcttgagaatttcatgtgtatctccgaaaatttgcccaatcttttctatgcttatgagttttgctcattctcttgcatgccttcaaatttcagtatacatcacttccataccttgaaatagtatgtaagggatccatattaaaatttggatgtatatgagggaatgagcataactcggggtatagaagggcctaaacaaactttcaggaaaatataggaaattttctcttcattatttggccatattcaaagtagttttcacttttcagtgacatgtaacattgtgatttaaggctaacatatatggtaaattttgaaattttgtaaatgaaataaaaattctttaaaatatcgtttattatgtatggtatgtacaacctaaattacctttttgtgagctctataaaaaaaattagtccgcataaaatagttttataacatgcttaaaataagtttttgtgcttggaataacctttattttgaatgggtctaatttatctaggtttaatatataaaaagtccaattgaaattttgtatattttattgaattaattatgtattcccaaattgtaaatgaaatttcagccatgggttatttatttgaaattttaaaaattagtaactgaataaaaaaatctgcaaaaatttctagttataaattggaaaaaaaatagaacttacataaatttggtccaatgtgaaattaattttagttgtatcttacgatttgattttattcggatttcagaactgtttttttcaggttagtagtactacgttctaagcatgtgttcttttcctcgagtttttagccatattgtccaagttgattacttgtaaattaatatcccctctagctgacaacattgatatcttactgtaatagcaaacttattaggccttttatttgtgtacaaacaatgactttcttttttactttttgccgaatagtttatcgaggtcactatctcctcttattggattcgtagtaatgcctgacgatgatacatcaaggagtattcctgaaaagagaaatatctacaaccaatatcgtaatataacaacatatgtttggaaaacgtcgtaataagttgaattttacatcgtttgcgaaaggttttgtgtacgaatatttctcagacataagctgttgctagcttttgtgagctggatattctccctagcccctagtttgatgtcggagaaagtgttcccgataacaaagctctagaataagccatcctagttgaaactttggtttacctagaccccagtcgtgaagttgtaaaactcaatttccatttacacaacttggtaaatacgcctcaattgaacactctgacatgaccgattttgacatggtcgtatggctctaaagcatctgacatcaccttatcagctctgggcgtccctagccaagatccccataggcacctcggaggctatgtcaaaacggcataaagggttgttaggtgttatcgtgatggcggatatatgggcaaaacacaggatttgagaatgccagaaatcctccgagtagtggtatatatatatatatatatatatatatatatatatgtatgactgtaagggaacttacagatgtggatacattggagctatacataaaagttacgtaacatatcaatgttccaagaattagataatccgcgtccttcaccatctgcaattttgaaagcgtctggccgcaatactcgaaccactgtgtatggtccctcccatttgggggaaagcttgttcttccctgcttgggattgaactcgtcgtaggacataatcgctgacggcaagtgtgcgggctcgaacacgtttctcttgatatcggcatagggactagggactgctggtatgcagctgctcggatggcaactcgttctcgatgttcttcgagaagattcacatagtcgttgtgcctttcctcttgttcctcatttgagtaattttggactcatgtgctctgatgtcttaactctaaagggagtactgcctcagagccgtacacgagaaagaacagtgtttctttgttggacaaagttggagtggtgtggatggcccataagacggatgtgagctcttcgaccattgtgtatcataagacataagcctatcgtagacgtgggtcttgatcccttggagcacaagacccgtggcttgttcgacttgttcgttactctgagggtgggaaactaaagcatagcaaatcttgatccctaantctatcgagtagtcttgaaaatctgcgctgatgaactgaggaccattgtgctgtgatgatacgatgaggtaattcggatctacaagatacccctttcattgaactgatagcggtctctacttgatctcttatgngggcttggctcgcatcact

SEQ ID NO: 34204 - DNA, 45685 bp, Oryza sativa
  unsure (1)..(45685): unsure at all n locations
cggtgtggaatctcgccacaccccatgtgagagagcaacacaccgccgacgggggggtgtgcggtgnnttctcncatagtgacatgaaanaggcccgtgggnaggagagagtaagantggatataaaatatanataaattgtgtntggaccggagaggaactnccattgtgtgaaccttggaactataacatanaaggtncggtacaatacaatgtttcaaagatatagatnaaccgggtccttcaccatctgcaatttggaaaggcgtctggccggccatactcgaaccaactgtgtatggtnccntcccatttgggggaaagcttgttcttccctgcttgggattgaactcgtcgtaggacataatcgctgacggcaagtgtgcgggctcgaacacgtttctcttgatatcggcatagggactagggactgctggtatgcagctgctcggatggcaactcgttctcgatgttcttcgagaagattcacatagtcgttgtgcctttcctcttgttcctcatttgagtaattttggactcatgtgctctgatgtcttaactctaaagggagtactgcctcagagccgtacacgagaaagaacagtgtttctttgttggacaaagttggagtggtgtggatggcccataagacggatgtgagctcttcgacccattgtgtatcataagacataagcctatcgtagacgtgggtcttgatcccttggagcacaagaccgttggcttgttcgacttgtccgttactctgagggtgggaaactaaagcatagcaaatcttgatccctagttctatcgagtagtcttgaaaatctgcgctgatgaactgaggaccattggctgtgatgatacgatgaggtaatccgtatctacagaatacccctttcatgaatctgatagcgttctctactttgatctcttatgtgggctctgcctcgatccactttgtgaatttgtcaatggcaacaaacaagaatcatttgttgcctcatccttttggaattggtctgattatgtcgagcccccagcacgagaacggccatgtgaggggtacggtttggagcacttgtgctgtcatcttcgtgtgtttgctgtatagttgacaagcttcacatcgtcgcaccatgccgcaagcatctttgagggcggttggccgaaaaaaaccttatcgaaaggcttttccgacaagggttcgcccatcggcgtgtgatccacagatgccttcgtggatgtccatcgtcagtcgagacgcatttgagcaacacaccgttcggggcctttttatatagattattgtcagttagacaataaatttttgtctgacgggatagtttttctgcctgagcgtcatcttctggtagcttattggcgcccaagaagtcgatgagcggagtccgccagtcttctggtttcttgatggaggcgacaatgttatcaattgttgacggccactaatgtcacattttatgccgtcaatgcctgcataagcataaaataataaaacatccaacctagtggtaggagttatttgtaaccatttccacaagtgttggtgaaatatttgtatgcaggaataatataccaaaaatgggagaattcatcctaaatggagcttacctcacttccaagcaagtccaagggataagagggcccacctgataggtgtaaccgccatacaaactatcatcgcatccacaaccgccatggggacccacctgtcagagactgaccaaggctgaagtcggttggcgaccagcctggtttggtggaaccagtgttgtgccacctggcccccatcttccacgtggagggccaggatcacttgctgatggcggttccagagggcatggtggtaaattcccatcagagttgccgccatttgaagcctatttgaggagctctcatcccacacttagaacacacacttgaagcttgagctgaattacaagagactctattgtacactatatctcagtttatcttagtaagattagggagagagtagagtagaagtcgtcggaggagtcccggagttgtcggtaacttcttcttcttcttttactttattgaatactctgatcattaatagaaatatcattatgagtatcaagtttatcttagtaagatttatatctcagttagttcctaagtagaatactggattactgttcattataaacaaccaacttatagtgattgcttgggtgcttaattaacacttaagcagttattaattgcttagacgaggtgtctaggtagattaattttcagtagttgcttcacatcctacagatagtttgaggcaagtatagaggtggtgacagccctcgagatcacgtagtcctccctgtgtgggtgtgtagtagagcgttgcatctgggagtagcgagctggccagtgcccgaagtatctcattaggattaaagttaagcttcctgtagacactgtttcttgctaggtaaaacctctctacccgtagccgaccttagattcgtgtccttggataagccagaggaggagttgacacacacgttccctgtggattcgataccttggacttatactcccgagtgaagtgctgcagcggtattccgtgcgcttgcgaatttatctatgaccgtaagaaataccaacattagtcgtcacagcttccaagacattggccgatgtcggagtttcctcttcatgggattcctttaccgatggctttgtcagcacgtcgaggaatactcctggttcgaggggttcaattcgtgatgcacgcctagctaaattgtcgggtttgacgttatccttatgatacacatgtcacacttcgatgccatcggactttagcgagatagttggtcaactcaggattagagtatttgtaatgtttacgcacttgattagcgactagctcagaatctcctttgactattagccgcttcacgccaagtgctgctgctgctcgaattcctgcgaggaggccctcgtactcggctgtgttgttcgtggccctgaagtcgaggtgtattgtgtgcttgaacttatcccctgtaggagatgtgagaatgaagcctgctcctacaccctggctattgagtgcgccatcgaacgccatggtccaagtctcattatccgtctggctaactggtctatttttggggatggtccagtcagctacaaagttagcgacaacttatgatttgatggttgttctcagtatgaagtggacatcgaactggcagagttctacgacccacttcgcaattctaccgatgatatctttattcctgacgacttctcccaggggaaaggatgagacgaccgtcactttgtgggcctggaagtagtgacgtagcttccgcgatgtcatgaccacaacatagagaagtttctggatctgtggataacgtgtcttggtgtcgtggagggcctcactgacatagtacactaggtgtgcactttctcccttccgacaatgatgaccgtgcttactgaatagggtgttgcagcaatgtataagggaaggtcttcgtttggttggggagcgaccagtaccgggggattgacaagtagtgtttgagcacgatgaacacatctttggctacttgtgtccactcgaacctatcctgttttttgagcagggtaaagaaaggttggccccgctctgccatcctcgtgacaaagctactcagtgctgccatgcacccagttaatttctagacttccttaagtcttgtaggtgacttcatatttttgatgggcttgattttgtaacagccctaggttcataaccaggtatttagaagtgaatttgttgtcctttagatttcatatttactatattgcattttaatcataggcgataacaaaagttaactctaatcggtaaaattgaaaccacttctatttgaacaataacttgaacataagtgtacatgtataataatttattcaaatactagtttatttatcaccaacaaatataaattttatggaatttctactctctgtttaggcctcctaaaaattcaaaccaactttcagcctaaccaatttcatcttttcaccagaattaaaatattttgaatttttgagtgaaactttgaaaaatggaaactaggtgtccaggtctatctccacaccaaaggataaaattctatcactattatttcttgaactaactgagtgtcatagtagaagaggtgtaaaattgctgaaaattcctgaaatttgcccaaattcttgttccacctctattccagcccttacctcctagaccaccacgacttgggcccacttgtcactgaccttgggtgcctctttagctcaaaacccacccttgggcgttcttcccacctcaggacataaggtgggcagaggaaaaccccttcttcttcctcccctttcacttcccttgcttgttctttcttttccttctcaagctgagctcccagctcacttctccccaaatcccatctaagaacccaaactcaagctctgcatgttagaccacaacaatccccatcatccaagctttccatccataccaacatcttgcacatgcatggagagttgtgggagatcgaaataggagaagagagtggtggtttcatcctgcatggttgtagcagcaacatgactttgtttccctccatttggtgagcttccttgccatccatggtgcattttttttagttcccttcatgttgaacatctatagcaacaatcaacaggtcatccacctccattattgcagctaggaggtggctgtagctcatccggtgttaatctcttttgatttcggtggaagcagccccaatctccattttaattgtatctataggtgagttttaaccttgccattgcctgcaatatgttcttagtttagcaacaaggccgtggcatgttctaccttgatctaccagcaaccccctacttgaattgtgtttagtttattcctatcaacctagcaccaatttttcttgaacgatagatctgcttctatatgggtgtttgctctaatcctactgtgcatcaccttggtcagttgtatccttgtgttttagttccacttgcatgctcggttgtggggtagcaccatcttaagcaatctcaagtgttgctgatttcagcaatattctcattatccattcagaattttattagcaaatgacctcctcttgtgttaacttcagaaccatgtagaaaatttttatgtaatcctttttggttgatcaaaatttctatgaacccatagaagtgtgctctttattgtttcaaggtaaaaacttagcacttatgtgctggttttggctctaaaactgcgaataatttatttgtgccttttgatcacctagctactagaaaatccataataaattattcctatcgtaaaatccagtgtgatatttttttaaaaaaacattgttgtgtgctctttcagctaagaataatcacatttgtaaaatctttatttgaaatgcaggttgctattaatgccctagggaaggtctgaattattttcagagctgccatttttcagcttgcatagcttgtcatttttgtagctcctaaaccatggctgaaagcatgctaattctttaaccaaaaatagctttagtacacctcctacctgctgtatttttgccttgagttgctgatcatgttgcatgcacatatttatttggttcttatttgcatattgctttttttcgatagatttggacgttccagagtgtgacgagcagtaccctgaggttgagggtgatccatctcagcagcaaggcaagcacccaagcatatagaacctatgctttctctaaaaatgttttgtttgcaatatatatatatatatatatatatatatatatatatatatatatgcatgggttggctacttattaatattgttggatttgggtatgtggatagatcttggttatgcatttatttccttgtatattgctgtccttatagttcattacccctggatgggaatatttgggatgtttacttcattcatgcttagccatgcttagtgctaatagaattaaggatggacagtactattatttgtgatatatagacaacttgtagtaatgggcataaaacttgagcacttccactaaataatggttgatgaaatatgttggacttggacgggtgatagggcgatgaagggaggttggttttcctctgatgcaagtagccccgtctgggtcattaaggaccgaacattttaacatctattcaagcacccttcgtacttaccacatgccttatttgggaccggcttgtcctttactagttctactgtgatcatttataccacgttggagagacgtgagggcaggtagccctttggagggcctcgggtgcctatgttggccgggggtgcctcccgcgtggcgcgcccgctttggtcacaccacacacgcacatgactgagtcgtcgggaaccccggcatggtataggtagttggggtgggattaggaaaggcatgtaatgagcttgtatcactcgcgtaacacactcgacggggtgtgtagctttgatccttgttcatttcgtgtgggtcccgttgtacacctcttatcagagtataatctatttgaatagccgcgtcctcggttatggacattgcttaatgtgtatcttactcatgttagcatcaaatgtggattaatatggatgggtttatgtttgatggtgatgttggcatgttgtgccatattggtttgggcaatggttgcccattgttgatgatgagagcaccggttgtgctcatttacttgtcagtttcagatttatatgcttgctgtccataaattaaaatgttactatttgtgcttttccagttgtgtttaacttgttatttgcccactaaaattagctttatgcaaatattgaacctagagccacactttaaggtagaatcatgcatacctctctctcctcttgtatatttatgagtttgggtaagacttgcaagtacaattttgtacttaacccgttggctgcattttcaggtgaggatcccgacgttgagctgtgtttcttatgtggtcattgtgctcccatgggcggtgagggcaatgactagttcttgcagcttggctcttgcccggtcagttgccctagtggggtttggcaccaccggttttatcttttgcttatgaactctagatgagacttccgctgcaatatttatgtgttgtatgttgggacctcggaccctattttgtgccatgtacctcgctgcactttaaccctattatggtacttgctatgtttattaattgcttgcgatgaaagtgtgaggctagtcgcattcctggggactagctaagcatgagtaacgggttttgatcgcttgagataatcggggatagcactttggatagagtcactggggtatgcttttggtcgccaccttcgagtggttgacaggcatatgacggagtggactggcaagctatcttacggttatgtcttgcgctcactactcgacattccggttattataacagaaggttgtcaaccgcgatcatggacacattgaggacgggtggctatttatgcgtgtatggatcccacttctccaatagtttgtggtggtcgcgttggacactggatggtataatactcggggtgtccacagattttctcagggttggcctcaatgccccttccagagaagaggaaaccgagtagttttcccgatcatactccaaaagtacctttctccgggttcaacttcagtcgatctcatagaaggttgtcgaaagtttcccacaggtcgtgtatgagtgtgcccctatttgatcaccgaggactccttggatctcacgctggtacttattgcctgcacttatgagcccgaagggcattttggtgtagcaaaaactcaaaaaggtgttatgaatgtcgtcttctcctcatcctctttggccatgctgatctggtggtagcccgaataggcgtctagaaagctaaggagttcgcatccagctgtagagtccaccaactagtctattcgaggcagagggaagtgatcttttgggcacgctttattgaggttagtgaagtctacgcacattctccactttccattggccttgaggaccaagcctgctttgagtagcttatcgagttcttcttgtatcgcatgcttccggcatggtgcaaaatctgcacagcttctatttgactagttttacatccggtcgcaccatgagtttgtgctctatcacatccctggggacccctggcatgtcggacgtttgctaggcgaagatgtccgtgttatcgtggaggaaggtgatgagctcgagttcctatttgggatccaacgaccccaccccgattctgactattttgtcggggttcgtactagccaacgaaactattttggtcgctccatcaggtcgtggggctttgttgggtttgctcactttgttgggtagctcaactgtggcggctatggtgggagtgtgctcgaccatttcgaggctccgcttgtcacattgcactgcgagcttcgcgttcccctgaacagtgattatcccctttggtcctggcatcttgagtaattggtacgcatagtgggaagctgccataaacttcgcgagtgcagttcttcctaagatagcgttatatgtcgtattgaatttggcgacatcgaaggtgatttgttccgttcggacgtcggcctggccgaaggtgacggctagtgtgattttgcctagtggttttgacgaagattctgggataatcccatggaatggttgatctgacggtgtcagctcgcttcgtgggattcccattgcatccagggtgttggtgaagaggaggttgatcaaactgccgccgtcgacgagtacgcgggcaactgtaatattctgaatagtgggctcgaccactattgggtatctccctggcgttgtggaggttgtcgaatggtcagcttccgagaactaaatcttgtgtcgtgaccacttcatcctggttgttcctccctgcgtgactgaacagacttcgcattctgccttcttgtactctctctttgagaaattcgatgtagaaccgccaaagatgtgtgagacgcaggggtcgcatgccggtgcgttattggaagagtggatgttgattcctgcttcgtcggtatgcgtctcttcctcctccaccgcttgtttccgtgccaacgcccttctgaagatgtggcactcttccagtgtatgggatttggttttatgtatcgggcaccattgtcattgaggactgtcgctatggggatccaaaagacaaggcggatcactgtcggttatcaccttgcgtttccccccttacgatctttttcctcatgtagttcagttttggcatcctcgagtgcactttgagctagctccggatcttgcttctccgttgggtgtcggagtttccttcgagggatcctttcggcgtcggatccgaattgtgagatcggaaattggctgcttgagtattgttatttcttatcgtcatccctggaaattttattcctagcaacggcggatcaaaatatcaacggtaatctatggtttacagaaatacacccgcaagcgcacggatataccattgtagcatttcacccggaagtattccaaggtatcgtatttaatcccaagggaagatttataagaatgaaactataccgataaattatatgtacctgtatacgttacagtctatgcaggggtaagtttatagcaagggtaggttgacacatagctaaggactagctaactcatataattcctaaattaagctaagtgtatgtagattagtcaagtttctttcctatacttctagtatacaagactttagtctattctaattagtatacactatgtagcataacccgtttaacaatacaacataactaggcctaagcatagctatgccctcctgatgcatcgcaagactaccacgggttgccgagttccttacgacaacctgtcatagccatccaaccgaagcgagatacggaggtgtatccaacccaaggaatttctatgtaggaatatatactgcggggggactcccgtactgagctgtcaccatcagcggtctacaaatcactcagagtatatacgcccaaataatgataagtggtaacctaagccccatgcttaaattattacttattactctatagtcttgcaactgaagtagagcaactaagtcccgaagccatagctcttggcctagcctaagcagactaatgacccggtagttagacattatactagcatcaatgcaaatcccaaaagatttagctacacagattatactaatcatgtataaactaagtaaggcactcatattctatgattagaatagaacaccaaacttgtataaagaagaataatatattaataactggaagtcttacaaagaagaaaggaaaagctatagaactttaccgaacttcccgaatcctccactggacttggaactatactaactctactccactagcactatactaatactaattaacttttatagagtagctaagagctttgcttgagtgtgtgttggagaagtgagtgaggtcctccttatatagggcttgatggcggcaacttttgatggaaaatgaccatcatgccctttggaaccgacatcaggaggtgatctggaacgtccatgtggaaggtcggtgggaatggcgataggagtggttcgccagcctggtctcccaccaacttctcctttggatgggtctctgacaggtgggccctcatgacggtttgaggtgcgatgacaggtttcttggcggttacacatgccaggtggctctctcatcctcaagcttgcttaagagtgagatttcctccatattatcttctccattttgatttattatccctacaagcaaatatttacaagtacaagtggaaatagattattctaaaataaatatgcattgtaagcatagctagttctccccaattttagttaaactgacggtcgaaattagtcgataacgaccgtcaacattgaggtcgcccccgggtggtagctgtagtcgctgttcccttctttgccagggcaggagggtatattgtcgcgacgttgttctctaaactagagactaggctagacgagatggacagagggacgtaaatcgggaagatgatagatccgacgcaagcccataccagcggtgtcgagattgaagatcctagggtgaggctgatgtagaggccgttgtcgggatgccttgaagtcatgtctgctgaaccttaaacaccaagttcccctacctagcgcgccactattgacggatgatacccgtagaccggataaatagggtattggggtacgttggtgtaaggatctacaccaaacgacattgtacaaacatagggacagggatttttatactggtttataccctactccagtttatatgggattgatcttgtggagtacagagtatatatggatcttaacgatgtcgacaagatagtagttggaagggtcgactagatatgtcgacgatttggcttctggctactttggctttgtcgattctgatggatttgctggtggtatgattcgatgtcctaagcccctccagggttccgccttttatactgtaggttacgtgtgtctccaagtaagactcaaagacatagaacccaatacgatatccggaaagacctaatcctctctgagtaggactacgtaatcaccaggcccgggaagatatctctctttatccttaatagacttccttgtttgtttatgggaataaaccgtatacgatgggtataccatactcgtatattccattagtcatagaggatgaggtatgtcttatccgtaaccttgacaacttgaatgatagatgaaacagaatttgcaaggcagcattcattgaaaagatgtctaatcgtctcctctttgtgacaaaaacaacaattcttactaacttgttagtttcgtttggctatacctttgtcaatactccacgatgtaaataccataggaaaatcttcactttgggatttttagtttctaaagacccttgtttacgttcggaacatcactgtgaacgaagcaagataatgagatttcatagaaaactccccatttggggttaggttccatcgaaattcatcttgctcttcacttaattgtatattggcgatgcgtggtaataaattattccatgccaccaattttgatcctactaggtctcttctccatgaaaagtttaggaggttggtttggaagacttctgcgacagtcatttgtttatgcctaacaatattgtagaggcaaggatattgatctcttagtgttgaatttcccaaccactcatttgtttatgcctaacaatattgtagaggcaaggatattgatctcttagtgttgaatttcccaaccacttgtcttccaagaacctaacttgggagtcatcttgataatcaaggacccaaaacgaagaaaatcaattttaccttcacgaggctagcccaaaaatctgagtcccaagcctttcattgagcttgcgaaagtggtttattacccaaatatttgttccgaatcagttgttgtcaaataccatctgtagtaagcagcttgaatagtcacttactgagtaaagttgtattctttatgtctaggtcatgaattcctagtccccttgttctttggggcagcacattacgttccatttagccaagcgatacttttttttttgaccatcactctgccagaagaacctagagcttaagtagtttaattatccccttgggatagcaaaaaaatatgacatgtacatcgggaggctgctaagcactgaattaatcaatgttagtcgtcctccggtggacaggagtttaccttgccaactactgagccttttctcaaaaagttcctccacccctttccaatatgtatttcttagcttcctataatatataggtatgcccaaataccgatatggaaatttgcctatagaacatccaaagagctcagtgtattgattctcaaaaattttagcttcgccaaagcaatacaattaatttttattgaaattaatcttaagaccggataattgctcaaaagtatagaataatagtttcaaattataggctttctccaaatcatgatccataaagagaaccgtatcatcagtatattgcaggatagaaagaccaccatcattgagatgcggtactactcctgcaacttgcccagttgctttggctctattgattagaacagtcagcatgtctgcaataacgttgaataaagtaggtgatacaggatcgccttgccatactcctttctttgtttgaaagaaatgaccaacattatcattgacctttactgcaacacttcctccagaaatgaaggagtccacccaagaaatccatttgggcgagaaacctttcatacgaagagtttgtaatagaaggccacttgactttgtcataggctttttcaaaaccgattttaaaatatcaccccattcaatttctagtaattgatgaactgtttcacgtaaaatgacattaaaaaccttcaaatctcgatccaaagattattatgttataatccttactatagttttctctgtattaaaaattttcttgaatttacttcttttatagcctaatctaaactacaacagtcagcaaaacattttgatatgacctaacaagaatcacctgaagtagacgaaattcatcctatctttcgtgtccttgtgacgccttgctaattccgctcgttggccttccaaccatacaaccaagccccccacagtacaccatacaatctggatgcattttgacggagcctctgcccttggtggccgttgatcacgcccacgccccatcctggccaggatgccgccaccgctcgtttggccgatggtcttgttgatgaaacccgtgcacacaagtcaccaggcagagacgttgagcagacacaatgtacaggtgctcacactgaaggcattacgaaactgatcttgacgcgacgtgggcctaaatccgatctacaagtcgcgggcgcacgatgatgggcagcgtgaccagaaacactatcaatttctatcacggactctacgcgacgtaccaacaagactataaaaacaccttatttttatggtatagatatagtaaagacatacattgaaataccggactgtgttttttttttgtgacttatctctgtgactgtgttgctagatctagctttgctctgtattgtttctcaaaaaaaaaaaagctttgccctgtattttacacggatgaataataatatctgaatcagagacggtgatggaaactggggtgtcacacgagctgagcacccatggcttttgtgaaaaaaaaaacaatcaaaacagacaatgcgagccatgtcattagttttgcaacacatacaatcacaaacagtacgttctgttttagctaaagtatccaatggctcaggtaagcaagcatacactgatttttgtaacgggcggcgttgctgtttgtctggcaacaataactggtctcttactttacacacatggagtattcggctggcggataaattaatctgagaagctaactgatacgggccccataaaggaattttatggcttgcgatatattgttctgactagtgaataccaatatgccttgcatcacattgtaaggcaagatgagattcaaaattaattgtcctctggaaattctcccaaccatggtgtgtatggaaaagacccttctataaatggctggatgcccatatcagttccataatattttgggcgaatgttgcccatgtcttggacctttctggtgtttaagtggtatgccagtccacgggtcaatgtgtggctcaagaacacaacctccttgtatggatggaatccaaggattgttacataaccagtcaaattactcctattgttaatatcgatgacattatcattgtcagagtcccactcaaatttttgctcctctattgcttcactgttatcatattcagaatgaccaatatgttcataaaagttgatatcttgtaaggtccagggtccaatttgatgaaattcctgtctaggcacatagcaaattctatgcttcagcacccactccattttgccatatgattcatcaagaatatataccccgcatggattatcaacaaatgtacagtaaatccccttctgtgatcgtcccagatatatatttgaatcatccatatctccaatatccaaaggtgactaaggtggtttaattatttggtacttaccagacagtgatattctgcaaataatggtaaactaagatatgttaatacacagaaatttgaatagcataagaaattaatgatatcacttattagtgtgtatacgtcataacagcattggtttggcaacgtacataaagtactcctcgccagtagactgcgttctgcagaaaatgtggaaaatttggtcgtatcttggccaaagttcctgcagcctccccttctcgaacaaacgacctctcctcccattgctttgtccttgatgagaaaacatgcaggatgcatggcgatggtggccattctattttctctatcatggggtctaattgaatattgcgatgaagtacagaagcatagggcatgacacgagcataggggattacaaatacctcaaactgtgatgacaatccggggtcaaagacaaggtactccgtgctctcactgtacatccctggatgcgaacttgggcatgggggcaattgtacccactgtcgtgtggccgggttaaccacataatactgtcgtgtagccgggtaatccgcatagccatcaagcaagagaagcccattgcagtggtccctaactatggagttgtgaggcaaatagttaaagttgccggatatcgtggggcctatcgaggggcgggagatgaactcagacaagattaggtcatggaagttgatgaatatgccacccaccaagtgtggaaggaggtccacacgcagcaggcaacgagcatcgatgatggtgcgccaaggcttgcaaacacatcgagaaattgcaaggcagcgtggtgcaagacgatggaggatgtttacaaggacatcttcagtagcaggttttccatgcccacctattattccagcatctctaatataatctatatatgcataatgaaagaaagaataagtttcattaaatagaatgaaagaaagaaataagcaataatctgggactggctaataattttcagggagaattcagattttgttaagagtttgtttgcattcattgttctgatgttttccaacatccaagcaataccgataggaagctattcatgcagttgcagctactggtccgagctaggacacgagattttaacccaggtatgtttctcagcaagaatagcaccatattttcctaatgttttctaataaattatccatacaaacaacttcttgtatgactgaatgtatggaattggtcaaattatattatacgtagagatcttgtgcaattgtgatgctaacaactgatcatgtccacactgaatgatccctatagaccatgagcccaacgatcatagttaccaactcaacatgatagcaggttctatttacctccagtgtttttaagaaaacattaggtgcttttttcaaacctagtctgcaaggaactgatttataaagagtatataaggccaattaaatagtaggcttccgctcagcaacagaaatacaatatcagatagaactgcgacataagatggaggaacaatcaaacagaactccatcactttcacactttctacaaattgtagcctcacctttaatagggattcagcgggtgatccatgttcttaatggatggatcattgacggatgagaacttgtatggattaaataaatactataaatcactcagaaaaagtcatgtagccattgtagaatgtttttggagaaatcatacttttggaagcatggaatgaataatctgtggataatgtatcatctatggtgtaaaaaagaacatggcacctagttagctggggtgttgattgagtggttaagtgtggtctgcttggtggatacatgaattgcttgcacataattgtttagacttgtgactaaccatgtactggtgttaactgataataatcttgaatgtccatcctcgcttgcaactaccagtattcaacctagatgatcatggatcttaggaaaagttttttttaaaaaaaataaaattctctccatcacatactgcagattcggagtgcacaaagatgttggtgtgagagagagaccaagtgaccaactagctgtgttttcctaccatgaaaatagaaaagatgttgaagagcacattcggcatcttgaatttttatttgtatacaagaaagccacacacgcaggaaaaccaatgaaatctagcgaaatttcacctttgcctcctgaaagactaaatatagttaattagaattccccgcaaaaaaaaagtatagttaattagaaaaggggtagcgttttgcaacagaaacctagcgaaatctcagtcacctcgcacctgccaattagatccaatcaatgaagagatcgtcttcaacctctactagaactgaggagtaggtgaggaggggatagataggaggaaggaggcggcagcgcgtcttctccggcgggtgggtgggctaccagccagcacacaccttcttcctaggcagtggcgccttctttctattagtggggtttctcaacaaggattggaggcggcggggctgtggggaagaaagaagccgacgctggagctgggtgtttgtttcatcacttcatcgatctcctctttctgacctaatcgtgcaaaaactcctctcatcaatcgatctgctctcttttctagtactccctccatccctaaatacaaggaattttggttggatgtgacttatcctagtacaacgaacttacatacatccaaataaaatcccttatatttagggagagagagagtactccagtactagcattctttcttagaaccacaagcaggcctgtcaaaaaaacaagacaatgggccagtttggttgcccgtatcccaaaaactagtacattgaaatttatcttaagtgtatgccacagttgccacatccaaatgatgctacctccagtagcatatcatcatcgaccatggaaaaaataagtaggcaccaaaaatttttctctgacactcaacacaatccatgagacaacaaatatccatgtgtagcaaacttaaaagttactagatctggggggaacaataactaatcataccaaataaacaactagaaatttaggagatcaacagtgcatttcaatccacacaaatcaacccacgaaatgcataagcttttagtagatctggaagatgctcacatgacagtaaatcaagaggaggaggagaaaaattgaggaggaaaggggaaggggaagagaggtttgcacttaccggaagagaggaagaaggggaatgggacaaccggcgtagtagagaggtggccgacggaggagacggagggcgaccggcagaggacacggccggcactcactaccggtggtggtggaggagggcacggcgacagccccaaaccctagcctgtttggcaagaggaatcggagtttgaaggagggagttaatagtgagattggtcacgggagttacatttttagtccccatcccttgtttggtttcacatcgaattccatttgaaggagggagttgatggtgggattgatcatgcgagttacatttttagtccccatcccttgtttggtttcacatcaaattcccttcaagtctcacgaattaacaggcctcccccaggtaaaagattggtgagagttggactccttaattcctcatcccaaaccccctcgaattttcaagtcttccaaccaaactacagacttaaactttcatatattataaactcccattccccatcaccaactccctccaaccaaaaagaccatagcttattcgatgaggagaggaaaggaaatgagggagagacgtgagacgtgcgcacgcgctgggccaggcctggctatgggggctttttttaaaggaataagttcaccagaggtcccttaacttaacagcgagattttttgaagtcccttaaccgaaaaactagaaatgtgtacccctaaacttatgcaaaccgttcaccggaggtccctcggcagtatacatggatggtttcgctgacgtggcatcctagtcagaaaaaaaaatttaaaaaaaatacgtggggcccacatgtcagctgcacattttttcctctctttttttcttctcttttctctcttctctcttcgggcaggcgccggcacggagaggcggtggcgggcggagcggcggcgggcaaaaatttagtgcaaatataaaaaatgataagtcatgcttaaagttatttttataataaagtaagtcacaaacaaagtaaatgataattccataatacttgtaataaaaagtcaaaacgccttacattatgaacagaggtagtacattggtaaacagtaaatacttttattactaatgcatcacctgagcttctcttttttttggaggttttgtcagtaaaccaaccgtctttcccttgcttatgacagtaattatcttcaggttttgaatgcctttgtttttcagcattattggcaaatgttgcacatggaagtttcaatcttctcttaaagtttggtaacaaggagggtgattattgtgcaaaaacaaggagggttgattctgattcttctcttaaaatttagggaagaagagaatatagaatcatctttatcatgctttagaagtttgcttaacataacaattttcttcggttaaagaatattttcttcaaaatatattaacattaccaaatatctccatatatagcgttagcacgggcatattactggtaataataaaaaaacacaagcagacccattattgcccaccatggtccatactaaatccctcaatcagttaggcagacctcgccctacgcgggcagttcggggcaaaaccatagccaccgcccgcccgcccccctcttcccctttccctccacctcgctgcctgccggagcaggctatccgtcaaccgcacgttgagccaagatgatggtggtggtgcccaagtttagtgaggctctgtctctcgcggcgtgcatggcgagatggcgacgcgatggtgccacggcaatgagggcatgcgcgcctgaatctggcctagggagcggcaactttgggtcgatggtgcctggtgtgtgttaccgtcttcccgtggtcagtttatgttgtggccattaggcttggcaacggggcggggtgggggccgggttggacaagaacgtccctgcccccgaccaacgaactcttcccctggccctgaccctgcaatggagagcggggcgtatctccccgcccccgaacgtgtggagccccgtagggagtcgatactccagaaaaatcaaactcacatggctcagatctgtccggcggcaatgatgtcaactgcagcagtgtcttctcagagctgagacggcgacggcttgacaacgttgaggatgaagagccagtgtggatgaggatgtgatggggcatcgtgccgagccactgccgactggatccttggaagcatcgaggacggcaaatgcatgtgggacgttggcgaagggcgccgcaccatcgactggaacctagcggctgcacgttgggcgccggcgacgggtgccacgccgccgactggaccctggtagtagctgcgcgttgagcgccgacgaaggttgtcacgccaccggctgaactgggcgtggggcaccagggtgacgctagcaactggacaactggtgaagtgagcggcggctggaggaatggagaaggatttagggtttgttaggtctataagtgggctattaggccctaaatatcatatttatacaaataatatatattcgggaccccatgaggtaccccacgagtgaatcccccccttgagtgtggaaatgactggggccccgcccccaatccctcgctggtacaaaatttacccaaccccaaccccatagggatggatccccgcgtccagcgggggaattaccaagcctagtaggcatccatagatcaaaacttcatgccctttaaaagtgatgaaactaagttttatattttcctatgaaacgccaaactcaaaccttaactgaaatgcaaattagtagctcaagtgacccatttagatgcaaccaatgaaaaaggatatgttccttttttttttcaggttaaatttgtctagaatagaataataaagtacatgattatactccccgtgttatagattacgtgtcattctgattttatcctaagtcaatgattctacgtttgacgatcaatttagaaaattgtatagtccaacaacatggaaattaatattatgaaatatttttcatgattccaattaacccaaaaacctagggttaattggtattgaactatatgaatttgtagagatcaataataaaaatacaaatgtttgacttaggaaaaaaatctacaattacaaatagtttgaaacggagttcttttcattggatggcatatgtgtttttttatatctattccgataactgagttttccctagttgtgggagtatatctaaatatctaatatcctttaaagctgcccctgtttatgtatttgagttttctttgaatctcaatgttttttacctcatatgctcataggaatggacattagtgatagaaatgaatccatgggccacaacttcgcggcgtggggcacacaacaatgctgaggcagccggtttttggctccaccagcagcgagcacgacatcagccagcgttagcaagccgtcacatgaaaggcaatggacgagacggtgatgacttgcgtgaccatcgaccagcttgtgctaattgcttacaagatgtagtcatgcagacatggttgaagatgttgaaatagaaagtagtccacttcatggtatttgatatcctttgcaggggggtggtgtaatggcaaagcaagttgcaaatatgtgttgcattatccacaattgaagctgagttcattgtagcgaaaaaagcaaaccaagagctattatgtctaaaaaagttagttagtgaacttgggtttgatcaagaaaagtatttgctattttgtgacaactaaaatgctatcaccacttgagtaagaatacaagtttttactcaaggtgaaagtacattgatgtgcgttatcattggatttgttatgtattcttaacaaatgcggcttgaggaagtctacaccgatgacaatgaggctgatatgatgaccaaggtgatgacaaaggagaagctcaaagctcactagtatgactgccagaagccattgaggtcttccatgatgttgggaggtggaatttgttccctccacgtggagattttgatctaagcctaaatgtagcccaaaagtccaacaaatatgagtcattaattaatctcttgatcgacggtggatattgcctcattctttggggtatcaagaaaaaccctgacctctctttgagagaagatgtgagaatgtgcagcaaccattgacctgaaaacaagccaagcaaacacaagagaagagaggagaatggagaagaagaggaggtagttgtcagctctcgtgttcttgcccgatgttcaacaattcagcgattgggggctcaaatgtggtcaaattggcaccattcttgatgtgttcattctaaacttgtagcagattaatctggtcagattgtgtgaagattggttgagaggaacatcatacttaggtgaggttttgtcagctttaaagggacctatagacctgtatttttaccgagttttgtgcaatttgcattccgaattttgtggaatttgcacgtgtggtttgggagatatgagctgagagcctaagggacataatctactatatcgctgtttgttttagttattcatcttgttaattggtatggttgatgttgtagatgccaagaccatgtcttgatgatattattgttgttgtgatgtacatctaaatgttctatagaagactttatttgtacccattgttgattatagtggaagtttaaagtgggctggttggtcccatggttttttactcctcacaccgaggagattattccacttttaatcattgtgtcatatgtgcatgtctatgttattccgctattgatttgctagttaatactacactaaaagtttatggcaagatgagggattgattgtgtgaaatactccctccgtcctaaaatacagggctcgattaattttgttaggataaaggtttgaccaataaattctctactataaatttatttttatggcatatagtttatgttattagattcgtattcgtattcgtaagtactctcctatggttatactttctaatatcataattgatatcttaatagagaaattataggttaaacctttgttctaacaaaatgaaatactccctataaaaaagatggaggaagtatatttattgggtagtaaaatttttctcttgtatgttgaaggtgcttggttcaaccccaacaaattgttcattttaccgatcttaaatactcaagtgaagttgtgcctttaatattaggaaaaattggttctataccatagaaatttttgggtttagttttatatcatcgaaatgtttcggtacacattaataccacccaaattctcctccgttatattttttaagcacttctgttacctctgaaagtgcatctaggaccccttatttattttggtgctaatgacaacacaattagaggttctctaatactctttgttgagatggatgtaaggataaaaaggagtggaacttgagtttaaaagctttgcggcatcttttatggtaattgtcttctaatccatgtatttcttgtgttcttgagtattagggtgccgtactattaagagggataccacatgcataaaattggtagaacactagtgctcaaaatcctgtattttaagtgttcctatttttctcctatcggaccatccgatcttgatcaggctatccaaaatttcacagaactttgctctctgtctttggtctgagtgttggcaaaaatatcagactatccgatatatcgtcggattgtccgatacatcggactgtctgaaatttctcagaacttcactccctgtcttgaattgctttttatttctgtcttgaattgctttttatttctcttgagtgattttcagatcagactatacgatgtgatcagagtatccgatgatacagagactccgaaatttaatggaacttgagtctctgtgaggatgaagttcttgcctaaaaaattatcggactatccgacatgacttcggactttccgacatgtcagacagtccgaaattcttcagaactttgtcctctgtctctgggttgtttgggactcaaaaacatcggactatctgatgtcatctcggactttccgaggtgggatgaaaagattcccttcccaacggccacattttgggggcatctataaataccccccacctaacccttttctagggttacccaactcattcattctcattcactttgggttgagcttggtgctaagatgctttggatctttgagctctttctccttctctcaaatccctcctcgttctttgtatggtggatcttggtggttgtggatttggtgtttgagggcctagtgtgtgtttcactcgatcttgagcactagggtttgaccaagagttgtgtggtgtttgttactcttggaggttaaggactcctagacggctaggtgttactcccgagccaccgatctatgtgtggttggccgggagaagtttgtgaagaccggatctcgcctccgcaaggaaaaagataccccttagtggaaggaggagtgcttagtgcaacctcttgagaaaagggttagcaaagacctggctcttagtgagctcctcaacagagagtagaatccccttaaggatttgaacttcgggaacaactctgtgaacttcatcgttggtgatatctcttcatcctctctttagctttgcttaattatgcagctatagatctagtcactgtttgtgctatactcttgtttgtgtgctagatctgcttattgtgattctttagtggatcagacagtctgatccaacatcagactatctgataatttcggatagtctgactgtagatcagactttccgaccctaactctgttttagcttccgcataaagttttaaattagcctattcacccccctctctaggcctaattgaccctttcaacctcccgtgaaaatccaatacacaaacacccccaacattttttttagtctggcctgcttagcccttcccgtcacgccgtcactctctggcctcgtcgccgccgctgggtgagtctgcctcttcccagcatgcctccgcttcctcacgcgcctcagccctcaggcctcccctcctctcacggcaccttcgctcccctcccacgtgacctgtccccaccctcgattgacgcgcctccacatctgcctccgtttctttgccggaccgccaatctcctgtcttgaccacgtcggtgattcagttatacataataactaaagttgtaatcttatcttcttaactgcaccaattcagttgtagacaataactgaatttttttggatctttggttgcatcgggaagaagaccgctaaaactatcactcaagaaagttcttcaccaactagttcaccacctagttctggaccaatgacaaggagtagggtagttgcaagtccagttttgagacatgagcaagttggatcacctagtagttctggaccaatgacaaggagtagggcaattgcaagtccaactttgagacatgaacaagttagattacctggtggcattgctaggcacttagatatgaaatagaagaaagcttgtgttgggcatccacaatgtggtaaaaagtgggtagtaggaggccctattacctggttcaacattgtggagataggtatcaaggtgggtactaatattcggtagtagcactactacccggttgtataattaaacaaatattacaatctctcttctctccattccaccagccatctctcccattctcacaatattttttttgttgcaatgtggcccaccttactaccacctcctactagtatacattgtgacaattgaaacaactataacctactgttaaagggacccaccttattaccaacttaggcaatatacatcggtgatgcccttaaattttatgattgtctgaattttttttcaccatggtctgaatatttgtgatagtctgaaattttatgatggtctgaatatttgtgacaatctgaaatttttgaaatagtctgaaattcttgtgatgctctgatattgtgatattatatgatggtctgagtttatgttgccttgctcttcacttgcatcagtactgccattacatttcactgtaattaaacactcaaagtgaactcaactgaaattacagcagagaacatctatcactgaccactccttgctgaaaccatcgtcaagaaaactagaaagttttcagtttcaacattgaaaagggaaaagtgacatcacatttcactgaaattgaacactggaactgaactcaattggaacatctaccagcgacaataatgctctgcagaatgcccatcagcgacaatatagattgaagcctatgcaatgcaatgcttcgcagatgaagaaccccaaccggtcaccgacgagcgccttgcagaggaaccaaaagatgcacttttggggcggggtcaggtagttcacgtcgacggggtcggcggctgaattgtcgacggcggcgagcatgcatgccgtcgatgacggcggagcttggccgctcaatcgcacgtgctgcagagggggtaggtagatggagaaggccttgccgttgaaggacatgctagggatgttggggccgatgccgatggggacgtcacgcttgtcgtcgacgagatgaccgcgaccaacttggacctcttttcatttggtcaggaacactgtattggtggacttggatctgatcaatttgatgaaggctttaggggaaaagtttgtaacggaaggtaacacaagtgtttaacggaggaaaatttgggtggtaacgtgtagtttgatggtataaaactaaacccgggaaatttcaaaccaatttttccttaattttaatctatagttgggacaagttttcatttgatgttcccgtttcagggcattgcgtcgacgtcgtccagaggcaacagcaatcgacatgttccctcatttggggatgtgcagtcagcttggatggcttgttttactgatttgcgtctgtaatgattggttgtaatgattgtaaccaaggactatgtagtgtgaattggcacccatcaacatttcgacatctgtttttataggcaccagtacaagagtttgaattggctgatcaaatcattttttgagtatgacaagtgtgctcaatgtgaatcacaagtgagtatgaacatgtacagaaactaattgtgaatcacgttaaatccaagtacagtttgggagtatggaaatcaaaatttcagaacctttacattcaacttcattttagaactcgcatatatttggttttttggcatcacatcatatgcctgaagcactggcaaccaaaactaacagatcagagaaagaaggaaaaagaaactctgcacatgccacagactgtaacaggaagaaagtagattacaattcctaaatggccagatttagcaaaccaccacaaatcatgcatagggaaagtttcaaaaccattagtatgtgtcctactcctaatgacaatatagttcaatatggaaaagaagttcctgtttcaaaaaggtaggaatgcaatttcattctcttggatgacatatagggatcatcaggtgttgggcaatataaatctactgctgatgctgccggccgggacgacaatgttgatggagcttcatcctcgtcaatagcgacaggtcgttcatcatgagaagctggttcagaaaatggtgcgtctatgctctcccagttcaggtcatctttgcaaaaaggctaggctcttcattgaaccattcatccaaaacgtctacatagccatgtctgattgggtcagtgacatctctgagtttgtaaagcttcttgcaagactgttaacagtataattagtaaagcaggacgagtactaccaaaattcccaaatacattccatcatctttatatcttcagttagcaagaataaagcccataaataagcaaaaattggaagtaattttgcaacagctaaaatgttctgccatacaaaattgagtaattggatccccatcaggagtagatcagatcatcaagaattcataccatgaggtgagcagctagcagtacttggcaaaacagccaatgtcacgagggaaacagatggcttgaggacagctggtgacagacggggatgtgccaacctggtggctggagggctcgacgccacaggcacttcaaccctcacacatagcgggctccttttcaaagtcgagtggctgatacagtccttgatctctctatatctctatctatctatatgtcggggtaaaaagctttcattatctaacaaacaatctatatgtgggtgtgaaacgtgcagatcgagggaaggataaagttatgaacagaacgagctgacaaaaatgcttagcaaaccagataaagaagcccaaatccctcacgaatatcaacaaaggacaggcagccaaaaaggtgacggaaaattttcaagttttaaggtggcatgataactagcgattcccctattatataaaggaccaaagaaatttgtctattcttctagcagcaggtcatgcatagtagtgactagccacaacagaggggaatatattagtattatgaacagaattaagataagaatcctacgaacaaagagaatgcttttttggcatatgatactctgattcacataaggctgtagggagtcacgtgatattacgataataatggcactgcagtttatttcacaacctatggaagtaaataccaacttacatcggaaaatgatcttacggtcatcaacactcaacagtgagccacataactcaataatctaaaattgtggtaaggagctgactgcccttgagtcgtcagttatatctgctaaacagataaaaagaagtaaaatatcgatgcccatgatttatgcacattaagaatgtacataacatttctatttaatgtgaagaaaaaatgaagcctgaaggctacttttatttttaccatttgtactttgccacaaaataaccaccaacttcagagctcaacccagggagttgtctaagcaattctagaatatggctacgcttgtacttattgcaatttagttagataatacacaagaacaagcaaaggatttgatgataagcacactacaacgcaaatattgcagcgtagatgcatatgttgtgccaaaggaatagctatcaaagtaagaaattgctttattgattaggaaaatttgaaaaggggttgagattttcagtttccggattttacctcgagtcaacagtaaaagatctgcactagaatgtgtagagaaacaaaaatgaagtcaatggaaaatgaggtacgtaaaagggttaaaactttcagtttcaagttttcagcttgattaatgcagcttgatgattaatttacagtacttgtacacttgaactctattggctattaattgacagaaccaaagaggctaacatgcataatagtcataatgaatggcacagttgacttacaacaaaatcgatgcatatgcatgtaattcaaataagttttgtatacaagtaacccaaatatatgtcgagcaactctgaattttgcagcctacgtataagtccagtttcaaaatccgcaaatgaaattaattgacatgtgtgattaatcagtagtactccctctgtcttaaaaaaacaaggcgtccttgttttccacaaagtcaatatttaaaagttttgactaatagttaaactaacaatatgaatgtttagtgttatgcatgcgacatcattagattcgtatttgaatgtgttcagatggtgtaaatgttatagtttttaatagtatcttatggaagaaattaatggtattattgaagatcgtgtacaattataatatgccttgtattttagaatagagggagtaattgttaatccctttgtatggactatcaaacgaaatgagtgaaggtggcaattaattaataggcaaatattcagatacacacaaacacaccttgtataacaaggagtagaaatattcatagcgcagcactgcagcattacaatcctaggtacagcagttgatactattgtaatgcctgtgcggcattccatttaatattacaaagatgacaacacaattcaaagtacagaaagatgacatgttcataagcatattgaaaaataaaacttctatgccaaacttgtatagaattgtgctaaaattgataaagaacagatataagacaaccaacatgttgctcaaattaattctaatcattattggctctcagatgttgggctgctgaaaatacagattttcagcctcctcaactcaggcgttggactgccagagaactggtctcctacctccacaacaccagggtcaattatcactgattaactatattcctcaatgtgtgatacagtaaacagaaaacagaggtaacagtacacacgtaaattgcctactgtagggtgtcagaagtgcataaaggtctatttaatcaagcagtacggttgagcagaatgtattcagctaaacagactaagaatcaatgatacaggatagtaatactatgtgtaaatactagcaatactctacattacatacagtatcaaaagcaaatctgaagcacaaaactaaagcaatttatttatagctgttaccagatcagataattaactagtatcacaagaagagcaaatttgtcgcttggcacaggattaaggccacatatgcaactagaattgtcctttaatctctatagacccatatcgtcattgagcacacaagaaagtaagatttccaatagaatactcactgatgaacaggcactcaaagccgtttagtgttgccgctgtcccagaaatccaattgccgccgcttgtgccgcagtctcaccggcaaggaagacggagaatgtagctgctcacgccgtctcctccttcctcccagagaccaacaccttctttaagagcaggttgtagtgcttgcacccgtgggatggacacagacaccaagatgcaccagcaccatacaaggtgattccaccgacgactccggcaaacaagtcgccggcgatctgcagaaccaaggactagcggagaaagaggagaagtggttgactcgggttttcgtgctgatcgagaggtggctcaactgaagaagaaatagggagagagagctcagcctcgccggggaatccgcgcatgatgcagcaaccatcggccagggccgttggttgcgccgccgccgcctcccttatatgccactctaaattaaccggctcccttatatgccacttcaaattggcttatcccttttatgccaccgattcaaatttctcctcccttttatgccatcgccgtcagtccaccgtcagttgaccgttaattttattgaaaaaagatacatttgcccttgagaattagtatacaaccaataattttagtactaatatagctactggatacaacatataaaaattgattttttttctacatcacatacaattttagccattaccatcacaaataaattttcaatgtaagtatgaaacatgtagttttccaacaatatttttaatataaagagcatttttcactggttctgacaaaattttgttcactcaaaaaggatttaaaataaattagttatgattttctgaagtttacatattttttagttgagagggcatattggtcatttacgaaaataactaacctttgactaacaatcaactaacactatagtgatgagagtggtatgaaagggtggaaaaacttgaactagtggcatataaggaagaacccaattttaagtggcatataatagaactggtcaaattctaatggcatataagggattctctctaagcagaaggactagtaatagctgcttaattagtactactgattagcccaggcccagccatctttcaattgcggggctgagccaggttatctgcttgctgcaccatactggccacagcagcagctggatgtcatgcaggatgtccgcccggttgtaccctaagtcatcacgccgcggagagtctgcttcctggctgtcccagccagtggcggagacagcgtggggggcttaagcccccactacccctaataaattattaaagcccccataataccccctacaattttaatcctgaggggagctaagatagattttgtttgagattgttagaaggcccaaaaggctgaaaaggccaaaaaaaaaatccccacaaccccacgcaaccctaatctcctacctccagcgtagagagaggcgtcgctcttggcctccttctgttcgtgttcgcgtgtggcggcggcagacgagcacgagtcgcgtgacggggcgacggcttccagtccaagcggagttgcggcgccggcgggggaacctgggagtcaggggcgcgggcgcgcggcatcaagcagggcgcaggcgagcggcagcaagcagggggcaggcgggccggcggggggacgcggcggcggcgtctatgcaaggagcaaagggcggcaccgtggtagcagcaagcacccagaacaacagatcgaggatttgaggaattgaggtatataaaatttctgatttgtcatttaaaatcaatttcaattgtcaagtctagttgttattaatagttcaagtcttcaagaaatcatagagatattgaattgaaaattttatttgtgattcctagtttgctactttgttatattgctagattgtgaagatgtcaaaaagaacacggctcatatattattttagttcaagtaacacgaataccagcgatcctccactcaacaatgagattgcaagtcagtcaaagagacctagggcagagtttagtcacatagatatcattcgtgatctagggaaacggaaacaaattgagaattatccatctgaaaccagatatttgcacatttcctcgtaagtggcaaagtagtgaatggagatcctttcaaaaagctttgttatgtataatgtttatttttcgttaattctatatatttatactttggattagacatatagctaatttacatgacacatgtcttgacttttattggtcacttttggtttagcccccactatatttttatgtttttatcatggctccgctactggtcccagcggctgttgtactgaacgctgaggaggatagctcatgacatagtcttccacttaaccaccagaggggccgcgccacctaggtcgatgccgttcaccggccagttgtcgctggtgatgagcatgattggcatgaaacgtgaggtcggtctcacagaaggttaccgccatgaccgcaacggcgcgggcgaggcagccggcgtcctcggatggcgacgggccatctcctccagcgcacgaagcgtggagtccctgctgactaccaagttccccagcgccctgcatgtacccgccgaccaagctgaactgaagtagtcgtcgtccagcctcattagcaccgttgctccaggtatgatgccgaagcaagcacgcctagcttgttggagaaaacgtaccagctagcgccccgtcctgtccgtgaatcctgcgatgtactccctccgtctaaaaaaaaagacaaaccctagtttccgtgtccaacgtttgactatccgtcttatttgaaaaaaatataaaaaaaattaaaacgataagtcacacataaagtattaatcatgttttatcatctaacaacaatgaaaatactaattataaaaaaatttatataagacggacagttaaacgttggcccagaaacttagggtttgactttttttagacggagagagtagaggttgttgacgcggatcgcaatcatgatcttgtcatcttcctagctcgttgatgcctctcgatcagctcgagcatcagccaccctgccggcttgcgcgcggttgtacgtacgtctgctgaggaagaagacccacgtgcctgccgtcaaccctgttaattgctgcagtacggaatgatcgatcttcgcgcgcatcctcgacatcaggtcgcccaagtcgccgtgcgcgacgtcgaacgaaatcacgtcatgtggaaaggtggcaggtcctgcagatacacagcacgcacgtactcccttcgtcccaaaaaatgacaaaccatgaatttccgtgtctaactttgattgtccgtcttatatgaaatttttttataattcgtattttcattattgttagatgataaaacatgattaatattttatgcgtgacttgtctttttaatttttttcataatttttttaaataagacggacggtcaaacgttgggcacggaaaccagggtttgtcttttttagaacggaggaagtactccttataattagttcaaaattacactactaataactattccctccatcccataatataagggatcttgagtttttactttcaatgtttgaccgctcatcttattcaaaaaaaattaaaattattatttattttatttgtgacttactttattatctacagtattttaagcacatcttttcgttttttatatttgcaaaaaaaatttgaataagacgagtggtcaaacgttacaagtaaaaactcaaaatcctttatattgtgagacggagggagtagctagtaccattgattgttgcaacatgatcgacttactgtgctggattgagaggaggatcagtgtcgtacgccacacactgatcgtccatgcagtatgcaggccaccagatagaacactcgccacgcgggaggacttcatggttgatctcgctcagctggtagcttgaagaagacggccggggatggccctgtttacatagcgcccgcccgggcaatataatctctctcttgtactccaatggtagtttactctgcactagtcactctttgttacaaattaaccactctatatccccagcaccaagctgctagctagtacgtttacggcagctctctcggttgaagctctcatactaaaattgattcactacgtactggctttactgctacaagagcaacaccactattagttcatgctacttattcggcttaccgcgtttgcttgttttgcctatcagagccatacgggcaacaatactgaaattaattcactactggctctactgctacaagagcaacatcattatccgttcagttcaggatacttatacggcttagcgcgtttgcttgttttgcctatcagagccatacaggcagctctctcggttgaagcaatactcaaattgatgcactgctactataagaacaatacaagtgcaaccagttacagccatctctacacgcttcccattgacacatttcagtattttccatcactgcctttgtaaacttcagggaacaccccctcgtctaaatgctttagatttatgtggtttagactgagaaatgaactacctagaagaaatggaaatcaattgatcaaaaccataatatggtcaccgtatatggtgatcaaaattctgtgactaatagtctttgatccctcactgacacagcaccttattgagttaaccaatgaattatcaatacagatagcatccacatctacatctttaacgaataggaagagcaaatgattcacaggctctcctctactgctacatcaagaaacatccctcattagcagtggtaaggaagaaacatcactcatttactttatactgagtatttacttttttcgaaaatacgcttggaatgcgtatcattgtattaagattgagagtaacaaagaattacaagactataatccaacaaaaaggattataatcaggaaaaaagaaaaaacacatcacgccacgtgctagctccaccaacacaccctaaggaagtgacctagtaccaaaacggccgcctaaagcaaaccaatcttcgctgggactagaacagaccaagaacacctctaaagcgacgccttcaagaaggaagcgacgctaaaaacgttgtggtcgcccgtccaaggactggacaaggttttcacccagaggattgaggggggagagaggtacctcgacagcgccctcaagaggtttgcggcgtccaaagacgtcgccgctgccggccaaaagaactggctgagctttcgcctagacctgcctgcatcccaactgccgcgacctcttaacgaccaccagccttacactacaaaaaatatgttaatctatgacggatttcctgtgacatattcagaaaacgtcattaactatgcacaatctatgacagttatctatttttcgtcatggatctagagtatggatatcaggcccataatatggtgacgtttcactaaattcatcacaatctagcccactaactagtggcgttctataaaattcgtcacgatcaacatggactaatcttttcatatctggttagcatggacccatctagacctaccactcgatatgggtaatccatacccatacccatacccatgttatttggggagggtatgagtaggaaaaaaattatccatttcagaaattatccatttcagttttaggtataagagggtaccgttttacccatactcattttatttttttatagcattaactcggactctaaatttttaaactcgcgtttacactttaaatttttgtcaaattcaattaaaatttatagggttgatttatcttgtagagaagcaactttgtacagtttttgggcaaattttaaatgtgggacccactgctttgctcatactcattttatactttgtatagtgttaaactcggactctaaaatttttaaacttgcgttcacactataaaattttgtcaaattcaattaaattttatacggttgatttatcttatagaaaagcaaatttatacaacttttgagcaaattttgaatgtgggacccacatatacatttcacatttttacccttacccgttggataatacctgttttacccattaataacaattatagaataccaataccaacaaattgtaacttcttttctatgagctcatcggttaagcgtgcttgacctagagtaattttgggatgggtgaccaactggaaagtcttgatatcctagagagctgccatgtgttagcgggcccggcccggggggttgggtcgagacactaagtgggctgttttttatattggcccattaataaacactgggtttgggttgggctacacggcctagaactcttctattaccgttaagaaacgtcacggatcgtgttcaatctatgacaattttgtaaatccgtcacgggagttaatccgtgacgctcaatacatgacggaatctaaaagcgtcataaacattggtttatgatggttttttagtgatctatgatagaatttgtccgtcatagattacaaggatttttgtagtgttacaagcacgagacaaccagagaaccgatgccccttcatcggccgaccactgcaagatgtctggtcgccggcgcgaccaagaccacaaccctcgactgcgacacatgggtagaaggaccatccaatgttgcacatcgccccaatcgcggccacaacctcccaccacatgccacatcgacacacgccaaaacccagcagctttcttccccaactgtcgccccactggttcacatgggcttgatgcggacatcactacctcgaatacacacaacaatcctctaacagtcattcaaggaccgataacaagagctcgtgcgcgacaattaaatttagaggtgagctcattcctatgttcttctttgtatgaattcgataatagattgctacctaatgattatattgtgattaggaacaatggaggggacaaggagacacttggagaaggacttagagccatggaggatcatcgaggacgtccaagtcaaggtggaggcccaaaccaagtcgacgtcgggtgcaattcggagtccaggatcagtctgcactaaaacgggcgcccaggtcgcatacgtgctcggattgaggcgttttttatatggatagaaagctaagaagataacctttccaatggtttaggtcccatgtccaaattctttccgagtcaatgggaattgactgaacaatttgacgtccagaatttgtcccggtgctgcgtcaccatatttgggcctttggcccgtgtattgtgttgaaacccattagggttgcgtcgagaggattttgcacgaccctaaactatatatatcagtacccgctgccatctttaggtttttgggttttgcttagattaatctgtcgagaacagtttcgccgctagatcggtttgtaagaccccaactcgtgagcttaatcattcatctgcaattttgattgttttctatctcgttcttgtttgtgttcttcgattggcaaacagggattagccttctcggtgaggtcatccgcgtttcgacacgggtgataaccagaggagacgtggtgctgcgattgcggggctcaagagcatgcgtgttcaagaagtcggatcaatttgtgtcgcgactccgcccaaatcgttgtgtatcagaacctttcggaagatcgggaaccctagtgcacatcaagtggtatcagagctctaggttcaccgtcaggttcgcttagttcctttaccctagattagtttttgttttttcgcatttatcctagagtctatagaaaagccaaaaaaaaatttagtcgttagttaccttaacctataccgtttttagcctttgcatgattctttttcagagtccgtagtgttgagtttgagtcctaattaaagttcctgttgctggtctagtgcgtgttttagtctagtcatgtgtttttcctttgtaaccctagccgccacctttcaccgtgtgttagggttcatcctttgagagccgtttctaccttcataaacacccacccagatcaccacgcatcaccagaacaccctacaactccgctgccaccatatcccaattccaccgcataatagactaggttatatcccctctggaaaacctagccggaagccgaaacttcaaacagccataacttttgcatacggactcggaatcaggcaaaatttaactttttggataagagaaaaatttttacatccgtttctccccccccccctctggtgggtttggcgaatccaatattccgaaatttgtcttgcaaaattgtctgttcgagctcacatgttcctgcaccttgtttatagtggtttcagaaaattccataggccacatatcaactccgattgagctgtaacttggaggtgtgcctattttcgtgtcctagaaaaataaaaaaatatcaaaaaaataaaagaaagaaaaagaaaagttgatttccactagtgcattgagctcacgacgcgctccgttgagcttatctgccagttcggttttgttgttttcgctgaaactcgccgaagcttgcctaccagtccttctttgttgtttactagtgtcattttccttgagccttttttttgttaccactactgtctaggacacgagtagaccagcaactaagggcaagtgacttgggattgttattcagcattactatctgtcattggattgtgtaccactcatatacatatatctggcctttctagctccacatattacttcttgacagcacaggttcttgatccctgcaatcgctgactacgtcttccaggtatcctttgcattgctggtaagaaccttataagagcttggttaagtactccatattgctgagaatcattgagaggcaccactacacctgcgtagtagattattagggataacctttactgtttgttgatgttttggtgtttccatggcagggaacgatgctgagaagagtccccaggattttgctgactgtgtcagtcaagagcaactacgaactctccaagaaaatactcaaaaggacatcacggaggccgttgcaaagtctgtccaagatactttcactaaaatcggcttcctgaaccacatggagaggttggacaagcggatatccacgctaactgatcgggttgctgcgttggagacaccttccaatgaggaagtgagcggtgacgacgatgctcatcctgaagacacggtgtatgattctagtggctatattgacatgccagttacaaggcaagcacggctacgacgtcgtctatgcacaaaccgcacaagtatgggtggtactcgccaccaacaaggtaataataatcgtgtgcccgaggatccttatgctaaggtaaagtttaaaataccatctttttcgggatattatgatgctgagaaataccttgattgggagatgacagtagaacaagccagtagtgagttcaaagattttgctatcatgtggtgggctgggttatctgataagggagctttatctactatttgggaagaacttaaggtagctatgcgcgataggtttgttcctccatcttatcatagagatttacgcaagaaactgatgcgtttagaacaaggggataaatctgtacaagattactatggtgagctacaaaagggtgtgagacgttgtggcatagtggagggggtcgaggatgccatttgtcgtttttattctggtttgagggaggaaattcagaacattgttgattataaggaatttaactctgtcaaccagttgtttcagtttgctatgcttgcagagaaggaattgcaggggcgtgagcagcagggcaagaacaaggcgagtacatacactcctcacacgatgccatctgcgggattgcccaaggccgtctcttttcgggcgccttcctagccagcgagcaagtgaccagctgcatccggagcttttgcggcaccaccaaaaccatctccaccacgaccagcagagttaggtaaaagttcttcgcaggtacccgccaagagtgcctcatctgtcgcttcgataggacgcattcagtgccaccgttgccaagggtttgggcatgtgcagaaagattgccctagtcaacgggcatatgttgttacagaagatggctacattaccacctccgacgtggaagaagaagaggaggaagaagaagttgaggatgaggatggcgaagtctttggtcgtgatgacacaatggcctacaggaccatcattgtgcagcgggtgctcagcacgcagatatagtagtctgagaggttgcaacgccataatttgtttcagattttctttgtcatcaacaaccgtcgtgcacgtgtgatcattgatggaggtagctgcaacaacttggtgagttctgatttggtcaagaagcttggcttgaccacacgtacacatccacatccttaccatatttagtggttaaacgattccggaagagcaaaggtaactcaggtttgcagggttttgttttccattggctcatatgtagattctgttgattgtgatgtggtttctatgcaagcttgatcacttttgttgggtcgttcttgggaacatgataatgatgctacacaccatggtaggagtaataaatacacttttgtgcataatggaaagaaaattactttgctacctttgacccctgctgaaattgtagaagctgataaagaacaagctgctagtttgaaacttgatgaatctaagaatcagctagttgctaaatctgtttttccacctaaaaaagataagctttcacctagttataaagttgaggggattaagttgatgggtagtgttatgcttgcaaccaaatgtgacattgctgaaatttcagatgatgatatttgctattccttgatatgcaaacaagctttggtttctctagatgatattgctggttcgatacctcctgttgttactaaccttttgcaggagtatgaggatgtctttccagctgagatacctctgggcttgccacctatgagagggatagagcatcaaattgatttgattccaggagcattattgccaaaccgtgctgtttatcgaaccaacctagaggagactaaggaaattcagcggcaagttcaagatcttttggaccacgggtatatacgtcaaagccttagtccttgtgcagttcctgtaattttggttcctaagaaagatggttcttggcaaatgtgtgttgattgtagagccattaataatattactatccgatatcgtcatcctgttcctaggttagacggcatgcttgatgagttgtgtggttctataattttcacaaagattgacttgcatagtggctaccaccaaattagaatgaaacttggagatgaatgaaaaacagctttcaaaactaaatttggtttgtatgagtggttagtaatgccttttggtttgactaatgcacctagtactttcatgtgcttaatgaatgaggttttaagaccttttattggacgatttgtggtagtttactttgatgacatattgatttacaacaagtctttggatgaacacatggatcatttacgtgctatttttaatgctctacgcgatgcacgtttgtttgctaaccttgaaaagtgcatattttgcacggaacgagtttcttttcttggatatgttgttactccacagggaattgaggtggatgagacaaaaattgaagccataaaaagttggccagttccccaaaccatcacagaggtgaggagttttcttggtcttgcaggattctatcgccgtttcatcaaagatttcagtacctttgctacaccattgaatgagttgacgaagaaaggggtggtcttccattggggaaagacacaggagaagtcgtttgacactttgaaggacaagcttacacacgcaccattgctacaacttccaaactttggtaagacttttgagttggaatgtgatgctagtggagttggcattggaggtgtgttgatgcaagatggtaaaccggttgcatattttagcgagaagttgcatggttctgttttgaatcattccacgtatgataaggaattgtatgctcttgtacgttctttagagacgtggcgtcattatttgtgacctaaagaatgtgttattcactccaatcatgagtcgcttaaatatcttcgctctcaaaataatttgtatcgtagacatgctaaatgggttgaatttagggtaaattgaaaccatgcgattataattttgcatagtttgagatatgccatcggtatctcaatgacatgtaagacccacatgagtcaatgacatgtgggtcaggatggcatatctcaaattttgcaaaattataatggcatggtcccaattttcccttaaatttacccaatctttttcttatgttatcaaaaaaagaaagggaaagataatgtgattgcagatgctttgtctaggcgctatactttcttgtctcaacttgattgtcggattttttgacttgaatcaattaaagaaccaatatgcgccgatcctgattttagtgaagtgatgttaaattgcaaagagggacgtacttggaacaaatttgtgatgaatggtggatttgtttatagagctaaccgctatgcattccagttggttccgtcctcttttgttgatacaagaagcacatggaggagggttgatgggacattttgaagctaaaaaaacggaagaagttttggccttgcatttcttttggccaagaatgagaaaagatgttgagaggttcgtggcacgttgcaccacttgtcagaaagctaagtctcgtttgaatccacatggtttgtatatgcctcttcctgtaccttctattccttgggcagatatttctatgtactttgttttgggattgcctagaactaagagggggagggatagcatttttgttgtggtggatcgtttttctaagatggcacatttcatatcatgtcataaaagtgatgatgctgttcatattgctgatctgtttttccatgagattgttcgcttgcatggtatgccttctactattgtttcagatcgtgatgcaaaattcttaagtcatttttggcacatgctatggaataagttgggtacaaagctattgttttctacaacatgtcacccacaaacatatggacaaacggaggtagtcaaccgcactttgggtaccatgctgagggctattttgaagaaaaatttgaagatgtgggaagaatgtttgcctcatgtggagtttgcatacaattgggcaacacattctactaccaaggtaagtccttttcaggtagtgtatggtttcaaccctcgtgctcctattgatattttgcctttacctactagtgagagggttcataatgatgctatggcacgcgctgaatttattttgaaaatgcatgagtcaaccaagctcaacattgaaaagatgactgaaaagtatagaattgctcgtagtaaaggtaggcaagaagttaagcttgaaccgggtgatttaatttggttgcacttgcaaaaagatagatttccggaattgaaaaagtctaagttgatgcctcgtgctgatggtccttttaaaattattgagaagattaatgataatgtatataaacttgagttggcttccgagtttggggttaataccacatttaacatttcaaaattaaagccatacttgggagaagaagatgagcttgagttcaggacaacttcaattcaagaaggggaggataatgcggacattactacctcggatatacacaacaattccttcaacgatcattcaaggacccgatacaagagcttgtgcacgacatttaaattaaagtgagctcgttcctatgttcttctttgatgaattccaaaatagattgtacctaatgaatatattatgattaggaccatggaggggacaaggagacacttggagaaggattagaggcatggaggatcattgaggacctccaagtaaggtggaggccaaaccaatcgacctaagtgcaattcggagtcagaaccagtttgacttaaacgggcgcctaggtgcatacatgctcgaattgggccgtcattttattggtggaaaagttaaaagaaaccttttccagtgggttaggttcctatgtcacaaattttttccgagtaagtggaattgcaccacaaagtgtgcttcaaaaattgtcccgttgtgggtacgctatttgtgcctttggcgcgtttatggtataaacattattggttgtatcagagagatttggtgtcctaaactttataataaacccgcgcgccattaagagttggggttgtttataaatatatggaaacattcccctaatagtttaaaccacaccggggcataaaactggatgtgggttttaatttctg

SEQ ID NO: 34205 - DNA, 1430 bp, Oryza sativa
  unsure (1)..(1430): unsure at all n locations
ctccctaaatataagggattttatttggatgtatgtaagttcgttgtactaggataagtcacatccaaccaaaattccttgtatttagggatggagggagtactagaaaagagagcagatcgattgatgagaggagtttttgcacgattaggtcagaaagaggagatcgatgaagtgatgaaacaaacacccagctcaagcgtcggcttctttcttccccacagccccgccgcctccaatccttgttgagaaaccccactaatagaaagaaggcgccactgcctaggaagaaggtgtgtgctggctggtagcccacccacccgccggagaagacgcgctgccgcctccttcctcctatctatcccctcctcacctactcctcagttctagtagaggttgaagacgatctcttcattgattggatctaattggcaggtgcgaggtgactgagatttcgctaggtttctgttgcaaaacgctaccccttttctaattaactatactttttttttgcggggaattctaattaactataatgacactccaatttgcatctgcatactctccttcaccttcacacatgaagccccaatttctttttgcaaatcaaattaatgtgcaatctccattattacctgatctgaattgatgggctacacaggtcctacatttgcacatcgtgctccatgtggctggctgcagaggatagggtggagtccgccggtaatgcaggtggttcgctatttttctttttctcgtcgtctctatgacataacgagaatgttttgcatttatttcgtgcttgctagaaatggatgactgcaactgcgcagtgtcaagctcatctatataccacaccgggacaaccttccatgactctatagtcgagtaccgctcgccacccgattgccctctccactactagtcacaaggcacagaccagtctcttcatcattatagcaaaattcggcaaagccaccatgatcccagcttcacaatagatttttggctgaatcatgttttttgcttttctagtttgattcacttgtgggtaattttatcactcgtgtgtgattgagccggtaattttttcattcgtactaccattttatgatacatattaacaatactattagcatcagttttacttcttatactgtgtattaaatacatcagtaaatatattactatacggtgcctatgagatcatgggcaatatcaagaggaatgtggtaattgttttactcgcagacctcgaagtctaacaatctctcacagcactggtaaaaaaatcactggcgttgtaagctagtagtaattcttttacgaccgtctaggaatggtgacgtgcgctgtgctcgcattcatgcaagtaaatttgtttcttttcnntctcatagactgatttcagtagntgccaantcaaccct

SEQ ID NO: 34206 - DNA, 7956 bp, Oryza sativa
  unsure (1)..(7956): unsure at all n locations
gtgtgaaatgcatgacnagcatggtacagtagttcatcatttgcctcatgtggagtttgcatacaattgggcaacacattctactaccaaggtaagtccttttcaggtagtgtatggtttcaaccctcgtgctcctattgatattttgcctttacctactagtgagagggttcataatgatgctatggcacgcgctgaatttattttgaaaatgcatgagtcaaccaagctcaacattgaaaagatgactgaaaagtatagaattgctcgtagtaaaggtaggcaagaggttaagcttgaaccgggtgatttagtttggttgcacttgcaaaaggatagatttccggaattgagaaagtctaagttgatgcctcgtgctgatggtccttttaaaattattgagaagattaatgataatgtatataaacttgagttgcctcccgagtttggggttagtaccacatttaacatttcagatttgaagccatacttgggagaagaggatgagcttgagtcgaggacaacttcaattcaagagggggaggataatgcggacatcactacctcggatatacacaacaatcctccaacgatcattcaaggaccgataacaagagctcgtgcacgacaattaaatttagaggtgagctcgttcctatgttcttctttgtatgaattcgagaatagattgctacctaatgattatattatgattaggaacaatggaggggacaaggagacacttggagaaggacttagagccatggaggatcatcgaggacgtccaagtcaaggtggaggcccaaaccaagtcgacgtcaggtgcaattcggagtccagaaccagtctgcactaaaacgggcgcctaggtcgcatacatgctcgaattggggcgttcattatatggatggaaagctaagaagataacttttccaatggtttaggtcccatgtccaaattctttccgagtcaatgggaattgaccgaacaagttgacgtccagaatctgtcccgctgctgcgtcaccgtatttgggcctttggcccgtgtatcgtgttgaaacctattagggttgtatcgagaggattttgcatgtccctaaactctatatatcagtacccgccgccatctttaggtttttgggttttgcttagattaatctatcgagaacagtttcgccgctagatcggtttgtaagaccccaactcgtgagcttaatcattcatctgcaattttggttgttttctatcttgttcttgtttgtgttcttcgattagcaaacagggattagccttctcggcgaggtcatccgcgtttcgacacgggtgataaccagaggagacgtggtgctgcgattgcgggactcaagagcgtgcgcgttcaagaagccggatcgatttatgtcgcgactccgcccaaatcgctgtgtatcagaacctttcggaagatcgggaaccctagtgcacatcagggctccccacgaccaaaacggccaaaaggggaggagcacgacagagaggaggaaggtacagccggtgaagaaattgacccatcaccgctgtccgcgatgccgagcagcaggattcaggcgcggggccccaaattcgacggcggctccacaggatgcacctgcatcgccaccaccatcgccgggtcctaggtcccagccgcccatcaccgtcgttgccgtcagagacgtcgggaaaagcacctaggggtgaatctgggctggaaaaaggaaggctggaaaaagaaggggggagaggaggagagggggttttctaggggcgacgggagctcgcttgatgaacaagggatagcccagccgtccggagagagcggcgcgcgcgccaccagccgccggcgccagcaaggatggccaaccgactccgcgggcactcctttcgggccacccccacgcgccaccagccaccggtgcccccgaggacgtcggccgactccgtgcgtgtgccctcgggccgccctcaccgcccactcgagggaaagcgaaccacaagccgttggcaccgctgacagcggctggccagctcctacgcgcgcaggccaccaccccatcgtcgtcccgacccactgccgccagatccgccggagggaggcacggatctggccggggccgacctctccctgccagatcctggcgaggacggcgcagatctggccagaggcacctccccaggccccgacagcacctagatcgccggcgggatgtggggagggagagaagagagagtcccaccgccaccgttgttgcggccggccggcttcgctcgagcagcggtgaggcaggggaggagagaggagagtgaggcggcggaggtgcgtcgccgcccgagtcaccctcgggggaggcgacgcgggcgttttctgcagtatgataggtagagtagccgccccctactctaaaggaccctgagtatttacttcatactgaaatgtcatgcttctactcgatgcaatttatattggttcaaacaaaataaatttactaaaatatgcctaccttttgttaaggagaaggtacattgagtcatgacccagttgacaagcttcaagctgatctcaagatgacaagctacaagaaattagtgttgatgtcaatatttggtctctaggagagaagttaggctgatccatctgattcttcttttgtatgattcaatatagtttcccaaatgatatgttggtttgacaatgcaaaacaaaaaacaattttgtaagattgttttgtatatgcaacaaagctgccattcctatttatgaatgaaatcaattgttgataatcatttcgatgtgatttcaagaaaagtatatatctctggtcgattccaattgtgcatataaaaaataatattatgatttattgatagtagcaatacataatagtactatgcaaccagaattgaatcctgctatctgttgcaactttgcaatgcttatttttagtgtcactaacacatgatcatatatttctaccattgcaacaccagcatagaacgcatactaaaagcgttggtgtagacccttgcaacacttatttggatttctagcaatacatagatgtgttgttaaatgaggttcctgttgtagtgggcacagttggtcaatggtgtgggattacacctaaaccacccatattctaatcctcgttaaggcgaatttgggtgccggttttcttgttaatgcaaagtcaatataaattccccaggttgatcccatttttttagactacaaattctgcaacatcgatattctagtgtctatgacatatatatatatatatatatatatatgaacaataaaactcaaaattatgcatccgttccaatatactaatctagcgaatgcaataaaagttgggaaactaccagctagttacacatgaagtgatgtcccttgctgttgcctgaagcatcaactaattttatttatttattggccgggatggccgaaagattggccaacctatttgattaagatttgggggaaagtgttacaaataaactggacaatgtactgtcgaaggacctacgtaacagaaacaactgatagatagggctacaagctctacactcagattacataaaaactctcttgatgttgtttatgatcaactcgcttggtttgaaaaccagattgaaaactctggcattctgcttgagacaaattttccactagagcatcaactgattttgtttaaggaaactatcaactattaaattcgtgtaaaatcaaaggtgtttttgattattattctgtgatgaacaattgggcattggagattattggttttgttatttggaatttatttacgaagtggtttttggagatgattggatttacaggtgaatctacaggatattgttgtgattttatgtggaccggtcagaccgggttggtgctaccggtcagactggcgtgtattgcgcggtcagacgggctggcccgcggtctgaccggccaacgctgtgtcggtttcggtttcgggttgtttatttggatatccatgattatttcatgattatggcttctagatggatactatatgtatgtaatactgttgtttgctactaatgagtcaagttggagatagcttggtctcggaatatggtttctttgtttgttccatgtgtaggtgactcgatgtctcgggagagtatttgcggtgatgaatcgggagtcgacttggggataagacgacgtccctggtggtcagagatcatgcgggatactaaggctagagttgatgcacgtggttgatggagattccatatggcatacgatggagttattgtgtgcgtatgggatgcagagtcgaatttggaaggagtccaaatttagtacgattggtcatgtaaagtttctttcttgtactagagggtttactaaggtgtttaggactcctagtatgagtttggttcgtggctttagcctgcctacctcgggtataaatagagggggagcgtgaggcttcccggtatcgcttttgagagcaattgagttgagttttgagttagggttcgagtttagtcaaaatttttgtaaggagtgctgttggtgcactttgtaaacacagagagaagtaataacgtcgtcatccactttaagagttcttcgatttgtgtttcaccgagtttcggcggtctaaccgtcgatatactgacggtcagaccggcgggaagcggcggtcagaccggcggtggctaggcgacaggcgcggcaggggatctcggcggtcagaccggagattcaacaccggtcacaccggcggcatccactcggtcagatcggcagatcaatctcggtcagaccgatctccgtcaatttcgagggtaacttttatttccgctaaaagtttttgggtataccagccattcaacctccctctggttggcttagtttttgctattcgattctacaagtggtatcagagccttgttttcttctttggatttttatcaatctagagtttttgccatggctactcctgctaggttttcaactaagcctcatcttttcgatggaacgaatttttctcattggtgtagtaggatgcagtcttacattatggctgaagattatgatatttggagaaaagtttctcatctttatgtgattcctgaagctattaatactgctgttgaaaaaactgcttttgaacaaaattgcaaagctcgcaacattcttttgagtggtatttctcattcagattatgatcgtgttgcacatcttcaaactgctcatgagatttgggttgctttaagtaattttcatcaaggaacaaataatattaaagagcttcatcgagatcttttcaaaaatgagtacattaaatttgagatgaaacctggagaagctttggatgactatctttctaggtttaacaaaattttgagtgatcttagatctgttgattcttcttatgatgctaattatccacaatctgagatttctcgtcactttttgaatggtcttgatatgtctatttgggagatgaaagttacatctattcaggagtctgtcaatatgtctactttgactttggattcacttcacaccaaattgaaaacacataagatgaatgttctttctcgaaaagctaattctaagtctagtgctttggtttcttcttcttcttctttgtatgtagatgcttcttcatctaagccttcttttattgctgtttttaatgccacatccgatgatcaactcgaacagatcgaggaggaggatttggctttggttgctaaccgtattgctcgagctatgaataatgccaggaacaggaaaagaggtggtccaaatcgttgctttgaatgtggttcaattgatcatcttcattcgtattgtcctaagcttgggagaggcaaaagagaagacaaagagggtgagaagaccagcaacaacaagcccaacaacaacaagccgaagggttcatcccaagagaggaagatggagaatctcaggaaggcctttcaacaagtttgcgccgccttcgagccactaagtgatgtagatggtgaaaatggagacgatgataaggggaagaacatctccgatgtttgcttcatggcgcgtggtgaatctgacacggagtttgaagataatgaggtaggtgcgtttgaggaagctattaatattttgagtgaaaaaaataagaagtgtgagaagatgtatagaaaccaggaatttatcattgaatcttttaaatctcaaattactagattaaaatctcttattcctaatgatgatgattgctcaaattgtgaggttttaatgaatgagatttcaaaaattagagatgttaaagctgcacatgatttcaaaaatagatcttctcttacttgtagtttttctttgcatacacgcactttggatgaattgtttttaactaaaaagttgttgcaaaaatatcaaattgcttttcatgctagtttgatgtttaatatgatttctgctaaaaagttaaaacaacctcatgatgttttggattgctcaacatgtaatttgaataagatgaaaataaaagatgctttaggtcgtgttgagtatatgtaagatgttgtgaaaaataatgaagtgttttcttgccccaaatgtcgtaaaagtaaagatgtcatggtagattgtgaaaattgtgctaatttgaaaaaagaggtttcctacttgaaaaattctttgcaaagattttctgatggtaaaaagaacctcaacaagatcaatcaaaggttagcacacataactgtggtttaggttttaatccttatgctcataattctagacatcctcctgttgtgttaggtgttggtgctagaagtggtgaaattttggttaaacctgataccaataaaactgtgtttaaatctgctggtatcatgtctaccttgaatgcatcttcttcaaaatccaatgttgtgcatgcaaaacctcctattactgcttatgttgctaaatcttctagttctaacaatgtgtctaaacaacgtgaaaaatatacttgttctttttgtggcaaagatggacatattgttgattttttgtttcagattagttcataaccagaaaaaggagagagagattgcttttgcaaaatcaaagtggcaaaaatctggtgttccctcgagaaaaccggtcagaccgcagtgggtcccgcggtcagaccggcgacaggtcagaccggctactgtgcctcggtcagaccgaacactagtcagacctgcggtgaagcctcggtcagaccagcccccggtcagaccggctgcacaccctcggtcagaccggcctctgagagatttttctaaaaattctcaaattgattttgcacgtggatatatgcctattggatcttctggtcgtgtgtctcagtactggattcctaaatttttattattatctaaccccagtactgaggcttcgacttctgcttgtgtgtaggctttggtggcaaggaaggagaacgtgtggatcgtggattccggttgttcgcggcacatgaccggtgataaaaattggttctcctctctcaaaaaggcatccaagactgaatcaattatttttggtgatgcttctacaagtgccgttctcgctacaggtttggtaaaggtaaatgaaaaatttgaattgaagaatgtagctttggttgaggatttaaagtacaatttgctttcggtttcacaaattgttgatgaagagtttaaggttcactttaagaaaactggaagtaaagtttttgattctcgtggtgattctgtgatgaatatttctcgctatggaagagtgtttaaagctgattttgaaaatcctgtttcacctgtgataacatgtttggttgctaagtttgataaagatgtgatgttttggcatcgtagacttggacatgttggttttgatcatttcttatggttacttgcagcggcacgtaatcgaaatctaaccccg

SEQ ID NO: 34207 - DNA, 1362 bp, Oryza sativa
  unsure (1)..(1362): unsure at all n locations
atgtgcaatcatgtacnacttggtacagtcattcatcaaacaaggtaataataatcgggtgcccgaggatccttatgctaaggtaaagtttaaaataccatctttttcgggatattatgatgctgagaaataccttgattgggagatgacagtagaacaagccagtagtgagttcaaagattttgctatcatgtggggggctgggttatctgataagggagctttatctactatttgggaagaacttaaaggagctatgcgcgataggtttgttcctccatcttatcatagagatttacgcaagaaactgatgcgtttagaacaaggggataaatctgtacaagattactatggtgagctacaaaaaggtgtgagacgttgtggcataatggagggggtcgaggatgccattttgtcgttttattctggtttgagggaagaaattcaaaacatttgtgattataaggaatttaactcttgcaaccaagtggttcaatttgctatgcttgcaaagaaagaattgcaagggcgtgagcagcaaggcaaagaacaaggcgagtacatacacttctcacacgatgccatctgcgggattgcccaaggccgtctcttttcgggcgcctttctaaccagcgagcaagtgaccagctgcattcggagcttttgctgcaccaccaaaaccattttcaccacgaccagcagagttagggtaaaagtctttccaggtaccccgccaagagtgctcatttgtcgcttttataggacgcatttaatgccaccgtgcccaaggttttggcatgttccagaaagattgccctatttaacaggcatatgttgtacagaagatgggttcattaaccacctccnantgggaagaagaagaagaggaagaaaaaattttgggttaaggatggcgaaatctttgggcgtgatgcaccatgggcctacaggacattattgtgcacgggtggctaacacccaaaatatatatttctgaaaggttgcaccccaaatttgtttcagaatttttttggattcacaaccgccggcacccttgatcattgttgaggtagtgccacactctggaggtttaatttgtaaaaaacttgtttgtaccacgtaacaatccaattttctattttttgggttaacaatccgaaagaaaagaaacccagattcacggttgtttcccttggcctaataaaatctgggtggaaagggtttttcaactctacactttttggcgttttggcaagataaattccaccacagcggaggaaacacctttctattagaaaaaatttctctccccccccactggagagtataaaaaacgttggaattggtaaataaatctctttt

SEQ ID NO: 34208 - DNA, 1197 bp, Oryza sativa
  unsure (1)..(1197): unsure at all n locations
ctggtncnnattttgaactcgtncttctgcaagcagctcatcatcttatgggccatccacaccactccaactntgtccaacanagaaacactgttctttctcgtgtacggctctgaggcagtactccctttagagttaagacatcagagcacatgagtccaaaattactcaaatgaggaacaagaggaaaggcacaacgactatgtgaatcttctcgaagaacatcgagaacgagttgccatccgagcagctgcataccagcagtccctagtccctatgccgatatcaagagaaacgtgttcgagcccgcacacttgccgtcagcgattatgtcctacgacgagttcaatcccaagcagggaagaacaagctttcccccaaatgggagggaccatacacagtggttcgagtattgcggccagacgctttcaaaattgcagatggtgaaagacgcggattatctaattcttggaacattgatatgttacgtaacttttatgtatagctccaatgtatccacatctgtaagttcccttacagttcaatacatatatatatatatatatatatatatatatatatatatatatatatatatatatatatatatatatataccactactcggagggattctggcattctaaaatactgtgttttgccatatatccgccatcacgaatacacctaacaaccctntatgcccgtttgacataccctccaagtgcctatggggaacttggtagggaccccacagcttataggtgatgttagatgctttaaaccataccaccatgtaaaaatcggcttgtagaatgttaaatgagggggttttaaaaaatgtgtaaaagggaaatagttttcaaaattccaccgtggggttgggaaaacaaagttaaaagggggggtttttttaaattttgtttgggaacatttttcaaaaaaaatgggggtggggaatatccgttaaaaaactgcacagttttttgaaaatttctaccaaacttcccaccaggaaataacttttccggttttccaaaatgtggaataccaatggggaaaattcctttaggaactctgggttattgcgggttttccaaccaaaggagaaggcctctaactttgcaaaaaaaaaagaatttgtccaaaaaagcaaagagtttccaaataaatgtgcggggggtattatacaaaaca

SEQ ID NO: 34209 - DNA, 12516 bp, Oryza sativa
  unsure (1)..(12516): unsure at all n locations
catgttaaatggttaactgatggtacagnagttcatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggggtatgtttcatccgtttctttcctctactgttattttgatcaccgtgtccattttgggttatatgtattaacttcttgcactgtgcttgcaatatactccctccattccataatataaggcacaaccacttttttagatgttccataatataaggcatccatgcatgtaggccattaactatgaccatttctccattaaattattacttttttaaatcctccattatcatgttctataattctattggatgcatgcattgtatttattataatgatccaaactacaagatgataataattattttcttggtctttggattagggatggttatgccttatattttggaatggagggagtaacagattatctttggaactcccgacagagatgtatagccttatggactgaagctttacctgagcagcgaggttctctgtgttttgggaccagcaattcattgcaggttggtttgaaaatagaaaatactgtcactccatgcgattcttcctcgacattagtctgaaataagtgtaataagtgcctttggtgatccagattcgcaaaatctgttgtaattgtaattgatagctactagcatacaatgcttgatttcaccagggtgtacccacatactgccctcgtctggtatcggttggttctcgaggtaatctgactgtgaatttgatccaattattgtagtgtgtaacaactgttattttgttactgatagtgtaggctgcgtgttcacggtggtatcatttgcaggggtcccttggttctttgagttcatccggtaatctctgtcagaccagtgcttctgcagatcagctcaatgttgctacatggcaagtggtgctctaacttctccagaatatgcttccatgtttggttttgcttattgtgcccaccatgcataaatgatcgttgtaatttgccatgtacaagctacgcagcagaatactgttgtttcagtttagtatcggattgcttgtgcaaatgggttacagagttaaataagcttttaggtatctacagctgggggataattctgacaaatggaggaagcatgtctgcattgtcaaagaaagcagatagcaaatatagcagctttgctctagcaatgtttgattgatacagttctaggaaatttctgcagcctgagaaagcaatgagctgctcttaggctgataataagggagcgatggactggtagtaatgatgcatatacccatccagcttctgtggaagtgatgcattgcatttgcctattattttcgtagagttgcattcatcttttggcctgctgttgcttgttatgtgctgctgtcattcatgctatcagtaactatatgctaatttcatcgacgagaataggactaactcttgtattcctgttaggggcacctatatgttgaataatgtgttgggctcatatattaccatgatgattttttcctggtttatataggtctggaaatgtaacaagatcagtctcaaaacctcatgggcggaacttgtttctgcaaagcttagttgaagaagggcagaatccaagcactagcaatggtgccagcaactcccagaaaagtgttgaagataaggacctgatcgactgtctagagaatggcgtcaacttttggacggattattcaaaagttcagtatcatcctcagagtttatatgagttacatgggtcatggacagactttgacaagtttgataactatggcagcgcacaagaggttgtttcagactggtcgcaaatagaggaaatgaatgagaggctaaggttctttgttgaagaatgcgaccatattcaggtccaacttttccccagtaaattatcagcaaactctactatagttttgcaacaagctaatgttcacttatgcacatcattttcgatatcatgcatattttgagaccattatttttagcattattgattcataatttaccacagggcatccagtttattgtgggtgattcaggaagtttttccagtgtagctgcacagtttttggagaacattgctgatgattacacaaatacacctgtattgctttactgtgtgagggatccaatgacccttggatcatccaggatgaatcaaagggagtccattatgagagctcttcatgatgctgtttcattttcaaaactttcgtccttttgcaacctgatggtccccataggaccgccttcattaagtagaagtatgccctttgcctgaactccacgattttagtttatttttttattcttttttgaaaactttccattcgaacacttttaggtctgaggagttctcgtaagttggctaaatacacaggaggatactaaattgcgatgctattgttattctgtgattttataggacttctttccggtggcctagttttgcctttgattgctttcatgtatactgatcttgtgccttaagatactgcacttgattgcgtttccattaagagagaatcaactccttttgttcatgctgtatattcacatttgatttccatacaaaattactttcatgaattcccttaaaaaatattttcgtgaatgtacagaaagcttattccgaatgagattttctcacaaatttcctttcactctgtttcatcaggttacatgtcaccgtatctttatatacaagacgagaaaccattccatgctagtgctgtttgtgctgcagcaatacattcaattactgttccatttagattgcaacgaacgggcccgagttcagacttagcacattcatctggtaatcttgacattggtgaacttctgcacattttatctgatcaaggtcggcagaatatggttactgctctggatgtagcgatgcctgccccttctttgacaggtacacaacataacatatgccctactgttataccaacattggatggaaatttaatcttgcttgctaattgcacacatctaatttgcagatagagatgctattggggaacatagagatgaagctgcactctttgacccctgaaatcagcgacgaggacgaagatccttattcagttgaatcgctggtggttcatggagctcttgatagaggtctgcacgtcttatcttttgccgtagggtctgattaaggctgtgttcggtactggaggatgggaacctatctcctccgcatggaaaacggagtggtccattagcgcatgattaattaagtattagcttttttttttcaaaaatgaatcaatatgattttttaagcaactttcgtatagaaactttttgcaaaaaacgaaccgtttagcagtttgaaaagcatgcgcgcggaaaactagatggggaagttttgtcatgccaacagaacttatttttctactgttatattgtacaatattgaacatttcacaacattataggcatggtggctaaattttggttatacatgtagaagtacaaagaattaacaattgaaatttgtttgcacaggtgggcaaaggacttccatatcacaagtgaaagactcggtatgttcagtctacgaagccagagagacaaagccaaaattttcccatctctcagcatctctttgccccctccctgtcccccttccgttcccgtcaatcttcagaggcaacattggccggcacggggagatccttagcgaccatgcagaagaatcccagccaaagggctcactcgatattgaatcgataccgatggcggcacgattacgatcaagcagcactgtcctgcctttcatagagaggcgatcggggagcctccagaagcacggtgtcgcaagaggtgccatcgggtctttggtcctccgtgactggggcttcgggagggaggaggtggatgacatgggggagcacctagcaaagttactccgcccgtttcaccctgaaatggatcttacttcggattctgactagatcatcttcgaaaatcttacttggagaatcaagcatgatctatctgttgcaatgtttgtggattgttgcaatactgaatttgtttttaagagggttttcatatactgaaaattcatgctcatgtggctagctgttgtgaaatcaagaatgagagatctgaatctatgctatggtagaatttctttttcttgtgcatgtgcatttgagcatgggtgcaggctgtgtatgccacatgctgctgccgtgacattctgcggtgtttcaggtcaggtcctgatttctgtcaagtcaagcactggcttagctaaatttccgttccattttcattgtgatgcgaggtcacattccgtcggtctatggcagtttcacatgacactattttatttctgtaaaatttaactaaagttacttcattgcaaacataggaggtatgtatctggttttagccacactagcatatgcaattgtatcacggattttttttttcggtcagatacaattgcatgtaacacggatttttttttttggggggtggggtggggttgcaaaacatggataaattacttaaattaagaaggaaattccaaggcaaaacaaatagcagtgatgttcttcaaaccagtggcgtataagtgtcgcttaccagccattgaatcttaccggtcatttgaccgagcacctgcagagcagcgagatgccgatatcgtggttagctaggcaatgccatctgcatggtgcgcgacgacgggagccgtggccactactacttaaaaaaaactatttttacaaccaacctttttttttcataccgaattttttattcataataattaataatgcagaaattaaatatataataaagcaaagtcaatttttacgaaaataggaaggacgctattgcatagggcgtccaggtgtggacgctgttgtagaaaacgtccagatggggacgctgcttacaagggcgtccattgaaaaccccaaagagccgtccaattcaccggactaagattggactttggatccaatcacacaatggtcgaactctgcctcgttactcctatgcagactattgtctctcgttgattgcttgcttgctgagcaggcaccgctctctacctgatctgccagacagggtcgccatcccccggccctccttcaatgcttccgctgttccgcatgacggacactctactcggggtcatatgtgaacagccaccacttttattttgagatatttgattagtttggtttttgtgctggtccattgtttactacgcatcgagctctttgctgactgaatcttgagaagcggccgccagatgtactgcatgcgaggtcttctatcgatgcttttttttttccttttgcaacaggccagagattggaagtcatcgggcgacagatgatctgatagaaggaggatgtttgcgtcctacccttcataattttgcattctttgtaaactttctattgcagaacatatacacctgaataccaagatctatgaactgagcatacttgctcggccagccacctggagtgaggcgatacctggtcttgctgttaggaaccaagaggggcggacagacgacgcaatacaagccggcatgagtgggttattgttccagcatgactcaaccagaacgtggatagcggctgcgatctcccggcgtgaaggcagaaagcggcggcgtcctctccagattcgagagccttcgaggtgagttgaggtgaactgcaacggcagattcctgacgttgtggaggcggaagccggaaggcagccgttgcagtctcccagagtcgaggtgaacggcggggatggcagcaccttgcctgagccctgcaccaacattgggcccgaggagaggagagtcgacgatggcgcctctccgcatggcggcatgggcgccccaaaccgagcctggacgtgcttcggtacaacgtccacctctggacacttcttagaacaacgtccaaatctggatgccctttgaaacaacgtccatcctatttttacaaattcaatttaagatttaccacttatttaattcaagacttattaattactataaataaaaaattagtttttcataggcagggtaaaaaaaatattgtataaaaatcagaatggagatgcatttcttacttgtgaaactctacaatgtagagatgtgctcaggtgggactatttgaaattttcctaataatctcatcaccttacgagagagcattgatgaaactcaactgccactaagtatatgagagcactgatgggtccatatttctcctttatctgttaattctctgatagaaaaataatggctggacaggataaagtggtagactaatatccgatggtacattaagtttttcaaaaatacatttatatgcttttgttggcatggttcctcgtccactcttaccatgaactatgagcaaaacagaaacctacggccaggcacatgcctgcaattaacaccaaatgcaaccaacgctatcaccattgttctgctcaccggcagtcttaccgttgcctagtcacccttaaactatgcccagtgcccaccaatcactgccaaagcccaagacatcaggatcagtagttgcaaagcactagatgggccatggcgcggcgccacgccgcgcgcaagattatatcagtaataacatgaataatacaggatggtacattgcgataagagcatttacaataatcatctaggcaaaacagataggtacaaataactgacaaattattaatacatatacgcatgtcacagtggacatatttttgacaaaccacgcattatgacaattgccatcttcaaacaagaggcaacgaaattgtcttcaaacatggttacaacagtatgacatcttttgcttggtttccagctgaagactaacaatgatcagtcttgtaagctcaccctattagtgaggtctctgagaaacaactccacttcagtgaacaatgatttggataaaaaaggagtttgctctgttcttttgtcatgtatatatccccagtatgttgacctgacatttaacaatatgagatgtagtaggtacaacaaatttaaataaaaagtggtttgtggtgcaatcgtttttcaatttactttaaaactctgtaatgtacaattcttcatgaatggatagcaaagaaattgtatttttctttctgaactggaatgacctcgattgacgttctcctgccaaacaatacatcatatataacgtggggtaaaatggcaagtaagttagcaaccctaaaaggaactatggcagaatactctcaaatacaaaaacgagaaggaccggagtctgctgctatctgcttgtatcatgtaagcgaaattttgaactgaagggtatggtacacatcaatgcaaacatctgtgttgtttggtacatttgcactgtcctgaaagtaaggtggaaaacaacaaaaccatgatatgacaggtgaggtggcaccaaatatcaagtgccaaaatgaaatatgtgctgactgatttatactccctagtgtccttttttacttgtctagtacactgcgagagtgtcgaatacccatgtttttaccattctatttttctaatcatatatctataagaattagtaaaaagataactacactgccaagtcttaatattttttgatattttagctggtaaagaatctgatgtttgaatctttgattgcatgtatcctaatacaacatctacaaagaacagaggagatatgttttgtggtgccttgaatggtttgcactctccaacacagtacatgatgttcttcaattttggcaccgggccatccaaagagcttgggaatgcaatacttttgcagatgatggctaacacttcaaaggaaagatgatgcatccaaatccagtaggtcagaatccaggaatcaaacaacattttcattgccatgtttcatacatatgaagctagtttgtccgtgaaaagtagctatggttcagatatatcagtggacatgtatttagaaactacaattcaagtggcaaaaaagcctaagatcttcatttcaccatctattcggtgatagatgttgcagtcaattaccttactttctgttcagaattgcacttgcttgtttggatggtttagttcaccctagaaataaactcccctcccctattacacagagggatcatttaccctctcgtagccctgcaatatcccatctaccaattacaactattatcctagacaacatctcatcttagacggtgggctaggtgtttccatatcccactctagaaaaaaaaaaaaaaacaaaacaagcccattctcttgattatttagtatcgactccaaaatcagagataggtcgttgtagtcaatttccgctacccaaatctccagatatgaagcatcgaagaggtgcaagaaactatctttgaattaagatgcaatttcttttataaagttgggagatctgaatgtgctcacgttgacgttgtggtgggcaggaaagaggtatgtggtgctgagctcgtcgaggaacatacagcatgcgtgcgcaatacgcacggccgccaccatgtcgctgtggagcatgttgtacgcgttctgcaacatcaccactccaccacgtcggtcagaacaggtacccagtagcaacatgccggggacagctcacaatggaaaggaaatgcatggttccatgtgagataaagtttactgggctcgcatgagtattgctagtaccgatcagtgcacactcagtttgcagcaattcaagttgctggacgataatgaccctgaactgagaaaccaagatatgataggaaaagttagttatggattcaattttcagtaagtgttgacacatgttgtaatacttgaaactttcaaagtttcaagtaacaaaaagaaatagctaacaatgttccattctaaacaggttgttaatcggatgattgacatggattaattactccatgcttataatgatttgctaaaaactttcttaaactacatcatttgttaggttgataatgtgtaatattaaatttatcaatatgaacaagtagatcatccatttgatttcatccgcatttcatcactttagaatgttgcctgatgtaaataaactggacaagagctgctactatacaaaaatagaccagactttggttaattttttagatttaatttctgccctggatcagtaaagagcaggccctgttattcatcagtccttccctagcgccgtttagaactccgaaaaaacgaatttcggcagagcatttcagaataaaattttacctagcagttagaatgaaaaaaggaaattaaccaaaatttccccgatagcagtcaaaacgtgcacacacatacattaaaatgatcaaagagcggctccttgaaaagatcgatcagccaggcaggcatctggtctgatacatgattatagcagcgagatgagatcgatcgaaagcaggaaggatttgtatggtcaccttgtgttgatgtcggagtcgatgaagagatagtcgaggacgcggatgatggtgccggcgcggatggcgcgtgccctgatgaggtgagccatggacgcgaccagcacccccgctccgacatcgccaccatcaccactccgcgctcccgatcggtagtgagagtgagaggaggaggaatgaaagtgaaatactcatatagattcctcccaacaccgccaccgccggtactacctccaaatccatcgatccagaagggaggacggcaccgggcgccggctccgacgccgccgccaggagaggagcacgggacgcggccggcgctcgtgcaggcatgaggtcgggaagaggcccgagataggggagaaggggggggggtggcgacgacgggtggaggacggtcgacgacggccgcggcggggggagccacgcgtcggtgaaggccagcatcccccgccgggcaacctcacccctttctccatcggcgttgtcctcttcatcctcccatgccgccgtcctctcccctcataccctattcaatccggcgcggggttggctcgcgcagatcgagtcagtgcagatcgggacgccttgtccccgcccgtcaccagctcctttctacccgcacctgacaccgccaccaccaccgcgttgccgtcatccccgacgccgtcgaaaggggatggaagagggaggggagcaccggagccgactcagacgccgccacgaggggagggggaaaccggcgccggttacgccaccgccgcgaggggagggcgaagaagggggaagggggaccggcgccagatgacgcacggcggcggcgggggatggcgcacggcgaccacggggggagagcgaaaggcgacgtcgaggggaggacggacggcggcggcggggcttgcggcggcggcggcgctgaggtgagggaacgaggagggtttggggattgggggtaggggatggatgtttttcataaaaacccctagaagcggaattttctcttcttcacattgtatttcgctgaaatacaaggggtttttcggataaaacatgtcgggttgtcagtcggtttaaggaactgtgcgatattttctacaaacacgaggagttttttgcaaaaatagccaaccacgcttatcctccccgaggagccgaaaaaaattccaaaaaaacgagaaaattcgtacggttaggggtgttatttagatccctccaccggaacgaacccttgttaaacaataaatgaggtaccatagaaccataatgagaactccgtatcaatcttggccaaggtaaattagcagccatgtaaaacttgcttaggtgttttagcagtagagctatgttatgtatctacaaatcctatataactatccccattagctgtgatttggtgcagccacatttcgattaattaaatgtgagcattggatacttatgtgattgctagcaaaactttacttctccacataggatactctcaattaaaacaatgtcattaatcattgctctactggcccttttgaatcataggaatgaaaaaacggagaaatagaaaaaacacaggattctgataggaatacaagtgtaaaacagataattgcaaaatacaggaaaaatataggaacgactgtttgattgagccgcagaaaaaacacaggaatttgaggagagataaagactcaaatgattctttccatgaggttctacctcatgttaaatttcttccaaaacttacatgggaagaggcattccataggaatttcataggattccataggatccattcctttgattcaaagggctatataggaaaaaattcctataggaataaaatcctctaaaattcctatgaatttcctttgaatcaaaagggccctaatgttctctctatttaatctgggaaccaatattgattcaagttgtaaaatatggtgatttcatccaattttgtcgtctcaatcaatcaccgtacatccattccatcctcttatctagtacacaccaagcaagaaattattcgcatcccatcacataagtgtgtaaaaccataagatattgtatacccctttgagtgcgtaaaaccataaggtattgtatacctctttgaatcataggaatgaaaaaacaaaggaataggaaaaacataggattctgacaggaatacaagtgtaaaacaggattgcaaaacacagaaaaaatataggaatgactgtttgattgagccgcaggaaaaacacaggaatttgaggagagataaagactgagggcccctttgaatcgcaggaatgagaaaacataggaacaggaaaaacacaggattttgataggaatgtaggaaaaacatagggcccctttgatttgtaggaaaaatgtaggaattttggaggatttcaatcctatggaaaaaaaatcctatgaaggcctttgagacaaaggattgaatcctatccaatcctttaaaattcctatggaatgggtaatcctatgcacattttggaggaaagttagcaagaggtctaacctcttggaacatttcctctgagtctatctctctcatctgattcctgcgtttttcctgtggtccaatcaaacagccattcctgtgtttttactgcaggaaagccagccacgcctncaccttgacagctcagtcggagaccgatgtgtggtcgatggacatcttgcgggacgactacgaaccatgtcgcgggcgccggttatctttaacagacaattttgcaagacaaatntcgggatattttatttcgcaaacccaacaaaaggggggggggagaaacggattgtaaaatttttcttttttccaaaaaagtaaaatttcgcctgattccgaatccgtattctaaaattat

SEQ ID NO: 34210 - DNA, 11858 bp, Oryza sativa
  unsure (1)..(11858): unsure at all n locations
cgctcaagactgcggaggaaggccccggatgacgcaggagagccccattggtgccagttaaataaagtgggggaagcagccaacccaaaccccgtgggagaagggccgggactctcgcgcgccccttgggctggataaatattgcgaggccgccgcattgtcccctgccatttggtccatggcgcgaacaaaaataaagtgtgttgcaaatggttcgaacgcccaaccagctggcagggcacacagagtatcgcgtcagacaccatgacacctggattcccgccgccagcctggagagagccgactcctttgttttttcattcctacgattcaaaggggccataagtgtaaaacagaggattgcaaaacacaggaaaaacagagaaatggtagtttgattggcccgcaggaaaaacgcatgaattagaggagagataaagacttaaaggaaagtttccaagaggttttaccttatgttagaattcctccaaaacttgcatggtattagccaatccataggaatttcataggatatccattcctttgattcaaagggctataggattttcaaagggctatataggaaaaaatcctataggaatgaaatcctctaaaattcctatgaatttcctttgaatcaaaaggggcctcaaaggattctttccatgaggttctacctcatgttaaattttttccaaaacttgcatgggaaaagacaatccataggaatttcataggattttataggatccattccattgattcaaagagctatataggaaaaaaattctatgaattttcttttaatcaaaagagtcctaagttgtataaactccactgccaagtgcgtatggtccacaaactaccgtataaaatgtgtacagattgccctccaggctcctgcggtctcagttgacaagagagttgcgtacctaatcaccaaagtgcactcagatgtgcacacatcaatgacgaaaataattttaaagcgaatcgtaatttgagtcattttttattaccagatttttattaatcttgttactttgaattaagtaattttgctttttacattttgaaccacccaaccctatattctcaagcacacatcggcacacccacgtcaactatcttaccccagccacactatatagttagggtggtaaaccataaaaaagaaaacacaattacttgtttgaaagcgtaaagattgagaaaaggtagtccaaagaaaactttgattataaaaagtgaccgttttaagacgtgcaacacagtgatgtgtagtaccacatattccctccgtccaaaaaaactcaacctagtactggatgtgatattttctaatacaacgaatctggacatactcctatccacattcattatactagaaaacatctcatctaatactagtttttttttagacggagggagtaaaaaacagctaaaaatttgatgtacatagggagataaagaaaagcatcatgtaaagtaatgtgcactatcgtgtacggtttggagcacaaaactcgcccttctttgctgcgcgttcatcgaaccaagttatgtggtgctacatggcacgtgtcgcacaaatcaaaaatatatatattcagcaccttttgtgtttggtagtacggcactaaaagaaactatattctttcagattacgcacgcaatgctctatagtgcttgtcaacgaaatttttgactcgcaattgcaacatctcaatcaaccaacggccaaagcgacatcagaactctgaagacaccagcagtaaaactgaaactcatacgaaccgcaccaggctgcaacgcaacgcaccaccatgcaagttaacatctctttctttggatttctatcggtatgtatccggggtaaacgaactacaatgtcacatcacatgacatggcatcccaaggtaaaatgtgcgcaaccacagggccggaaaaaattgcaacgcccacaaaagccagaaatccttttgggaggattctgcatcgggggagcaccaccaatgcaccaatggtaactcgacgctactaaataagtatagctctagcagcagctgcactgccatgagcagcttctctatcttgtcgaaagcttagctttgcttacttggacctatcttccttgtctacggtaattcctgtggtgagtattactggggccatctctggaagatggatgatacctgctcttgcgttctttgtactccgcagcttcataggcagaagcagagtggtcatcaggctcagaactacagcaaaagatcagagtacggtttttttaaccagttcgaagagtaggtgaaaggataggaacacatgaagcgtcagaatatatataccttcgctcatgaaaaggtttggccaactggtgacgaagaggcaccacttgggagcttgcgggggctgcatcttgttcctgacaaaaaagaagattctacaatcagaatcaagtattacaaagaaacttcattccaaacactagtgctgtagttttgtgcttacaacatagcattcgccacaattacacatcccaggggaacttgatgccatcaacttacggccctgggaaacataagatcaaatagttagcatcactctgaagcaactgaatttataggaggaagtgtaaaaacacaacctgactgaacgattcctcacagtgggatgctacttgggaagatgaaggtgttggctcatggtcctaagaaagtaaaccagctccaatgaacatcaagcaatggataataaaaccagatagtgtttatatagtgtgcttactgtcttatagaaggcactggaactatgatcacttggattacaatctgggcaagaatctctgtgtgacctctccaggtaggagtgtccatatttactcctgtatgcatctcgctggatggattcttcatgccttgagtgcctatgtcttgggtattcattagtatatcgactatcaagatatgcttccctgggccttgccctctcatacctgtggatgtggcctacaaccaagtattggaaataaacattcattagccttggagagaaagaaaaaagaaagaagtttatttagagaagattaaaggaaaccaaccagatactgcagaatctcttctataatgagatctgtgttctcgtgatgaaacgggcctttcttcaacatcaattgccatacgatgcatgtggcgatggtatttgtcatgaacatgattgcttgagtaatcacgtcttgcatgacctgaaaacccaaatcccctatcaccataacgttctctattatggtaacgttctctatcatcatagcgttccctatcaccatagtgttctctatcaccataactttttccaataaatcccctcctgatgcccaacatgggagtaatcccttgccatgaatgttttttcaaagtaggtctgggcctttgtaaagaagccttgattcgaacctgaaaatattgacctactaagtaacagtagctggagcaaataaaccagaagaaaagcacatctaaaaacacctcaagtgattacctttccgctaccttcaacaataccacctttactaactgtactaatgcaatctaaagctgattgtcttgaagtaaagccaatgaaaccaaaatcttttcgttttgctttaaacatgttcctagcaaggtgtatactatcgatttcaccaaactttccaaacacttctctcactttgtcttcatcccagtgaggtggtaagccatccaagaaaacagattttacctgcaatgcataatcaaagttatagcagctaagtcaaagccaagatattccaatacgtgtaacagattcatatagtacaaaatatagatgccttgtttgtgtgactaccttttccataatcttatcatccagtgaaagagtttttgaaaaggacacttgggctcgaacatccgtaccaagataaatatctctgttctgtagtttaaaaaaagcatccacaccatcaacatttgtgcggaaatcaagaaacgcatagcctctgttttttccttttctttccggatcctcgactaaattaatatcctcaaggttttccaacttgtaagttttcagttcctccgctaactgcacagaagagaacccttgtagaaaataacaatatgcttgtgacaaaaattacaatcaattaattaaataaggatgaaagcatacatcatcttttgtccaatcaaagcatatattccgcagatgaagggtctcgtttgcatcattcttgcatatcatacaagcttctcccttgacctggaaaaacattattactgatcaataaagatatcattatcgtctaatagaagggaaactaaaactaatgtggagttcaacagacttggatctaatgatctaacagttcattgtgggagcaaacttcacaatgaattggcaaatatcgcggagtataataagcttggcacatttgcattgtggctctaattgtgactcttaactaaagtaacaacttcaacagaataattagttcataagtgcagttgtcctctagtttagatacttattcgcatcaccatttcaatagaataactagtatagtgaccagtgcttaaacataaaaccataacataaatgcaagtatgctaacttggacttgtgcacacattggcaaaacacattttagtaaatggatgtttgtgtgtgcacatatggatcaattgcagatttttatcaagtatgcaagtttatacattttacattcaattcaaactgatgctacaacaagataactgagattcaatcagtttgaacttatccgggaacatcgaaaagtattcatgtaagtagcatctttaataacgattgtcctagtgtttgtcctgagcgtgaggcagtgtggtacaaattactccctccatcccaaacaaaggcaatctagtactaggatgtgtcacatcgtagtacgaggttgagtttttttgggacggagggagtaattaacagcatttaaaatatttataaatagcacaacaaattatcaggaatttcccattttcattgggtaaatctaactgagtgcctctttttccaatgacaccatgaatgaaatcattggctattaccatattggcttaacaaccaaaaatatttgctcattgcatttagaaaaatgagcgccaaaatatttgctaatttagtttcagcttcttttagattgccacgtcttggtcattattaccagatatatgaaacacaaaacgcatttaagaaggcattccagcaggagtcgtcattaaaactatccgaagcatcaagtactgacaaatatgccattacaagcttaacgtaatatgaccattaaaattatgtttggataaggcacttggcgggaaagcagggtggtgcataggaccttagtgggaaggtgacacctagcaccacagcaggtcacatcacaatttagaacagtatttttcaaaactaagacttttaaatatctctacgactttagttcaataggtgaaccaggcacatgctatgaaatcaactaaaaggtaccattttcaacctggctaatctgtttttccccaattttgtggtctgatcggtcacttaggccttgaaaaacaagggcacataccatacatctacttcctcaacactaatcaaaagccctgataccacatccactaatttaaatcttgcaagccaacaacaaaatgaaatcacaaggataaataatacctaaatttagtaaacaaaaaacattccagaccactaattttatcagctctacttcaagcatgactaaagcaacatcttttcccaaactacttaatctcattatctaattccacatccactaattcaaatttcacaagccaacaacaaaacgagattgcaagggcatagattacctcaaattagtgaacaagaagcatcccagaccactaactttatcagctctacttcaagcatgactaaagctaacactttttcccaaactacttattctcaacatatcaaattcgcattagatacaactctatccaaatcgaacgagtcggagatacgaatctagtgcaggggggggggggggggtggacacaataccatggccgtgcggacgtcgtcagcagcccaccgcgcctgccaggcggcggcgaatcgcacgaaggcgaagcccttgttggagcgcgggtccgccggatcccgcacgagccgcaccttcttcacatcgccggcgttcgcgagcgcccgcgccacgttctcctccgccgcgtcccggggaagccctcccaccaaaacctcgcagtccttcctcttccttctcaccttcccgtccacctccttcggcaccggcggctcctcctccaccacttcctccaccacctcctcctccatgatcacctcatggggctcctcctcctcctcctcctcctcgagcactaccacctcctttttcccctcctcaacaacctcctcgggctcctcctcctccgcctccgccttttcccccttctcccaatcccaatcctcgtgggcgacgttgaggtcgaagagcggccgccgccccgccatctccccaccggtcgccgccgccgccgccgccggcgacgagcctagggtttcgcgtttgcgtgcagtcggggtcctatcctcttctctccgtcgcgaagagaggcagccgatggggggaggaggcgggggcagccgattgcttcctctgtgtgtgtgacgcggcggccggcggcggacgacggcggcggcggaggaaagagcacgcggcggtcggcgggggcggaggagagaggcgcctatatatatagggactcgtgccccactcgctcaggtggccggtgggagggtttgggcccgaccaagggagcgggtgtgacccacgcgtcactggcactgtggagtggtggggacggcgagtaggtgccgggtggggtaacaaaacgtccgtggggccgaggcgtgacgcgtctttcgggaagcgggtgggccgctcgtttgacgggtggggcccgtgggtcagtgagggtgaggaatctgggcccccaccggtgcggggtgcaggaacgcgttcacacgggccacgaatgccacgtggaacactggccccgtcaccgtaatggatgacatggatgcctacgtggatatagagagaaaggttgggagactggagagggaggatggagaatttttctatgctcgtagaagtaggacaaaataggtatatttcccgctcttttgctggagactaatgtcgaaaacgcttcatctccatctggcgtacgaggaaatattaaatgcatctgtctcacttttatctaatcattatctacatctccttttctttccaatagtcaatcttattcccactcccccactcccggtcatttatttttccccttctctccccatagcaactggagcagctatggagccgagttgctgagaccatcgctaatgctcgatggcgagcatgaggcgactcatcttgctctgcaccacattgccaggatgtagtaggccggcgttctgaccatgctaagctcagggcgctagatcaagggaggggaaccagcaatgaggggactagctcagcctcatcttcgtcaacaacggtagtaggaaggacagtgtacgcggtgtggatcatctagagaatgcaatagagtgtcttcatggatggagtataagtaatccggtgccaatacggtggcctgccactagaaaggaggaagaccaaaaatttgcggtgtttttctttgtgtttcattttttttcaaagtatttggatatttcagtagctcaaaatcgatgtttcatgtgttatagcaaaatgcttcaagaatgattcgattgtgtttcactgtttaaattgttgaaacattttttctatatgttgaaccatgtttgttcaagggctgagacatttttgtgccatgcaatgaaacattattctctatattttgttgaaacattttccatcaaacgatgaaatatatgcgacactttgtaacaatgttgtgcaacaccatccgatgttttgcaaaacgtttgacgtccgatccatagtcctccccgactaatgtacttcaaaattttattattgttaatgttgtggcaaattattttgaaggagttatgaagttatagttgaaatattagtggaagaagaataataggtactctgattgttcactttggaccagagagcatttattatgtgcaatagaaagtttttatatgataatgtttcgaattatgaatctaatgttgtaagttctatacatgttatgttaactaattattggtatactaaagattgattttctaaaatcaaaatatgctacacatcttaggaagtaatttttaaagtaattttcacaaaattatagatattttgattaaactatcacaaaactatatatttaaagtgttgtatcgtaaaattacagattcaataccaaattttaccgtaaaactacaaagttaaggctaagcattacaaaactacatatttaatattaaaattagcatagaactacagatttaatattgaaattatcacaaaattataaattttagagttcaaatctctagcactacagttatgttagagctataaatgatgcagttttatgattatactagaaaaaatacttgtgcattgcaacaggtaaagttatagatgcagttttatgattaaactagaaaaaaatgcttgtgcgttgcaacaggtaaagacgttctttcactggtataacagctattaggagatgagaaataaactaaaacattgggatcactattgcactataattgaaaaagtaaattaaaatccttccttggttttgtgcccaagcaataaattaaaacatgggatcactatcactattacactattagaagccttatgtattttttattagatatatattggtattaaatctatagttttgggataaatttgttactttgtagttttgtgataggctatcttaaatatatagtttatgataaatatactgctaaatcgattccttaaatatgtatgtagttttgtgatagtttcatcaaagtatatatatagttttgtgagatttactttattttttaactggaatttacttgaacatacaaattaaatgacgcacgcatgatttgctcggtttacctatattgttgcaatgttactgattacacacatgcttcctgttgctttcaatttcgactaattaaaccgcttaggctagcgtgatggacggattttccatggcagattttactgtagatatatatgactccgtgcggtctaaaaaaaaaagatggtaggtagacgcgtggtttctgttcgtggtgctggggttttacgctacgtggacagcagtggcggaactgaggggggctggcaggggccatggccccttccaataaaaacaaaattttttattacccccatatatcatagcagattcagtgaataagcaacagagtttctcactttgtgtacatctttggatccaagtgattcattcagttcaacattgataaagtgtgctctctagctttaaagttctatcctgctgattttttagaagagagagccaatttgagatgtcaattacgtcactatgaacttgatgtatccacaaatcctaaattttaaaatctgacatctgtagctgatctttgttgtcgacttttgcaaactattcgcttttacgtgttgccaatgcatgaaagaaaagagaaattgctaattttttgaactgtcaaaagccggctggcccccctttgattttctgtccagctccgccactggtggacagctactacttcttctagcagcggcagattgaggtattaaggggtgaaaacggtatgaaaattttccgaccgtaccgataccatttccgtaaaactaatataataataataattttaccgatgttaccgttttcaaaatttagtttttttaatttctgtcagcgtggcattaaagttgacactaaatagatgaattcataaatatgaaaatttccggaccgtttccgttcgttttcgaaaaaaataataaaataatgtaccatttccgaccgttttcattccccgtattatttatcctgcaacactcaaacatggactagtaagaccctctttgtttaggcttataagttaacttatggccgaaaaatctaagcctaaacaaacaagtggctgttttgtttggcttttttgaagccataagccactctaacactattaagtcaaaagttaggttggataagttttttttggcttatatgagatagatgcattactccatcattaaacttaggacattaaatccaccggcttgtaaatcatataagccaataagctgacttaaaattctaagacaataattttaagcctaaacaaaagagagcctaagtatagtagtagcaactaatctgaagctccgatgcaatcatatactccgatccgtaacacacagcagcactaccctgtgagaattggcaggcacgccggcgccgcggcaagactagatccgagcacgcgcctggaacgccgagaggccaaccagttagttctctggcgatcctccctccctccgtcgcctacaattgcgaggttcctgcctggctcatgcagaatctagctacgtacggggtgctcagtgctcaccttgatgtcctgcacatagaacgagtagttcgtctccacgtacgagcccttgaggttgtcccaccacgcgcgcgaggaaccggaggtcgtgcgacccatctgactcaaccctcacgtcaccaagaacggaggttatctgattttgtaaaattagaagcgcgttatatttggtattttgatttagggatgattttgaaacttgaatataagatgagaaaccttaactgtgaacctttttttctacggcttgtgctgtgaccaaagtgtgcccagctaattaaagagtaaacataggaaaacaaaataagttcactttaggtctctcaatttgtcaccgagttcgaaattcgtccctagaccgcaaaaccagatacaacacatcccccaacttacaaaaccaatacaaacgaggtccttcggcaatattgcccttggttttggctgacgtgacgtctacgtggctcctttgactaagtctttgtcccgtggcattgacgtggcgcgtatataacaattcgatttggaaaaataataaaacctatgggcccacatgtcagtttcgcacacagaataataaaaacggtgggatctatgtggccccacatgtcatctcactactctcctcttctctctatcccctctcatgtcatgtggccgcacatgccgctgccggagactatcgccaagcagacccgcacgagcagtgtcatgaacttcacctttttcttaaggcttctgcagtacccgtccgtacggaaggagcatgtccgagaccacgtcagtcgtttgtcgctgaaccgtactcgttgaacctattgaagtgtggtcgttattgattcaggccaaaacttagcacttatgttctggttttggctctaaaaaagctaataatttatttgggccttttgatcacctatcttctagcaaaatcataataaattattcctatcggtaaactcagtgtgatatttttttaaaaaaacattggttgttgctctttttgctcagaataattccatttttgcaaatcttttttctgcaatgcacgggtgctatttaatgccctataggaagggctgaaattttttttaaaggtccccatctttcaaactggcaatctttggttttttttttggggccctcaaaccaaaggtattaaagacttn

SEQ ID NO: 34211 - DNA, 16142 bp, Oryza sativa
  unsure (1)..(16142): unsure at all n locations
agaaaatagggtcaagtagttggcaagggtaaagtgcttgtccaccgagagaagaacaatcaatggtttatttaagtgttaagcaagcctccgcaatgtacatgttcacattttttttgatatcccaaagggaataatttaaccacttaaagtataggtttctttttgcaaagtgatggacaaaaaagaaagtatcgcttggctaaatggaacgtaatgtctaccacaaagaacaaggggactaggaattcatgacctagacataaagaaatacaacttgattcagtaaatgactattcaagctgctgactaaagatggtatttgccaacaactgattgaaaacaaatatttgggtaataaaccactttagaaagttcaataaaaggtttggaactcaaatttttgggctagcctcgtaaaggtaaaattaatttttttagtttagagtccttgattatcaagatgactcccaagttaggttcttgaaagtacaagtggttggtaaatttcactttaatagatggaaaatcgttgacgtgcccactattgttaaggttaacgaagtgctcttgtcatcggtcgggattagcacagccctaacagtaagataacgctccccacagggctcgtgcgggcctgaataacgacagtctccggcagcggcatgtggggctacatgacatggaggatagagagaagaggggagtagtgagatgacatgtggggtcacatggatcccaccgtttttattatttttatgtgaaactgacatgtgggctccatatgttttattatttttccgagtcgaattgtcacgcaagcgccatgtcaatgttatataggacgaagacccagttaaaggagtcacgtaggtgccacgtcagccaaaactagggacgataccaccgagggacattgtttgcatagttttgtaagttgggggatgcgttgtatctggtttgtggttaagggatgaattttagactcgacggcaaatagagggacccaaactgaacttatttttaggaaacaaattgtgaacaggctaatggcccaactagccacatgggcacaggcgttgtcaacgggcggtcatatgctttgcgtaccaacatgtgtccccttgcacttagatgggctaatgtaccaactttgtcacagtatatatttagctatataacgaaaaatggttttatcatagatattacttactaccagatacagatggatatatgatgtcaaaccagtattgattttgttacgttgattgcgtcgtttggaaatgcatgataatgcatggcatgggtatagattaactatgaaaagttgcactacttgtaatatatcaggtgattaaacgatattactaattgcacagcatatataggtccgttccatattattgtcgttttttttaaagttctctagctttgaccaaatttttagaaaaaaaatagcaatatttataacaccaaattagttccataaaaattagcattgaatatattttgataatatacttgttttgtattgaaaatgttcgatggcgctaatacgcacacagcgcgtggaatattagttcgagcgccacacaacactccctcgtttcggatttcacttttttaccaccacacctgtcctgtctgttttcttttgttttttaccaccctactttccgtgtttcttttttctcttttttatctcatctgtgcttcatcaaagggccctgtaaaatattaaccatctatatttttccatttttcgttgcttctctttagtttttctgttttcgcgtcttaataaaatatttaccgtctagtttttctttccgagttttctatttttctagtgtctttacacgtttcaaaagtaacaaatttactctgtggagtttttcatttagtcccagcctcccacatttgctcattcaaaagcaacaattttactcgcatgaatgcccgtttcaaaagaaacaaatttacttgcatgaatgcgaccacagcgcacgtcaccattcctagacggccgtaaaagaattactactagcttacaacgccagtaattcttttaccagtgctataaatattgtttagacttcgtggtctgcgagtaaaacaattaccacattcctcttgatattgcccatgatctcatagtcaccgtatagtaatatatttactgatgtatttaatacacagtataagagtaaaaactgatgctaagagtattgttaatttgtatcataaaatggtagtacgaatgaaaaaattaccggctcaatcacacacgagtgataaaattacccacaagtgaatcaaactagaaaagcaaaaaacatgattcagccaaaaatctattgtgaagctgggatcatggtggctttgccgaattttgctataaggatgaagagactggtctgtgccttgtgactagtagtggagagggcaatcgggtggcgagcggtagtcgacgatagagtcatggaaggatgtagcggtgtggtatagagatgagcttgacactgcgcagtagcagccatccatctctagcaagcacgaaaaaaatgcaaaaacattctcgttcatgtcatagagacgacgagaaaaagaaaaatagcgaacaacctccatcaccggcggactccaccctatcctctgcagccagccacatggagcacgatgtgcaaatgtaggacctgtgtagcccatcaattcagatcaggtaataatggagattgcacattaatttgatttgcaaaaagaaattggggcttcatgtgtgaaggtgaaggagagtatgcagatgcaaattggagtgtcatttcctttcttccttgttatgtcaatgtcgccgacgtggagcaatcgccagttgttgctcttggcccaggtgaacacctccttgctagttaaggtgttgcccggcgttcgggagcgaggcccgaagcaatgacttcgcctcaatagccaccggccaccgccatcaaccacaacggtgccgtcgtcctcctccatggtgcgtcaccgatctgtgagctgggatggtggtgaaagatctatgccctagggttgtcttgtaaggggaattggaagatttatgaccctaagagtgcggtgattgttttggtgattaatgacaacccattgttgagttccggcatcaagttaaaagaccgaagctagaagatggacattataccttgatgaggagcaagtgaagacattgatgatgcggggtatgaagtgtgtatctatggcataacggtgaagggcaaataaggctcggttacaattggccatgcgatggtgaagggaaaacaagaggcttggcaccgatggaccaaatccggtggtgaagagtgagtgaaggctttgtcatgatgaaccgtacgaggccatttgaagctatgagtaatctgtatcaattataagatgagtggaagatggaatgtcgaaaatcaagaggatgcggttcttcgatgaacatcaagtcaaaagccaaagtgggcattgatcaaggcaaaagtataattgatttgggactaatgtgcttaatgagttgtagatgagaatagtcgcaatggtaaaatgacgtttacgttggcaaccctcaaggtgaagcaagaagatgtcaagaaggcattcatagtggtataacttttctttatgcatttgagtataggaatgtcgtactattaagagggatgcaacattgatgtgtttgtttatgtttcggtgttcaaagtgacctatgcaagtgctaccttgagagaaaccaaagctttaacctaacctatgagtggttttatagcttgtttttggttgggtttggtagccctctcaataagctttccatagagcccaagtttatcgaaaacggactccggagcaaggagttatgaccgtttttgtgaagtgatgttagggaagctcggaagttctgggttctgagccaggaagtttcgactcgatctatctgtttggtcgaggagggtgccaggaagttcctggtctggacagaaagttccgggccctgttatgtgagtaacggctagtttttggagggcttgggtttttaagcccctccaccctctcatgtgttggctgctgagtttaggcaagaatagacctatccaaagcgaaatagcccctcccaaacctcctaccttagtggtagatctttatgagtgagatttgggaagagatttgagagattgagaggttccaaggttgagagcttgagagatacactccatcctttgagcacttagttcatagcaagtaaattatcgtttgtgtttattactcttggaggttaagcctcctagacggctaggcgttgcctggtgagctcccaagcttgtggtgagttgcgggaagtttgtgagggcgttattccacctctgaaaggaaacggaatacccggtgagtggattccgagctgaggtttaggaggtcgtcttggtagagcaagcctcacttgtggtgttctcttggtgttctagttggggatcttagtggtcatttgaaatgaaagagaagtatctaggggtgttggtttgaagattggagacctcttcctatgcctttgcttagtgaggcaaggggttaatcaggacccggctctctggagctcctcaacggagacgtaggattctcggtggagcatccgaactttgggaaacagatcgtttgtctcctctcactctcctaatctttataattgtgatgcttatccccttatttgtctaagttgtgctatcgtgtctccccttgtatgatcattgtgctatcttgtgtagtttcatgtgtattactcttgtgaattaatttccttgttgtgaggtgcttgaaagagcaactcacaactacctggaagttcctaggaagaatcccagaagttttgggtagctttctctgctcggtagaaaaaactgccaggaagttctgggccttttgccagtaagttttgggccctaattttaaccgctacgatgagaagtaaatttcatgagtgcctattcaccccctctaagcaacatcaaggtcctttcaggtggatcgattcagattcgaaaaaaagaggaaaaaaatgaaatgggggcgagagtggtgctccatggtgcccgggctccatgattcaaattgagtacatactcaattcaaatgagtatgagatttttttaaatgtttaggtattaacattaactactttactaactagttcaaaacaagtttgaattgaatttaaacatgtttttattatattttgattctaggtatatagcatccaaacatataattagttaggtatgcaatattggattgtgaaataaagttagatttatgttgttttgttgctaggtataggtatgaatcgaatacttataactaggtatatactcacaatttgaaaatttttaaaaatttgggcaaatttgtgtatttcatatcatggtgcccgggcaccatggtgccccatatgagtgccttgttactgctacagtaataggctactaaaaaacctgatcgcaagtatcctttatgggaagagataaaaaaaaagggaggccagtacacaaatactatcggtaataatgcaaccccctattaaatttgactttgactttgtgtacaatgctgttcttgtgcaaatcaaaatatataaatgttgtacacctgggtattgtaaacacacaatcaatacaacaatttcggcgcatcgccactcttgctcgctaggtttttcgatgagatcgtgcttttgggtcgtgctgcatcgattaggttcgaactacggcaggaggtatgtctcgtcaaacttcatgcgcgtcggctagctggtacttcctcggttaggtccgatatactcagctactgatacgcatgtcgcgtatcatatacatcgttagattctagatcgattttgatgcatctgtatcggtttgcctcggttaggtcttccttggttaggtccaatattctaatcggtttgcctcggctagtgatgatattggcgcaagctgtctcggttaggtccgatccttcgggctaagatcaaagctaattggtttagatgcatcggctaaggatgcgtatggttctatcggggtttcagccgatagtttatatttttatgttatcttttcttcacttgcatcggctaagagctttacttcattagatctgaaatagtttatctttattggttgtaatcttgtgctgcatcggttaggtccgacctattaaaattatttctaatgaagattgactattgaatgatttatccttcgcatacagccgattcgagatttactgcctgtcggcatatctctttgggacaagagagagaatcaccctacaaatgtaaaaggtatgtcggtgatatgggcccgggggtgtcacgtctagagggaggaggccgccctcaaacccacgtagctctcgctgaggggggtcgagcccagggtggagcggcagctgccccctcccagttagagggaggaggcccgcccacaaacccacgtggctccccccgagggtggtcgagcccagggtgaagcggggcagcagcggcggctgccccctcccagctagagagaggaggccaccttaaacccacgtggctccccccaagggggggtcgagcccgaggtgaagcggcggctgccccctcctagcttggggtcgagcctagggtgaagcggtggctgccccctcccagctagagggaggaggccgccctcaaacccacgtggctccccccgaggggggtcgagcccggggtggagcggcagctgccccttcctagctagagggaggaggccgcccacaaacccacgtgggggggtcgagcctggggtgaagcggcggctgccccctcccagcttggggacgagctttcccgaccccctctacgtatcagcccacgtgtacagggttaggtgagcacgcctaacgtccacctaaccacatttaaagcggtctatgcagccgcgccatgccgcatttaatgcggcgtgctgcgcatctgaccgatttgtgaccggtcgaatgaccgatgggacggcgaccctgtaccctcgccttgtcagtgtgtcaggcggcgtgctccatcctgtcccatcataatgatgaggggcttcacagcctcttatcccggtcagagctggtccaaccactttgaactgacccgggtacctttttcctggtgtgaataggaacccggaagtcctcaaccattaaacggcgaatgacaagggcgccccgcatgatctgataggccccacgcagcagccgacgcgcagatagcttttgggctaaggcacaagacatgtaattaatatagagaatatttttcctcctccctaggtagtacccgcagcatatgtgggatccccttagagtataaaaggaggaccatgcctagcgagagtggggatcggactctggatccccaaactaaagcttctctaaccctagcttgtacttgggagattcagaggctttgcaagcatagaagaatcatcatacacacaggagtagggtattacgcttcatagcagcccgaacatgtataaatcccttgtgtctcttttgtctcgagggacctcggatctcacctgctcccccggccgaactcacaaagggggtctcacgacctcccgctagagaggatcacccctcgacaaggtactacctccgtttcgtaatgcaagggttttgacttttttactcgtaaagtttgaccattcgtcttatttaaaatattatgaaactatcatttattttatttgtgacctactttattatcaaaagtactttaagcacaacggagggagtactactgtatgttatgaaaaaaattgtctttcagggaaatgaatttgccgaatgtacctatctgatgacatgctctgattgagcctattgtaataatgcattaaatttttgggtgtattatgaatcatgttatgtttttcacgtttctttcactgtttcacctcatcatttgagcatatcagttctgctgtttggctcctcaagcaagacattcaataggttacaatagttgcttgtcacacctataattactgtttaattttcctacagcaattcagtaatttgagataccaatgccgagaggcctgaccgacggcccaagaagccaccgcccacaatgcagttatattgcaaaacattattcatgattttgtttgtatttttggcactgtcaagtgcaggttgagtgtgcctgttaagcttgaaactgtaggatcgaatcacaagaactaagccaaccagaggggggatgaatggttgatataccccaaaaccaaaacttttagcggaaataaaagttaccctcaaattcgatgtaaatcggtctgaccgaggttgatccgccagtctgaccgcgctcgtgccgccggtctgaccggtgttgatcactcggtccaaccgcctgaagatcacctgccgcgtgtgaagttgccgccggtctgaccgcccttgcgcatcataagaagaaatctcagattgtggataattagcatcataagaagaatcaacaaatctaagatcactcaaaattttattaaaccgagaaagatagtcatccaaagtttctccaggtttcatctcaaatttaatgtactcctttttgaaaagatcacgacgaagttctttaatgttatttgttccttgatgaaaattactcaaagcaatccaaatctcatgagcagtttgaaaatgagtaacacgataataattcgaacgagagatcccactcaaaagaatgttgcgagctttgcaattttgttcaaactcagtttttgcagcagcagtattaattacttcaggaatcacataaggatgagaaacttttctccaaatatcataatcttcatccataatgtaagattgcatcctactacaccaatgagaaaaatccgttccatcgaaaacatgaggcttggttgaaaacctaacaggagcagccatggcaaaaactctagatcgattaaagtccaaagaagaaaacgaggctctgataccacttgtaggatcgaatcacaagaactaagccaaccagaggggggggggtgaatggttgatatacccaaaaaccaaaacttttagcggaaataaaagttaccctcaaattcgatgtagatcggtctgaccgaggttgatccaccggtctgaccgcgctcgtgccgccggtctgaccggtgttgatcactcggtccaaccgcctaaagatcacctgccgcgtgtgaagtcgctgccggtctgaccgcccttgcgccgccggtctgaccgccgcttgccgctggtctgaccgccggagagatgctggttagaccgccgaaacccggtgaaacacaaatcgaagaactctcaaagtagatgacaactttatttcttctctctgtgtttacaaagtgcaccaatagcactccttacaaaaatctcgactaaactcgaaaccctagctaaactagcaactcaattgctctcaaaagcgatactgggaagcctcacgctccccctctatttatacatgaggtaggcagcctaaagccacgaaccaaactcatactaggagtcctaatccccataggaaaccctcttgtacaagaaacaaactttacataaccaatcataccaaatttggactccttccaaattcgactcggcatcccatacgcacacaatacctccatcgtacgccatatggaatcttcaccaaccacgtgcatcaactctagcctaagtatcccgcatgatatctgaccaccacagacatcatcttaccaccaagccgactcccggtccatcaccgcaaatactctcccgaggcatcgagtcacctacacatgaaacaaacaaagaaaccatattccgagaccaagctatcaccaacttgactcattgttagcaaacaacagtattacatacgtatagtatccatctagaagccataaccatgaaacaatcacggatatccaaagaaacaacctgaaaccgaaaccgacacagcgtcggccggtcagactgcgggccagctcgtctgaccgctcaacacaagccggtctgaccggcaaccacctcccggtctgaccggtaccgacaaaacagcaaaccctattcatcacatgaaaatcaattatctctaaaaccacttcaacagtaatctccaaatatcaaaaccaataatcacaaatgccaattgttcatcacagaataagaatcaaaacacattgatcttacagaaacatatataattgtccgactgttcatttatgtgtctgaaatttgataattaatatattgttgaccttgatgcttgtatgttcagggtgagccaataattaagtactacactacaatattttcatgttatctaggttgtcgcattggttctctgaattctgcataatacactaatatgtatgatgtcaacattgctccaaatataggtaaaggatgagaggactcttcattagatcgaggatgagaggagaagattgtgtaaattagatgcacaaagcagcctcttcttgtaaacaagcaccaaaaatatcataagaaaataaagaactaatgtagtatgagttattgtttgatatatttccaattcagatgaccaattcaacatggctgctgcaattcagatttatttgtttattttggaaccttaatgtgaagttcgcagaaaaaaaagggcagatttatgtacagaaagcctaaacaacggtatcccgtttgatatgagattgtacttgatacctgatacctcttgtggtatcagctgcatggtacccgataccaatgatacttgttacctgatacctgtaatacctaggacctgatatctgtgatactcatgcaagagaatagttaatatgtctatcccgttgcaacagaatcccgttctgtagcagccctcatttatttatcaattgataccttactgtgattttccaaaaaaaaaaccttactatattgaagagtttttgatatgcaatgaagttcatagagaactcacagtaagagtttttgtccgctgcaatgaagagtttttggactcttcagatttatttcacatctgcattttttttctttatctagccctgctactctcctgatcaatgaagttcgctacctattcatattaactgcgtagatctatgcaggcttttccaaatgcagataattggttgtgtttggtgctgaagagcaattaagttggtatacatttgcgagaaaagactgatagatattggtaccggagcgacaaaagacagttgatcttgtcgtccgagataatctcgcaccagacaagattaaaaaaatgtattcttgggttggtttatgcttggattattctttgttcctagcaacggttgaacgaattgtaggatcgaatagcaaaaactaagccaaccagaggggttgaatggttggtataccccaaaaccaaaatcttttagcggaaataaaagttaccctcgaaatcgatggagatcggtctgaccaagattgatctgccggtctgaccgagtggatgccgccagtctgaccggtgttgaatctccggtctgaccgccgagatcccttgccgcgcctgttgcctagccaccgccggtctgaccgccgcttcccgccggtttgaccatcagtatatcggcggttagaccgccgaaactcggtgaaacacaaatcgaagaactcttaaagtggatgacaactttattacttctctctgtgtttacaaagtgcaccaacagcactccttacaaaaattttgactaaactcgaaaccctaactcaaaactcaactcaattgttctcaaaagcgataccgggaagcctcacgctccccctctatttatacctgaggtaggcaacctaaagccacgaaccaaactcataataggggtcctaaacaccttaggaaaccctctagcacaagaaataaactttacataaccaatcgtaccaaattcggactccttccaaattcgactccgcatcccatacacacacaataactccatcgtatgccatatggaatctccatcaaccacatgcatcaactctagccttagtatcccgcatgacttctgaccaccacggacgtcgtcttatccccaagccgactcccggtccatcaccgcaaatactctcccgagacatcgagtcacctacacatggaacaaacaaaaaaaccatattccgagaccaagttatctccaacttgactcattagtagcaaacaatagtattacatacgtatagtatccatctagaagccataatcatgaaataatcacggatatccaaataaacaacccgaaaccgaaaccgacacagcatcggccagtcagaccgcgggctgcgccagtctgaccgcgcaatacacgccggtctgatcggcagcaccagcccggtctgaccggtccacataaaatcacaacagtatcctgtagattcacctgtaaatccaataatctccaaaaccactttgtaaataaattccaaataacaaaagcaataatctccaatgcccaattgttcatcatagaataataatcaaaaacacctttgattttacaatctcccccttgatgaacacattggcaaaccctttaaaaatgttttggtgtttggaaaaataaaaacaaaagtggtaaaaagcacactttgtacaaaagtacacatcgtgctcaaaaatccaaaagaaaacttctccccctttttaaaagaaagaaattgccaattgaaccaaaaatatactcttctcaacaactctccaaaatttcaccttgcttctccaaaaatctaaaaaaattttagattacttctcccccttttgacaatgatttcatcaagcataggaattatgttcattaatatataagagcttagcatacatatagcatatcaagtcatgtgttacaataaaaagaagatgaacccatctataacacaacaagcatgcattaaagtataaccatgaaccaaatattttacaattaagcttgaatcaacaattaaaattcatgatttcatacgatttataatgcaatatcttaacaagcacataggttgaagaataaacactagacacatatatctattgcatttatcactctttctcaaataacctttagcataaaataaccaagagaattttttaaccttttcttttcttgagcctttttgctcatatttttctcttttttattccgggtacgtccctgtcgtcaagactgtttccagagattcggcacccattattttgctcacatcgaatatgtccttgtcgtcagactgtttccaaggatttgatattcatttttttcattctttttattctcttttcataatgagcaagtaaagctatttgaggaataacaagtcaataaagcatatatatagagcatttataaatcaaaccatatgctagtatcaacattgcatatttacttaattcaagtatagaatttaagtgtcatgcatcatctcccttaaaagcaaagtctaaatctcatgaaaagactagaatacatacaagctatgctagagacaaataaaccttcaaagtattgctagcatgcacaagaaataccatatgcataaacaaagctttcttttatcaatttttctcattgttatatttttgcttgataaaaccatgaggtacaaactccccctcaaaccatgccaaaaggatgaattatgcccaattcaccatgaagaaaagcaaagcgattagaatccaaaggtttagtgaaaatatcagcaatttgaatctttgtgtccaaaaactgcaattcaacatctcccttttcaacatgatccctcagaaagtgaaaacaaatatcaatgtgctttgtgcgtgagtgttgaacaagattcttagcaatgttaataacacttgtattgtcgcaaaagagaggtactttctcaaaagtaagaccataatctttcaaagtagataaaagccaaagaatctgtgaacaacaactagctgcagcaacatattcagattcagcagttgattgagcaacactagactgtttcctagaagaccatgcaatcaatgatgtaccaagaaaatgacatgttccactagtacttttcctattaattctacaaccaccaaaatcagcattggaatatccacttaagcatatagaagatgaagtagaataccaaattccaaactcaagtgtatgattcaaatacctcattattcgcttgaccgcttgacgatgtgaagcacgaggagaagcttgaaagcacacacacaaacacacagcaaattgtatgtctggcctagaagcagttagatacaacaaagatccaatcatacttctatattccttttgatcaacagcttcaccatcttcatcaggatccaacacagctgtagaaccaatcggtgttgaaattggcttgcaattctccatcttgaaccgtctcaaaagatccttcgtatacttcgttgatgcacaaaagtaccttgaggtgtttgcttaatttgcaatcccaaaaggtacgataactcacccatcatgctcatctcaaattccctacgcatagtctcagcaaaatctacaaccaaagcgtgagttgaacaaccaaagatgatatcatctacataaatatgaacgaacagttgattatcatcatgcttaagaacaaaaggcgttttgtaaacctttcccattgtaaaacctttcacaagcaaaaagttcttaagcctatcataacatgccctaggaacttgtttcaaaccatacaaagctttagacaatttaaaaacatggttgggaaaatcaggattttcaaaacctagtggttgtttgacataaactttgtcctgtataaaaccatttagaaaagcacttttaacatccatttgatataatttaaaaccttttgaagcagcaaaagccaacaaaagtctaattgcctcaattctagcaacaggagcaaaagtttcatcaaaatccaaatcctccacctgagtaaaaccttgagcaacaagtttagctttatttctcacaatcaaaccatcctcattttgtttatttttgaaaacccacttggttccaataatattatatccagaaggtggttcaactaaagtccaaactttgtttctctcaaaattttcaagttcttcatgcatggcgttaatccacaattcatcagttaatgcatgtgacacatctttgggctcaaaagaagcaacaaaatcagaatttacacaaacatcatgagtcgttaccttagaccttgtagtccgctcacctatattaccaatgatttgttccggcggatgtcgtcgttaaatgtgcaaaggagcagtgatttctgaagttgatctacgttctgtatcagtactggtcgaagtagtaatctccggaggaccatctcgatctgcatcaacagaaccctcggccgacgaccctggccggtctgaccacacctcctgtgccagtctaaccggaggtgtgccggcggtctgaccggcctggcgcccggtctgatcggccgagtcgacctcgtcgtcgtcgtcgtagtcgctctcgtcttcaaaaatacaaccattctccccctgaacctgtgacagtgtacctgaaatttcaggtctagtacctggactagcctcatcaaaagaaacttcgcaagtctcaagaattttgttagtctccaaaataagtacacgatagccacgagtatgtgtggggtaaccaagaaacaatccatcggtagaacgtgcctcaaacttgtccaaatttccagatttcaagacaaagcatttgcaaccaaaaacacgcaaatgtgaaactttgggttgatgaccaaatcgatgttcataagaagtttttccaagtttagatcgcaagaaaactcaatttgaaatataacatgcagtgttaatagcctcagcccaaaattttctaggagttttatattcatccaacatcgttctagccatctcaaccaaaacacggtttttcctttcaacaacaccattttgttgaggaacacgaggagaaganaattcatgttcaagtccttgatgtgctacatgcagacgatcgcaaatctaancccgt

SEQ ID NO: 34212 - DNA, 861 bp, Oryza sativa
acatgcactcccgttggtacagtacttcatcaaatggtttaggtcccatgtccaaattctttccgagtcaatgggaattgaccgaacaagttgacgtccagaatctgtcccgctgctgcgtcaccgtatttgggcctttggcccgtgtatcgtgttgaaacctattagggttgtatcgagaggattttgcatgtccctaaactctatatatcagtacccgccgccatctttaggtttttgggttttgcttagattaatctatcgagaacagtttcgccgctagatcggtttgtaagaccccaactcgtgagcttaatcattcatctgcaattttggttgttttctatcttgttcttgtttgtgttcttcgattagcaaacagggattagccttctcggcgaggtcatccgcgtttcgacacgggtgataaccagaggagacgtggtgctgcgattgcgggactcaagagcgtgcgcgttcaagaagccggatcgatttatgtcgcgactccgcccaaatcgctgtgtatcagaacctttcggaagatcgggaaccctagtgcacatcagggcttcccacgaccaaaacggccaaaaggggaggagcacgacagagaggaggaaggtacagccggtgaagaaattgacccatcaccgctgtccgcgatgccgagcagcaggattcaggcgcggggccccaaattcgacggcggcttcacaagatgcacctgcattgccaccaacatatggcgggttctatgtgcccaaccgcccatatacgttgttttgaaaaacttattttttatttataggaattaataagccttgaataaaataaggggaaaaattaaaattggatttt

SEQ ID NO: 34213 - DNA, 857 bp, Oryza sativa
acttcgacctacgagttggtacagtacttcatcacttatacattgctgcaacaccctattcagtaagcacggacatcattgtctgaagggagaaagtgcacacctagtgtactatgtcagtgaggccctggacgacggcaagacacgttatccacgagatccagaaacttctctatgttgtggtcatgacatcgcggaagctacgtcactacttacacgcccacaaagggacggccggctcatcctttaccctgggagaagtcgtcaggaataaagatatcatcggtagaattgcgaagtgggtcgaagaactctgccagttacatgtccacttgatactgagaacaaccatcaaatcataagttgtcgctaactatgtagctgactggaccatccccaaaaatagaccaggtagccagacggataatgagacttggaccatggcgttcgatggcgcactcaatagccaaggtgtaggagcaggcttcattctcacatctcctacaggggataagttcaagcacacaatacacctcgacttcaggggcacgaacaacacagccgagtacgagggcctcctcgcaagaattcgagcagcagcagcacttggcgtgaagcggctaatagtcaaaggagattctgagctaggcgctaagtaagtgccgtaacattacagatactctaatcctgaggtgacccactatgtcggctaagtgcgtaggcattgaagtgtgacatgtgtttaataggattacgtcaaacccgccatttagctggccggcatcaggaattgacccctcggaccagtagattcctcggcgtgctgcaaagccatcggtaagggaatcctggagagg

SEQ ID NO: 34214 - DNA, 854 bp, Oryza sativa
  unsure (1)..(854): unsure at all n locations
acttcgannnatgcacctacnagttggnacagnagttcatcatcgataggaatctttctgctgccactctattacctacgtacaagtcaaagcagtattcttgagataatcttttggacaagtagatcacttagtttttggagtaaattgcatatatgacctagctcttcgatttcctaaacttccaaaagctaaccttttcaggaatcaggagcctatagctaattaacctttttcagattaaagttgtttaagggagtaggggttgggtatttatgacaatatatttgttgggaaacgcctgggctatgatggcataaattaaaatttctttttgcgtaacccagaacccaagaccggtttagaacatgtacccgtcacactaaacgcgctgcgcaagtggagagaaaccctgaaaatccgagacacctctcgcaagatagcgcgcgtccatcagaggaagcagtcgatcgccgcgctcaaccttgtctcatagacgttcttctcggcgccctctgatgccgatcagcacccgaaacaaagggcgcctctacctgtatccacacgcagatgtgctaccccccgcgcgcggctaggcttttgctcggggagggaagngacagctagggttcatacctgaaggaaatgcttccgcggtcacccccgacaagatattattggatccatcatgcggacatccaacgcccgggaggttcctatgggcatcccaatttaaatggacctaaagttggttttttggcacaccctttttcgccttcccagagggggccatcccggagtgttattataatttggttgaaacctaaaattttttttggcccgccggggaaggg

SEQ ID NO: 34215 - DNA, 2287 bp, Oryza sativa
  unsure (1)..(2287): unsure at all n locations
cactagtaagagacaagtgtggaatgatcaaaccggtgttgnaatgtcttgagccattatgaatatcttaaacaaacttaatgattcacaactagatgcagtcacgtgagcatannttctaaaatccttttttgttgctcaatttagttctaagaaaaatcagatgtctgattgatcaatgcattatctcttgcagccaggtctttctcgcagatcctttgttcttatccaggtttgtttgcttatttccagttatatttgtttatttttcagtattatttatcattaacctattttagagaaatgctagtgccttgagaactagagtatatgcagctacatgtgctctacttgttgtcacctgccattcatatagaactccaatgtatatttgtaggggcccccaggaacaggaaaaacacaaactatccttggactcctcagtgctgttctccattctgctcctgcaagaatgcaaaccaagtaatatcttcacctgtgtatatttattactgagtgaaatgtagactagtatctttctgttatggagaggagaaaccttgatatataaaaaaagagatattagaagctaaaacataaatataagtgttcaatacagtttccaaaagctacatgtatctgacatgatttacgttcttgtcatgcagaggtggttttgatgttaaaaaacacggtccagagcttgatattgagggcaagtatgttaatgaattggactcttttcaattgcttcatcctcagctaattttcttgttttgtccatttcttctgcttgcttttttcctcctttaaacaagttctctatggtgtttggaaataacaaattcaccttactttatggtacttctcttagtgtttgttagagggagaagattgtagctatttttacatttgtactatcatatttagtgatcactcagcatgtggattttatatgtagtatgggaactgataaagaaattcttttcagtgtatttttttcttttcttactctgtggaattatgcagttcctttatttgctacataatactgctgcaaatatctgttgcactatcttactgcagagctcatgtgataggcatgcacactggatgaaggcctccccgtggctgattggtgtaaatcctcgagatttaattatgcctgttgacggcgatgatggtttttatcctactgggaatgagctagtaagcttctgtgctctgtactttgctatatttgccatgatgcctgtatgaattttgtatttttgttacatggtaaacacctgtcttgatagaaacctgaggtcgtaagttccaatcgcaagtatcgggcccatgtcttggtctgtgctccatccaactcagcacttgatgagattgtgctgcgagttctgcaaacaggtaaaggggtttctgtgctgactgatccaattcagaaaaatgttctgacaataaaaatactctttcaattgcatccatgtgctacaaactaaacaacatttcttaggctcatctggtcactaatttattgatcggaaaatcaatcatctaaattattattcttcttcctttcaggaatacgcgatgaaaataacaacacctataatcctaagattgtgcgaattggactgaaggcgcatcactctgttaaagcagtttccatggattaccttgtacgtgattttagttgctaagtattttctgtccaactcaattacagtgagttgataagttgatatctttgcagatacaacaaaaactttctggtgtggatcgctcatcagatggtgggagacgaggggctggtgaatatgatcgaattagatcttccattcttgatgaagcagccatcgtacattcattttcttatttcacattcttttgcttatttcagtattccaggaatcatttaatatttgattctgactgtcaagcaaaatttgtaggtgttttctacgctaagttttagtggatcatccattttcagcaggatggctcgtgcttttgatgttgttataattgatgaagctgcacaagctgtgagtgtttgctttatacagattgttacacgatggagcatttagccactctcagatttagataatggtattttatgagtttctgactttctgttatgttgaaattctgaagtttggcatatccccttcttttttcaggtagaaccagcaactcttatacccttgatccatgggtgcaaacaagtttttcttgtatgacatccacctatctacgatttatgnggccttctcttaactatgaa

SEQ ID NO: 34216 - DNA, 1299 bp, Oryza sativa
  unsure (1)..(1299): unsure at all n locations
accaatcggagagggagtcaatgcgcgggggccgccaaacagcgaaatcgaaaaggataggtggggaccgatgcgcgtggggctggcgccgtagcaagatgcggtagatgagagaagaggagctatgcggtaggaacggccgatctggatccaacggtgaggacaaaaagggtgacatggaagcaccaggaagcagagaattctaacagtgaggatgatttgtataggtatataggatatcatttattttactgtgacatattttattattaaagaagccttgcctgtgacttatatactttaggctaatttatcctaccgagaacgagagagaaagctgagagaaagagagagaggagatggagacttatacgtgatttatctcttctattcaattgtaaataaatattctaataagtgtggtgtccagcagtaaattttttatgatttctctcttctattaaattagaaataaatattttaatagatacggtgtccagcagcgaatttttgtattttgtatacaatgattaatgcgctaaccacagcacaagtaattgaagccccatttcatcaaactttcgtttgtggatttgcatcggagttgccccatgttcgttgggggtacttcagaaatgggctcaggcccattacatggccataaccattagcatcgcactttctctctgtttgctctcatctcgttccttttccttctttccagagcgaggctgtttgccgctgcagcgccggcggctcactaaaccccagaacccccttctctcgccgccgccccaatggcggtggacaaatccggcggcggcggagccgaagccggcgcctcttcctcctcgtcgggcgtcgccgcctccaccatggaccgcttccacaagatcgtcctcagctgggactacgtccgcctcgtcgcggactccaaggtacgcccctccccgccccgccccgagcgctcgctttgcaatcaccgacaccacctttgaattttttttctatatggcggcttgggaggacagggcgggcagcagcaggcgaaggggctggggcgcgtgaagaacacgtacgcctcggtggccgagtacctcgctgtgttcgagccgctgctgttcgaggaggtgaaggcgcagatcgtccaggggcgcagcgacgaggaggaaggtgggtgggtgggtggcgcgcccgatttcgtgttgcccccccaatttgctgtcggtttatttaacagtgtgtgtgtgtgggtgtgtgtgatganctnctgcagtgggccatgcaatcaaggccgcg

SEQ ID NO: 34217 - DNA, 6486 bp, Oryza sativa
  unsure (1)..(6486): unsure at all n locations
gtggcnattgatgtcgattcacagtagcgcancacctaactaatagatagaatgaaaccgagatgccgtggtctttacgaatcctccttgaatggtttcttctggatctgttttctattaccagattgcgtacttttgtgtgccagggtcattagaacatcttacctaatactagcattacaaccgttgctggcgtggttagagcaattctatgacccatcttgaggaatgctcaaacatgtcactcattttgttttaggggtgcacatgatataaaacatgtgacgtgtggggatgtccacaatgaagttatactgctatcttaaatttttttttgcaaacactgtcacatggtccataataagcttacatgcgatactaacggtagtaaaatccaattaaaaatagattttgatactgattgccaagtataatatggtcgtgttcattgaaagccagagtagtagcatatacatgaaaaatatgattgttaattggtaattttagtgcttgccctgtccagtacatggcttaaaaaaatgtaggtcaatacgatttccaatttgaaaaacaaacaatccatattgttatgtatttgataagatttgcaccatctaacgaagatgggtgaattatttgagcaatttacaagatgactgactaaactgcacccacctcgtaagttgtgataccaacgctgcattttactcaggggattatcaaacccgattacagtattttagggtgcctctaatacccatctatacatatagatacgctgctagtataagataagaggatagaagaaaagatttttttacacgcttagtttcctaatgtgttcgatgtgggtaacaccgtaacaaccttaatactgtaggatcgcacaagaccaaacaaacctaccagaggggggagtgaatggtaagaaaaaccaaaaacccaaaatcttttgtggaattaaagattacccttgaacgaagtcgatgacgaagtccagtcgccgccggtcgaaccgccttcctgccaccggtcagaccgccgaagcctcgccggtcagaccgcccggatacttgcggtcagaccgccgctatcccaccagtcagaccgcgcacacacctacggttagaccgttgggacccagaaacaatggtagatgataaactcgaagatgtagattgaaactttttgactttattgcatcaactagtatttacaaagtgcaccaatagcactcctcaccaaaatctcaaactaaactcgaaaccctaactctctatcaactctagtctctctaaaaccgataccaggaggcctcaccctctctctctatttatacatgaggtagactgtgcaaagcccacgaatctattacaacttagaactcctaacccacgtagcaaaccctctcttgcaagtatacaactcatctctttccttatctcaatcaaacttcccgaattcggactcctttccaaattcgactcctctttccatacgtacacaacccctcttgtataccatatggatttgttcatcaccatgtgcattgtcctctaacctttagtatcccgcatgatctcttgatccctggacatcaacttctcccaagttgactccgatctattaccggcaacactctgccgaggccttaagcaacacctacacatgcaacaaccaagaaaccatattccgagcccaagttcgttccaacttgactcacattagtataacaacagtatccatacgcatagaaaccatctagaagccaaatccccgaaggaaatatccaaatccaacaaaacaatccgaaaccgacatcgatcaggatcctgcgggtcagatcgttgggccgaccggtctgatcgccgcaacacctgcagtctgactggcggcacacgaccggtctgaccgccagggtcaaccgaaactgtacacttcacaaaatcaaccatctataaaatctccaaattaacattagcaaaccaccaatattttcatcataaaatctaaatcaactccttgattttacaaatacttgtataaattaatctaggacatatcatatcaagtataaggggtagcaggcttagctaatttgccaccaaactaaccttgatgggcaaagcaatgggtttgcagtcaatggctaacgaaaaagcttcttcctggtgtgaactcaatgtggtgtgatttcgaatttaagtcctaaatttatatcagaacatgacctctcgtcaaggtaaaactcaagatccaaataggagaccttattatcaccgtgctggactacctagtcattccttaagtggatgggatttcctggtcctctcttagggcattcacagtgggttgagttggcattcagccttatcgatcctcaacaaatattgtgtgccacgtttgtgtcacgcccgaaaattcactagtaatttccgaacttatttgtgcataaaatcctcgtccaggaatcagccgaggtacacaaactgacaatttaatatacagattcatcaaattaactaaaacgataaatacttacttatgaggcacttagtcctcatcatgaagaaaactgcagcggaaaataaaatctagcgaagctccggctccactcccacaggcagctcaactggggtataagccaaacgtcttctccttctggattctttttcttcaactgaggttgattgattattgcaaggtgagcatatgacatactcagcaagccacacagcaaatatgcaaatgcacaaggataccaaaggatggcataatattggctcatttgcaaaagcagcatttagcaaaacatttaagagaagtaaaacagtggagtaattaatcaggaattttaatcaacactgaacagcacacccatgctgcacaggcccaaccatcctgaacaaccatacccggctgtacagatctaactccaaaccaggagctaagcaaattattaccaattaaagcatcttttacaatgatgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcataacacaactcaccacagtgcaccattcctggatcataatcacccccttataaaacaaggcatggactccccagcgacccccgtgggcttatttccgccacttctcagtctggtgctccgcaatgaatcatgttatacaaaaggtaaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgagctaccattaaaccatcattaaataataatgaatcataagttatcccaatagtgtgctaatgtttctaagcatggctaagcaatcacatctaatatctagttgaaccaatatatataaagctcaactagtccaattataataacccaaggtatcaaggaatagagtaatcaatgcgaataggccataacaaaggaataggttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctaacacgcaaaacgaggaaaaagactaataaaaaccaaataaacaatacataaaaagtaaacaaacatgtagatcataattttagatgaattatgagacttgaacggcctcattctgatttcatatgaatttattatgaattttacaagatttaattccaattaaacctattaaacggagactattccaaattaattaaatcatttacaaatgatttataacggagataaaggattaaagcaacctccggaaaagattggatcttatttggtagatgacatatattaaaaagaaataatatgccactgaaaagaggagaggatttatattgattttggacagctgagattaaccttgaccgagtcgactaagatcggatggcttggattgatttggcaagcgggcctcacgagataccgactcaacgagtcaactccacgtgacacgggatcacccaaatgatcaaccgaaaccggcgaacggaaccggcggctctgaactaaaggacgactcaacacggacgaacgaacgaagcacggggaacacctcattcgaacgaacgagcgaacgactcaacaacggctgcggctaaaccggtggactagaaacgattcacggtaaagccccggtacgacaaacgataggccggtgggaaactagggttgcacctacggctacacaactcgactaaaagcagcggctaggtttaagcggcacacagctgcgacacggcggcactaagacaacttgactcggctaggcggcggctaggcggaaacacgcagctagggttagggtgacggcacagccggtagcgaccatgcacggctagagcagcagggctacgacacagcgacgacgacacacacgtggcttacataaacatcttccctaggaatcggagaggaggcctcaccgggaaacggtagtgaacggagaggaagaggcgatggctacggtccgacgacaacacacagagacgatgatgacgctagggccaaacaagattagattagatggaattaagaccctaaggataaactacaccggtgaacgacaaagaagcggcggttgccggcgaaccacgatacgacctcgccggagatagagcggccggctgcggatttggagggcatgcacacgtagaggacgacgaggcgaacccaacggtactcaccacaacgacaatcgacgtccgacgacggccggcaacgacggggaacgggcggcggctcggttgaccggcggcggcgaagaagaacgggcggccgggcttcctcactcctcggcgcacctcttggcggcggcggcaagcggcggcgacggcaggggcggcgctgcggcgcggctgcaacccggccgacggcggcggcggactaagcggcgtcgacggcgagctacggtgcacgggagaccacgggagagggggcaaacgaaagaggaggactagggggtcctatttatagccatgggagctcgggtccgggcccaaaacgacgggaaaaactcgggaaagtttatcttcgccggaaaaaggaaaggatttgatccgcgaaattggaaaggatttccaaagaaaattttggggatttcttggggaaaaggaagaggagattgagaggattccattcccgcaaccaatttggaaataggagcaacggggaggtcggatttggtggaggaagcggcggctgcacaggtacaggacggcagctcgggctctgtccaggcttgaagatgaacagtgccagggagggaaagtagacttcttgccgggcttttctacttccaaggactgattaaaggagggacgcaaagcagacttcgggaaagagaggaaaagggctgcaggctgagaggagactgggccgagagtgagaggacttttcctaattcggcccgaaaaggaaaaggtgaattttaattacttttccaattaaattaatcactgaaatgatcttcgaattgttaaaaatacttccaatgctcaaataattccaagaaaaatcttgaacatacttggacactcaaagtacttaaaaaaattataattagaccatttaatgattaatttaatatgtgggtaattactgaaatgctctttgtatgattaaaaattaggaattgagctccgaaaaatccgagaaaatttcagagagttgacttaatcatggagaatttaataaaaaaaaattaaatccatccatgctttagatttaagaaattttatttcccacattttacttcacttgaaaattaaagaacatttaatataaattctacaaataatttattaaatattttataaatcctgaaacgaaaatcaggatgtgacagtttgctactgccatatgtacctgaagttcttgtgtccaattttggtcactcgttcttcagtctaattctgagtgagtgcgtggngtgaggcaccgtgagcacactgtggcgcactgtgaagatctgatccctgctttctncactgctcagcctgtagatgtgtactttgtctttttcccttggtcacggcatgaggacccgacgcagtgtgaatgcccttaggtggacatgattctttctttatctttatccatatt

SEQ ID NO: 34218 - DNA, 5979 bp, Oryza sativa
  unsure (1)..(5979): unsure at all n locations
aaaggtagattcctgatcagacccgtctgcaagtagctcatnacctggtgtgaactcaatgtggtgtgatttcgaatttaagtcctaaatttatatcagaacatgacctctcgtcaaggtaaaactcaagatccaaataggagaccttataatcaccgtgctggactacctagtcattccttaagtggatgggatttcctggtcctctcttagggcattcacagtgggttgagttggcattcagccttatcgatcctcaacaaatattgtgtgccacgtttgctactgccatatgtacctgaagttcttgtgtccaattttggtcactcgttctccagtctaattctgagtgagtgcgtggggtgaggcaccgtgagcacactgtggcgcactgtgaagatctgatccctgctttctccactgctcagcctgtagatgtgtactttgtctttttcccttggtcacggcatgaggaccggacgcagtgtgaatgcccttaggtggacatgattctttctttatctttatccatatttagaataaaagcatataagaataagaatatgtatatgatatttctggtgataataagtgtatgtatacgtgtatatcatgcttcctctatctaaaaatataagggattttggttagataaaacacatcccagtgattaaaatttcgtactactatggtgtgtcccgtttagggtttaaaatttcatatcgaaatttctgaattttcggtaattttgtcccccaccggcaagttcatatctcacccaaaattttccttttttgcaaatttttgtgaatttggtcaaattttatttaaattcattcaaaatcagtcaaaatttcaaataatttcagccaaaaattttcaaaatttccaaaatttcggtaatttggtccctcggcaaaaaaaaaccaatttcaaaattgaaaaccctagtcccgtttaaccaagattgacgaagcaagtatcttacagcaatgcactatggaactatttttcgtaaatatacacatgttgctcttgggacggggaggttgcagagcagacatacctggcacccgtcactcaccatcagggttcacaagcacgtttttcccccacaccaacaagcccacaccaacaatcttatagtacatcaggataggataggtgacacgttctaaaaaaaaaaggataggtgacatggtcacacgacgttcttaccaattgaatgggcaacacatatatatattttcttggaaaataactagttgcttatctttgtaaagtggagtgagaaaatggttatttaaaaagaattcctagatgtgcatttaaactcaagcccaatggcggaggcaggttaaaattatagcggggctaaaccaaaatgatcaagagcaactaaaagagatttagggttgggttaggattttttgggccttcttagccttttgggccatataacaacctcaaacaaagtctatattagcccttcatctataaatatatggattacaattttagaggtattatgggggctctaatgatatattaggggtagggggtctaaagacccccacggcccccacgctgtctctgcccagctcaagcccaaggcctaagcactgctccctccgtttaaaaaaactcaacttctaccatgctaccctcataatgtaaaacgagaagttttatttcttcaataccctctacctacctatcaccattaatattttttttaataatgagggatattttggtcattttcaccttactatttttgcattgggatgatagggtttgatttaatatgggacagagggagtaagcaggatacatcagtctatagaggtgatctggttttttgagtgtagtaacagtaagacacgatcacatatatagacaaagttgatttgctctaaataagaagcaatcacacgaaccatgagcagactaaacccaattttcaacacaacaaaacatgacggaatcatggatcatgaacaaacttaacagcctgtttaagtacttgtttcaattcctttatggaagacaaactaaaaagatgggtcttttccgatcttctgcacaataacatgaaaaatcacaagttcaccgtatccctccggcaaagcatcaaaatacagaaacaactctagaaagaaacagccggttgctctgatttggctgcatctgctgaaagattgtcttttctagcagcagagtaggcaaggcatggatggagggttgcaaaagaactcttgtggtggcaggtttcttggcttgtgcaaaatccaagaagaatggcatacttgaattcttgatgcatcccaatccatgcctcagctgagaaccaaatcgcatctacttacatatcggtatgcattatatagccttagaagaaagccctcgatctcggctaggctcacgctgtgctactatatcactgataaagaaagctaatataggatgcctcatcagatagagatagaaaagcatcatcggacttatttccttctaattttgagtcattagcatatgggttcaatttgtagatgacccacatatcaatgattcatgtttgaagtataagtcaaaagagaagtaagtcagagtatctcaattctcattagatatattgccgcggatatcaatggatcttgggttttatttagacattgatggctttcagtatcacaaacaagagttaaaatatgtagttgaaaaaattttggtgtaatgtggtcatgtgttcatgtgttttactttatccaagacaatcgacgattttttgcatactgtattatttaatattcctatctcacgaaaagttcatttgaagcgattctcaaacaaataaggctgtgttcttccttccattttcccaacccatctctctcgtttttcacgcgcacgtttttcagactgctaaacggtgtgatttatacaaaaactttatatatgaaagttgcttaaaaaattatattaatccattttttaaaaaaatagttaatacttaattaatcttgtaataatacaagcttcgttttgcatgccggggaccaaacccctcctcccgaacacgggttcagatcccctagagttggcatcaactccacctagtggatttgggcaaatccaaatctcatccatcgttttatttctacggttgagatcataattgactcccttaattgatgcatatttggatatttcttttcaactgtcctatttccaacgtaatcaagaaaattaacgtaattaatcttcttcctacgattaatagaccaacatagaagatcttttcagtgtagagaagagtgatatcgtagatggtgaacatgggcagccttgcgatgtgcagaaacttactcagcgcaagcaagtagcaacatgtaagtacatcacgtcaagctccttgatgctgctgcacaactcgttgatatagccgatagagtcctcgtttacaatctttgatgaaggtaagattaaaagtcgaaggaacaaattaaggataggtggttgagctgtattgatttaatctcaaccactggtgacaaataacggctgggattgacccaaatccaccggataaagttaaagccaactctagaaaatctggacccccgaacagagtctaagtgttgtggttagttcacgttgatgtctctctcatcaatcatgttatatcatatacctggcatttgtcatttggtaagccggagagcattaggcaccgtttgaatcagcttcttgactgagctactatcttggttttcgtaagcacatttcctaaagtgttgaacgataactttttaaaaaactttctatatttaagtttcttaaaaattaattaaatcaatttttaagtttataagttcatatttaatcaataatgtgcttatgattattctctcccgtcaacaagctcagttgttcaactgtaataaacggtgcctttaatcgtgcatgcagtagaaccaagtgcttcagatgaatattttgcggtgcagggggtgaagttataatactctctgttgatttgtggatcaagcaaaagtagggtagagtaagtgctccagatgaatattttgtgggagaaatttaataaaatttttaaaaaaacaaactcttcatgggatggatggagtagcacataggtatattactaatttaccttagtccgattagcatgaattaaaatgttcctgaagaattgataccgttgcatcaagataagacaaaagctcaaatgctagcaacacttgccctccactgggggattttgaatacctcggcctgaaatttcaaatcctaatatgcactaagatcctagcaaatgctaacatgaaataaaatatactaagcgtgttggaataggtatcaaatatactagtcttattttgttatagttgaacttggagttataataggtgataggagtaaagttagagtcggattctgtaacccagtaactctcttaaataagggggtaccacaatataattatgacgactataactgtgaagtcaatttgcccttgagtatgatcttctggtgaactaattaaagacgtatcctgtaatcctaaagaacacagaaaaaagtttaatccacatcccatggttttattgctcgcactagatactagctagactagctatcaaggtaaaataaacgatcacatacatttcaatctacaagacagagagagtagcgatgccaacagtatgtacatttgcaaaaagtagaaccaacaatttggacgactactctatcttccaggtcaaaatgcaaatgcatatgctgccttgtctgtcgttgtctactatcttcatggatgatctgaggatctgcactagagcccagccaagtgctaagtgccaacacaactccaaatatctgtatgggtagtggaagtcgaccaggatggatttccagtgatcccattgtctcccagtcctataactctagtctttacaggcagacagagccatgtttctctttgagaaatttagatgaacatctctctcgtgtgtcgttatagttccaagaaatagggcaatttatagccccctatcaccaaggccatttcttttggtaggctctcctatactcctttcatcttttcttgtctaacgtaccttttctatttatactaccactgctacaaacaagattttttcaaacgggtattttgttttttccgtgcggttgtcagttcatcattttgttttttccgtgcggttgtcagttcatcatctgggaccgtacggaataatggattatcccatgcggttgtgttatatcacccgcatggaaccaaaaaaggccaaaaaaatatatataaaaaaagcaaaaaacgccgccggccaccaaatcgctgccttgaccgccgcatgcgacgaccaggaggaggacgacgagcggacgacaaagccttgcctcgctgctcgccgctaccgcgcccgactgccgccaccccgttggtgaagaggcggcgctggcggttgcggacggtgacggcgcggccctcggcgaggacgtgggggaggtaggcgttctcgacaagtgcgtggtggcggtggtggaaggtggcgccgcggaagtcgtcggcgacaacctcgtggtcgtcgacggcgagggccaagcggtcggcaccctcggcgaggtcttgacggccacctcgctgctcgccgccacgcccggccaccgtagtgactgccaccgagcccgaccgtcgtctcgccccggaggccgtctcgtcccggtggccgtctcgaccggatcgcccggtcgacgtctagcccagccgtcgactcgtgccggaggtcgtcttgaccaggccgtcggctcgaccttacgttgactataccgaccgccgacacctcggcccaaccggttgagggagttggtgagggagaagagataccgtagagagagggttgaggcgggtgtccatgcaggactcgtccttgtggc

SEQ ID NO: 34219 - DNA, 5972 bp, Oryza sativa
  unsure (1)..(5972): unsure at all n locations
canataaggtagagagagggttgagggaggtggttgaggtacaagagataaagaaagagataaggtagagagagagggggagtggttaccagggaataaagggaaaaatgaagagggagaggaaaaatttaaagtgagtagagggaaaggagggaggaatatcccgtgcggttggattaggacgcccgcacggggaaatcgatttttccgtgcgggcgacacctagcgccgctccctcaatttttccgtgcggttccacttatggactgcatagaaacaaagaggagggacgtccagaaaaatcaatcgtgtagtagtgtgtcatcttagctattaataataaaatatttttaagtggtagtagaactcataaatcaatggcttaaactgcttctatgcatagatatagtagaatggtactatagtagagaccaccgtgaaaaagtactcaccaacaaacaggccaacaatttgctccttatctccgcatccaagcttagtttgcaggccaaaattagctatgatcctctcttctaaatgggaactacacgtgaaaatataagttatcgtcacttatacacaaattataaatcataagttggccactcttggtcaggctttatagtgcactctaatacatttgcaccctttcagtttcctcttccatgctccaaccctcgcatactaatccttggttctttaatttctttccagcgacattgatgtgaaatgtagatcatttactagagagtaaaggtgcgcacgtatcattagagcgtgcaaacttcgaaactgtcagtatatttggggcttgctcttgcatacaattctcttcgtcttaaaatataagagatcttggacggatagaacattttaaaggactgaatctagataatcctatccatccaaaattccttatattttatattttagagtagagagagtacgaatatcgctatgtagggcatctaaaaaataagtgtttttgtaaatcttcatacaaagggatcaaatttgtggtttcatgtacagagagggtcatagatgtactgcacattggtccggataagaacataagcatgccgggccctctcgttgctattactcgttgctattactctaagccctccatagctgcctatggcctgcagtaataatcagtactgtaagctgaaaggatgatattacccccatgtagcggtgaattttgttttagctatcatgcatgaacttcaattaggtaatttctatggttgcggacctaatttttttagataatagaatataatatccataattaagaaatggttgcggacctaattgagtgacatttgcatcaacaaaattaatatgcataacaagggcatgaactaggaaaaccgctaaaaaaatataacccaagtgtttttaaagagttgatcatactgttgaacgaagatgtgatgaagctcaagtaaaatataaaaggaagtgcagtgaactctactgttagggcactgagaaatccacggcactcaaaagggaactgacgaagaccaatttctgtgcacagtgcgatcaagagctgagcctggggagcaaaggggtattctcaacatcaccttgagttatttcttcatttaactttagttcccagtgccccccaatcctactgtccacgagcatacttctccgttcttggacctgcatctcatgttgtctaatcaacctttggcacatcttgtgcagcatttaaataggcttttcgttcctcctctctccgtcccatagaacatcaacctagtacgagatgtgacacattctactactacggatctagacatacatctgtccagattcgttatactagaatgtgttacatccaatcgtagattcattttttgtggggacgaagggagtacaaggcttcaatcattaatgcgaggatgcctagcatactaaatgattgacacaattcatgctatgttactcctttcgtcccattttaagtatagttgtgagagtttctgtgttcaacgtttaacctttcgtcttatttggaaaacttacgaaaaaattaaaaaaataagtcacacaaacaataaaaaatactaatcataaaaaatcaaataagacggatggtcaaacgttaaaaaaaaaactcataattatacttaaaatgagatagatagagtagttgtctttggcagcctgtagctcggcagctttgttttgcaacagaatgagtgtaagttgcatagatgatgcaggaattctgaaatgagctactactctgtcccctaaaaagacaaactctagctacgaatttgaacacgcatgtatccaggtttgtagctaggattagactctttttgggatggagggggtaggttacaccccgagtacgtatgcatggtgttttggtgagcgaaatacgtagtcaaagttcaatccacatccaaaaatgagctagtgatgatggttatgctcagtagatacgagccaaggtaaatgaatgatcataatactcaccttggttagtgtgacaagataaaactgtcacgtccgcactgtgtagcgtgtcagtgttgttttgttatgttaggcaggctggtgtggccaaaaaattcagatgagtttattattaaaattaaaaaaataaaaaagttcaaaaaataaaaaaaatcaaagctaatacagggttcaaaaacagcatatcataagatcacattatctgccagttctataactttagtcttattaccaggcagccggagccatgattctcttaagaatttacatgaatatctctctcgcgtacgagttatagtttcttcatgtgaagtataaacacctcaaatcctataaatgattaaatagcttagccttggagttttaacccctagctactatagtacatagggcaatttatcatcccccgcttatctctgcatctatggtagagcaaattggaggccaatgcaaattgatttacgaccctttctccttatggcttaattattcagttaatctttatgagaaaaggattgaaaaactcccctcagttaatcccatctaaatcccctcagttatgtcggagagtgattaaccgaacaaggcctaaaactacacatgtgataatataggttattctaatttatacacgaactataaaatagtaaattggcacggagtagtgaaggcgcatgcacaaacatatcgcgtggtgcggcatagattgctagaaaggtactcacagctcaccaaaacactagatctggccaggctgagcacatccgagctcaacacaagccaggacggtcacacacagctgaatagacctacctttcatatcccagcagagcagctcaacatgaaacatatctgttgccgcttcggcctcaagccggtaccctaagcagtgaacatcctggtgcctcccaatcccacaataattcagctaatctcaaggaaggaatccatatataagcggcattgattcaatcacgaatggtaaatgggcagcaaattaggccttattaattatttgtttgatgccattcagtgtatctctcatgttttttatcctagcagctgaatatatatagtgggcaagtgggcaaaaatgggcaaatgtttttgatcctagcagctgaaagctcacgagagaaaagaaaaaggtaaatgggcaaatggcctggtggtattaacgctatttacctactacccaggttaagaggaataattatagcgcatgtgctctccattttatgtaatgaatgccagatattcttttcatgtttttttatggggaaaaaaagaatggaagacaatgatacacacgtagagatgcttataattctcaagttcataattagcactggcaattagaaacatcaaaacagcactaccgttttcaatttgttttcttcttgtacagttgtacaatgtttcttagataatggaatagaatcttggcctttgctacaattgtactatgtagcgagaggcatatatgatcccataaataagtgatcgagagattttacagatcttcgtatacaaaaaacgtcatgatcaatccagttgtacaaaagctattaagatcatagttgtaccaacacagcaagtacaggaggagcatgcctctgatcctctcgtggctctttctgatttagccttgtattgctgcctatagctagcctgcagcacatgcacttgaacctaacattacgcgaggtgcttcatggcctggaaagtccatgtgcctcccaatcctatggttcgagctactaaggaaaaaggaaaatagaaattgatacttgttggccttagcatgtccagatcactttaccttgagcatatgaaaaggagaaaagcaagagaactgccctaggaattaatccctcacacacacctctacttctcttgctctctgccttctaaggccaacagcccaagagtgcagaaatctacatatacacccatgcagcatcacagcagctgaatgtcaaatgaaaataagttgtagctatggccgcaatatgaactcgggctatatatatatcaaagaatcacggcactgtatttctaatttaaatttgaaggctcaacattcctatgctttgaacaaatgaaaaatacagcagccgacccgcttttaatttggcactctgaataatgtcatgacaagttgcttttatgatttatgtaaattacttttaggttttattgaattttttttaataaatatctaagaagtaatttagtcaaatctaaaagtgatatttacatatgtgacaaaagtaatttaatacacatatatatttttatcagaatataattatgtgagatcttattaaaaatattttattgcaacgaatacaacaatgcaatcggatcataaattggataagtattgtaagagaaaattctataagttgagaaaaaaaagacatgcatgacctgtagcaaaatagttcttcagcttgtctgtagacatacagtagtagttctctcacatatggtcggcgtcgcttcttaatctagtgtagtgtgataggtcaaagacgagatgcctcccgatttagattttgcgtttacgtaacatatggttgcagaaaattcacttggtataggaccagttaacaattgcactcatttttttccattattgtaccacccataaattaaacttaaggaaacacaaaggtgttcgttgaattgttattctcttcccctttttacgacctaaatcaacctaacgctcttaattcggacatgagctctgccagctacctcatgtgctagagctctgcaattcagccctaagcctaagccagaaagatcattttggtttttaagcatagtaagttagtaacacaaaagtcacacatacaagtcgacttcctttaaacaggaagcaataagcaaacttaacatttcgcatactgcatgctaatttcttttagtaagacacaaggaaaaagatggatcgaatcctttcagatcttctacgtagcaacgtgaaaatcacaaggcaatattcatacccaggcaaacaatcagaagacagagcaacctcaaaagaaactgacgattgctttacttccaggctacagctgacgaaaatttctgtcctgattgctactggtggagaaggcaccgatctgatggtgattgtgctttcaattctcttcgcctgcgcaaaatccaaggtagcaggcatacttgaattcctgatacatcccaagccccagaattcttgccagaattatattgagaaccaaactcatgcctgattccatggccttgtgtatgcatcatgtaggcatccaacttccttctgcatcaattcctctcggtgtgtgtgtgtgtgtgtgtgtgtgtgtgtgtgtgtgtgtgtgtgtgtatggtgttcctttaatggctcatcacttaacaaggctattgatggncngttgcagaagcaggctgtactgtccgatgcgccg

SEQ ID NO: 34220 - DNA, 768 bp, Oryza sativa
  unsure (1)..(768): unsure at all n locations
gctggccattgatgttgantcccttnctatgcaagtagttcatcaggagcaacaagaacatgacgaaggtcgaatctagtggtgccaatagggagaaaggaagtgccacggcaaacaaccggaatggagtgaccattaccaacggtaatataagtttgtgagttggggaggcgagtaacgagtataccgtcggtggaggacatgtgcgaagtggcacccgtgttgagaacccatgagttggggttgtgaagcgtcattccattgagagcggcgacaaggccggcttggtcccaagccagctggacagaccctgcaggcggtggcgaggagtatggcccggcgaatgcagtgtgagcctgaggatacggcccaagtattccggcgctgggagaacgccagggttgctgctgtcctgcctagggcaagaacacccatggtacagcttggcgtggagcatggacggagaaagtgctggtgccgaagctgttgctgccgatggtctattcaccagggcggccgtcgaatccaccgccgccgttgtcgtcggagttgcggatgttgttgcgggcgtcgttcttgcccttggtactgacggcgttgccgccgccggcgcggttcttgtgctgcccaccgctgacagaggagatgcaagtgcccctcgtgcacatggagtgcgctcttattgcttggacgaaggcattctccgactgtacttgtaccgagttggcgttgcgaagcttcttgagaaccagcgtgtttctcgagaag

SEQ ID NO: 34221 - DNA, 1345 bp, Oryza sativa
  unsure (1)..(1345): unsure at all n locations
ntgattttcgatgtctgcacgtgttcatcataaacgaggagcattttgggactacacaatactcccatggtctccaaactcagctcctgatcaagctctcatgagagtgatcttggttactttgtctgggtgaccatggacaatccgagggctgaacacaaagtggagcgatttctgagcatgttttataccagaaccaggtttcaggtgggagatggggggcaatcactgagctctggagatccaactgactcgaacagggttcattcgaacatgggatgcttccagatgaacatcaccaatcccatgggatgcttgatgcttccagctgatgaacatccggagatatccctgaacccagatgaagaagacactgtgtggtgggagttggagacacatggccatttcactgtatcattggcctaccagatgttcttcatggcaagccttgtccttaatcccctatgtttgttcttcatggcaagccttgtccttaattccctatgtttgatgttgtgacggatcatccagaaggagagaaacacaggagcagtgtttgattatctgggcaagtacatatttcggtatttatgtcatgatcatttgctttggtctagttttcatgcagagtaggattagaaatctcaggccgatgtgtccgaaatccccagtgaagggcattggcaagcgtctcaagcattttagattacttcagcttttgtctctatcaactctttggtgaaacattctaggccaattattcctcttaaccagggttttaaatttcgaaagcagcagttctgccgctggtgagcgaaagaaccgaaatttcgtacgaatttttttgaatttttgacggattttgaataaattcgaataaaatctgaccaaattcacaaaaattgcaaaaaaccgaaattttcgggtgagatgttagcatttcggtggggggggggggcgaaatttccgaaatttcgttccaaaatttcaaacactgctcttaacttgggtagctatggaattttaatagccttaataccagttgattggctgtgcctttttattgtcagcttcagacataacaaggaatcattcgagcaaccatacatatatatatccaattgctagaagcaatacctgagagatacaccgaatggcaagagacgaantnggtttcttgcccatttaccattcgtggttgaaatcaatggcgcctgtggattatgttgcctacatgaactaccctgtgggggattaggaggtcccaggattttcaggctacgggcttgaagatgatccagccctcgcacgtgataggctttatgctcggattgatccaaaaagg

SEQ ID NO: 34222 - DNA, 3853 bp, Oryza sativa
  unsure (1)..(3853): unsure at all n locations
ntagtcaagaaaagacaatcgtcaattcttcatttctgtatgtggatattggtctttttcttctgcccattcgtttacccttcagtctataagctgcaacaaaaaaaaatataacctaattttggagttgtttttgggtttttctttatcgtagtttaaaattttatactatgataccacgtgtatttgggggtttactattttgatataccacgtgtatttctcagtgcgaggtatctaataaggtgaagcaaattacctataagctcgagtttatgggcatctgcatcactgcatgcagtcgctgcctccgtgtaaatgaattgcacagaacctatccgatgtgacatatttcaataccaatgtgatattttcttggtaaaattagttgtgaagataaaggtcatgtaatctttgcatatggtgatttgaaaaaaaaaactcttatttcttcagatcagtacagaaaaaaaaacagataactacaccgatgtttgtgccgttggcttgaattggttgagcttgatgtgtttaggccagcaccactactggaattacggttctgttcgtccgttgagttctaccgcccaatacctggagattaattagccattctcatgtttgccgattggggctaaacaaactagcaaccggaaccggggctatcccggacgaaagctctattaaattataatatttttgaataaactgacgatgaaacttttataataaatgatagttacagtgaaatttgtctgggctcgaaaaattttctaaccccaccactggccagaattgtttaattatctgtaggttttgaggtgttgatacttcacatgaagaaaacaggaacacaaacacaagagataatagtttgtacgtataaatttctcaagataggaatatggctctagagtctttcaactttcaagactacaagcacaaccgtagctgcattcttttggggttgggaaccttcccctcatgcaaaaccggaacggtagactaacgaatattaattaagtatcagctaaaataacttgagaattaaatttatatgatttgttaagacaacttttctacataacagtttgggaagagtgtagacagaaaacaagagggtagaagttggaaaaataaaggtaggcagagatagttatagggttaattaggagatgatgagatgttatggtgtgcttcttgcaggtttgaatgccatattatcagctatgttatctagtattatcatagatactactagaaaaatcaattttacagtcggacaaatcggcttttcgtaggcggccactcgaaccgcctataggcaaaggcccacgaaaatagtgtatttgcagatgggtgaactggccgcctgcaaaaactgatttttcgcgggcggattccttaacaggtccgcctgcgaaaatatttgcatagcgcaaaaaaaaacctgggaaatttctaaatcccccgtacaagcagattcgaaagccctaaatccattcaacaaatttatcaaatcctcaaatccattcaacaaattcatcgcaattctcaaatccagtaaacaaattcatcacatatcaacacaacgaaacaaaaattcgtcgccagtcgaagccgtcactgctcacgaacaaacctgtgacagatctaggcgcccgaggacaaccaacggtggaattgctctcccgacgacgacccaaggcaggccggcagcggatccgcgtgcccgaggtcagccggcggtggatctgcgcgcctgggtgagccggcggcggatcaaggcgtcgtcgtcgtcatcacagccggtggcaggacccaggcgtcgacgccgtcgtcgtcgttgcggcagtcatcatcatcgtggccgaggccagcttgcagtggatccgcgcgcctaggcgagccgacgacggcagatccaagtggcattgtcgtcgtcatcgcagccggcggtaggactcggcaccgtcatcgtcaccaaggcggacctcctcggagccgttgccaaggcgccgacgccactcctctccctagccaatgcgtgatgagagagagaggaggaggggaatgagtaggttgatctgtaggcatgattttcgtaggtggaccacataaagtttcacttgcgaaaatcaattttccaggcaggctccttaagaggtccgtctagattttcacaggcggggttaaatctagaggttctttagctattttcgcaaacggttataagagggtattttttttggtccgcctgaaaaaaaataaaaagccaacgttgataaaaatcgtttttctattaatgtgaccatacatgtttggagaggtagcatgtctccaaatagtaacggtccacgggtaaatttggacacgaaacacatgcttagatttgcgttttgacctacataacggagactaaattgttggttttttacttgtgcccaaagttattgttggcatgctagcgctgatggtctctgtatatgtgctaaaggctgatgatgcgacagctagcgcgagatgcaggggccaagaagaataggattgggcggcactaggaactgatgaagctgaacgacgaaccaacttggggtgatcttgatcagaagactcctttggtccccaaaaacttctgatcttgcttcgcagcgagattgatcctggtgatttcatctagctgttgtggttaacttgctgattgtcccaactgaatagaggggcgccctgcacttctccttatctctacatataccaagtttgatttggatattttgaaagatgaccatgctcatctgtttacactctgtttcgatatcaattctttaagttaattagtgcttggtattacatggtaggatttgctaggatcgatccagtgtacactaaattttagtttcaggtatatatccaaaatcccgagagggagggaaaagcgtggtgctctctactgttagtagaaattaatttaaaccgattatctagtttatctaagggtttagatctttttatatagtactaccacattagtcaacagtagtagaaatgtgtataaggtataattgtccaacaaatataggagtatatgggtaaaattataatttttttccactttattttgcccagaaagtgcgaactgcagatccttaactaaagtaaagataaattatggacttgtacgtctacagtgtttcagttcgaaaataggactcgtagaaaacttcttcatggaatcaattggttccacatatatgatagagaaaatcccctgtgtacccctgaaggttcacctaatcccttctgtatccctgaattttgctcaatctcttggatacccctgaattttagtttggatctcttccatgccctttcaactagttgaccgttagttgaccgttaaattcttatgaaaaagtccattttgcgctttggtataaagaagcatataaattaatagagtatattgttggagcatagaaatgtgttatatgagactattatgtttatgagatagctatgcaccatattatttgcgataaatatacttttagatatgacataaaaaattaatacttatttatttttttagcatatgtattctgatagtaataaacaaatatgttatattactatgaaaacacatatgctacataaaagaacttttaataactaataaataagtattaaatttttatatcatatgtaaaagtaaatttgtcacaaataatatggtgcatcgcagactcataaatataatagtctcatccaataaatttttacattccnncgagaggcttcattaattcaaagtgtttctgtgatggggctaatgcactctgatatgcaactctcg

SEQ ID NO: 34223 - DNA, 14332 bp, Oryza sativa
ttccgcggccaccgccgacagagcagccgccgcggtcctcctagtcgcgggcggtcattgttcgtcgttggtcgtcgtggtaagaaccgttgggttcgtctcgtcgtcctataggtgtacatgtcctcaaaagtcgcagccgaccatccaatctccggcgaggtcgcaaacccgggccggccatggatgacgtcatgctgacgtcatcggtttttctttttcccgtagattaaatcttctgaaaatcatatctaaataaccgtagatccgtttcgagtggttcaagttgctaaattttttctaaaataaagatctacatattaaaattgtccataaattgaattaaatttatttaattctttttaaatgggctttaattagatttaatcttgtaaaattcataataaattcatttgaagtcagaatgaggccgttcaagtctcataattcatctaaaattatgatttacatgtttgttaactttttatgaactgtttatttggtttttattagtctttttcttcgttttgcgtgttagcttgtcgtttccgtcgttgcgaaggttcgtgagtgcgtcggaagtgatcaagaagattaattgaagaccgattattgcaaggcaagtcacacagatcctaaacacaatcctttgagcatgttgatcctatatttaaattctctatttgtttcaactgtgcatttattttcgaatgtcaccgggtggtgtgaaccaattcctttgttatggccaatttgcattgaatatcctattccttgataccttgggtaataaattgattagcttgaaccttatgtattggtttggttcagctaaatgttatatatatataattgcttagcaatgcttagaaacattagctcactaatgggatgaatcatatatactacattattatttatggttatatttaatggtagctcacgatggttaatcgtgttatgataattaattggtatttaaaatatgattaatggtgggttgtgagcacatggttttgaaggtcgtgctcatggcaattaaggaccggttcgcgagctactgttgtgaaacatttatcgtgccaaccacaagccagcatgggcaacggctttatcttttgtatagcgtgattcattatagtgcgccagactgagaagtggcgagaagtccatgggggtcgctggggagtccatgccttgtttataagggggtgattatgatccaggaacggtgcactgttttgagttgtgttgtgcaaagggtattgtcacgatttcccctttgcaatgccgtggtggtatttcggggcatggcaacatgtgtggaatcgtgtcttgtgggtacagtggtacacctctggccagagtaaaactattcgaatagccgtgcccgcggttatgggcgagttgagcaatgtttttcgtgattagtctcacatctctcacaataattatggatgttatacctggtaataatttgcttagctcctggtttggagttagatctgttcagccgggtatggttgttcaggatggttgggcctgtgcagcatgggtgtgttgttcagtgttgattaaaatttctgattaattactctactgttttactactcttaactctttgctaaatgctgctttcgcaaatgagcctatattatgccatcctttggtatccttgtgcacttgcatacttgctgtgtggcttgttgagtatgtcatatgctcattcttgcaataatcaatcaacctcagttgaagaaaaaggatccagaaggagaagacgtttggcttataccccagttgagctgcctgtgggagtggagccggagcttcgctagattttatttttccgctgcagttttcttcttggtgaggactaagtgcctcttaagtaagtatttatcggtttagttattatgatggatttgtatattaaattgtcagtttgtgtacctcggctgattcctggacgaggattttatgcacaaatcagtttggaaattactagtgaatttccgggcgtgacaatggtgcaaatcttatcaaatacataacaatatggattgtttgtttttcaaattggaaatcgtattgacctacatttttttaagccatgtactggacagggcaagcactaaaactacaaattaacaatcatatttttcatgtatatgctactactctggctttcaatgaacacgaccatattatacttggcaatcagtaacaaaatctatttttaattggattttactaccgttagtattgcatgttagcttattatggaccatgtgaccgtgtttgcaaaaaaaaaaattaagatagcatataacttcattgtggacatccccacacgacacatgttttatatcatttgcacccctaaaacaagatgagtgacttgtttgagcattctacaagatgggtgattaaattgcacctacctcgcaagttacggtactaatgctagaatttggtaagatattttagtggatttggttgagaaaagaacgcaatctgctgatagaaaacttatccagaagaaaccattcaaggaggaatcgtgaagaccacggcatgacagtttaattctatctattagttaggcaagattcaataattttccttttatctttaggaagtgtttatctagtattcgatcaggacttgtaattttccttttttttctttaggaaagtgtgtttagtgtccgattaggactcttaacggcctacgggtataaatatgtacacctagggccattgcaggacatctttcgatcaatacaacttcggcgcatcgctactctttttatttgtctttctcaacgagttctcgcttcgagttgggctacatcggcttcgatcttcgatgaggggtaaggcttgttatggttgtttgtatcggcggggttatggtctcaatactcttggcttgtcgatattaacacctatttatcatatactttaggtaatttaagttgatgtttcaatttacctgtattggccagatcttttctagggttttgttggtattagttattgtttcatcgatctagattagcaaaggtatctatcacccttaaaaagagtcaaaggcttaattgtttagatattatgtttcttttcatactttgctgcatcaattggttttggcctactaagtcatgtttacaaccataatgtctagcctgttttttgattgccaataagagtttcatcggggttttagtcaatgagctatctaggctttgcatcggctcacaaggattacatataagttggatttagccgatgacaacaaatgttttattaattatttaatcttttggatttaatgacatcggacctctagccgatgtatgttttaaccttcggatcaacacttattccatcatatcattattagccgattggtttctactgatttatattcttgtcttatcacattatcaccactcgattgtctttatatcattgtttactcaagtatcagaatatacattggatatatagccgattgttcaaaaccctatcaacatcggctgacatcgacgtcggctctttgttgatcatcataactgattggcatgtccgcatctaatcgaccttaggatctgtattggagctaagcataactccccgtatcttattaactttaggatctgtattagagctaagcagaacttctagacagtaatgttcgttgacttaaggtcgcgtcaatatatatccagcaccatcggccgaacgctctaatccctttatttgaggagagaccagaatccttattatacattccgttcgctatttgggttggttgggctatagaaaagcccgtgtatcgccatttcgcccaacttcccggccttccttgtccatctcccttttctctcctcctcctcgcgtgctccccgcgccgcttgcgccgatctctccgtcccgctgccggcggcgccgcgcccccacccctgctgcgtgctgctgcttccgcggcatcctcgcggagctccccctccgctgccgccgatccccgtccctcgtagcaccggggtgctggcgtcgtccgccctgctgctgtgctgctgctgctgctgctgcttcttcttctcccgccgcatcctcctcctcgccagtgagccacccgtgcgcgcatcccttccttccttcgcatccggtctcgatctggaagagttttgctcttcgtattaaccttagtcattactattaatcagtttgtttggggaaaaaatatttggggggagggggtggttcaaactgccccacgttaggtctgccctttttgtgctttgtatgtatgtatctcaatggcattgtgttggcagttttgctatctgttagatgactaagaactgtaataaagaaaagatttagtcgagtttgcgcaccgtcgaatccatgtgggggatgtgtgagatttgtgctctagttgtcctctttagcggcatcctgcggtagggggatggcggcggcggcggcaccagattagggttcatggtggggggattgggggagggggtctttgggcttatagcgatgactggagcggtggtggccgtggtggggtgttgaggcgacacctcggccttggaagaggatgagggcgagttccggtgatggcagtgagggaagattctcagataggctaagaggggtgggtgggtggttccggaggttcaagctggaggagacaggggaataaatgggatgagggaggctctcaatggagttgaggagagggcaatgagatagtggtgatcgagggtggcctggtagggagggagtggtggcacggaggggctgaagattgggaggatgaggtggcaaaagaatgagagaaagagtaagggctaagtttgtgaaggctgcacgtctttgaacaatcgtggctatcaaaaagtgagttcagttgaccaatgaatagacaacccctaggttgattcaattgcatttggtaatttttgcgctctaatttgaatgtgaaaaattagtaccatgctgcaaaaaaagagaggaaaatatggttggaacattaaacttgattctcgtagcactggtgaagtggtaaggcaagtgcaggataagttcctcttgcattgcctctgctttgcatatataagtaccagaggtgagggggatgggacgggagtaagttcacccccgagtcaccagccaagtacacccacccaaaatatgtgaaatggtgagagtattgtttacatctgacccacccaaaaatccttgttctatccccctccccccctcgcttcttcactttctttctctttatcctccgtcttcgccctactttgtactatcccacacaggcccctcttgcgctaatttaaccattttgcttatcaaaaccagattagagtctgttccaggaaaataatctgaaacgttgggcctccgtgtatacctgagtgtgcataccccgctcattatactaaggctgtcccactagccagcagaaagtacagagtgaaatatttaccccatttcatagcccttaaatctagcaggtagactcgattatttgattttgtcctctgcctaagacttccaccttggcccgagtctcatttggttgcactgcaaaaactactacctggttctgagcagcatctgtgccaattttggtttgatgtgtttatgagactgtcaagtattgatttacatcatggcataaaataattctagctatttaagtcattaacatgtaatattgtgtgactatatttttttttctgtggaggaattgggatggtgttttttgcagctacctagtcatcttctttggagttctagtgtcaatggggacattgaaagttattttatttgcaccaggaattctgtgtgtgaatgaattatatgaaccccattatttgttcctggctcccatattagcatgtgaatatgggatagcataaacacccaaacactcgtaacatggaataatcgggaatcttgcgatgaagaagctggaatgggattgagttgtttaccgaggacgagggtcgacggttcaggaggtatgtggcggtggctagaccttcggcccaataggagggtggcatggaggcttgtaggaggagggtacggacggagttgttgagggtgcgaatcatgcgttcggccttgccgttctgcggggaagtatatggacaggagagctgtaacagggaacctctaccagcgagaaaggaggtggtgttgtgattaacaaactcggtaccgttgtcggcttggagacacttgaggcggtggccgaactatgtgtgggcatactcaacgaactcaacaatatggcgatgaacatcggatttctggcaaagaggaaacgtccagcaaaaatgagtaaaatcatcaaccagcactaaataaaatttgaagcccgaaatgctcataacaggagaagtccatacatcacagtgcacaagttcaaaaggagaagaggtactggaggtggacttattaaaaggaagacgagtgtgtttccctaactgacaagcatggcaaagggaattatttgtcttggagcgaggtatggcggataaatgttggagagtggtgacggcggttggacccggatgaccgaggcggcgatgccataatgtggaggaggtggcaaggttgcagtgggcggcgatggaaggtgcagcggccgggagggtgtagagctcgccatggctattgcaacgaagaatcacgcgtcgggtctgagggtccttaatagaaaaaccaaactcatcaaactcaatggaacatttattgtcacgggtaaattggcgaatagagagtaaattgcgaaccaaagagggagcaacaagaacatgacgaaggtcgaatctagtggtgccaatagggagaaaggaagtgccacggcaaacaaccggaatggagtgaccattaccaacggtaatataagtttgtgagttggggaggcgagtaacgagtataccgtcggtggaggacatgtgcgaagtggcacccgtgttgagaacccatgagttggggttgtgaagcgtcattccattgagagcggcgacaaggccggcttggtcccaagccagctggacagaccctgcaggcggtggcgaggagtatggcccggcgaaggcagtgtgagcctgaggatacggcccaagtatcccggcgctgggagaacgccagggttgctgctgtcctgcccagggcaagaacacccatggtacagcttggcatggagcagggacggagaaagtgctggtgccgaagctgttgctgccgttgttctatccaccagggcggccgccgaatccaccgccgccgttgccgccgccggcgcggttctgctgctgcccaccgctgccagaggagtggcaagtgcccccggtgcagttggagtgggcgctgttggctgcgacgagggcagtctcggactggacttgtaccgagttggcgttgcgaagctccttgagaaccagcgtgttcctcgcagaggcgaaggacggcaagacaggggcgctcgcgatgttgtcggccgtgctggtgaagcgcgagttgacgccgcggaggaggttgaggacgagctgggactcggtgacggggtggctaacgtcgcggagggcatcagccgccgtcttcatgcgctgacaatagtcggcgacggagagatcgccttgggtcatggagtggaactcgtgatgcagatagatcgtgcgaggctccttgttggcttgaaagaggttgtcgatggcgatccacaagtcccgggccgattgatcaggctccatggcgaggtcgaggacgtcgtcggcaacggagccgaagagccagttgcggaggcagcaatcggcctgttcccaggtggcgtcggggttggtgagaggagcagcgtcaagaagatcgaggagaccgaatttcccacacatcgagcggaagaaggccttccacttgttgtagttggggttacgaagctcgagggagatcggaacatgggacttgacggtgatggtcgcatacgggttgacgaaaaccggggcgacggtagaggtggaagacgacaccgtagcggagtcggtggcagcgaaagtagctgaggaagtggacatggtgagggaagaagggcgtggcagccagggaggcggcgacgctcggtggacatagcgaccagagaggaagcagcgctggagcagcggaagaggagaagaaaacttggaatctgataccatatagaatggaatggggagaacaccacacacccaatgggaggggtggccatgtattaatataggaagcacatgtacaggatcctcaattagaggagaatacaaggaaagaaacaatacaatacaatctgtacatatatggcaaagtattcctaataggcactgggcgagatgcaacaaggaggaagaggaagcggtgctagtcgttggtatgctcgtgcggtcgtacctggcagatagtgggaaggggaagggtgtttatataaactgatgataccccgctgcgttgctgcggaacattgtaatagctaaatcagataaattgtaataacttgaatatgattaaaaaacttctatgttgtttcaagagtgctatgtctatgaggatattttttcataaatcaaacaaaattggcaattaatagtatgaggatactaaatttggttgttagtgtcatgatgttttatgttaggatcctccagatgcggtagtgcaacttttgtgttaggagaagggataacatgatggtcatataaagggtcaataatatgaaagggaacacatctggaggataaacacatgggttacaatctaggaggagaagaaccgttgttggtaggttgttcatgtgtcatgagttacaaagagaagattagcattgcagttttgcagcctgaaaattttatggaagagaatgttttttccatgatatatttttggaatcaaccagcaattgaatttgtacctatggtatttttttcttaacagaagcatccatgtaaataagtgtttaaacgctggaagatatggttacctttgtgttaggaatagtgtcttcaattctgaatccatttgtagtatgcaaaaattacatatgaaagttggacaatgcctcagacggtcagacctggtcacatagatatagtgatgaatcagaaggcatcatcctgctattggcgtgctccttcagctctgaataatcggataatcggcaagttgagcaattttgcccagtgccagcgacctccttctgttctgtatttgggctgcaaaattgacgatgatggtgcttaccttcatggattagaaaggcggtggtggtgcttacctccatggcgctgggcacagcaagggccacccttgataaaaaaaagtgcgttctttagcccgaagaggagtaggcgatgtgcagctggactcaacctggtgccccgacatacatacatgtgagggagatgaaagtggaggggaagtttgagaagatgggcgacgatttgatagtcggaggaaacggattcgatggcttttatgcttattgccaatgatatacagatgtgagaggaaggagatcgaagtgtaaacgaagggatctgggtgaatggggagcgaaccacaggaggtcgtgatccctcaactactacgcacaacagcgctgggaggaggagagtcgccataaaatcagcaaagcaagcggcgcggtgaatggaagaggcacgacgtttgcgcggtggtcgcgcttcctggctgcccgccacgatcgaggaggagagcgatgcgggagaggggagtcgatgcgcgtggggccggcgaagcagcgagatgcgagagaggagaggtggggagcgatgcgcgtggggctggcgccgtagcaagatgcgggagatgagaggagaggagcgatgcgggaggaacggccgatgcggatccaacggtgaggacaaaaagggtgacatggaagcaccaggaagcggagaattctaacagtgaggatgatttgtataggtatataggatatcatttattttactgtgacatattttattattaaagaaaccttaaatgtgacttatatactttaggctaatttatcctaccgagagcgagagagaaagctgagagaaagagagagaggagatggagacttatacgtgatttatctcttctattcaattgtaaataaatattctaataagtgtggtgtccagcagtaaattttttatgatttctctcttctattaaattagaaataaatattttaatagatacggtgtccagcagcgaatttttgtattttgtatacaatgattaatgcgctaaccacagcacaagtaattgaagccccatttcatcaaactttcgtttgtggatttgcatcggagttgccccatgttcgttgggggtacttcagaaatgggctcaggcccattacatggccataaccattagcatcgcactcaggggcgggcccactattgattcaagggtattcagacgtatacccaagatttttggataaaaaataagtatatgtactctatacctcgtatatgtattaagaaattaaagaaaaaggctaaaactactcattttgggccctgtttcatcgtttcttctctattgggcctaaatttcccacttccctcccctttcatctcagcccacaatcagtttgggccacaactagttcatttcccctcctcgcctaggcacagcaaaccaaagccctaattcccaaatcggccaaatcctaaccagaggaccgaggacgtgcgcggtgtggcggcgaggacgtgcggcagtgcggcggcggcgacttccggctgcgtcggcggaaggcggcgccaaggcgggtaggagcctaggcggcgcgtcgggcggcggcgactgcagtctagtctgcagcgtgctcgtcggcggctgcggcggaggcttccggctgcggcgtgcgcggctgcgtcggcggcaggaggcgccgaggcgtgcaggcggcgcgtcgacggctgcggccgtgcggcgttggggctcggccaggcgtgcaggccgccagtccgccaggccaccacacaggtacgcgatgcggcggccgaacgaccacggctcgccggcctggcatggattgcgtgaggggcttgattcattgattcattgcattgatttgttctaggtagttcaatagtagttatgttttctggtggcgacggcttgtttcattgatttgttctatagtagttcaatagttcactagcaccgaaggattcaacttcctcagttcctgtcttctttatttttcagagtgttaactgttaagtgtatatttattgatagattgatagtataaagctgtaaatattaggaatttagataacttagaaccataatatttaattttcagtgtgttaaatttatatatatgatgatagtatgaggctatatatgagctgttgttaggaacttagagaatttagagagggtgttttcttcgatgaactatataaaaacaagaagcaagatgagcaacaatctgcatttattggaagagaattttttgtacaagttaaaggatgaggacatcatcactcatttttaaaatatcaagcattgaaaagttctcctctaaattgtaagttttttttatcattttaccattttctatcctttacatgttatatatgttgccactttcatatgtcgaacaattagtacttatatatgttaaagaatttggacttatgatcaattctatcaatttataaagttatggccaattttgtgttctatatgctataatattatacaattagtaatgtgtaatattataccaattaattattggacttctggaagtaaaaagaattttgttttacccctacctatttcgaatacctaacctctaaatcctgggcccgccactgatcgcactttctctctgtttgctctcatctcgttccttttccttctttccagagcgaggctgtttgccgctgcagcgccggcggctcactaaaccccagaacccccttctctcgccgccgcgccgccgccccaatggcggtggacaaatccggcggcggcggaggcgaagccggcgcctcttcctcctcgtcgggcgtcgccgcctccaccatggaccgcttccacaagatcgtcctcagctgggactacgtccgcctcgtcgcggactccaaggtacgcccctccccgccccgccccgagcgctcgctttgcaatcaccggcaccacctttgaattttttttctatatggcggcttgggaggacagggcgggcagcagcaggcgaaggggctggggcgcgtgaagaacacgtacgcctcggtggccgagtacctcgctgtgttcgagccactgctgttcgaggaggtgaaggcgcagatcgtccaggggcgcagcgacgagaagaaaggtgggtgggtgggtggcgcgcccgatttcgtgttgcccccccaatttgctgtcggtttatttaacagtgtgtgtgtgtgtgtgtgtgtgttgtttttctctcccttgcgtttctgtgtgggcagaggctgggcaggactggcagaaggggattgtggcgtcgtgcaccgagtcggaggggttccacaaggtgtccatggccgtgcttgatgatttccgggagatggtgtcggagaacgatctcctgctgctgtccaaagagaaagtaagtgctttagcaccttagtggtgtgataggaaatgtttcaaaaggtatagatggctacagaatttagtggaacatatagcgtgtcaagaactcaagacaatgttagttacttatctgcgctcctacatttggaagggctatggggaacttgagacataatttcaccagaaaaagtgctttccatggttttagataatatgccaggctagcaaaatgctccatcgattctatgcgatatctcttcaagaaagaagttatgattgaaaattcatcacattgatatatatctgcacttttgtagtttgaagagggagtgacccccagtgcatatgcctttgccttagtggaacagcggggtggcagagaaacgatttctctaaggacatttgtggcaggtgaaataaaaaatcttaatgtagcaaagcctgtgagctgttctaggctgcagcgtattgcttccattttttcaactacagagagcttcctctggattttaaaggtgagtttcaactgctaataaagaatgcctgagttttcatgcttgcataattcattgacaacacatatgaatatgctattttcttttatggttaaaattgtcagatttgcagcttgtctaccataatgcgagaattctcgggcatgcactctgtagcatcacttccttttaaggatctgattctttcagctagtgagaagaacagtggtgggaatgatcaaaaccgtgcttggaatgtccctgagccacttatggattatcttaaaacaaaccttaatgattcacaactagatgcagtcaacgtgagcattattcttaatatccttttttgttgctcaatttagttctaagaaaaatcagatgtctgattgatcaatgcattatctcttgcaggcaggtctttctcgcagatcctttgttcttatccaggtttgtttgcttatttccagttatatttgtttatttttctgtattatttatcattaacctattttagagaaatgctagtgccttgagaactagagtatatgcagctacatgtgctctacttgttgtcacatgccattcatatagaactccaatgtatatttgtaggggcccccaggaacaggaaaaacacaaactatccttggacaaactatatatatatatatatatatacacatatatacatacatactatatgctgcaagacatgttgcgtgacgttgagaacctaacttatgctgtgttctcatgttcaggttgggaacatagtgcctccgcacggtaaacggagcggttcattagcgcgtgattaattaagtattagctattttttttttcaaaaatggattaatttgatttttaagcaactttcgtatagaaactttttttgtaaaaatacacaccttttagcaatttgaaaagcgtacgcgcggaaaacgagggggaggggttgtgaacaaggggttgcaaacacaggcttaccacgagagagatttcatgaagttcaccagttgatcagtgatcggagacacctctatacgtctgatgccaggaaaaatcaaccaaatgtccgctacctggacttaatgaacttgacgccagtttggacgtcagaccaaagtacaaacctttgtgatttttaaa

SEQ ID NO: 34224 - DNA, 839 bp, Oryza sativa
  unsure (1)..(839): unsure at all n locations
tgggatttgaaaaccgagttgcagatctccatcagcttattgccaatgatatacagatgtgagaggaaggagatcgaagtgtaaacgaagggatctgggtgaatggggagcgaaccacaggaggtcgtgatccctcaactactacgcacaacagcgctgggaggaggagagtcaccataaaatcagcaaagcaagcggcgcggtgaatggaagaggcacgacgtttgcgcggaggtcgcgcttactggctgcccgccacgatcgaagaggagagcgatgcgggagaggggagtcgatgcgcgtggggccggcgaagcagcgagatgccagagaggagaggtggggagcgatgcccgtggggctggcgccgtatcaagatgctggagatgagaggagaggagcgatgcgggaggaacggctgatgcggatccaacggtgaggacaaaaagggtgacatggaagcaccaggaagcggacttatttattagttattaaaaggtcttttatgtaccatatgtggtttcataggaatataacatatttggttattactatcagaatacatatgctaaaaaaataaataagtattaattttttatgtcatatctaaaagtatatttatcgcaaataatatggtgcatagctatctcataaacataatagtctcatataacacacttttatgctccaacaatatactgtattaatgtatatgcttctttataccaaagcgcaaaatggactttgtcataagaatttaacggtcaactaacggtcaactagttgaaatggcatggaagagaccacactaaaattcaggggtatccaagagattgacn

SEQ ID NO: 34225 - DNA, 5102 bp, Oryza sativa
  unsure (1)..(5102): unsure at all n locations
cgggattgataaccagttgcagtacttcatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattcactgcagattagtgctggtgccaaaacgtgaggttactgcgagtgcagcaaaaggatgtaccgtggatttctcgtacattttgcttgaatgattttttactgaattacagggcctgaaaaaggtgaaaggtactgaaataacagcccagcggcaaaatcattgcacatgggtaaagaagcaaatcttccagtgagctgcctggatctcatcgacctgagtaggtcagatcctttatttatgtagtctagtgtcgtatgagattggcaagacaatgttttcacacggtgttgaacgagtgtacgtatgttggagacaaccagatgatgagttgatgatggaaaagaacggacgaatttggtatagtataccacaatttgaagatgcatctgggttgtcaccgaaacttgatagaaaatttattgagacggttcatttagttatggttcttgggcgaagaatggagccaaacagttcggattctttaatgattaaaactcaggtccacacattaaggcgataatttcaataattaaccccatacatcaaatttttttagctcggctattgcatttctagaagacatcacggtaaatttaacctggcacataattcacctccataaaactgaaaaaaggttcattattcccataactatttcatcaaacaacaaccttcatgctttcttcatactagcaggacggatcacacaatgcagcctcctcgattaggacttgtcggttaatttttcatgagggtattggatagaatcgaggggaatcaattccacaactattaaggtgtgaaatcaattccttctaatcacgctgaatccatgcataggaattagccgaacatgccagtttatatttcctttgtctaatatagaaggaacattattaacaactcaaactatttgtcaacttcaggtaggagtggaggtagattttatactgcaatattaggaatatataaatacatgactaccattatgccacctatacaatgcgaactacggaaaagggtgaaagaaagaatgtcaagtaaagaaagaaagacggaaagaaagaacggcaagtaaaccgctgagagaagttttacagaggaacgtttggattggatgtttgcatcaaacacgtgtataaagtttcacgcatagattttgactgtaacgagcctcaccactactctgttaagaagggtgaacctaattaaagcagcgaagatttgcacaggtaatgaacgcctgaaggaacatggactcgctgctctccaacttgcataaaatttttccaaggggtgtagctttcttcccacttcgtttaaacatctaggcaaaacagctgatactagcatctcaaatgtacagttgtgattcaaaagaatgacagaatctcatctaattattgacactactgaaactgcttgttgattcatcatacttccacctgtcaaataaattgcagagagcagattatgtaaagtttgttgagcacaacaaataaactgaaccagtcggaatgaacaaaaattataagcaattactctgaacagaaaccactgggttctgaaaatggattccaacagacattaatcaaagtttgcaaagttggaagttgccttctcactactaaaatatgaggaaatattcaaccacaaatatattcaactactaaaagatattatgacaagttgccaacagatactcttgtatgcacaaagatttcaaccatgcagcttactgctgcttgagcgcaagctatgtggaaaggggtacaaaaattttgtgcgcagtagtatacataagttgcacctgactagggctgtcaaaaatgctcgagactcgtgagctactcgagcttgattcgttatgagcttgattcgagctcggctcgtctaagaatcaaatcgagctcgagcttgactttaagctcgcgagcctaccgagccgagctcgaataactcggcgagcctcaacgtctggctcatgttctttctcctaggcatttcctccccctctctctctcttactcttcaaattctctagtaggagtagtactggagtagcacaactgcacatgtactagcagtggcagggcaggagggagcactatgcatttgttgtcccatttcccaacaagagagtaggagtactagtgtgtactagtaggagtactagtgtgcggcttgcacagttgcactagtatacataggagcactagtatattatttttagccatctaatcatgcatcacagtgttagctttttctttgaatgggatgaattgttccagtattctaccgcacgaagcaggcttgagagaagctcgaagctcgaacgagccgagcacgagctcaacttcaagctcgtgacaaacctaggctcggctcgagctcgactcgagtctatagcgagctcgagcctacacatggaagctcgctcgagctcggctcgttgacagccctacacctgaccacatcacaggcccatgtactggaaagcagcagaacgtacatgtggaatggtcgaacgcgtacattacactatgatcttacaaacctagttttcctggaacctacgagtcaagattttgattcagacggtagattttaccatttggatcacaatccaaacaatcttagctggcagaatgaatcctaatcaagcagagtagacaagatcactatgtgctccgatcaatccttgacttggatcccaaataatttgttagctgcaactatttcttactataatttgtgttactaattcatttaaaaaaagatatgctagtaacactcctgcgtgttactaactcgccttctaaccttacaatagtcttatatgactaggttgtatgaagggaaaaatttggacaactattacaaatctcttttgccctttgtcacattttgagaaaaaaatattttgacaattgaatgaccctggaggaagtgtattacaaatatcttttgccctttgtcacattttgagaaaaaaatattttgacaattgaatgaccctggaggaagtggcctttatgtttggtagttcggtactgtattcaatatatgcattgacatgaattaaggccaagtaggatgatgtattagataatacaagtttcaaatgtttgttacataaaaaagatcatgatacacaatttctattttaatagtgtgactcctgcaagccaagtctactattttctccaagtaaggcagggctgtggctgcccaatgggttggttgcacagccaggttccaacaaatgtatattagttaacattaacttttttaaaggatttgatttcaaattttaactcatcattcacccactaatttaagacaaagcatcaaaaagacaaacctgcagaggaaaattggatgtagcctactactgacaacctgacttcccttagtttcttctctaaacttgtcaacatgaagaacctcacattggccacaaatcgcggaaactgttacagttctttgattacaggaagcaaatacctggaagaacataacaccatcaaagaaatgtagtaagttattctcatttatgatttatcacaacaagaacaatcagttcctcaccgtgaaaatttggcaatatattgccacacaagagaagcataaaaaatgtctaatctaatttatcgatacacgagatttccagcactgcagattaaaaatctactatttaacaatcagctatttaaaagccaaatgtgaattacatagatttttcatgctatttaaaagaactattgataatgcaaattacatacttcccctagccaaaagcaatcctcctaaacagattatatattcttcacaatggttagttggctcacctcattctcttctgcagtgcatggtttactgatcaattctggaatatctgaagcaaagaaatatggactaaccaaagccatcttagacctagaatcatgctcttcccacagtgactgcaaaaggtaacaataacttgactattttagagataatacacttacaaagtctaccacaagatgatctgacaggtgcatagggggcggttactcaaacaccccagtacgcagaggggtttgcgccccatatcatacaagagtatgtagggtatattaagaggaaagatacctgcagcttggatggagcagactccttatctttggaggcaaccaaaatatgatcatcaagattgtatgctataccatcaatgttacaagagtaatagtaagtcttgttctcgactactctgagaggatcaccaacccaacccacaatactgtgatctgtgctgcaaacaatagttttatccttagcatcgcctataacaatttcattctttgtagataaatccccattcgatgtcaactcatgaacattgccacgttctgaaatggcattattttccattgttcccacaccttgaggttttcctcttcccttatcaacagctgcagaagcagagcctgattgtgattgttcttttgaactctccaaagccaacttatcactattatgtacaatcctgttagcttcactggagtttttatcgataactgttccatctgctgcaagttcttgattattatcctttgtagttcgattttcagaaactccctgcgaaggaactccactaataagattaacctttggtgcaacaacagttcttgtaaccttgccatatttcggaggcaggggttttcccttgctacgagctacacatgttggacaataccactcagctttaggtggtagaacattgaccccgtcatgctgaaggcattttaagtgtattgatgagctnctgtaccantgtatgtgcattcagtggccag

SEQ ID NO: 34226 - DNA, 4478 bp, Oryza sativa
  unsure (1)..(4478): unsure at all n locations
caaagcaatgtgggggtcttgggatacagaacctagaactacaaaacaaatgcatgttaagcaaatggttatataacttttgaaatgaagagagagtttggcaaaacttgttaagaaggaaatacctatctaagaaaactttgactcatgtagagaaaaaccaagggattctcatttctggtcaggactcatgatggttaagaacatctccctttcttgtggatcattaaaagtgcacaatgggactcaggtcagattctaggaggataaatggaacgggaatactccctttgctgctcgttacctggccttatacaaccttgtgataaacaagaatgaatcagtggcagtggttatgagtaaaagacctctaaaagtgtcctttaggagggctattgtgggtcatatttaaaagcttggttggaagtggtctcaaaggttatatcaataaaattgaccgagcagaatggtacctttttgtgggagatacaaaagaatgggcgtttctcagttaactcaatgtacaaagcaatcatgtacagggaagtcgttcctaaaaaggacatgatttggaaactcagaataccactaaaaattaaaattttcttgtggtacttaaagaatggagtaattttaacaaaggataatttagccaaaaggaagtggaaaggtaatgttaagtgttgtttttgtgattctaacgaatcaattcaacaccttttcttagattgtattttagcaagattcatgtggaatgcagtctatatatcttttggaattcacccgtctaggaatgttgctagtatgttcggcaattggctaaagggggtttaacccaagctaagagctcaaatccttgtggggatttcagctttgtgttgggcggtttggttatgccggaataatgtagtctttaatggctccaatactaattttctgttgcaggtgattttcagggggactttttgggcaagacaatggtctttgctacttaagcaagaacatggccaaaaagtgacacaaggttgcttgattctagagaagagagtttctggctttttcgcaatgaagggatggaacttaacgaaaagattgggagattaatgctctctggttttcttgtgtggtatggttgaaactttgtattaactttttaagaatttctgttgctagagcctaagtactcgggtctagttgcttgtgatggtgttaaaccttgtgtaagggtgtgagtttatgtactcttgtaagtttcgttggggctgtgtacatccttttttgggtgtagaggccggtttaatccattatctaaaaaaatgtaaaggatgcactatatggcactctgaagtaaggtttcctgagtatggtcttttggtgaacaaaagatgggagatggatttttatcgctcgaggagatatcctctcgttttcttattttgtacatggcattgaaaaaatcatcagaaaattttgagaaaaaaaatggaaagacagaccagtatgtgatgtgtcattccacaaccatgtaagcttaaattcaacttgtacaattagaaacaaatatagcaaatttgactgtgaattacgtgttttattcaaagtcgaatttgttgtatgagttgaatttaaacatgcatgtttgtagagtggcatatcacatattgatctagcttgctttttttcaatttttttagtgattttttgagtgatattaaaacaagaagacatcctgtcaaggtataaatagtttcctaaaaggtgtatattttgtaagactacaatctagggatagagagagagagagaagagaagagaaaatctaagaaaaaaagttcaatccacatccagaaatgaaccagtggttatggttttgcactcactaaaaaccagactagctacaccgtaatacactttgaacagctacataatacagagtagcagcagcgcttatatacacagtttggggacaactgcacaaataaacccaacaatttagctatttagacgaccctctcatccttctgcattcttctctaatttttggatcgaaacacaaatttatgcttgtgtgttatgagccactactatttggagcccccactatcctctgcacataaagatcagagcttagtggaggcacgacgaagctcatcccgagcttacacagccatccaaagctgtatccttaaaatgcgcaagctgctaaatgattgtcagtctctagcctgaaaatgccggtgccttccaacccacgttttagttcatcccaaggaagaatggtaaatagagagcaaattaaatggtagaggctatttaacctccatggtcatccaagttaagaggaataattggcacgggtgctctctgtttatatatttattatatacagtgcatgctagagattctagttatatttgtctttctaaaagaattgatggagacaatgatatacacatgcacatagaggtacttggaatctgaaactcatataggtattgacaattagaagcctcaaatcagcactatgatttttgggattatttttccttgtactgaacaacctgcgtacatagctagatgcatacatatgatctgaaaaaataaagatcttaagaaatcttcgtagacgaagatttcatgatgtaacatcccgtctctcccaggccgggcccgcttacatatggtagctttcataggtcatagactgccctcacagatcaactttgtccttactagtgagtgtgaactcaggaagaacttgaagaacttacatatcttttctgcacacttgaagaacttacatatcttttctgcacactttatccgtccttactagagccctcacagaccaactttgtccttactagtgagtgtgaactcaggaagaacttgaagaacttacatatcttttctgcacactttgtctgtccttactagtgtgaactcaggaagaacttacatatcttcttcccgatcggtcacccgtccctaaattgctccaagccaagcacgattaacctcagagttccttagtgatcggcttccgaaaaaaaagttgcaacttgttgatatgagtattttattaatcctattaagtactaggctgggatgttacatatgattaacatcttttttacggcatgacaaagatgatagatttgctgcacgttaactctctcgtggttcttactacccatgcctccatagctacttatggtctgccatacacaccctctgcaataccactggcgatgtatgagccactcacgtgggaccagacccgcttgtcagtgacttctagttctagccgcagtgcaaaggatctatgcgcattttatcacaactgttgcatggcctaaagtcccagtgcctcccagtcctatagttcgagctactaaaaaagaatatatatatatatatatatatatatatatatatatatatatatatatataggacactcatatggggcaccatggtgcccgggcaccatggtatgaaatacacaaattcgtccaaatttttcaaaattttcaaattgtgagtatatacctagttataagtattcgattcatacctatacctagcaacaaaacaactcaaatttaactttatttcacaatccattattacatacctaactaattatatgtttggatgctatatacctagaatcaaaatctaacaaaagcaagtttgaattcagttcaaacttgctttgaactagttagtaaagtagttaacgttaatacctaaatatttgaaaaagtttcatactcatttgaattgggtatatagtaaatttcaatcatggtgcccgggcaccatggagcaccaaacaaatttactatatatatatatatatatatatatatatatatatatatatatatatatataaagggcttcatttcgttagaaaatcacatattcatttccttcgtatgaacagagaaaaatatgatgactcaaagaaccctaccacgaactttgtacagcgtgcattacttagaacgactaggaaagtaagataagataagcaagaataaaaaaatatttgtcggaatagcggaatagaaaattaagaaatgcaaaaatgcagaaaaagaagtgcctctatttagagatttatctacttagatgaaaaaaatcatactctatctatattattaacgaatatgtatcccaacccatctcgaggtatttgtatcaatacctattcggaagatcccttttttctgtgccaggaactaaatttgaactggtgacacgaggattttcagtgtatgtatgtatgtatgtatgtatgtatgtatgtatgtatatatatatatatatatatatatatatatatatatatatatatatatatataactaggtatatactcacaatttaaaaattttgaaaaatttgagtaattttgtgcatttgaaaccatggttgntgngctcatgtgatcgcattcagaggtacag

SEQ ID NO: 34227 - DNA, 1500 bp, Oryza sativa
  unsure (1)..(1500): unsure at all n locations
ttcgtgaaattgttattctcttcccctttttacgacttaaatcaacctaacgctcttaattcggacatgagctctgccagctacctcatgtgctagagctctgcaattcagccctaagcctaagccagaaagatcattttggtttttaagcatagtaagttagtaacacaaaagtcacacatacaagtcgacttcctttaaacaggaagcaataagcaaacttaacatttcgcatactgcatgctaatttcttttagtaagacacaaggaaaaagatggatcgaatcctttcagatcttctacgtagcaacgtgaaaatcacaaggcaatattcatacccaggcaaacaatcagaagacaaagcaacctcaaaagaaactgacgattgctttacttccaggctacagctgacgaaaatttccgtcctgattgctactggtggagaaggcaccgatctgatggtgattgtgctttcaattctcttcgcctgcgcaaaatccaaggtagcaggcatacttgaattcctgatacatcccaagccccagaattcttgccagaattatattgagaaccaaactcatgcctgattccatggccttgtgtatgcatcatgtaggcatccaacttccttctgcatcaattcctctcggtgtgtgtgtgtgtgtgtgtgtgtgtgtatggtgttcctttaatggctcatcacttaacaaggctatggagaattttaacactgactgaatcatgtaaattgtaaaaaaaaatgcttatataggatgacacaccgatttcggatgactgaaatctcaagccaatcctctgcatacattagcacctttgaaaatcgtaatatatgtcaaacataccaagtggtcacttaagactggtacaggagaggaatgtgacatattacgatgttaattagctgagagagtgaaacattcatggtcattttattcggatctaccttggctcgcatgcaagtgaaaatgaaccacccgtcttctcggggcatacatcgcaacgtgctgcagctatatcctaatcagaatcggcgctaacaagagctgggtttggagagaagttgagtatagtgcattgggatcgtctggtagtcacactgagttgatgctacggttagcttcggttcccggtgcatcccaatcctatggctcatgagcacagcttctttctttctttctttcttatccctgcacatctcgtgaaagctgagtcttcatcacatattgtgcagcatttaaggtagtatttggttggtgcgatggaatgggttgggatgggacgaacctgtttttcgtagcgtttggttgggggatagatgggatgggttggtccctttagaagaatattcccctcagatccaagaccaaatcatccagcaaaaacgagtggatgagttcgtcccacctgggtcggatgcacggcgtgagaaaagctgatgaactncttgcagacgaagaanntgcaaattcaatggcgcgc

SEQ ID NO: 34228 - DNA, 2237 bp, Oryza sativa
  unsure (1)..(2237): unsure at all n locations
ctgtncnatgaactgcctatcgtttgacagnngctncataaatggagagttttgcatcctagtgaagtgtgtacaaagcaaggagcatctctctcatacagtactgctcagcatgctagttcaaggtggctgctgcaatttttgttctgtcatgtgaggttttatcttacgttcataatgtaaagtccctttctgagattggtgagctgtgcaatatgtaactttcttggattccatccattgcacaggggctagtaaaagtaaatcatagactggatatctggtcaatcagttgtttctggctatatcactatttgcttatgtagttaactttgttggtttagttatcaatccaaataatacttgtcataccacaggttgtaggttctgcttcaacattgaaggaagataaacactggaacaaccttgttgagagtgcaaaagagcggggtcgctatttccaggtttgattgctgccaccttttccttttgttcaaagcataggaagtaaacacttgaatgaatctaactatgagcaccttgtaggttccgaagccattcaccgcattctttgtggatgataagctgaaaaccatgaaagtggagagagctcctccggagctgaggactgtgcaagcattggaagcaataaacgaagcagttgtagggcaagaactcatggatgtcgacgatgctggcgaccaagaggatgaagggtatgatgatgatcccgtggaggctgatgatggtggcggcgatgactaaccattcactaccacatagaggtatgtagaagagcaacatttgtttaggtggacttggatgctggaccccagccacagccagggcctttagttgagccttcgaattacaaattcagtgccgtgattctttgctatttcgggtgcgagaggtggctgaatgcctgagttcatagttgcaggcatagctacatcttatgttttaagttatgtatgtatacaaagccccttgcaccaaaagagctgaaaactgctcaactggctttaatttgtctgcggctataattttgcacggcagttgtgcatattgttccaaaaaaagaaggttgctctaggctgtggcagtctgatggcattttctttggtgttcgtaggtaagtgtgtaaccagtgatttatctcatctttcttttacatggggtacttgcagttgtcgaagaaaaccattgtttgcttttctatatgaaagccaagtgcattaaccgcagcatacatgcactgcctgagcggcagaacacacatgggctgccatcatgagtttgcagctgctgcctgcgtgtagatgagctgcacaacagatggcattggcctttaaaaggcagagtaaaagagcaatatatgcagtgacatgtacacagagacaccgagaaaccaagtcgagagaggcgtgtatgcacgacaggaggggtttctagtgcaattctttggtttttgtttttctcctttttcatgctcaaggtaaagtgagctggatgggcgcattctaagccaagaagtctctctctctctctctctatatatatatatatatatatatatatatatatatatatatatatatatatatatatatatatatatatatatatatatatagatacacacatactgcgagggagacataaggggggcactggggcgccggggcagcgcgggcgcgagcgcgcgcgagagcgcgcgtgcgcgagagggagctagatggggcgctatacctagacatacatatatatatacatatacatatacacatatatacatacagatacagacacacacacacacacacacacacacacacacacacatacgcggagggcgcgcgccccaccgatggacagggggacccacgcacagaaaagcgggccccccgggcgggtaccgacacccacgcctggggggcggccgggacacacacgccttaatgacacagggagggcgcgccggttacacgcaacgagatcgcggtcaagacggcggcgcctccctgtgccgggtgtgggcggcccaccaccggcgcccccgggagaccgaccgacggggccggcatttggcggacgccagctccctccgccacaagggctgccggccgcgcgccgggccagcgaacgggcgggggttccgggagccatcatggtcgcccggcgctcgcgcgcgggcgagagatgtggcgctcctcgacacccctggagcccgtctc

SEQ ID NO: 34229 - DNA, 1008 bp, Oryza sativa
  unsure (1)..(1008): unsure at all n locations
ctgnnntttgaacgtacgaacaactgcacagnagcccancatatttctgttaatattttgtcaggttggtgacccagttcagttgcctgcaactgtaatttcatctactgctcagaagttagggtaagatctctctctctctctctctctgttctatacatactctggatgtaaggttttacaacattctaaataatactaatgtatccattaggtacggtactagtttattcaagagatttcaggctgcaggttttcctgtgcaaatgctcaaaattcagtatcgcatgcacccagaggtaatattgcctaaattcatttaaaagatggagactggagtcgttttcttattttattaatccactaaaaaacagattagtatattcccctcaaaagaattctacgaaggtgtcctagaagacggggagggactcagcaagaaacgtccatggcattcctacagctgtttcggcccattctgcttctttgatgtggatgggactgagtcccaaccatctggaagtggttcatgggtgaatgaggatgaagtggaattcataaccctcttatatcatcaaatggctatgcgctatccagaactcaaatctagttcccaggtagctgtcatatcaccatacaggcatcaggtgaagctcttgaaggaccattttcggtcgaccttcggtgatcagtctaaggaagtgatagacgtaaatacagttgatggattccaggtttgttttgcatgcaaatgcagacctgctgtatatgtagatttgtagcaaatcacagtgattataacttttgtaatgtttgttcttgatgctcacatataggggcgtgaaaaggaagtagtcattttctcatgtgttcggtgcaataaggaacaaaagattgggttcgtttctgattttcgacgaatgaatgtcgccatcacaagagctaggtctgctgtactagtatgatgnncnnctgtnccatctgtntgtcatgcaatcaatggcacag

SEQ ID NO: 34230 - DNA, 3998 bp, Oryza sativa
  unsure (1)..(3998): unsure at all n locations
ntcaccaggttgatcagtgatcggaagacacctctatacgtcggatgcaagaaaaaaaacaccaaattgtcagctaccttggacttaatgaagctgaaggcaagtagtggacggacagacaagagtcacagaccttttgggaatatttaaagccatgcttctcgagaagaacacattgcctatgacaacatatgaagcaaagcaggttttgtgtcctctgaggttagaggttcgtagaattcacgcttgtccaaacgactacatattgtacctcaagcaatatgcggacttagatgcttgtcctgtctgcaagacttcttgatacaagcgaaagaaaagtgttgacaaaggaaagaattcaaagcggggtggtccggcgaaggttgtgtgatattacctatcattgattgtttcaatataatctttgccaaccccaaggaagcggagttaatacgttggcatgccatagagataaggtacatgggagttctaaagtcccttgggagttctgaacaaaggtatgctaagataccctgcagattcgattcaatgaaggaatatcgatcagaaatacctagaattcatagccgaccctaaaaacatgaggatatgtttgtgtacggatggcatgaatccttttggagacatgagcagttctcatagcacttggctagtgcttattgcaaattataacctaccgccatggttgtgcttcaaaaagaaaatacattatgttgtgcttgttaatccaaggaccgaaacaatccagcaatgatattgatgtgttcttggagcatgttatcgatgaccaagaaattctttggaagaaaggtgtggaaacttgggatgcgtatggtcaggagtacttcaagctacaagttctattgttctgcaccattaatgagtactttgtacttggtaatctttcaggacaaactgtcaaaggaaagaaggcttgctccgactgtatggaagatacacgtagtaggtggctgaagaaatcacgaaagatagattacatgggtcataggagatggctcccactacgtcacgcatttagaagaaagaagaaaaatttcaaacggtaagagagaacttcagtctgctgctaataatttgtccggagataaggtccatgacatggtcaaggacataactaatgagtttgggaagaaaaggaaggggattcctaacgcttacgcgctccgaaggccgacgcgtatgttacgcccccgtcgctaaccatgtgattagcactaatgatgacgtgattagtgattagtgctaatcatagtacctacaagaactttttcttttttctaatagattgaaaactttcaagttagatttgaaaactttcgacttaagatttaaactttgaagtcaaattttgaaatctttcaacacaaactttgaaaattttcaactcggaatttaaatttgcaagataaattttgaaaactttcaactcgagatttgaaaactttctactcagatttgaaacttttaactcgagattttaaatttgagttataaaaaatatttttgatttgataatttttgcttgtattatggctgtgtttagatccaatggtgtaaagttttggcgtgtcacatcgggtatgccggcacacatttgaagtattaaacgtagactaataaaaaactaattacagaatccgttagtaaaccgtgagacaaatttattaagcctaattaatatgtcattagcaaatgtttattgcagcaccacattgtcaaatcatggactaattaggcttaaaatattcgtctcacaaattagtcgcaatctgtgtaattagttatttgtttagcctatatttaatactctatgcatctgtccaaacattcgatgtgacagggtgtaaagttttgccaggggaactaaacaaggcctatatggatctaaaattattttagctatgcatgtttctagattaatatgtactcgtgatctttgaaagttttatcttcttaaaggacccttgagcttgtactcgtggaaacaaaatgtgagctatcagtgggtacttttcactttcatcatgcatgtgtaatttgtaagttccgtgataaaagtgccttggtcaatcactcaagcactttatcattctcatgcaaacaaagattgtttagctttagaagtatcacctctgtcatgcttgaaaaggaataacgtgcaagtttcacccaaatatgccaaaaaagacgatataattgccacaccacgatggtgacgtagcattattgtatttaaacaaggaaatatgtaacgtatttgatattttagttttgaatatgtaaatcgatcatgagatgaaatttagtactccaatgtagtactcctaccaatcacttaattaataaataaaagttaataccacatgattaattatgcacataactactccctccgtcccattttaaatgcaaccaaaagtttctgtatccaacttgaacagtctatcttatttgatttttttaattagtatttttattgttatgagatgataaaacatgaataataatttatatgtgacttatgttttttattttttaaataaaaaaattaaataagatggacggtcaaagttacgcatggaaaatcatagctataattaaaatagaatggagggagtactagttcgacctacgctgcaatgattggatgtttggatccattcattaattttctacacaaaatgttggcccttggcctaaaagaaactaactattgataaattattgaaaaatatacatgtacctgaactagagaactagagtgtgcttgaatcaacgggttgtgaaccctctcactcatgattaattaagtattagttaaaaatattaaaaatagattaattttttttagaaaaatcgtataatagtttggaagtctactgagaaaaatgagaaaaataaatgagaaggtagttgaaactgaaattaaaatagtgtagtgccaaacacagtaggctgtgttcggatagcagggatgggaacccaatctccccgtacggaaaacggagcgatccattagcgagtgattaattaagaatcggctaatttctttttaaaaaatggattaatttgaattttttaagcaacttttgtatagaaactttttacaaaaaaatacaccgtttagcagtttgaaaagcgtgcgcgcggaaaacgagggagaggggttgggaacttggagttccaaacacaaccttagtaaattttcataaaagcaaatccaaatacttgcggaaaattggcagccgtcgtctcgactcaaccagtagcacgccagccttcagccttctccttccttcggccggccgccttttcactccttcacccaccggcatggccaacctccatctcctcccccttcttctcctcgcccttctctcccccgccggcgcgggctccggcgaggcgcacgcctccgcggtggtggcagagaagggcctggacttcgccaagggcgtgctgatcggggaggcggtgcggtcgctgaccccgctgcgcctccccggcgtggagaaggccgtgcgggtgcccttcctgggcgccatccgcgtcgccgccaccaacatcacgctctttcacctcgacgtcggcgacgacttccgcatgcaccccggggacaccgccctcgtcgtcgtcgcctccggagtcagcgccaacctcagcatgggatggagctactactacgattcctggctcttccccatcgagatctacgacagaggcaccgcttttatcctggtagtactaaccctttgcctagatctcgagttgattgttgcctaagaaaggattcaattcgatggcgatagcgctagaaatgggtagggcctcattggtggaaaactagaatgtgggggcataagctggcaaagctgccgttccagttgctttagaggcaaaaatcgttcccgacgcatgatgttcttccttcaaaacagaaaagaggaccttattcc

SEQ ID NO: 34231 - DNA, 9148 bp, Oryza sativa
  unsure (1)..(9148): unsure at all n locations
atttaacccaattttttttataaatttttagnttggcatttgtatgtggtaatagaccttataatttacttagggtattggtcccatgataaactgaactattgataatattccttgagcaatctcatatttgtaatgtcttaagtaataagggtcagaagtgaaaaaattgcataggtaattgcaatttcatgggggacaacatcttcgtggcttccctgtccactctttcctgcatggatcaccctccagattcagacatctatcacattttgctcaacttgatggggctgttgatcccattggcaaatgatgcctatagctgtgacttatgaaatgtgatgttgtatcattcatgtttcatgtaaatatcatagggtgaacaagctgttttaggtaattttctgctttatctttaccttttgttctttgttagtaactcataagtgctttctgtgtctaaggttcaaggaatggaagttggtataaccatgcaaattaagaattataacgggagtttgtctctctctgtgttgcaatgtggatgtaatgtcaaggacctagtgatatccctggatggtggagcatcttggttttatcaggggtatgtatctcttgtgttaaagaatccataaatgttactttttaaattatggcaagtcgattttccatctgagcctttgctttgaagtttaagatctgaaatacttgttttgatgattcgaggcctcctttaacccatgatttcttcctacactgggtcctttgtcgaggaaattacatattgcaatgttcagacttctgtacaaaattggcatatatctgtgcattctgacagtgatggcaacctttcctttgcatctgcttcattatttctactaaacatgaattttggagtcgtggcatgtttgtcaagtcagagctaatattatcaaataaaacgtctcttctgtttggtgctttggtggttttgtttgagtctttcctttggggtcgattgacagagataagatttcattcactatattactatttgctggtacacatgtatattcagataaatgatcccgtgttattctttttaattctgaagcatgtcaagagcccaaatgtctatcctcctagattaatcgctgagccttattcccctcctttcttgaaggttaataaatgctttcgagggccatattaaagctgcagttgagacgcaaatcctagaaaatattattgacggcacatccaaacttgactcgttgcttcaaagccttcataggagtgtcaatctggctaatatttctgctttgaacatgacttttgttacggatccgcagtatggaaattcctcaattgagtttgatatcaatggattattctcttctgcaactgctaagcttagcaattcgcaaaagcatccccaactttcattatcatgtggtggggcatccaaaatgcttctgctttcacttgatgaagctgttttcaattctgcattagaggtttacttcaaggtaatcaaaacatttgtgtcaaaacaataattcatgaatatttacttttcacttgcgttgttgcttgtttcttggattttatgtcagctactttttttttcttcaggcaggttcaatgcattgggtagttgacaaaattcccgatcaatctctactaaatacagctagttggaaatttatcattcctcgcttgtactggagctatcccaatgatgacatgctgttaaacatttcaatggcttcacccccggtgatgaggattacgtctgaaaagattggtgctactatatatgcggacatgataattgatgttttacatgacaaagagacaattccagttgcatgcatctctgtagtaagaatcctcaactgctaaacttcatttatgatgttgtgcttttgatgatgttcattgctaaggagagaagattctgccattactacaactcttatttgaacgaagtgcaaaaaaaaacgatctttttagtcgcagcccatgttgaatgcatcttgaatagagaggtgcttataagaaaatgaacgccatctatcaggctggaagtaattaagtctgctcagtattccgcaatactatcacacaatcctctagaatagttaggccatactcttctagattgaacttgactgggggaattcactttgaatttaataaatttattgctcgtgaagtatgtgttcgcatatgccctatagatcggtaatgactccaaacatgggcagnnnnnnnnnnnnnnnnnnnnnnnnnnnnnnnnnnnagtttatgtacctgcggacgatttgaccgaccctgcttgcactacttcaacatctctttttgtgtcttccagatcatatatctgtattcctgagtgcgattctaactactggaatcattttttttcttggtaggtagtaagtgcctcaggtgtcgcagaggcagcaggcaataaagtatatggtaaggttgaattgggcaatttctcccttgccttgaagtggagcaaaattggtaacttccacatgtcattgattcaggtaacagaaaaattagctttctttatacaagtttatctttcctagattgctttttatcagcattatagcaagcttgattagtctgttagttaactactgggcctggctaagtggctatttctgatcattttgtttctatccatgtgcgggacaccattatcactttatcagtgaaggtttttgttttctcggttcatgcttaataccaaatgataacgagtttctgcttgcagggagtgattcgtgttttcttgaacacggtttgcatgccctatttgaactcacggctggggcatggagttatcttacctgtggtccatggtttcacactcaaagacatctacgttcttacttctcctgagaagttgacactttgttctgatgttgccttcgctaatgcaagcagcctggcaactttaccaattttgagatcccctcgggttttatagggtatatgtgtacctcacgtttgggccaaaaagggccttgggcataatagtaagtgcacacttgtacatatacatctgtacattaagataaatgtacatagtttctccttcattgatatattcacattcatgattcatttatacaaattctcttcgtatgttctttttaatgattagagcttgtactgttctttttaattctcagtttcgatcctttacatcttactgtcttattgtattaatatagatggttgaaatatgaggatagataatggacacattttatcgccattagtcagcctagacccaacaagatataatatagcaacctagtcatataaaaaagatttttcaagataaagttttacttcattgttaattttaagatgtttctagggcctagttctttttctccactcacaacttcatttaatgctccatatatgtgtccaaacattttatgtgacggaaaagtttgaagtttgaagggaactaaacatagaagttgtttgaaaaaaacaaataaatccccttttcaattttataataattaatatttaattaattatgtgctaatgagttttctcgtttcgcatgcgctgaaaatatccaccacctgcttagaaggaacagggcctaagatgactaattaatatatcttgttgcatttttggccaatttagtattactagaaaaaatgttcatacgttgcaacgggtattcgaaataaactaaatatttagtagctacttaaaaaaaatcaggatgtttatgtcccaatcatccctccctcgccctttgtcagtcacaacagtgcgatgaacatagaaggatggggttagctaggggtctgaccatgcctgcaactgtggaccgtttccaaattttcaacttgagcacggagggaaaaggactttgatctgtcaacaaattgcactctaatccattaaaaaatcaatagagagatacatgggattgcaaaacaaagaaatcaataaattgtagctgaaattgtgctagaggagtgcgagtgacaatgggtgtaggcaatgtaaacggacacgcggaggaaccgatcaaagatatagcagcggactcgacgcgtgatcatgataaatatattgtattatcattgatcgatctattacttaattgagtttcttgtgtattttctacctatgtgtgtcatgcacgacatgactaaaacatgtatgcgtatcgctttgtgtcaaagcagggatcagaagaacttaataaatatataaatatgtaatgttttaatggtgatgtgtgggaaaagtcttggtttataaactaattagaaaatagaataggaaacaaacttttatttagaaacaaacttttatttagaagaagaatggtacttcccgtaaaaaaacaaagaaaggaacataattgaactggatggggtaaataatcgaactggatggactgtctataacgttgttgtgagctgtaaagaaaaagaagaaagagacagtatcagactgggtggatgggctggtgcattggcttggcaagcggacgcactcacgtactcagcgtgccgacatcatatcgaagtaggatgacttacaagatgtttggaaacattttaacttttataatagtagagatagaaatatatgttggaactattacctttgcggtgttcaaacatatctataagttggatactaaatcctaaatcctaggtacccggtataagggggtgtttagatccaggtgtgtaaagttttggtgtgtcacgtcgggtattatatagggtgtcgcatggggtattcgggcactaataaaaaactaattacataatccgtcagtaaactacgaaacgaaattattaagcctaattaatccatcattagtaaatgattactatagcactacattgttaaattatagagcaattaggtttaaaagattagtctcgcaaattagtcgtaatatgtcccggtcatgttactgcccatgagccatccattgtcgtaggaagagacaccagagcacgtgcgtgctctcctggggatttggtgcaccacgccggcggcgaggttctggtaggtgcgcgggtgcatcaggttgagcagccacggcaacggcagcggcagcagcagatgctgccaaagcgtgccaaggtgccactggctgcacacggcgacgaagctgaggcggtcatggtgggacagcaacgaggagacgatctggcgaggtctgtcaggaggttcgaccagcctggaggtggctcggcagcggcggtggcggcagcggctgtggcggactgctgcttctgctgaaacagatccccacggtggcacgagaggaagacgcgcgcggctaattaatatgtgggacgaagaacaagtcaaactagtcatgttggcgccacatcagccaaaaccagacttcgtttgcaccggttttgatagtttagggaccggttctatccggtttttgtgttcgaggacgaaaatcgaattcggtgtaaagttaagggacctcgaatgaacctattctatataaatacgtgggctttttgctttactatcgttagccctacccctcacccctcacccctctggccctccacgaaggcccagacagcccaacgtcgggaaccaggaaagattaggggaaaaaaaaaaggagaaaagggcgtgagaaaatcaatccactgtgtggctgtgtcgcaaaaatcttccccaatctcgctcgctttccgccccccctcgcttcgtttcgcgccgcgctccaacgatccaccgccaccctcgcgccaaaccgagccatttcaaaactcctccccccgcccttcccgaaccttatagaagcccctcccctccccttcccgcgcacgggggatggggagcgggcgggagcggaagcggcggcggaggggggagatggggcgggtggcggggatggtgatggtgctcgcgccggcggggcaggcgcggggcgggggcgcgcccacggcggcggagcgcgcgctcgcggcggtggcgcgggagcggctgctggaggcggcggagttgctggcgcggcccagggatctgttcccgaggaagccggtgcgggcgctcgtgaaggacctcggcctcgcccgcggcagggacccctccgccatgggctaccgcccgcgcagggcctccatcgccgagaggatcctcctcaccaagcgcaaggtttgcccacataagcctctttcacactccagctcttcttctcgttcactctgtgagtatatgtttcgattggatgtgcgtacgtacaagaggggtatatggaataatctcgaagagatccctgtgtttggtttggtgaattgaaataaatggttcaggatggtggagtactaagagtaagtttaatagtatagccacctattagctccaaatcatctatagtcaattcatacaatacttaactacaaatatatactccctccatcccataatataaggcgtgcacgcatttcaagattcaacctttaaaacatttgaccaacacttagtataatatgaaataaattttatttgttaaaaattatatcattagattgagatttaaatttactttcaaatggttataattttgttgctacaaactttataatatatgagaaattataagataaagattagttctggagactctgccaactttggccgcgccttatattataggatagagggagtactacatcattaataattggtcccacttgtcatacacacatagcgtcttgacgtccgtgctgcggctaggtacaaatctgtagctcgtttctcttctctctcatcttttgtatcctccacatgtgcttatagttgacttatagtcctttattgtacctactctaagtgtacaacttctaagaattatgctgccagaggatatgcttttccgttcaacgaaattcattgaatggcaccatcactggaaggcatctcactggacctctcacatgtagtaacatgtgtgttggtcagtaatagaaccaacaattaattccaccaaacaacaacgggaatatcagaataataagtaaaacgccaaaataaaataaaaattatcaaacttaatcttgtaacgtcggatatcattccatgcaactaacgaaacaaatccctgccatctcatcccattcaacttcatctctccaaccaaacaagcccatgtgatgtgctgacactagaaagtgttcatccagaaaattttattacatataatgttacgtagagctttcaccacgctctcatgtaggtccttgtcgtcacaacttacctgaaattatgtataaccataacttatgttacacaattccccctcaggttttataagttatggtttttgaatccataaggttatttctgctgcattattttgtttcaagaggaaatgtttggaatttgtcataaggaggtggtatcaatgtatatcttactaaaagagcaaaagttcctcctgcaaccataatttggcatgatcggcttcaggacacttgtccggaaattctacatgaccagtaaaatctgagaacagttatggatccatgaacttcactggaacacgctatggtttcttgacgattttgagaggagatgaactatacccaaaatatccatagtctctgttttatactccctctggtcattaatatatgacacttttaacactaaaatactaattttagttttaaaaatgtcatgtattaatgaacggagggaatgccatatctaggcatgccccatgtgcctcatatattaatgtttcattccaaatgttcttgggctcaagtaaaagctgccatttgaaacccctcttgttgatctctaatatttcaaaatggtaataaatacatgttgtgcagcaaattttctgtaacatatttggttttattaatgcagattttctaaagggaaaatgtatgcatctctaaagtttgtgcttttcttccccttttttattttgtcatagatggaagaaatcaaggaggctccagtgtatccaacaactaatgtgtctcaaacaacagccacgagagcaacaactgtcttccaacatggagcttctaagccaactactgggttgcccatgaatatttcagctgttgcctcattccctgtcacaaccccacctactataccatccccaaatatcttgaagcagacacagttaaatgaatcaccatcaggagtgaaagcagctggtacctcttcaattgtttcagtaccatctgttggtcctacaaatattaaagtggaaaagggtgttaatagtcctacttgcacacaaaatggaggtattataaacatattctttcatgactggttttcttacagtatcaatgttataattgttattcctattcattatctatgagtattaggtttcttgcttgaattaggacatagtgcttaatgttttatctcgtgaattttgtgtaaattttataaatactagcacagcacatgtgcgttctgacagatgataaataattgtgccatatgatctaactaaaaaatgaaacaaaataatctacatggtatcaattagttaccgacatatttgtgtgaacaaagtaatttttttagaaaggatcatgcaaactgcacaaacgggtcatagagcacaccatcactcccaactccgctttttgaaagagtgaagattatccccctcatactcatattgttaatatcatgcacaaaactacagatttaagttgagtaaatagcttataggaatatggtctggtatttctcagaatagttactcccagtagtttatacatttttaatgtacatcaattgacttctttattttaagtgtttgcctagtcagctgactagcctaactagtcactagtcagcggcaaaccgacctggctcctgaacatagggtaatcggtgggttggtcggcctaattggtcagttcttagtctgtgactagtcttttgtatttctttggcagccgttttgtactaaaccctgacctaatgggcttaattgagtccttttggactcttttccttcttaatataatgatgcgcagcctgcgtgtttgagaaaaaaattaggcaggccaactaaaaatgatgagctacttgcagacggngacatgcagttcacctt

SEQ ID NO: 34232 - DNA, 776 bp, Oryza sativa
  unsure (1)..(776): unsure at all n locations
ctagtctccagtaggcgaggcaccaaaaagcgactaggtgaacactattacttgtgtcttaggtgttctgcaatagtcatttacattttcaatgtataatttgtatggtgtacattccatttgaaaaggaagtaaaaccatttggagcttaatagcagttctatttttcctcatgttcctcccaaaggtttatgtcccactttaatcagctattcagaagtttattttatgctttaaataaaattactgaaatttgacatcttgacaacaacatgattgccagtctgggaatgttattcatccttttagttatgtacttctctgaagtcctctgtgatgattgtgaattgttgctggtcctctctttatagaatgatcccagtccaactcttagaaaaagccacaaacacttccacaaatcttcatgtgctccaggggagaaatgtggaatggacaaataaagtaacttctttattgtggaatacttacaccatgccattttgatgattttagtttcatattggtcatctttgatcccctgactgatttgcctaagtcacctgtcactgcagcaactataggtcaagcaaataaatcagctcatcttacagcaactatgtctaatccaaatatagtaccttcttccagtcatgaagggacgcctcagcatgaaaaggcacctgtaattcgacccatcaccgtaaaaaatggtatgacacatcaatctcgacctggtgatgaactactgcagagnagccatgcaactcaaggcgcgg

SEQ ID NO: 34233 - DNA, 1350 bp, Oryza sativa
  unsure (1)..(1350): unsure at all n locations
ncaaatgaaatatgaaacttacgggcccttagttctcccaatattaaccaagtcttcaatgtcgcaagcctcactcccaagctcactgttgttcctcatgaattctacaggataagcaacatatggttaatctgtaaaagaattgtttaaaagaaactacaacaaaatacctaacatggacaggcaagcatgggaacataggaagatacttcctttgacaacaaaaataagttgttttgaattttcaaagtcaacaaggtgtcccttttatgaaggaaaagcaagatgtccctttaaccactaaagttgaccattgtctattcgaaaactttgtaaaatatcacggtagttcttccacatcaaatttactcataccattttccaatatcagaactacattttatacatttagacagcagttctcgccaaaataaatatagtttgactgtgcattcaagggtgatatgtttttttgtcatcacgggtagtactacagaagcatcagcgcggcagtaacatctgacttgaaggataacttatatgactcaagcattcaagttgttgattgtggcattgacaataaacttcttgtacgaatcaaatgggcctatgatacagaaatgcctaatgtgtgtgggtgtgcatggatttaccatggctttaactttatgtgcagagataaattttatggttatatgtaacaaggatcctattgcaattaccagcgacagagttgtgatggcggcaccaccgtttcttgcagaggtagtggcaggcgttgttttgttgccttccccggagtttgctcacttcctcgtggatgcacatctgctcgcgggagcccagtactgccatttttggcctacaaaactgaacgagttaatagtgcgagggcactaactccattactccagacctccaagacaaagacattcaaatggaattacagaacagcatacatccggcgcagttagcttagataaaaacaactgacagataagcgtaatttgctcgccatcgggcttcacctgtaactggtggccttgagctccttgatgacctgccggagctggctgtgagtccgtgaggcgtagatgatcacggggtaccgagacgactgcgacgccgaaccccccgagtgctggctcccagaaggctggctcccatacggcggctgctggctcccgcccccgcccnnaanncccaaacaaaaactcgggggggttaaccacctttcacctactataaacgatgttttagcaaaataacaggatcctcaggagcacaaaggtcgctaatttagactacgaccccacctaggaacgaaaacttgggataaaaaggtttaat

SEQ ID NO: 34234 - DNA, 7303 bp, Oryza sativa
  unsure (1)..(7303): unsure at all n locations
ggcatggcatgatttcgantgncaacttgtgcaagcagntcatcatgaaaagaaaacggaaaagagagagaaggggttttggagtgggagaggggggagagtgaggcgtgtgaacggcaacagcgttgggcagttgggctgaatggcggtttgggccgccagggatgcttttcagctggatgagtggaacaggcccgtataaggctaaggagcagctatatttatgggaataagttcactttaggtctctctacttgttggtcagtccaattttcgtcccttaaccacaaaacttggtacgacccatcccccaacttacgaaaaccggacatatgaggtccctcgacagtatggaggacgtttttggctgacgtgacgtctaagtggcttctttgactaggtctctgtctcacgcactgacatggcgcttacatggcaatttaacccattgggcccacatgtcagttacacgcaataataataaacggcgggcccgtatggccccacatgtcattttcaatatcatctctatcctttatctctcaccccttcgttggagcagttggagcaaaggtaggcggccgccgaagcaacccgcgaagctaaatgaggtgggcagtggcgactgttccctactcctctctcacttcccctttttggcatgtgggcggcggagggtgcgactgcagagcagcggggcggggcaaagcggatgaccggcggagcggggcatgcggcggaaggaacggcggggaccagagcatgctggcggtgcggagcggaatgggtggtgagcgctccctactcctctctcccttccccttttcggcatgtgggcaatggagggcgcggcacaaagcacgcggggcgaaccggccggccggcggagcggggtgtgtggcggaaggagcggcggggactggagcatgctagcagtgcagagcggaacgagcggcgggtactccctactcctctctcccttccccttttcggcacgcggctggcggagagcggagcggccgaccgatagagtggggcgtgcggcgggcggagcggcaatggccatcggatgactgtgacaggcggggaaaagggcggcgcgcggcggccacagccgtatgaggaatcagcttggcggcggcggcgtgaacccgttgcgcgcgcgaaaggcgaccacggccgtgatcgtgccgtggctgttcgctgccctccgctcctctcaacttgacacctgtgatggctgccactgcttttcctcgttgtcgctcgatccaccgccaccagagaagggagggaaagacagggggagggagaggccgccgctggagatgggggaagccgacgaggcgagaggagaagggcagcctcgacagaggaggggtggatctgtcggcccatcccttgctcccatgctgccgccactgcttcatgggaggagaggaagagtggatctggccaccccgccgccatcgcctgccgttttatttgcgatggggaaaggaggaaaggagagaaaaagagaaagagagataaaaagtcaaaaagattatactaatatgacccactatagataacttgcacggtaaagtatgtggctaatgaggttcttcatttagttggtacgcgaagttcgctaaaatcgcaaggcgcgctgcccttagagcatccacaatggtaaagtaaggtgctctctataaaacatgtacatctcagcaatagattagattaatagtaaaccacctcaatagcatgtctacatgggtatctctagctatctaatctattgcctcgtttttctctagagactatctccaggttagtagatagctttgttctctctcttcatttaatctcttttaagtagaaaaatatattgacattgatatcttataaagagcctatagataaccattgcgggtgcccttagatcatcaggtgtcacggccaaatcacagagctctgtccttatatagatcacacgtgctgttctcagaacgatcacaaattaacggcccggattggcccaactggcgtctagcataagatccaacgacagagatccgtcgatcacgtttccctgaaaaaaaaaaaacgatgacacgaaacgcccccaccacggccgcatctctccactctccagactggccttctcgcgaactcgccttcttcttcctcccccaaggccccaagccgcgcgacccagagcaaaagccaaaagcccgagctccacaccccccaccgcccatccgccgcgaaggcgcgaagccccgtcaccgcgcgcgcgcgcgcgcacagccatgttcgccgccgcctcgtgatcccgaaggctccccgcatccacccacccactcacccctccctcgggggggagggattcttcggccatggcggcatcggagcgggaggccgcgctcctggcccgtgtggccgcgaaccacctctacctcgggcagttcgaggccctgcgagcggcgctcctcagcctacgccgccgcgccgacccgggcctcgccgcgggattcctccgcgccgtcgtcgccgcgggcggccgcgtccccggggtgctctggtccgccccacccgcgtgcccttccccgtcccacctcgcctggctcaccgcgctcgagctcgccgccctcccgtccacccccaaccccgaggcgctccgcctcaaggccgaattcctcgtcctcctccagcacgtcgcggacgaccccgctgccaccggcgccgaggcgcgggggaccctctctaggctgctggatttgggggtggcgaggctcaagcgcgaggtggagggtggaggggaggcgggcgtcggtgctgaggaggtcgcggtctcccaggaagatctgacggggctctggggggtgttcctagacaaggccgagctgtttgacgcgctgtgttctggcgtctcgaggcaggtcgcattggacagtggtttaggcacggatgtgctcctgtggctgcggcggagcgtgcagcttgcacacctggacgcaatgaaatcacttgtagcggcaggagatctcgagggtgccactgggcatcttcgattcctttgcctcgatcatggagtggaggaggatgagtataagtaagctctattgcatatagttggaacctaaatataaatcaagttgatatttattgtggaacatctcatcatctgataggagcgaaaaattagcttcgaggtgcaaattgtgaatttagtggacatcataagttctcagcacatgcgtgaaacggtaggatcggtggtagttttagttacaatcagcatttattgtaagaataccatttgtttaacactaacatatgaatgatgtaacatgtttggttaactccattcaatatcttacagctcgattaggaaatgcatgtttgttggtgcacatctaaacatttgcatgtaaatgacttattggagtgacagtggagatgtaaatatttttagcatggtagttagtatattaaaagatatttgacttgggactatactccctccgtcccataagaaaacaacctagtaccagatgtgacacatcttagaactacaaatctagacatacctgtgttcagattcgtagtattaggatgtgtcacatccggtactaggttggttttttatgggatagagggagtacttcatgttgacagtgagctgttttggagttattgtgtaatctctgtctgattcaatggtcttgctacattattccagttgggtttgtaaactcccaccgtacacctgtcctttaacttcagttgtagcctatgtttgtattgcaaagtacactactgacggctgctttctagtcactgctgccattccattgtaatggacatgggggatttagataatataagtgtgatccataattttgcagtgcggctaactaaaaccgcaatcactaggtgctatctacttatggcaaaaaaatttttctgcaatttgtttttaatatttggtcttaacgccatcatattcatgtttgcagtttaaggttagacataaaacctgtataagtggtttcagattacatttgttcaactagtagtatactatgtacaatggtcacagtttggtggcaaatatggataccttccataaatttttagtttctttatacaggattgcactaggagatcttgtcagaaggggttggccaaaaccatcgaattatggtggaacatggtttgagtcacacgatagaataattaaaatgtttggatcagctcttcagtctagcactccccagcttgttcaactgattcaggtagcaaacataatttttcttttatcatttctactggcatgcttctatttgctttccctttaatggacaaccaagggggaacttggagtcaaataattaagaagaaagggtgagcatgttgagaaccaaacacgggaccacacacccctgccactaggctagcaagtgcaactcatccttttcattttcaaccagccttttcttttgttgtaataacctaaaactgttatgatttatattaccattccttttctttcatgcaacgaatctgacctacctaggtcattcaacatttagttcttaatattatctcattgctaaagcttttcttgcgtttcaggtaaaagaaaacattgtaggtccttgaaatcccatgttcctcatgatcccaccactgtttccctctccactctatttaatatattaatgttaatttatctttttttggaatgtactcttgctgatttatagctaggtggtgcttatttctgttctttgttctttggttctagctcatcttggatgacattctttctgaagaaatcgaagaccatggtgcctctgatgctaattggatgccccttcctttcaaaaagtttatggaaacattgtccttggagaggggtgcttatttggatgacaaaaccatgctgaatagggctataacatcctgcaagaaagatctgtatcattattcccgaatttctggaaaacatgtccttgaagtcgttatggaaactgttctttctttgattaagagggagcagcttcaagaagcagctaacgtatgcattttttttatgggatatactgccttctttttgctactatgagcattgcaggacaatttccactagttatatgcctcactgataccttctggcaaatggctttctgcaggccatttcaatgtttcccctactccaaccattggttgctgtcttggggtgggatattctgaagggtaagacagcactgcggagaaagctactgcagttattttggacgagcaaatcccaagccctacgactacaagaatatccacattaccgtacagagacagatgaggtacttctgtgcttcttggctctcttcatttctcaggtagcatgcataaaaaacttgtgaacgattgtgacagcttctattggcagacatcctgcgaggagtacttgtgtgatcttctatgctttcatctggatgttgcatgcttcgtttccagtgttaattctgggcgccaatggaatttgaggaattcactgttgtttacccaacaagagcaagattctgatgttaacagtacagaaatattagacccttttgttgagaacttgatacttgaacggctagctgtgcagacccccattagggtgagttctaatttatcttaaaatccgattactctgatattatttctccaccaagcattcacatggctacatttttactacacctttccatattttacattttctcttttgtcttattcatttcgtgttgagtgcagagcctttggttttgcagttgatggctcaatattcttgtgaaaccttttcttcttgtaacttccatataggtgctatttgatgttgtcccaggaataaagtttcaagatgcaattgagcttgttggtatgcagccactttcttcaacaactgcaatttggaagaggttcataaccatctctgtaatggcatttcaccaactactccatccgtttcatattataagtcgtttggctttttttctagtaaaacttctttaagtttcaccaagtttatagtaaaatatactagtattttcaacacaaaacaagcatattatcaaaatatattccatgttaggtttaatgaaactaatttgatattttagatgttgctaaatttctattaattttatcaaacttaacaaagtttgactaggaacaagtcaaacgacttcagagggagtaatatttatccttttgatttacatattcaatattgcattcttaacttctcacttattgtgttttggtccattaagatctcaccatctctgtgactctgacctgccttttgcttatctcgataatgccttaacttgtttagaagatttcttaacattattatgcaaataaggaggaggaacttaatcttatttacgtattgttcactcataaatgggcaggatgcatgacattgagctgatgcacatgcgatatgcgcttcagtcagccgccctttctctaggagagatggaaaagagtgcaattgatgggaatgaacaccattatcagatagccttgtcatatttgagggagatgcaaagttttatggaggctatcaaaagtactccacgaaaggttggctttgctgcacatcttttttgtttggccctttgtccttaaatgaagtgatggtttatgtgaagcatgcaatacttctgtgctaattctaaacgttgtttctgaaatataaatatagaaaatcatgggatcgtaaattctaccaaattcttgttatctgaacacatgtatattactacttttacacctctttgtttgttaatgttaaagtcatcagttacatcatgttatttatataaactttttttttgttacatgcacttattttgatgaggataattcataaagggaaaacaagtcaacaaaacaacaacctgattctagattctttctccattctccatagcaccagattcctatcaacaactacctacttttgtctattagcacctcatcatttgaaaataacatacaccagagaatagtcccttgtatgtcccctgtgacttcatccatcacaaatgctaaaaatcattagggctcaggggtaacccgtcatgtagtcctatcttaattgggaagttagcatcctcgctgtcacatttttgaaactttatgatttttcagtgcctaccacagtgaccatttttggtgttctgtaatatccgatctccaaattgatgaataccaagtccagattcttctgctccagtcaaccttacattttgag

SEQ ID NO: 34235 - DNA, 1710 bp, Oryza sativa
  unsure (1)..(1710): unsure at all n locations
ncaagagtagcccttctgaatgtctgttagtcatgagtgcttcgatagtaatgttgaatctgaagagaagaacatggtgacatcctntngtcgggcttcttcttgatatacttcgtcataatcttatgttagatatggataatcagtcaagtatggggctatcacctgctggcagccaagcactagaatgagattcaaacatgccaaacattccattaaagatttggattggcgtctatctgttctacaacgccttccacctctgtctgaacggcaatggagttggaaggaggcattagttcttttacgtgctgctccttcaaaattactcaacgtgtgagttccttgttgctgtatatcaattttttgctgtctattattgtgctcaatcgtttgtacatctgaaagatcatcatgctctcatgctctgatgcgaaagggcatgcagtctagtggttgcagtgacctgagtagcacctcaaggtcctgagttcaaatctccataggagcgaatttcagattgggttgtttgaggggctaaattcccaatttaaaaggcttcatatattcggttggatgtagaagctgggtaaaaaaaaaagcattatccgatatagttattagattgatttgtttgtatgtgcatatcatcttgcatctttgtttacacagctaaggtcacatcaaactacgtgtaatctgtgcatgtttgctcatctgaatcatgcaccatgggcatgcatctcactaagtagcttacaacccagggtgtgatgctgtagatttttgagcctatcaaaatcaagctcacaaactaatctcaaataaaaatataatctattactaaatgctggaaatatgtaattttaagtgaaagttttattttgtatgtagtaactgatttacaatttctgccttttatagcctctactctttattcgttattttcttttgtttcttttacttatatgatattttaagatttagtacactacttcgtattatttgttaatttcattgtctttctatcttttattcgttatttactacttttattcacacatgattgtgatcggctgtacatcattgaaattcttgatagatgtatgcaaagggcaaattatgatataggagaagaggctgtacagcggttttctttgcctgctgaggataaagcttctcttgaactagccgaatgggtagctggtgcgtatagaatagcactggtatgcttactcttgctatttttcttcattattgccttatagatatgaattgtttggctcctctttatatccatgcacttttaactcataggcatccacatgtctggaaaacacataattccatatagctctatatggcctgactcaccatcgcgtgagtggtccatataggctatagcagtctttatgatgaactatccatatgcataaggcctagctttaaggcaaaaataacaataatttctttctcctctcccctctcctccctcacatcacatggttggtaattgagtgggccagtgggacccaggttaaatgtcttatcttaccatatactcctccgttccaaaataaaccaacctaggagaggatgtatatggttgattttagggcttaaggttcatcttatgtcctaaattgtggatgcccgacattggcgtgnnnnnnnnnnnnnnnnnnnnnnnnnnnnnnnnnnnnnnnnnnn

SEQ ID NO: 34236 - DNA, 1650 bp, Oryza sativa
  unsure (1)..(1650): unsure at all n locations
cgcgggattgaattgactttacttcgtctgcaagtagctcatcatgcatcaaatatttttcatgatcatcactatggatttttgacctgaaaacactatgtgaactttcagattctgctctgcattgatgtagctgcaacttctgctaggtcaggagatatgtgccgatttcttcttgacgaggtaggttttgatggttatgcatttctatgtcttcatattcttattcttatggacgttggttcatgaagatagcataagggcccaaaactccaaatactgggataaggtttgatcgcttttcagagtggggcttatgtaatgaagctaggcttcactttaaaattatgtattagcatattgcttgtcatgatagagttaccttggtaacttctatatggatggttccctgctacagtaccgctgatactaattcacgcaaaccagtaaccttgaatttgcttatcctcaagggtaggatccttgccatcctaacaaacttctaatttcataactaaaccatttccttcctaactaatggtaccaaatgattagcatcttagtaaccaaactagttatttaggcaatagataattagatattattattggggaaggtaaactcttccttagtcatactgctaccgtaggcagcacccttcttgctacagtcccaatgcccataacatgtactccctccggcttttcttcaagcgctgagtccctgaccaccgatggtagtagttgaagcaccagtaccatcgcggacgcgctttcattatttaggactgaaacttggcctagcctaacagggccgccgacgcattccgatattctgttcttttgcttgtgtccagagagggtctctgccactacagctccttgagcaagctaccaccttttgcttaccctcattgccttcatgattttagaaataaatctcacctctctggacacatgcccatttgctttcaccatcaaacatatccaggggcttattggatctggtcgctgctggacatgagccatactcagtgcccttgcagttgttagatctgatcaggtactgccatttcctggtcacaggcaatggccttgaccatacagctgcctgactgcattcatcaccggtcgaggaccttgaccacgccattgctgaccattggcgctcactgtcacctggtcataatttgatgaaagcactgcactactgtcatgttgaccctggcaatggccacatgatgaccaatacttgtcgcacatttgctgtcctagccaggccatgtcacattggcgaagaaggcagcaaatggaaaatatcaggtggtaaatgcaaaaagagtttagctttcagtaacaccattcatacaatttataaacagtacttggcaaacgcttttacggcaataattgagtggtacataaccaaattatccatatttctgtaaaggccagtaaatgatgtttatctatgtaaggcacatttcactgaatgatgcagcttcattaatcctgagaacaaaaaaaaaaggaacaattaaacagcaaatactttgtctctgcatgttttgcactgtttaatttgacatcgcgattccnnnnnnnnnnnnnnnnnnnnnnnggaatctaaatcatcaaannnnnccccatc

SEQ ID NO: 34237 - DNA, 8059 bp, Oryza sativa
  unsure (1)..(8059): unsure at all n locations
nttgatgtttacagtggtacagtagttcatcaaggctacaagtttgttatctgaaatatttccaggaagctccccaaaagtaggtccaaattattgggatcagattcaagaagttgctctcatatcagtgataaaacgcatccttcagcgtctacgtgacatcttggatctggtgagcttttgttttatttgtaaccacttgtagacattactgggttgtttaaaatcaaaccgtcctaagatgagtaccaccatgtgctgagttgctgatctcatggtttttgaatgaatgtctaggacttcttcttgttttgcttcctcagttatttcctgggtgaagtattacactgctaggagtacaaatgcattacttgtaataagggttccctcagcttttccatgattttttccctcgaaaatgcaggagagctgcatttcatttcattaaggggaagaaaaacaacacaaaaacacaaaaacgcaggagagctttttccatgcttattagcacagtcaatgtcaagctgtttctttataagaatactatgcattgattatgtctgcaacttttaatttggttattgaaccaaagcagatgtgatattcctactattgcatgcttaataaagcaaaacatctatgcatttttttagggttaattggatccatgccattataacaaaaattagaatgacatatcttttggtctcatctaggagggctatccatatcttcaattagtttttaccgagatgaatgcctcctcatcaactgaatctagcagagttggacaaaagcaacgtcctcttgggcttctgcaccaaatgattgatgatgctttcaaaggaaagcgacaattcttaaatggtaattttttctactttattcggttgagcggtaagtctgttttctgtgatgttctaatagcatttctgaacaaatctttcaggtaagcttcacaatgttgcaagagctattgttgatgaggactctgatggtacttattcaaaggagagtatcaagatagaaaagagagatattttgagctctgaaaaaggaataatccttggtcatggacttagaatcctaaagcaagcatctaggactgaccaaacagcgtcaactgttgttgaaaacaatgcagagcacaaaggatctactagcagatacctgggtcctgtatccactaagccatcaacatatttatcaaatttcataatatatattgcaaccattggtgacatagtggatggaactgatacgactcatgatttcaactacttctccttagtctatgaaaggcccaaagatgtaagccatttacaattttacatatcatgttctgaagtcagatcaaatctatacattttcacttttaatgtttttccttctttgtactggaaacttgaaatgatagtccttaccaaaagtttccccatttaggattatgtttaattggctggcgtttttattaaggcctgtttgattcagttcccgtatcaatacatacttaactcattgggcttctgccttctattttctttaagtgacaatattttgtgatagaaaatcttgctgttaagaccatccataaatttctgtgttttcttgtattttgttttgagatctctttggcctcagagctaatgtggaacctggaattcataatgttaatgtaaatagatattagttgttaggtgtccctggaatatcttttacaagtttttgtgattaaatgtttaaatattatctccgtgccaaatatagctacttctgggttatgtacatagccagaagttgttatattttggggtggagatagtatatttagttgaacatagcagtgtccgattctgtttcctatgattttgtctgacctaaatttttattcaaagtgcttcaaccatgatggtttatatttgatttatttcaacatcctttatagtttcaccttaaaagttggggataaaacttggtaagaaatcatgcccacatgaggatatgccaatgataacattaataagggcatggtatatttgtctatgaagtgaatcctttttagaaacagggggtaactaatgttcaatgtgggcctatttcattattctgatgtgaaacctggtattgatttgtatgaactcaattactgctcttttggcagcattctgacccaccaaacactttccttgtttctattatgttaatttctatgtggctcaaaaacttaggagccatataaatttgtttcagcatgcagcttttagtcatataacatgtgttttggcatgcagcttttaactcgtcttgtttttgagcgcggaagcactgatgcagctgcaaaagtagctgatacaatgggtgtagactttgtgcatgagatcatatctgcttgtgtgccacctgtttttcctccacgcacaggacaaggatgggcttgcattcctcttttacctaccctttctaaaattaattcggaaaacagatcacaatctgctcaaggatggagtgcgcacgattcatcattgtcttctcgtcaggagcccctttatcctcttcaattaaatttagttaaacatttggcacagttgtcatcagttagagcagttttggcatgtgtgttcggaagtagcatactatctggtgacagtgaattatgttccaatgtaaaagatgcaaaacaagcccctgaaatcaagaggtcattctatgaatttgctcttgagcaatcagaaaggtactgaactactgattagtcatttaaatgattatatttaactttacttttgtaattgactaagttctttacaggtacccaacattgaaccgttggatacagatgcagtgtaaccttcatcgagtatctgaatctgctgtatcagctgaaactgacaatgaagtcaccttgcatcagcccaagggaaagttttcttcgaagcgagcccgtgaacctgacagtgatgccgaatcggagattgaagatattgtcataagcgggaaatccacttcaaattcactagaatctcctaagtgtgatgaggctaaattagagccaacaacttttatttcatttgactgggataatgaaggaccatatgagaaagcagttgaaaggtaacacatcatttgtatgccactccttctgctacttggaaaggttgtttgagtagtttgaatctgatgactgtggttactttgtttttgcaggctaattaatgaaggaaaactgactgatgctcttgctttatctgaccgctgtttgcgcaatggagcttctgataaattgcttcaactgctcattgaacaaagggaagaaataagtttaggggccagacagtcccgtgcatatggatctcataattttgggagtgatacatggcagtattgcttgaggctgagagataagaaactggcagctcaacttgctctgaagtatgataagacattttagtttgaacctttcattgttgcgatgaaacttctgatttatacgcatattttgagttttagtgtctctgatacacatgcaatttgtgtgcattatcatgctaccatcttctgttatccagatgtgcttattgagttatttattgcatatgaacactggcaggtacctgcacaattgggatcttgatgctgcagcaaatgttttaactctgtgcatctgccacttacctgagaatgatccaatgtggagtgaggtagccagatttgcatctaattgcatcttaagtttgtacattatcttcaaaggtcatactgtatctcgtgattgctcaccatgattttgttttgtctaaaaaaatcatgattttaaacatgcatggcacattgccacctttgacatatgcctacccaagctaacactaggaatggcttactggcttcttgccaaactgcttagcatttcatgtacaatatgcacttgaatgattacatttttgtgggcaaatttttcaatgataaatgcccaaatctgtctgaagtttgagctttatagatcttgtttagcattgtttgcttgttaaatctctgcctttttatttgtacaggtgctacgcatgaagcaatctttgcaacgctatggtcatattatgactgcagatgaccattacaccagatggcaagaggtaacccaatcaaatgtgcacaaaatactgactaagccaaccctcctcccattttttttaaaaattattcaaatgcaacaagcataggcttcagccttttctcctcaacttgttaagtgtgttcatcataaaatttctgaccattgctgaaattattaggtcgaagttgattgtgaagatgatccagaaggtttagcacttcgacttgctgccaaaggagctgtttctgctgctttagaggttgctgaaagtgcctctttatcaattgatttgcggagggaactgcaaggccggcaattggtcaaacttctaaccactgatccactgaatggcggagggccagctgcagcttcgcggtttctgtcaaccttgcgagattccaatgatgctctccctgttgccattggtgccatgaagcttctacctgacctgcgctcaaagcagcttcttgtatgttggcagatgtgacacataagtcaagtgtggtaaagctttcctttcagtgattaaattgaaatcgattaatgtactttcaggtacacttttttcttaagcgtacagttgggaatctgtcagatgatgatgttgcacgacttaattcatgggccttaggtctccgggttctgtccttattgccattgccatcacaacagcgttgctcttctctgcatgaacatcctcagttgatcctggaagtattattgatgatgaagcaactccagtctgcttctttggtattgcattgcatctcaactgattttttgtacttcttgactcacaatcttgaataccctagaagaataaaaatgattatcatctctcagtactaaactccttacagctgccattatacttgctgtacctgttgtattaatggaatatttcttatttttgactgcagattttgaaagaattcccatccctgagggatgacaagttaattgttacttatgctaagaaagcaatatctattaatgttaattctactcctagggaacctcgactaactatctctggctcaagagcaaagcaaaaaaaggttgctgcaccagccaaaacaaattttgtgcagagctttggtaacttccagagagaagcacgcaaagcattctcatgggtccctcgtgatagtggcaccaaaacacccccaaaagatattcttcggaaaagaaagagttcaggttcaggaggtgaaaggtcctcttgggaagcaacacctagtgtacaggaggagcgggcacctgaatacccttctgaggggcaagaaagacttccttntgtctctgctcctgaggaatgggtgcttactgnagaccctgataaggataacgcaactcgtgcatgccatagatacgaatcctcccctgatattacattatttaaggtaagccaaatttatcaggctttgtctttctggcaatgctgctgacttttacatttttatcctccatagtctgaattggctcctgtgttttttccatgtaatatgttatgcattgacgctggcctaactttctgctagcctgttgactctgtatggttttgagttgtagcttttagttatgtacttatgttctttgtataaaaaaattgaaccttgctgtttagttgccttagattttgatgatgtgcagaagtgtgaatttggtagaatcatatgagtaatactgtgttagaaaaaaacataaacagaatttatatattgtagcacatattgttttcaactgtgtgccctggaagggacttccaaattatccaggagaccaggacatgcaatgcacaggtttgtgacgaaacaggatatagttgagatgaatcttgggcctaatagtcttactgagttgttatgtaaaatgcaattggaatttacacttcttttgttagattgtactgactgactaaacagcactactccctccatccaagaatataagcatatctggagttttttggggtgatgtgattggttgacatggggaagtagcggggaaattaaatgagggatggttgtgattggttaagatgaagtaggtggggaaatgcttatattcttggacaaatttcaaactttcagatgtgcttatgttcttggacagagggagtatacactaaatagggcaacatagtgacagcatgctagtagtttcagagatgttagttaatatttgtaatgatactcttgttggtctgcttagttttcatccactcctgtaattcagttttctaatatattaataaacttagaaaatggatgtgttttgctactacttttactagcaaatcttgtaaacattttaatttatgaattggagttaaggggtgctttcaatgttttgacttcctgttatctatttgctctaattcttcaacaatccttttgtaggcattgctttcattgtgcaccaatgattcaatagctgggaaaggtgcactcgaaatttgtataactcagatgagggatgtgctgagttccctacagttgcccctcaatgcgtctatggacaacatagctcgagcttatcacgcgacagaaacttatgtacaggtacacgaaatggctaacaagatggaacttttgagtggtacagcatgctaaattaacagtatgtcatatgttcaggcactctcttatgcgaaaaatctattgaaaaaactagtggggactagtgatttgtcaagcagctccgaaagaagtagagatgttgatgatatttctgtggacacgggcagttcaagcgctggaagccaaaatatagatgggctgtctgatctcctacctctagctgatttgtggctagggcgtgcagaactacttcaaagccttctggggtcagggattattgcctcactagatgactttgctgataaagaatcttcaactaatctgcgtgacagattggtcagcgatgaacggtatagtatggctgtatatacttgtaaaaaatgcaaggtacgaagtgttacaacttatttctggtttatacttcacacttgctatgacatggacagtaggcttaatggtgtgatcaatttcagattgacgcctttccagtttgggttgcatggggccatgctctagttcgaatggaacattactctcaagcacgtgtgaagttcaagtatggaaagctctgcttgtaggttttgccaaaaggaaatagcgttaggggaacacaagaatatgtctgccttcagaaaataagacaagaggataaatgaactaataaccttttctgatcattttagttcttttaaggtccaaactttcgttgttaatgacgaagaggttttttttattactagcttcgttttgttatattttttcctcattagacagaagggattttgtcctctagcatgaatagtttttatatgtgaggcccaattgttaaaagatgtttaacataaagtttgtctattttcttctatccttctactttatcaccagaaggatgacgaaatgtgtttcctttattaaattcgttgctgagataagtgagttaaaagagtcgcaatataaatggaatattgaaacactttttcgtacgtccagagtgtgagagaggagatgttgctaatgctgatctaaagcattctgagtttgagcactatgttagctcattatcttttaatttgcctgtggaagtgatactgtttatctattgtagtttaaccttctgttgtactccctttccagacaagctcttcaacaatacaaaggggatgcaactcattttgtccttgaaatcatcagtacaattgaaggagggcctcctgttgacgtttcttctgtccgttctatgtaagtgattagcttcaagattttttttccatatttttctgaacttgcagtaaaacattgtcctttgacagacacaaaaacagatgacgatcgcactaaacactctgtgatccatagttatattgatgan

SEQ ID NO: 34238 - DNA, 5378 bp, Oryza sativa
ccatttttgatgattcactttctgctgatgcttacctcaatgttctctacatgccatccacattcccacgatctgagaggtccaggcaatcgaaaggtcctatggacagccagtttgaatctgttggttcatacctagaagatggtcctcgcagcaaccttgatggaatccgatatgccgagtgtattcattacttgcaagaagtaagatttatacccccaactgtattcctattcttctttcgctagcatactgcccacatggtgcatagatctcaaataaatatactgttagttcttaaaaagtgcaaaagaaaaaaataatccaaaccccaaatctgtacacaacatttacatcagtgatcttacaaataacacagagacgagatcttttgaattgagaagttaggggtgtaggcataccatcaccacaactcctttaggctgtgtttggaaccctgggttcccaacccctctccatcgtattccgcgcgcacgcttttcaaactactaaacggtgcgttttttgcaaaaagtttctatatgaaagttgcttaaaaaaatcatattgatccatttttgaaaaatataactattacttaattaatcactcgctaatgtaccgctccattttctgtgcgaactgtgcttgttgggaacagatgcttctgaacacagccttaagtctactggattatcctagctcagctgcttaaaagttatagtggctgttactgtatgcacctgaattgtattcctcatgtcctgttcactactggggtgatcaaattcatacaagatctcggcagctaaagccacaaccctgaactatttttcaagttttggttcacaattggcacagctccttttagatgcattttagaaattggataatctatttaatattttgtcaatttaaagcaattaatggttttttttcggggattcttgcagtatgctcgaccagaaatgcttgctttcatgttcaggcatggtcattatgcagaagcgtgctccctgttctttccatcaaatcaaccaactgatgaaggggaaacatctttgtcttcaattccgcgaaatgatcctttgacaactgattatgggacaatagatgacttgtgtgatctgtgtcttggatatggtgctatgactgttttggagaacacaatcttgacaattactcagtcacccacatatcagggctcagctatgactcagtacatgaatgctatcctcactcgcatttgcaactattgtgaaacacatcggcattttaattacctctacaactttctggtactgctaacaaatttcccttcgaattattcatgtggaatacactgattttgtgccaagtgttagttacactgatgtggtgtatcaggttctaaaaggtgaccatgttgcttctggactttgctgtattcaattgtacgttaattcaatgtctcaagaggaggccttgaagcatttgggacatgccaaggtacacttctatcatatctttatagcataacatgcttgtggtatctatgaatgattgcacaattgtgagttgtgcaatccttgcattgttattgctagaggtctggagcatatgcatcttgtctagcctactcagggaagcaggatcttcgtaaaccagcattagcaaaagattaagtgacaactaccactctcttatgaatgggagggtagagtacccaatgatactagtagtattatctagttatgaattatattaaccaattttgacattctttaaattattagatgctgctgcccatgggcatcatgagttctgacctgccagttgaccacttggcttgtgctgttgttggtcccgtggcccttgttcatgcaaaacatggatatgcttggatttaattggcctaatctctgtttctaactctaccgtatcacacaattgctagtttgtttatgaggatcattggtctagctgaaatttaataacagaataagcttcatttatgagaatgatttctccacatgtccatacagttgtggccttgtgggtacatatgctatcaccacccaaatgtcttgatagccaatattgttgcaaacttccaactttcaaaccaaacaacccctattccgttcatcccaatgccctagcacaagacttgaagcactttggataggtagcatagaccatgtacctgaatattcatgccatctgcttcattttgtgttattttggaattgaccaagaaaatcacttatattatggtcatagttgcagaaaaactcaggtttcttggtgagtggtagttacccaattcatttatgcttcaactaaaacattcatcttgcaccttgggatttagtaaaccagaactacctctttagctttttggcttccatttactactccctccgtttcacaatgtaagactttctagcatttgcccacattcataaagatgtgaatgaatctaaatatttatatatgtctagattcattaacatccatatgaatatgagcaatgctagaaagtcttacattgtgaaacggaggaagtattttttaacaacccttgaccaaatttcaacttgttaccatcaaaatgcatgatatgaaactctgactattttgctcgtatatattcatcagagttagcaaaggcactctgaagagtaaaattgttttggtggggtttaacaccttatgaccataaaacctgggttaagtgacactaaccaagaaacctagttatttgtgcagctacagccatgaaacaaatgttttgaagtttactgtaacaaataatggtgaacatgtgtttgcataatatactttgttgggtagattgtggtaccataatacaatagttatgttgccataattttctgtgttgatgcaacttgctcatcacacagtgacacggatggctgctgtaaataaaaacatttttgttaaatatggacctgggttcattttatttggagctctattgtattgtaaaataaacaaataatgatttaactgtgtttttcttatgctgggcattcttatgaatgcagtcacattttgaggaagccttatcagtgcgagatagaacaactgaggctacaaagctggtaccaagaactgctcgcaataagagtgcatcagaaaaaatgactcgagaaatgataatgaaattttctactagggtgtcctatcaggtgaggaaattatcgaaacagataaaatttctttgtcaagcattcattatttgtttttttatcaatacatgtatatatatatatatatatatatatatatatatatatatatatatatatatatatatataacccagcatgactattatttgtacttcctccatcccaaaatatagctacttttctggttcaaatttgaactgcgaaggtagttatattttgggacagagggagtagctatgtagtaattttgtatctgcaatgttagatctaaatcagctaagatatttttacatgatcgattgtagatggatgtagtgaaggccctcaatagtgtagatggtccacagtggaaaacttccctttttgggaatccaactgatgctgaaactctgaggtttgtatcacttctttgcttgtgaaggtcgattcccttttaactgctcttggaggaggtcaaattatcaacacattactatctaagcgaaatgtgcctcttggactatcgctactatcacatgataaagtttaatttacatttttcacttcatgatttagttttatcatgctattattgagctattttaagtgtaatactgtaatggcagaaccgtcgacatagtttccctgttagtgcttcaaatggttgagaggcactaaaagtgattatgccgagtttgttcttttcattatttatttgttttttgtatcaaggtttctgtagacattcgctgggactaaactgctttctatgttatctttatgacaacatttagttagatttcatcacctgttgacttgtctttcatattattatattacaggcggaggtgcatggttgttgaaacgttggctgagaagcattttgatttagcttttcggatgcttcatgagtttgatctccctggtacttattgaaatcaatatttgctcctaattttgtggaattaatattccaagatatgcttatcgtggacatggaatctacacactcaagtactttccatttctttacagctgttgatatatatgctggtgtggcagcatcccttgcagaaagaaaaaaaggtggccaattgactgagtttttgaagaacataagaggaaccatagatgatgatgaatgggatcaggtaacatttactccgtagtctttttctgcagccttcagctttgattacatgccaagacttggaaagaatattcttggagcagaatatattggccatgatagaatcttttgaattatgtgttctccttgttaatcagcttgccagatgatgctggctagtttttagtcctatatcaaaattcacgttgttcatatgtaattattgtctagggttcacaaatttgatagaatgctatgtatatgcttcctaaaaaaagagtatcatatgaatgctaactcttcctatcaaattctatttcctatattgcaggatgaatttgtttcatcaggtgttcaactatttaacatgttactgatgttcagtcaacatatgcttaaagccttggacatgctttgcatacttatggtccttgacagaacaaatgtgctttatcattagcccaatatgtgatgcccattgtttagtagatctattcgtgtgtgaggatagtttatttgattgctctgctgatatatttgttcacttgcttttaataggttctgggggctgctataaatgtttacgctaataagcacaaagaaagaccagatcgccttatcgacatgttactcagcaaccacaggtatcagttgttcactacataggaaagatactcaaatgtgccactttattgtcatgatggaacttaaccttaatttcctcctgccttggcttctttagtactacaaattactttatggttctgctgatgtggtattttaattattatattatctggagttacaggctagtgttataatcacccaaatagtaatttggtttggtaccaaaatcattagacaccaacagcttactatgcagactagtaggcattcaatcataggagtttctatgagacatgccccccccccccccccttggcatgaattactttacaagacctgtgcactataccgccctcaataaattaactaacaatttttatttggggtacaaaccattgtcaatacttaccaacattcagcgaatggcttgtaccctgattcttttg

SEQ ID NO: 34239 - DNA, 18249 bp, Oryza sativa
  unsure (1)..(18249): unsure at all n locations
tgttaccactaagacgatgctaangncnnccnnnannatgttcaggaaacaatcatgtttattaatgactctatgagtttaaggtgaactttgaagcacctcttttccaccctttctaacctgcttctgaactattcaggaaagtacttgcctgtgttgtgtgtggccgtctaaaaagtgcattccagatagcctcccgaagtggaagtgttgctgatgttcaatatgttgctcatcaggtcagccaccttcacaggtctacaaatgtttcatgcttgatgacagaataggtttatggttgttcctttgcaagtgttcactataaccagagatcagttaaagccccatgggccaaaatctggtttggtagataatgggcatatgccaattggatcccttctttttaagatcagttctgtactgttttattggataaatggtggaggaaaactgaactagaagtctaatattaaatgattattcaggccttaattttaagatcaggtctatactgtttttatggataaatggtagaggaaaacccaactggaagtctaatattaatgactattcaggtctatgttaggccctgaattttgaggttacttatttggcacgtttgtattaagcgtattaccacagtcacgttaggaaatggtggagttcattgcattttcaagatattaacaggagcctacctatcagttagcccctttgtcttgttttgaattttagatctgttctcaggactccagttggcaatagcatggttcaaaatgttagggaaaatcgaaactaaaagtttagagactaaaaaaaggaaggctttttttcccactagtaatgttttagggaaaagatacaagtaaatgaagcaatatgtagctgaatatcccctcatcctctattcaccgtattttgttctaactgatgtttcatgtttggtaggcattacatgcaaatgcgttacccgttcttgatatgtgcaagcaatggttagctcagtacatgtaattccatgtgctgtgccaccccataaatgctggagtgctcagaactacacaaaagaatggtaacatcaggagacatactccgtagttctttggtgaatgataacatcaggggacatactacgtagttctttggtgaaactgccctgagaatgctgagagcaagatcaaagaccatggtgtacagttttccttcctcatgtaaagcatgcgtgcacacccatgcctctatatatatttgttcttgcaagtggccttttttgtggctcatttgcaaagggaggtgcttgtggcttcctctgtggcttaaaattttgtagttaactagtagtacaaagggaggtgcttgtggcttcctctgtggcttaaaattttgtagttaattagtagtagttccgttgcctcttattaaagttggaaaatgtggcgttttttttttgtataatgaaaataattttttttggcagtacaaaaccacagcccatgtgtacttttggtgtatctgggtttgcctgtgcacagtctgccaatctaaattgaataaatattgttggttaaagttaactttcgtatatcaaaaaactgaggtagtaactcagtcagctcctgattcatctttattgcacgagaaatatggagcctttgccagtccagttgatagtttctgtttccaaagagaatatgttcatctgaggtctcttaattttacaccgaatccgatttacgcccttgaaccctaaaaccagatacaaccggtccctaaattgttaaaaccggtgcaaaggaggtccgtcggtggttttggctgacgtggcgtcgacgtagctggtttgactaggtctccgtcccacgtggcattgatgtggcaattatgtctaggaaaataataaaaattatggatccatatgtcagctaaacaaaaaaaaaatttaaaaatgatgggtcccacatgtcatgttagctacacaataaaaaataaatatggtggggcccacgtgagcaccatatgtcattcttaaattattaaatgaccaaatccaatcctcttcctcctctctccggctctctcccctctactccctcttctcgccggcggagataaggacagcgtggagaggcgcggcctcctccactcccgcccccatgggcttaacgccagcggccgccgcccctctcctcatcgctcgccgtgcctgcctccgcctccaccgccgcacacaccaccaacaccatcacacctctccccattgatgacgagcacccgtttcggtgggagaggcggccagctacgagcggccgttcgagcgggagaggctagcggaggtcggcgggagaggcacgcggtggatgggggctcgacggcggcgggcagcgggcgctcgttgtttggccttgtttggcctagcagctttcgatgatagtgtgtgtgaccagtgtggaggctttcgatgatatcctcgtctccgcaaaccacctggatggcacaccacggacaagaattgtgtctggccttttcgctatcttcctcacaggattccctgaacaaagcaagcatcaatccaaactccacctaggaagaatcacaactaagagcagcattttcattttaaaaaatgaattccatactgctactgaggagctcggaggcgtagaaattctcccaagacttcttcattgccctgaagtcatcggagggcgggatttcgacgctcatccgaaacttaaccctctcgaggttgagctcgatcccggccagcttctcgaccagggagctcctccactgcaagtacttctcctcctgctcacgggtcatctcctcggtctcctcatcatcatccccgttgtggctgcgggggcggaggaatgagaggtcgcggacgtggaggatgcccgaagtgacgggctcattgcggcgaagcttatgcaggtcggggagggacacggagaggtcggagttgggaaggacggggagggagaggggcgggtcgcggagggaaggcgaggtgcgcggacttgagctgccagatggcaacaagtgcatacccattgggtttccttgccccatactcacacccatgatggttaaataaatacccacacctatcacgggtacaaaatcatccccatacccacacccacgcgggtaacgtgtacccatacccatataattgacttgtatcatttatagttttgtaccacaattagctatattagaactgtaaaccctcaatattttctcttgtaacaatgctattaacattagcgttcaaaggcgagtaaaaaaattctacaactacattatatgatcaagaaatcaaataataatttcatataactagactagaacaatgattaagatgtgaaaggagttttatgttatgatttagtagtcgttttgacttatgttacttatagttttaggctcaatctacaggtttttttaccacgggtgggtaaagaacatacccatacccacgtacctaatgggtaagagttttcacccatcaatagacccatgggtataagagttagaacgtgaataactcctaatagagtaaaaacccgtcgggcatcgggtcatgggtccccattgccatctctagctgccactcgtcgacggggcggacagataggtcggcgcggaagaaggtgaggagaagcttgaggcgcagccatgtggggcccaccatattttttggctgacacgtggacccaccatttttaattttttttgctaacatgtgggacccaccgtttttaaattttttgtgtggctgacatgtgggcccataatttttattattttttcgagatataattgccacgtcatcaccacgtcaatgtcacgtgagacggagacctagtcaaaccagccatgtaggcgccacgtcaaccaaaaccgccttcaaaaccacttaggggcctcctttgcaccggttttaacagttctgggaccagttatatctggttttagggtttaaggatgaaaatcggattcggtgtaaaattaagggacctcaaatgaacttattcctttccaaagggctcgtttagatatggatattaatcttagcccatcttatatttattcttattttgatttctccggcctatatacctggttggacttgattgaaatccatctttcgagtttttttccagcaagcactgcattggccgagaattgggccactgttcatcatgtacagagtacagactacagcggcgtcgttcattggatcttcctcttttttctaacaggacgtcttgtggaaaaacttttttggcctacccgttgtatcgcctgtactatgtgtgtacgatttgaggtcgcattcatagccgaaggaaaaggtcctgcgcataacctgtctttttccctggtccattccgggctcatctttttgcttgtgttttagtggcggttaaaaaaagggtttgtgtcgagtactacactgatacatcactgcctcaaatgttacgtttcccttgcaacccgagccaggtgagaatcgattctcaacctgccaaatttcactggccggccggcactgtgataatatatctgcagcgtatggtttggagtttggactatttatgtgaggtctggtttaggtaccaactttttcttcaaacttttaacttttccatcgcatcaaagttagtttggagaaaaaattagtagtttatgtgtgtagaaagttttcgatgtgatgtgatggaaagttggaaatttgggaggaactaaacacagccaaaactttcctacacacataaacttttaacttttccgtcacatcatttcaatttcaattaaactttcaattttagcgtgaactaaacacacacaccctgaatcctcaagatttcttcgtgcggcatgttccccacaaattgtccaaaagagactcgaatcgaacagtgatcaaactttcattaagcgaaagggctgtacagtatttctcgtcggtgcctcgtactgggatttgggctcgacttgaatagacgagctcatgcgacaatctatataatatccgacaacttatataatatccgatgtgacaacctatataattaactgacggattctgtaattagtttttttattagtgcctaaacacctcatgcgataacctatataatatccgatgtgacacgtcaaaattttacacaatgaatctaaacatcccctcagtcatcttgcaaattcctttctgggtggagcgacttatgaaatggatgccttacgttgcgtgcgcggagaaaagctttggtttggatttcgccgcagcgcagtgcgcctcaccgaatgatggcacggtgcacctcactcacctctcaaagccactttctttacccttcctctctctcaaaaaaaaaaaaaccgttttctgatgcccttttttgccatctccgtggacatatttctcctgcaaagatgaacccgtcaaggttgggtccagccggagtagcaccgaccgagcagcttcgagtttccacggcgggcgggcgggcttgtggtgtggtggttcgtggtgcaaaaattcacggatgtcatgtgaaggttggttgggacttgggacttgggacagcgagcgtactacgccctacctgtacctgcctggtggtggacgtggttggttgaatggttggcgtgtatcttgtccagtaccgtatgttcccgtctcgagacgagacgagacgacaccgtcggtggaccacgaatcccatcagttttttctcttgtcaccacggcgcgacacaaataaaaacacaacacggagtggcttgcgacaccggcaggtgagtatttagtaatccctccgtttcacaatgtaagattttctagcattatatatatgttaaaaaatctaaacacatatatatctagatttattaatattaaaatgaatatagaaaatgctaaaaaatcgtacattgtgaaagaggaagtagaaaagtgtgatcgccaagccggagggagggcttgtgcttctctgatgcaccgtctcgtctcgtcggcgtcctacctgatgcaccgtgatccccagtgaccataccagcgtcgtcgtactatggtacaggtcgcacaggctgagcagcgagtacagacgcagacacgccacctgcttgctttgctgctacttccagggggtaggaatagttactccgtaaagaccgtaatactctctctttgtaaaaaaaaaaactaacctagatgaaaatgagatactccacattggctgtgttcgggaaccgtcactccctcgcacgaaaaatgaagcagcgattagcgtttgattaattaagtatttactattttttatcaaaaatagattaatatgattttttaaacaactttcgttacagaaacttttttaaaaaaacacaccgtttagcaatttgaaaaacgtatgtgtgaaaaactagaaataggggtcgcagcctgacggaggaaatacatctatatcatgtacagacttactctctttaaaaaaaaatctcaacccaagtaaaaataggacaacataaaacaatgaatttagatagcccttaaatttgaacagatgactatccagatttattgtcttaggttaggttatgtttcatcctcatctatattaaatatttttaagacagagagagtaagtttatactagtatacgataaaagacgtactattttcataaaaaaaagtaaatctgagattgagtttaacacagtatggtattagtacaatcaatctaaacaagttgatgggagtatgggacggatggagtactgtgtaagggtgtgtttagttggggaaaagaaaatttttgggtgtcacatcggacgtttgaccggatgtcggaaggggtttttgggcacgaatgaaaaaactaatttcagaactctccggaaaaccgcgagacgaatcttttgagcctaattaagccgtcattagcacatattggttactgtaccacttatggctaattacggactaattaggctcaaaagattcgtctcgctatttcttctataactgtgcaattagtttttttttatttatatttaatacttcatacatgtgtttaaagatttgatgtgatgtttttgggaaaaactttttggaactaaacgggcccttaaagtgcatcgcttccttttaagaaaaaatagagggagtagagtggagtatatcattaccaaccaaccagtccggtcctctgcggctctgactccttaacgtatagatcgtaaagagcggccaccgacaggcacgggccgccgcgtgtgcggtgccgtgcgtctacagtctgcggacgcgactcgacgccactctctgcgtcggttgatcgtcccgtttgtgatcgcctcgccgcaggcaagtactacaaaagtcagctataaacccacattaatatatagtcagctgtaatacaaagtcttaaacgttaggtgtatgagatatgggtctatatattaatactaatgatatagtatatatttatattacatgtatagataagctattaaattgattatagataatttgaagttagtagttagctacactgctaaacttgttctaaaaagcattttttaggtgcccaaccaaacaccgtaccgagccaccgggcgcatgggcgagagcgacacgctgaggaggcggaggcgcgccgcgccgttggttcggatggacgggcgcgtcacgggctcacggctgcaagcaccgcaccaagttaaaaccagaggccggtcgccatcgcggaaaatctgtcacgactcagcgtcgcgtccacccaacgatctcgctcgctttctccgcctccttcgctttttaatctctcatctcaggatgaggagtactactgtacagcaagcaggtcagcctcccctccaacgaccaccactcttgtgtctcctccctccccatttttttttcttaaatccacacaccatcgccaataatactactaccgttttgtatcgtcttaaatcaccggcagcgagtttcaaaaaaaaaaaatcaccggcagcataggttaacacattgttcctggttcatcgcaccgcgaacaaactgcaagtcatccatcaataataataaaaagaagctgattttctttttgagaacaaatacaaagctgattagtagttgattgatcgaacagatataaaccagttggatacttggattgatgtctctacattgctcctttgctttctttttctccagcgatgatgacggtgatgataatgatgatgatgatagctagatgcttcggttgggatcgtaacaaacagtggtcgctcacaaggcaaacaagacctcatcaaaatttgtttttatcaatcaaaagttattagtactgctcctatccatcatcacattgctttctctgttaaaataatcaatcgtcattattatattgctatcagagcaagtttaatagtatagcccactactagtttcaaatcatctatagccaatgtaatagccaattcatacaatacttgcttactatactattaatacttggtcccacatgtcatacacacattacatcctggagttcgtgttgtagctggctacagatctgtagcccgctgcttttctcttcctttttttatctctttaaaatatgtttatagcaggcttatagcctgctattgtacgtactcttacttgtcaaattattgcttaagccatggatggcagtatggcactagtactaccacagtaccactacaagtaatagtactcgaaggtaagcaaaaggcagtgctgattccacgcagggaggccggcagcagaggcggattcgtggattggagctcacgtcttcctcccctaacccggatggggaaaaacaacctaatccttcggttttttgggggctgggcggtccttgttccacgccacaacttttttaggttttccaccccgctgtgctgcgtccagaaaggagaaaagctggcttttaatagcagaaaaacatcgtgacattttacaccactacctattgtgatctcgtcgcttacgtagcacgtctaaactgtgcaaccaattttgtactagcggttactgaagtacacattccttctcacgaaaaaccaacttctacaacaatacgttcggattcataaccaaaggttatttttttatgtgacagaagtagtacttaatacttatcgtctttttttctctatgtgttgtatttatcttgaaacaaattctagtttgttgctgagttattcttaatccgtttcatgcctacgaggttttttctgtttttttagagctatcagctgcttcatgcttcttaaaaacacgttttctaaataaaatcttttactctattacttagataacttattctgagctatacgttaattttatttcttaaaatatttaatttatttttatagtaaagtagttaatcagtaagaataatcgggtgaaataatccgcattgtatgcctaaacttcggccttgttcgtttcttcaataaaattttaaattcttgtggcacgcttttcaaagtgctaaacggtgtatttcgtgcaaaaactttttatatgagagttgctctaaaatatcaatatcagattaatccatttttcaagtttgtaataattaaaacttaattaatcacacgttattaccactttattttgcgtgaaacacttaatcttcatatcttcatcttcaggagattcaaacaccaccttcgttcctaattttgtaacaatttaccttgcctaaactttgttctagtagatattttgtcacagaagtgtatttctttatacatacatgcagcgaatacccgcagcatttcaacacagaaaattacctgtgcgcacatactgtatcacagtaacattacacaaagaatatacaactactttattatcgcgaatcttttcagatactactcctacatacaatgttttaacttgcaattaatcaagcctcgtgacctgcaagttaatgccgagctgccccgagtaaattgaggtcatgactcatgactcatgagtacccccagccacctaacagggaagcatgaagccacgatgaacacacaaaataccagcaataaatcataaatgtactatcaactgctagtaaattcactacattctccgtgactaaagattgagcttctaactgaagattatcaccgacacgtagcgagacaaatcatcagcatataattaatttaatacaactattataacttgaaaattagatttgtttaaattctcaaagaaacttttatatagaaaagttttgtataaaacacatcgcttcacattttagaaaacgtgctaataaaaagctggagaaaatctcggcctagaaggtgaattgaaattaggccgaacttctaacttttatatcacagtaaaacttttctatacacataaatttctaacttttttctttaaacttctaattttagtcaaacttccaattttggcgtagaactaaacacacccttagcctttttgtggtgaagctggaaatcatcatagatttttgtggtgtatggttccatgtatcattgaatacgccatcatttactagtgctggtacactgattttcaacataggatgctttttttttcaccttccacagtcaaattttttgacttcagtaacaggtttgtttatgacatcaggaaaccagtaattcaaaagcatgtgaaacacaagtgattctgaaaaccttaataaggctactaattttcaacattggagtagtatttaactaggaccaataagcatatttacaagaagagctttcaagtatactgctaattattctgtctctcaagcaaagaaatttagggccctcaatgtaccagacttctgaatgtatagtaatcttcaatttatagaagaattaatttgataagcagtaaaagagcatattcaatttatatgaatatattactcttaattaacttcaagtttaaatgtatagtaatcttttctttcaagggatatactaactccgtctagaaaaataatactataattattaactttgcacctagacaacctggacagtgtccatgtacatagccaaaattgtcttattttaagaacaggttgatacaagttttctaatgttagcgcatatttttttcttataaaaaatatatttaaattacacgtcttttttttgggtgggggagatatacgcgttttctaatgatggcactaatttctttcttctactaacttgcatgttttgttaggaaaactctgaatgacttcctaacaaattctctttttacctctgcaaaaataattctttttttatttctcaaaagaaaaagaagaaaagagattatgcggatatgcccttgcaaaccggggcagtggacgaaaatttctctggcaagtggactggcgagcacactctccaccagtagaaaaaaatgccaacctcaaaccaggtcaaaaaagcagatttgacagcatgcttctttggtgcctccaccgcctgcatgataaaaaaaattcctccagctaaagataaaaacaatttaaaaaatttactgtatatcacaacaacaaaaaaagtcacaaataatatccactttccctttttttttttccaaattctctctctctacagtctaacacacatgctgacaaaggagatctccacatcaaagaaacatgacatcataatcttggcaaacttccaaaccctacaacaacctttctccctcaaaaaaaaatcattttaatatattttaatcaaccaccaaaagtaaaaaaaaaacaaatcagcaccagcatagctgccacttgtcctgcacctgcaaaatctactaccccattattctcaatcaaatcagtgcatgatcagtagggacaggccccccttgagagagaaagtagagagagaaggagaaaagtgtgcactcctagagagagaaagagagaaaagtgtgtactgctggacctactagtagggtccaacaactaccattttagagagagaaaaagagttctctctcccataaaccttctccctctctctctctaaattctctctcctcctccactatttcttcctcccctttatctttccggggcgctgccggcctcaagtctcctcttccacccctccacttgctggtgcggtgctgcgggccgacgaggccgagaagggtaggctgcttctcgatccttcacgcgtcctggtgattgatttttcttttcgttggggaatttttttttggacctgcattccgtaggagggagggatagattggaagagggagttcttgattggggttttaatctgtgtgttggttcttggattcttttttttttctttttgttctggtctgggttttctgatcggttctatatctgggttttcttttcgatctcgttttcgattttttttttgtttttgcgatttatagggtttaatctccgctcgtttctgtgttcttgagggcagaaaattcctcgagttttctttttgttcgttgtaactgaccttccgcgttggtggttttcagaattttggactttgatgagggagctgctgattgtgagtcaagaacagttgtgaagaggtgagaatgggggtgataattgattaatcagtaaaggcatatctttttcttgtttttgtttagattctctgtatggtgttgcttttattatgttttaataatcacttctcaatatagctaggcgtacaagctaaggaatctataaaaaaaagatcatatgttgccttgcacttgaatctttagaacgcttctattttggttcatgatgaattatataacaacagtatagcatctatttgtttcttgatgaatactggaattgtgttccatatcaaatccatctgattgctctgttcttgactccatggagtttcttgatactgacactagaataaacccacttcccaagtcgtcgtagtgttaaagaaaaggtggaattatagaatttaagttattgacacaataaaatctgcagtgagaagaaagctagagaagatcaaatggcagctgaatcctccctggttccacaaacctcctctgaatcgattgcgcagaagatgggcttcttcagggtccctgaccttcttgtcaaactgagcagcaaatgtttgattgagctggatgcagtccgcagcccaacatcgcccctagacctcatattcttcccaggcctcggtgccaaatcgccgaggtcgtctttccttggcgacagggttgggcttggactggtggattcacttactgatgatagctccactcccttgggcagcaggaaggttcttcttggatctgagatgaggattactgataatgtaacttccaagaacagcttcactgctcctgtcgaagctggggtggttgatcagaaggatgagagtatgtgtgatgacctgaagggtagtttcatgtctctggatgacattgtcaattcagaggattacacccgtgttgtttgtcgtggtcctaaccctaggacaacccacttctttggagatcatgttttagaatttgaaggtgagcagctgatgcctgatgagagtaagagtgaggagagtttgccccctcgtctggaagagggtatgatgagcttctgttatttttgcggtgagaaactcgaagaagggaaagacatctacgtctatcagtaagtgatccagtattatagtagatgcatcatcgttgtggatatttttgttgttgtattcaagaaccctgtagttgtttcgagggttatccttgtttcgatcctttctttatgtttggtattctatctttcaatcataggggtgacaaagccttttgcagcatggagtgccgggagaatttcatggaagatgagatggaagaaggcgaacccgatctctctgcacctcctagcagcccagtcgccaacgatggttgtattttccaactgatccagtgaacgagcatcagtaaacaacttgatatggtcttatctgaagtgctgtccgaggttaataagttgcagccatggatgtgatcatatttcattgagttgttgcctgaagattttgtctgccgcggcactgatgaatttacctattgatttcttaattttacttacccggatcctcgaatttttggaggagcctgaacggtaactttgcttccggtcatattattattttggtcggaaagggcgtgcgtctgagtttgaatttgtgtttgcttgaacctcatcttcaatcggctgtcatgttgacaccattgatcactatcatgtatctgaatatatgtgcttctgctctttctggcagaaaggaagtgctaatcttcaagtttactaataaatgataatcatgatgtatctgtcatgatgatgatgtttgattctcataaaatccatgatgctcgattcttatgtggcaatcactcctggattgttggcaggatgtaagagcatttatctgcaatcttgcatgatgattttctgtcaaaaaaaaatattgcatgatgatgcgcatatcaatcaggaaatgttagcagtagttttcatgttgctgctaagttagcatttcacgctacttatcagtgccaaatgatgttattcatgtcaattggttcaggggttaccaatcttaaaaggctgggtcgctgttttcatcggctcaggagtatctgtcccttaaaacttcacagtgtggatgttgttttcttttcaggttttgaagtcagttttgttgtgaagtgagcttagtttaacttggtaggtttcttgtaatagaaccagcctatttatttaggttcaagttctagagttaacacgagtactcgtatttataactaattattcttttagtagtaagtgaggcgtccgtgataacgaattcatcaatctcgagatgcatagggatagggagcatatgtactgtgtttctttagaaaagtcacttttgttcgtccatatggccaatagtgccagatttgcttctgtaacatgtaacatttgcttctttaagatcctccctaatgatgattgcaaaatttgtgaacctctcatctcaaattccaaaacctcccaaaacgaatttgaatttcagacagaggagagagagagagagaaagagtgtgtgtgtcaagtccaaattaaatccaaattgcctgatagactgatatcgttaagaaactgatctgaagctcgttcataaccgaatctctctttctttctttttgattgagaggataataatagtataaaaagcgttcgtaaattgctcacgcgggccatctttatatgggccgaaaaagaaaaaaatccggcccaactccaacgccgcttcggctcccttcgactataccttcgccttcacgcgacgcgagactcgccgccgcaaggttctcctcctcgtcggcggcggatcgtctcctctcctcatctctctagcagccgccgccgaggccggcggatggggggagctccacggggagcgggggggcctcgacgccgccatcgccgaacagggctccggctgcgtcggcggcggcgggggtggcnaggtggagaagctcaggcgggagctccaggccttcgcgagggcaaacccgttcctgttcgtcgacggccgcgtccccagagacgacgcgcgacatggtcaagctggacatcgaggaccacgagcgccgccacccttgcatcgacgtctcgggcttgctcgcgcgctacgacgagcgggaggagaggaggcttcgcgccgggaacaagcgggctaagctcctcgccaagtttgtgttaggaaccctaacgaggaatctctcaattaactggaattacgagtacgcatacaatctctcaatccgaagaattgagccgccgccgccgcctgcgccaccgcgcggttccagttcatcgctgccttcttcatcgttctctgtttcacgtactcacttcgaattaaaaatatttatgtcatgattaaagaatatttcatcataaatcaagtcacaataaaatataattatataattttttttaataaaataatggttaaatgtatcttaaaaagttaataacgtcattcgttaaaatacagagggagtatattacaacaagatttgacagcacacactctctcacacgccaaccaccctgccagctggctactaggctcacttggcccattggtccctggtgtatcgagagttgggcttcctccgtcttggcccaagtggagcgaaaggttcctgtagcttgtccggcacgcctcctcccttacgatttgcagcttctagcttgaagtccagcttccctccttggtcctccatgatctcagcttcttcttcttgggttccaccatcttgttcttgtttgtctggttccttggagtggtcgtgtccccccttgagtcctccaggccgccttggtgaaggcctgacaagcacccactcttgaaaccagcttgcccccaagacggtgcatgcggaaatcttgtctgcagatcaaccatgtcctcccaagttgcatcacccgctgcaattcctgtcgaatgggttaacaattgaatagtagtggttttacttttcttagtcaagtgataatcaaggaattggtggggtatctgcaagtggtctagagtggcaggtaattcagtttgaacagggtgagaaaaaccctttgctcccttcagctgtgagacatggaacacatgatggatctgacatgatggtggtaattgcaaacgataagcaactgcttccactgcagaaactggaaagggtccaaaataacgaaacgataacttgtgacttgctttggtggccacatatgattgcacataagggtgcaatttgagatagacccactcccctagctggaattcttcgaaacttcttttatgtcagcaagatgtttcatgtgttgttgagcccggttcaagtgatgttgcaacaattgttgcatcaatcctctttgcttcagcccgtgatttaaagcaggcacaacacggtcattcatattgatgccaaagtggcttgggctatacccatagaaaactttaaatgtggttttacccaatgtggaatgggtaatgtttatgtaccataactctactaaatacaatcaagatgaccatttagtgggtgtagcatgaacaaaacatctcaaataaattttcaggcattaatttactctttctgtttggccatctgtttgagggtgatatgaagagctcaaatgtaattttgtaccaaatctaatgaaaagttgttcccagaattggctagtgaatattttatctctatcgatatgatgattttaggcaagccatggaatttgtaaacatgttgcagaaactgaatggctacactgctagcggtaaaaggatggtccaagggaataaaatgtgcataatttgaaattttgtacaccactacgaggatatatttataatggttagattttggtagtccctctatgaaatccaatgatatggtctgccattcaccttcatgcactggtaagggttgaagtaataccgggtatttagccttgtcttgtttagcctatagacaaatttgacaagtttgtaatctgctctggatcatttttttcatgctagactaagcaaacattcccttaattcttctgtaggtggtaggaaacccagagtggccacctataggtgtggcatgcaaagcatcaattacttgtgctgaagttctgcatcttgccccaaccagattttgttctcgtatttcaaaatgccctgctacagggtaaaacctagtttagctgaaggatcaatgatcaaatctacagccaggtgtgtggcatgagcatctttttcataactttgcatgacttcttgcaaccacagagttacacattttgatatggacactaactcagctttgtcatcatgctccttcctggatagtgtatctgctgtagagttactcaccccctttctatagcatatgcggtattgtagacccattaatttagtataggccttttgttgccatggcgtgtgtaatctttgttcagagagatgtttcaaactatggtggtcagtcaaaattaggaacttcccatgttgtaggtaagtcctctagtgttctatagccagcaaaatggccatgtactcctttccgtatgtggataaccctcttgattttggacctaaggctctgctaagaaatgcatatgatggtgttctgtgaagtacttgcccagtccta

SEQ ID NO: 34240 - DNA, 1689 bp, Oryza sativa
  unsure (1)..(1689): unsure at all n locations
tattttaggttcttctccctctgccatccttatttgatgatgtctttcccttaagtctaatttagagaaccgttgggatccagccaactcacccagcaactcttcaataatgggcactgggtacttgccttttatggtgattgcattcagttgcctatagtcaatgcataatctctatttcagctacttgtttttcaaactcatttttaagggctggtttatgcctatagggtcttaaattcactggtttgtctccttcaatcaggggaatatggtgatcacaagctcttggaggaggtaatccagcgtgggttcttcgaacagctcctggaattcctgcacaattggttgaacagattctgagattttaggtttaatttactccttagctggttacaattgtatcacacatacaacactgttttagccattccattaagctggtgaagtgaggttgcttcacacaaatccagtttgggtattaagccttgtagccttatcaattattattattattactattataattatttttgtgcctgacatgtgggtcccactaacacgtaggtgtcatcgtggtatgccacatcagcgtacgaagtgggttagagcccttttggacctacataacacccatgacatgttcagagacccgaaaatgcattttcatagtttagagacacccgcacaagtttaaggatcttcaacatggatgtacgacccaaaaatttcctagcctaagacccttgtaggaaaatatagtaaaaaaataaaaaaaaacccttgtcatgtgaagtgtgaaatcgaagtgtggtcatctcggtcccgtatcgtgttcgttttttcgctttctcgccatatcgtgttgntatagtaacagtcatcatgccagatgacaatacgagtccgagacaaaggcagcaaactggcaagcaaggacgcatcacgatgtcatagcagcagttaccacaacagacaacaattaggagtacgagatagggacaacaaactagcacggcaagggcgcatcgtgttgtcatagtagtagtcatcacgctagacggcaactaggaatccgagatggaggcagcaaactagcatgacaaggatgagaggttatcaagcagtcaagccgacatgccaacaagctggaaagggcaaatgccgtggcacgacgtccgcgcctctctagcggccagcggatagcaaggtggcaagggcggcgcatgatggtaagttggagcacccaaatctcaaatcctagatacatcactgatcatcagcatacatgactcttgtttttataacggtttaggagttgaagtccggcggttcgaaatggaaaattggaacgtccatgaccacaacgtaggtcattgacaacatcaacatgcacgtatagagcaggatgacccgtattcccatgcgactaggttggggttgttagccaaaatcagccaacacactatagcgatcacctgaaccacaacagaggaggacgaagtagcataggataataaaacggtgcaaaccacatgtgcagtgcaaacaaacctgaaaactacagcgtgatcttacaaatagacgtatgatatttatccacatcattataaaaacctttatactcttaaatttaaatgggctatttaggaaagggaaagaagaagagagaattacctatcattaaac

SEQ ID NO: 34241 - DNA, 28726 bp, Oryza sativa
  unsure (1)..(28726): unsure at all n locations
gggatgtctcagtggacagagttatcatacttctgttgcctaaaattataagttctctcttcttggttggaaataaaacgagcatttttttctagcaggactacaccagtgacaaatgctacaaattcgggcatagatttgatgcatttatcttggagcatgtaagaaacaacacttctcacttttgtttatttctcttctccacataagcttatagccggtttatagcccactactatatatccttccccttgatacttttttttggcggggaaccttccacttaatatttaacactacacaaatgcattttttctccattttgcccttgtggctgcacagagaaggatctagaactatcttgggtgccaaaaagttacactagtgctaatccagtactatcatagttaccaaggaatacaatagtatcatctggatcaatacttttctcacaagaggtttgttagtaggggtaatttgaaggttgttcttgttcactttgatgcctaaatcaatcttaccaaatgttggcattgctaatatttggtaattaaagttgagaagtgtaaaagttgttgtttagtttgttaccattgtcaagatgttgtgagaggaagattctagaattaccaaaatttggtaatggaggcaagttttggtaatgtttagatttataccttgccaattttttgtaaagccaaaacttggtaacaagggcctgttcactttgatgtcattttcaaccttactaaattttggtaaagttgctaaaaaagttgctacatttagtttgctgccaaattttggtaactatataagaaatcatgccaaaattttggcaaattttggcaggtaaggttttttttggcatcaaagtgaacaggttgcaaatctccttggtctttatcttgtcaaaattcgattgcctaagtatgtgtgcattggtcaaaagtgtcaagtaaatgtaaacggagggagtatatacattaagctatgtgaacaaaggaatgttgccacttctgcataaattttgcatatatttacaaacagatagcttgtcaatttgagatatatcacaagtatttgaatcactgatgcagcagcaccttcatgctctcttttaaggcaaatcctgtacttaatcacatttttttctgccgttatttgcttggacaacattgtgattgtttttgaagattatgtttgtgtggtgattggtgaagaaagaaaggtttgcatttgatctcacccttatttcttaaaaactggacattaggtctctgaagctgaagcagtgttctgattcttgagcagggattttggtattctttaccaaaagaggaaaggagattcttcatttttgttctcagtactgattcttgaggcgggattttggtattctttaccaaaagaggaaagtagattcttcatttttgttctcaatactgaattactgattcttgaagcgggattttggtgtcctttgccaaaagaggataggagattcttcatttttgttaagctgccaatatgacgactgaagagtagagcattaacttctctggctaaaaaagtgaggccaacaattttgaattgtatattgttgtaagttgtaactgttgtcactgtcgtaaatggtctgttcagcgttgtacggacgtaacgtatatttgtcaattgtgtagtctgtctacgatgctgatacgatgattacttcgatggttcatccatatgttgaagtgttcattcttttaaagtttcttcgctgaatgaaagggtcttcgtctatgccattcaattattaacaattgctatatatcatcagtcatactcttgtcaaaccataagtttaaactttaaagtacgtcattatagtgagagtaagatggggacagggggagtagaataattggaaatttgggagaggaaggattcgtgggcagctgaatccgatgggcatttggtgttaatccaatttccgagcaaacaagcagatagtaaaacataaaagcacacagcaccagtcgagattgcgtaataagaacagtcgagattatggagtggtgtgtgatcatgtagatacaagactggacacagtaattacttggcaacggcaaaacatatacttagtctctttccctaaccattcattatacatgtagaagaacactctgcgtaattccatcagatttgcaaatggctattccaaaacaaaacagcatagtgtaagtctgtgactaactggcaaaaccattttccggacatttcggcagttactctagctgcagcacctggctcctcaaatcatgcattcctcaggtatagtggtccctggctacaagtcatcctagtattcattgtaggagaacaatcaaggcctggataacacacatgaacataaaaaaaaatgcagagcttattctgtgaaaccagttaatacaaacaaaactagttattttgacttcttctgatcaggtgctcttgatcctataatgctacagatgggttgttccggtgactgaagcaacctcagagctgggtgaactttgagatcacgcatcaacagtttctgtccgacatccaactcacttaaatccacctcaatgtatggtggcactatgtcagcagggcacagatacttgacagttcgttttatggtgttgaagtaagcccctgtagtttcaaagacagtcacattataatgcttttaaacagaaccttgatgaaaagaaaaggctcacgcatgaataatgacttggaataaagtgcaggaagaagaactaaaatggaatgcatctgcaatgcaggtcgacactaactgtgtggccagagttttcggaatggtttcttcacttagcatttcatgattttcaaatcgtgtaatttgacccagtccaggaggaaattaaagtttcccccaaaccccccttccaaagggataggaaaggtacactaaataacaccagactgtttagtgttgttcaagagaaatgagacattttcattagcactatacaatacagatgattccaaccaacttaaatagcaaatgtttcataatattgttccatgtaatacatcagatgcacagaagacattatgccaagctaccttaggtctaagccttttatgttgaaaaaaccaggagaacatttttgtttggcatctaatataagttttaagtaacacaggcgcaccaaatgaaatgtggaagcatatgctacatacctttcctgagaccaggcgatgcatcctctccgatgaacatcaaaggaacatctatcttgagtagggctgaagaaggggctctcatgaatgtcacattcagaggctcatcagttcctgcatgtaagtgtacctgaaaatatgcatgttcacataagtcttcccccaaaaaatcacatataacagagtgtgaggaaggattcctgaaaatctattacattaattgctacaggcccacaattgcacaacttattatagcattcacctttgcatagagatatttttggagatatacaggccagtttgcaactgatattgtaaggtagaaggcaatgtatgatttaatctgatttatttcttgcattctgaactagaagaagcccatcatttatacttcattgatcaaagaaccatgtcttcaagtagcagttaatattggttacaacagtaacaacacagtactgtttatcttattatgaggccatcattgacactagacaaattgacaaaaaatatttagggaaccaacacagccacacattgttcgtaaaaaacagcagctaagtagaatatgtaaatgatgtcgcattgcgcagattgattgaagaatatatgagcaaacaagcattcctatagattgattgatggggcatacaagttcaagaccccacagccccaaactgcgcggtatgatgcaagtctttcacttttttttttgttgggcataacagtctctgacgtatcaatttagccagaccaaaggataccgaagtggattttggccaacttcaaaggaaacgcatattcgagtttcagaggttggtctcagaaagccatttgtaggaagaaagctcatgttacttccctcaagagctatcgaaccagaaagggatgctcctaaaacaagaaattgacgagatttccgtaagacaaaggcattgagcatcagtcttcatgctgctgcatctaagagtttttgcggtgcatacattttcagttcattgagcactacatactagagcgcatttttcatctacactaaatcatcttccagtattctacagaccaaatcaaagtcatagcccaggctaaagaaacatcaccacagaacaatatttgtatctcgaggagaaagaagcaagttaggcgtatcaccaaaccttgcggggaaggacgcggacgctctcgatgagctccccctggccggcgtgctcggaccagacctggaggcggaagaggcgggagaggaagaaggagcggccgaggtggtcgacgagcttgcggatctgcttggactgcacggacaccagccgcttgttgccgccctcctgcccgttctcctgctcgaacacgatggccggcacccgcccggccttccgctccttggccgccacgtgccgccccgaggaggcgcgcggcacggcgaggatgagctcgtcgtgcttcgcgtccggccgcgggtggcccgggaggtagtcgaacggcggcgacaggaggtccgcgtcgtggtggtggtggtggtccgcggtgaccgcctccgcggcggcggaggaggaggagaggtggcggccgaggagggggaggatgggaagggtgtggaggggtcgccggagcagcatggccatggcggccggcggcgtgtggggtgtaggggtttttggggggaggagggaggaatggtgggtgggctgggtggaggagagtggggtggagtgtgtgggggaagaggaggtgagtgggccgtgggccttcgagggtttgggtttggtgggctgagattgtttgggcctaagaatatttcatgggccggaagtgagaatgggtccagttcggcctaaaaagtcatttttacggagaaaattgaaataagttcacttttggtccctcataatgaaattcgtcaccaaccataatagcagatatgacgcgtcccttaactcctaaaatcaatgcaaataaggtcaatcaatgcaaataaggtcccaagtcggtttggatagtggttttggctgacgtggcacctatgtgacattgacgcggcacatatagtgggacccacatgtcagtgataatataattaaaaataaaaaaattgtagtgggacccacatctcccattccaatcttctcctccccaacatgctgccgttgatgcgaaccgccgtcggcgttttcgatgtctactagctctgccgcttgcggcccccgctgtggcctctcgctagcaagccacacactcgcgcaaacagcctgtctgcccatgttgacgcttgacaacagccgatgaacatcgccttgggcagcacgaagtacaacttctccgcccgaagcaactcagcgtgggccaatgtcggcgggtggtcgtcgaagtagtgctaaaatgagatgaaaaaaaactgacgatggtgctaaaatcaggaatagggtgagcttttcgatgctatttaagtgaacaaataacatttggtgctatagaaccagaaacaattttatcaattatttatgaataaaacttttttatatgtattcttagtggtttaaaaaccaactctggaaaatagaccacgattaggaaaaaaactaatatattttttaaaaattaaaatttggttatcaacaagtaggcaattagaaaagcctggctgatatgaatttgtgataaatttatacataaaatatggcttatatataatatgaattctcatgtaaagtacatacacaaaaatggtttacattatggttacctttcgaaagcacttatatccatttttcatatagagttagctaaaaaaactagattcgaaaatacaataatcatgccaaccacaagatgtctcaaaagtaagttaatcaagcaagaatgatataaacctcaaattagtttagccaaatgccaggtactcttgcatacgtagctcccggaatccaggatcaatcaggcttcacctttgcaaccactaatcatacttatcagccgctcaatcagagtgacaacgccacatggaccaaccacaaaatagaccccctggacccacaatccagtgagagagacaccacacactccccacaatataatttcctccagcgtcctctctccgtccggttccgtaattcctaatgttttgataagatttgtgacaaatttttataattttaactagcaataattttaaaaatatgtagtttaaagacactagtacaatatatatagatttgtcttataaaatagtactccctccatttttatattataagtcatttgatacttttcttagtcaaacttttttttaactctgatcaagtttgtaaaaaaatatactaatattttcaatgcaaaataaacacattattaatttgtcttacaaaatagtactccctccgttttcatattataagtcgtgtgacacttttcttagtcaaactttttttaattttgattaagtttgtaaaaaatactaatattttcaatgtaaaataaatatattattaaaatatattcaatattagatttaaatgtaactattttagtattgtagatgttgctaattttttctataaacttactcaatcaaaaaaaatcttggactgtgaaaaaaaatcaaacgacttataatatggaccagagagtataacaaaagtaaaattttatttatttatttattatatatgttatagtaaaaatatagtgaaagttatattttgaaaacgtgtctgaaacattaagaactatgggtctggagagagtaatattaatttccatgtcagagaaaccaaaaaagaaagaagaaaaaaagagagcatattcctgggctggctgctcgttccagcagcgcagcagcaagcaaacctaacatctcttcctctctcctctcctccctgcgacccgcgaaccacccaacccaacccaaccccaccgcagccgaagccgaagccgcgggaggggagggagatcccgccgcccccccaaccaccaccgccggccacctcggatctcggctgcgtgctgcggcggcggaggaggcggagaaggaaggaggagaagatgttctatggggcgatggtgtgggatccgtggctgatcgtgtcgcagatcgtgtgcctgcagtgcctctactacctcgccctgggcctcctcatggcgctcctcgtcggcacccgcgtcccgcgcctcaccctcctctacctcttcgacttcgccacgctcaccccgcgcaccaccaccggatggtgcgtcatcgccgccttcctcctcgccgccgccgccgggtaacgccgcccactcaccgctcctcccccccccctggtctcgtgctactagtacggaccgagatggattctttctcgaaaaggaatcggattcatgcgctcgctgctagttgactacaggttgtaagagtaatgccagcaattagcaagttgaaccgagtgtatgctcccagatctgtgcgcttaggagaggtagtatgtcaaatttggtgccgttaaatcgagaaaacttgctaggaattcccccatttttcctaggtatatctgcttggtacctgctgaaattttacacccaaatcttccatttaatatgagggccaacaaggtagtataatttttactagtcaacgtgtacaatatgagcacgagggtaaaatgtttctcggcatagtactatttgttatgaatgtgattgtatgtatgggagctagcatatgaataggtgctcagttgatattaaagtagcatattcttcacattttcataaattggctaaatctttctagtttatttcagtttgatttggtactctcttcagtttcattctccaaatcaccctaggacagcttataacagagaacgggaactatacctccactttctaattctaccagcattcattacagatcgcagaatttactacccacatattacgcactattacacatttggtgattactgcaatctaagaggccctgtggaaaacaactcccttttgcctaatttcttcatgcattttaacaggttatcaacaaccaacttaaattaatcttgcaaactatatctatcatggataattgcagaaatcaaaaatatacttttaattatcaaggataagcctgttcttgacctttggtgtaactttgttttcatcaaaatatggttgaatgctaaccttttcatgctttcgcttttgcagtgctgctttcatgctttatgtgattgagagagctaagaagtgcctggactttgcagccaccctctacatcattcatctgtttatttgcattgtttatggtggatggccagcttcagttacatggtgggttgttaatattgctggtttggcgattatgtctcttcttggtgaatacctatgtataaggcgggaattaaaagaaattccaatatcacggcttcgtgcaagtaagcaattatctcctactggatctggcttggattcatgcttttcctctatataattattgtcttcatatatgtataaaaggtcctgtatgatttatttgcttaccctttagccttttgtactgaagtctgcatattgcttacacaatagtcatgtactagctagaatattagattaattcgccaatgaactaaggagcagtagcatgatagtatggtacaataattcttcccaatgattttaattttctattacttattttttctgcttgccacctatctgtgtcatcgtccctgtaactaagaccttgttccatcacaaatgcccacattttggaaaaaaaatatattcaggtgtatttatgctgttgactgattgggactataggaaagggagagtacaaaagttcaactagtgatgtaaagagtgtgggtggcaatgcttttctatttagctttccttggtacgtcacagacagattatttgtagggtgtacctcaactcatatgttccatgtagctaaatgttgtaaacccaatgccaaagaaaagaagatgaagaaactaacattattatgcaagtgcaagcatctcacaaactcacagttgtgtagttgcaaaaaattagtcacttctcacctgatatagaccataaagtatgtaagctcagcgtggagcagagatattcgtcagggacttaatattcttttcaatatggaagaatgctttctgaaaatctgtaccaagcttttgttcagtcactgtttgtggtcatcttgctagtccagttatggtgtttaaagtttttaatatgtgaaatcaagtatagcagggttaaggtgcttaattattagactgcttcttttctcttccatcatattgtgcctgttgtcttttttataaagcacagtgacaagtttagctagcatcatatgggattcccttggaatttctgaagtttgaagttcccatcatgtcgtgctgatcttagttacagcgttcacagttgtccttttctaacatttcttagtaaggtgcatattgcctttctgacatggattagtctcatgtcaataaggctcaatagtgtttggttaatgaaaagcctaatatattattctaacttgggcagttgggctaggccctccatgcacagataacttctgaaattgtttccggtgaggagcggactcagattaggcctgcaattagtattacattgattaactggccccaaatattctacttggattttggtttaaaaggcttctgggtcaagaaccattgggcacaattacagggatgcactgctgactcctggcttgggattttatgaacttgaaattgtgaaatagtatgggaacatgtgcccttagaagcgtacaaaataaactttgatagtttacctggtcaagtgcttaattgcttttatgccgatttcagagtggcttcaaaatcctcagtaaaaagttttagcgtgttgtttgttactgtatgttacaaacactatctataaataagatgccttcaccttttagatgccgggccaataataactaaatcaaactgttgtagtgaaattatgtactttcagttgatgtggttggttgtttcttttttttccttttgtggtatttgggattggctgtactacatgaacattgctacttttctccttccaagtcaccttctattggggataatcttctccagtcactttcaacttattagcctgcttaattattttgtcctgtctttcaggtgtttaatcttacagactaaaggagtatagatggccttcaaatgttgttaccccccaagagatgcttgttaatatgtttctttaggaatacaaagactcgtgatacatgctttcctctatggtttacgaccaatactcttcaaacctgcaaattgatgcatgatctcccagtaaagccaccaggtagagactgacagaacaaatcaagggttctgagaccaagcatagaatgccaactcaatttttaaagcatgtatcaactattcaagtcttctcttctctatggatagtctcattgaattgacgaaaaaagagattacttgacaatttgtatggctagataccagcaccttgaaacctgtgttctttagcgagggtctgtatcgcaccattcgattcttctttagctttatcctgcagataatatatccagtttccagtgcttcctcttaagctcattccagcagagttcagtttggcggccaatcacatgactactcgaacctccaaatcatgctgtccttctgaacatgtatgtcaatatatgtgccctgtgtgtattgcgtcagaggtgttgacatgagttggttaaaaatacatgcttgatacgaaattgtaatttccatcgcaggtgaactcgggcaaaaattttaaaatcccttgtgggttcgcactttttttttcctctagtgctgtgatacttgcagtagtttgttttatccttgctaagtattgtgatattgtcagtactacagaagcgcctgtaatctcaggtgtcaaaacccaaaatcacttctttctcttctcttcactaaggttaaatatgcattgacattttcttttgtggtagttttatcaatgtgcattggtttttatattatggtgtagatgtcaacttggttgtcatgcccagcatttctggtactcttatacctcggtatctagttacccagatttcagttctcctcactaaaattcactgaacatcgccgagaattgacaattttcaggaacgacaccaaccagtggattctgccaggtccaggacctgaacggccgttttgcttgtaaagtgcaaaagttaaagtgtaggttactgttttttttccctgttccagttcgcattaaccaacagaattctctgaatcccaaagggcctaccgcttttttttttttctgaataggtaaatgattttgtgatattattcaacgaataaattaattattataaagttgaagaatataattaaatatcttttaacagaataatatatagaaagcttttttttttttgcgattaggtttgtcgtctgagcgagaggccgaggcttcaacatactggatgcctgggtatatatgacacctgcttactgcacacagcaattgcaatccccgctgaagttgacctagttatgccactactaatttctaatccttaattatgcccagtgtcctgtttcatttctgttccataatcaggtagttggttgcataacaagataatctactgtagctttggtatgctttgagctgccactagtattttccatcctgatctgatctgatcagatgtcaaagctctacaatctcacgtttttctcacctaaattaattaagctcgcgttgacatcacctctagatctctttcctgtgcgtttctataaactgtattttgctggctcgccggtcaactggttgttaattaaaactccaggtttcggcgttccaggtgcctcagttttcagggcgcgatttcgccggaggatggccggccgccggaatagtcaatattctcatatagccaaatgcccaaagtttgacgagttaaaatggaggatctctcctatcctgaattcctaatgcaaagatagccatctctcccgcatattcctacactctaacgcaacctcatttgtaatatttattttttgaaaaatacaagaggttaaaatataagaatgaatagtttcgttgtcatttgaaaacgggaatattttttatagtataaactaagaggttggccaccatcatctccgaggcacaaaatgagcttggctcaactaatcagatttcttctattttccctactgttttgatagaggttatcactatccgatggtatcacggtttacatagtgaccaaaccggttaccgatggaaaccgtagagttctaaaaactaagatcatatggtaatcatgcggttttataaatctagtggtgaacctatccacatgggtgctcgtatcatatctatggctaattatgttttcaagtcacgtcgagttatgatttagattttattttttagaaacacaatacaaacgcagacgctcacaacacacactcacccttataaatgaatatgcacacaccctatctctattagaacctctgaaagactgtgccgatatatttaatgaatttacaatgggcgcattgctacagataggtacatcctctatcacggaaaaattaattagctgtaaatgtgagcatctgttttaaccacagagaatcttactagttgagttatgctcacttcgctagttttctttttctcacaaggaagagtttagaggtggttagaattggttttctgctaggagatcaaggccggcccatgttcggcattacgccagcacgggcgcatgggccgcatctggaattcggagttatcttaaccggatgttggctttagctacatttcttctttacaataataatcatttgaacagatcaaggccaccctgaaggcggaagcagaggcgtttcaattttttcttcgtgatacaataatgagtggcacagcaaaaggcaaagccagctagtcacattctgaaaaccttcatacatatacaaatctggttttcacgtgtgaaaaataaagcaggcatcactcatttccatctatgaatattttatatgttttctcaaaaaaagtgtttgttcattgttaatttagtttacgttcatatcggaacaattcacggtcccggaaaaaagtgacagataacagttcacattcagcgtttatagagaggaaaaaaaagagtgataagcatagttcaattgattaggtttcttatattagaattagcccatccgggttcaagttctacagcctgtttaggagagtttaagattttgataagccgctagttggtaaccaaaatttgaaattctaaaaaagttgagttctctatttctagtttattttctaaaattctacgggccaatttggtaaagctccaactcataaatttaactctaagagttgggtttggaatagagttgtgcagtagtctaaacccagctctatctctttattacattttgtgagagtgcttcgaccggctcaattcccgttttaggtggagctgaaactgtttagatggactctagctcctcctaaagctagagccatgccaaaacatacgccacaactacagcttcttaatatctggatgaaaaactgaattgtttatgggagtttctaattttgggagaagatgcagctgacagaagctctcccaaacagacttgacacggatgctcgcatttgtagctcattattcttttagtattaggtaacgtgtaaccattgacagcaagacgtccatggtccatctttcaaatatacttatagaggtaaatgtgccataagcatctgcatttgtaatgtatttcgaaaactgagattgcgtttatacaacgaatcactagactatatgtttcaataattcgatgaataaagtgaaaataacaaggccttagacgcagcggctgtggttaccagtcacacattaccttaagaaaaatgattttaacatgtgggataagcaaagggaatgattttctttttctaaaaactaacaatcccaaaggaggaaggaaagaaacaaaaaaaaaaaaagagcactgactttggcgtaaccaaacggcccaatgcaaatccatccccgaatgctcatcaacaacgagtgtgcaagcatccggaccgaaatacgcacgcattacacggatgcaacccaaacccaacacgggaagtcgcggcccaccgtattctctatctctctacgcgtatatatgcatacgcgcccctcccatcctctacacgtacggttacacaaatccatttcccaaaagaattcaaaatttaaaacgtacataccacgcagcagctagcgcgcgcgctatagcttttccctccaacacacaagtacgtatctcccatggcggcggtgacgccggacgagcacgagcggcagcaggacggccactgcagggccagggtgaacctgcggccggcggcggcgcggccgttcggcgcggcggcgcgggcggcgctgaaggacacgctcttccccgacgacccgttccgcgggctcggcgggatgccgccggcgcggcgcgcgtggcgggtggcgaggtacttcgtgccggcgctggactggggcgcggggtactccgcggcgagcttctggtacgacctcctcgccggcgtcaccatcgccagcctctccatcccgcagggcatcagctacgccaccctcgccggcatcccgccggtcatcggcctctgtaagatcagatcacgaacgaggaattcctcagaggtgttcgtccgcgacagaattcgatctgtttgttgattgattggttgcgttgcgtgcacagattcgtgcttcgtgccgccgctggtgtacgcggtgatggggagctcgaggaacctcggggtggggccggtggcgacgtcgtcgctgctggtggcgtccatcgtcggcggcaaggtgagggcgtccgacgaccagcggctgtacacgcagctcgtcttcacgtcggccttcttcaccggcgtcctgcaggcggcgctcgggctcctcaggctggggatcctggtggatttcatgtcgcggccggcgatcaccgggttcatgggcggcacggcgatcgtaatcatgctgcagcagctcaagggcttcctcggcatgacgcacttcaccaccaagaccgacatcgtctccgtcctccgctacatcttccacaacacgcaccaggtgcacacgtatatacttcgtgttattaattacaacaagctaagtctatgcactcacgttatttttagctatgtatatacactgtagatatagacgttgaatttctatctattattaaaaaatagcttgcgggatttgacatattataatactatgaattagcgtcacgtccagcgtttgcattttttatttcgcctaaaatttttgtgtgatttttgacacttttaaatttattgaaattttaactggatttgaataaagtttgaccaaattcaacaaacatttgataaaatccaaaaattttggtcgatatattgatttgccggtggggtccaaaatttcgaaacgaaattgcatttgaccaaattcaacaaacatttgataaaatccaaaaattttggtcgatatattgatttgccgatggggtccaaaatttcgaaacgaaattgcaatcactggtcacgtccgatactggttttgtttttaatgtgacggagggaataaattataactctagtgcatttgtaattgcagtggcagtggcagagcacggttcttggcgtctgcttcctcatcttcctcgtcttcaccgagcaagtggtgagacatgctgccattcttgaaactttaacctttttccacctgatgtacgattgaataccaattgattggaggaacaattcctttgcagaggcgacggcggccgaagctgttctgggtgtcagcgatgtctcctctgttagtggtcgtcgtaggatgcgtcttctcgtttctgatcaaaggccacaagcatggcatccctatagtaagttctagctgttgcgtaattaagctagtttgtaagaaaatttatcacctcaaaactcgtatgtttaatctgtaacttttgttcaggttggtactctgaagcgtggcatcaacccgagctcgatatcacagctcaagttccagccggagtacgtcggcgtcgccatgaaggccgggttcgtgtcagggatgctcgccttagcggtgcgcacgcatgcaacaactccttgattaatttttttggttttctttctgaatttgtttggcgatcgacatggctgatctttgatgatcttggcatgcaggaaggcgtcgccgtcggcaggagcttcgcggcgatgaagaaagagcgcatcgacggcaacaaggagatggtcgccttcggcctcatgaacctcatcggctccttcacctcctgctacatcaccaccggtaattaacccactcatccatggctcctcctgcgttcgtcgtcgccagcttagctcacggcggcgccgcgtgtgtgttgcggtgtgcaggtgcgttctcgaagacggcggtgaactaccacgccgggtgccggacggcgatgtcgaacgcggtgatgtcggtgtgcatggcgctggtgctggtcgcgctggcgccgctgttccggcacacgccgctggtggcgctggcggccatcatcaccagctccatgctcgggctggtcaagcaccgcgagatccggcgcctgtacgaggtggacaaggccgacttcgccgtctgcgccgccgcgctcctcggcgtcgtcttctccaccatgatcaccggcctcggcgtcgccgtggccatctccgtgctcagggcgctcctgcacgtggcgcgcccgtcgacgagcaagctcggccgcgtgtcctgcggctccggtgccggcgccgccgacgacgaccacgccttctgcgacgtcgcgcagtaccccggcgcggcgaccgcgcccagcattctcgtcctccaggtcgccggctcgccggtctgcttcgccaacgccgagtacctccgggagaggatcgcgcggtgggtggaggacgaggagaaggccgtcgccggcgaggacctgctctacgtcgtcctcgacatcggcggcgtgacggcgatcgacagccccgggatcgagatgctgcggaaggtgcacggcgagctggagaggaaggggatgaagatggcggtgacgaacccgaggatggcggtggcggagaagctggtgctgtccgggctcgcggagctcgtcggcgagagctggatgttcctctccaatggcgacgccttggccgcgtgccggtacacgctccagggctccaagcacggcggcgtccctccggtgtagatctcgactctcgaggccgctggatcggtacgcgcgtcagtatatgtacagcacacatgcgtatgtgcgctgtactgtacgtattactaacacattgtgatttgaaaagtacttgtataagttttcataaatattacggaacgataatagcgtatcatgatcatataactataattaggaaggtggcccacgcacatgcgcggacacttatattattatattattgaaaggtaagtttattgtttgttaaaaaattttgcctaataaattaagggcaaactaacgttcggataatgttattttataataatttaagggttctatttttcttaaagtatttaaaaaaatcattcataaactttcgagtaggagatggattgagtaattacgacttttgaatcatggttcattttctcgagtaaataataaactattgctagttaattattatacagttcatctatatacatatcgtgtagtacggccacaaatgaaaaatgctagagcgaactacttaaaatttttgtgattaaattgtctcatgaaggccataatatagtaaaaagggagaaaaacgtatgcatggaaaaaaaaagaagaaaggggaaaaagacaaaagcgtaacatgtacgttggtgcatacctatgccgcgggaggagaggtgggactatgaaggtggagagtttgtgaaggtggagagttcggacctcgtagtatttagtttgttctaagatcaatttaatctaacgatttataatattagacctaccgatttaagtgaaaattaagtaatatatactttgctttttttctctctcttagaatatatgatattttctctaatttattagagtgccatgtggtagcttgagagtattttaaggaattttaatggacttaacacatgtaattcataaattaaccgtgtaatatatatgtatgggacatacggtaatattcgttttagatttgtacatgtttgtttatatatatgtagagagaaattaattatgttcctaacaagccattagatgtctaattaatagcaattaattgtaacaactatttacaattgttcatagtagctcttacatattcatcctatgactttgattatccattgatcaccatgactcgcacgaaaaaagaatgtactacttaggggtttaggatagctgaaattgatgaattatttgatatatgtgatatctatttgaggatataaacgaataaattgacttctaaaaagttaaaaagttgtttaaaaaacatcatttagaaatttcaaaacatggaatcagaaaaaaaagagccttaaacttcattctagcacccttgtcttagtaagagttctattgatattcgttaatactatgctcatatttataacataatgatttcattcacctgtacgaacaaataatacagaatccaaatacaacataaaacaatatattataattattatggaatcaactgtcggtttcagcttaaacagagctatgtgttggaaacaacacaacccatggtgcttaattcttctctcactgcatcacacctttaatttttcttttcatgttattaacaaaattaatcatctccatatataatttatatgtggcaaaacggtagcgctgcagcggtcgtgatcaccttagatgcctcagacatgacgctttgtcacacgtacgaaaggtaaaggtgtagacgtgcattgtgcaaagggccaaaaagaaaacttcagacactttaattattagcaaacaatagatccgaagatttaaataatcggtacatgggtgacggagcgtggagctcctcaccgggagaccgcgcaggcccccctttgccggttcggccgggggcgctaagtgaggttcttcgccctcgatcgatctggagaatgttcgcgagagagcaagtgcacgagacacgggcgatgtcgacaggttcgggccgctgagaagcgtaataccctactcctgtgttctggtggatctgtgtgtgaaggagttacagagagccggagagccagagagttcaggctccagaacccctctagcgtcctttttctcctttcttttctcctttttggtgggcaaggtcctacttttatatctcaaggggataccacatgcaccacttctacctacttttcttttgggtggggacctaccctatcttgaccaaaacttggcttgcaccttcgcctggaagctaaatcacaacttgtccttgagtgaggctcagcgccgtcactcgcctgacaccggggatctccctgttactccctcattaatgggcggagatttgccatggctgctttccaaatgaccatccgacgagatgggtcatacctacctccactccaccggaggcagatgcatcgtgggagcacggttgtctgccgatgacgcgaccggcgtcagaccagtcacagaccggtcattcttgtccaccacgtgtcagtttagcatgctacacgtctgcccttcttcatacaatgacttccttgcaatggttgcgatgaagcctggaatgtatctggccggggctgacgtgccaactccaggagttcccacgccggctccggctagggacgagtgcctggaggctctcatcattccgacgggacggggcgaggcgtgtgtcaagccgcctgttgccacctaacccgcgatctggccggtctgtgaccggtcacacactgtgacctgtcacggaccgaacgagtgtgctgtgctgcattaaatgcggcgtggggcgctcgtccaacccgcaataaacgcggttaggtgagcgccgctgtgctcacctaacccacacacgtggcgccaaacccacaggggtcggggcgccccagccctcggggccgaaacgggagcggcccgacccctcggggagacagagggaggggcggccacatcaccctcgggcccgacccctccgagggggtcaggccacgtgggtgactgcagctgccccaaacctctagtcaagatacccccggtcccatgtcaccgacagtagcccccggcgttacgccagggcgatcgcccccctcgagggaagcgctcgggcgtgacgccactccttagacctggtgacaggtggggccggtctccacaggcggcagaaacccagcggtcgcaaatcgcgcacatcggcaaggaaaaaccgaccgacaataatgagcggcttccttcaagaccgctacattacttaagtagcgcgcgaaccgggacgagccggttcgtttcgcctggagatgtgatgacggtgcatcggtcggcgagcgtagttaacgcgtgcacgatatgtcccatctcgactgccacggccgcacatccgcctcgtgcgccgcaaacgggcgagcgggattagtggaggtgggcgcgagagacgagggggtgaggtagtgggcgcggggatcgaggagccgggcatagcgttggcaagggtactaagacatcaaggaagggatttgtttccttcctctcgtcactcttccctttgcctttgccacttgtgctctgactctccgtttccggcgccctacccttgccatactcgctcgctctcaagctcctcctccgccggcgtcatggcacggggctccgcaccgctcgagggtagcgtgctgccgccttcccgcatcgtgagcgagaggcaggccgggctgccgtgccgattcatgccggaatctgccaccggccgggaggtggtcgcgctgggcgagggacgcccggcgccgcattacccggggtggtccgtcttcttcctctctttcgcaatggcagggctggtcccgccattctcttctttcttcatggatgttctggagctttatgatatccagatggcgcacctcacccccaacgcggtaatgacgttggccatcttcgcgcacctatgcgagatgttcatcggggtgcgcccatctctccggctgttccggtggttcttcaccgtacagccggtgtcgccaccgtcggtagtcggtggctgctacttccagccgcgggggccggtgctgaaccgctacattccctgcgtccttcgcaagaagtgggacgactggaagagcgactggttctacacccctctcgccgacgaagcgcgcctccgacttccgagccagcccccggcgcaggcctccagctggcgggcgccggtagatctgggagacggctacgacgccgttcttgaccgcctggcgggtttgcgatcccaggggctcacgggggccatggtgttcggcgactaccttcgtcgccggatcgcgccactccagcggcgcgcccggggcgcctgggagtacaccgggtccgaggactacatgaggacccaccaggggggcagatgggactgggcccctgaggacttcaagatggtggtccaacgggtgctgaatctcagctccgtggaggcatccctcatcccccaaggtgtcctccccctctgcagcgatccagagcgcgccaacatcctgaccatcatgcaggcggtcggggcgtcaggggagcgggctcctcgaggccacgatggcgcgggcgggagccgcaggggggaacaatctaccccgggagggggtcgtgcttctgggccgcgtgacgggggcccggggggcagccgccctgccgacgcccgggggaagaggaaacaggaggataccccctccccatctcctccccgagggggcggggcggtgcgtgccagcagcaggcgcccggagggtgctgtgccgacgtcgcagcccgagggggagcgaaaaaagaagcggctccgcaagatgggggggaccgaacgatgctggggaaaccttatctcccccccaaggtggtcgtttagtcgacctcctcgcaggttcgtccccgcgcccactgcggccgtattcattctcccaaggcgagttttcacttacccgtttctttttgtcttctggtttttcttccgctttcagcgagattccgtcgcgcccccctcgccattccaagtccggccggtctgaggccgaggagacagcgaccgcggaggcccggaggcgggaagctgtccggcgagaagccacggaccgcctccgggaagctgaggaggctgcccaggaagccgtccgggttcgccaggctgaggaggccgctcgggaggaggccagactccgccgggccgggaagtcagcccgggaggcagaggcgacgcgcgcacgccaggcggcctgccaagcccccgacccgactccgcccgaggcgacgacgacttccgaggccacccacgacgaggccgcgggcgcgccgctcggacccgacccttcgggcgacgttcgggacgagccagcctcgggggacgcccctgagtccggcacgtcgattggcgggccgagccgcacagcgcccacaccgaggcggctctcccctctgccttccgccgccccactgaacacagagcccctcctgcaggccctggccgccgcgaacacgacggtgctggacgggttaggtgcccagatggaggtcctgcaggcagagcgggcggagctcgacgcggcgtgggcgcgcgtcgaagaggggcggcgctcggtggaggccatggtggaggcgggccgcaaggcataccgccggcacgcctcagagctcgaggcccgtcggagggagctggcggagatcgccagggaggtggaggaggagcgggagactgccctcatcgccatcgccatgctcaacgaggcgcgggacgatctccgcctccaatacgggagtccttgacgccgccactgcacgggaacggcgggcgacggagaacgaggcagcgtcccggcggcgcgaagaggcccttaaggctcgcgccacggcgctcgaagagtgcgcccgcgcgagggagagggacctggcggaccgcgagaccgccgtcgctatccgggaggcaacgctggcggcgcacgaggccgcctgcgccgaagaggagtccgcactccgcctccgcgaggacgcactcaccgagcgggagcgagctctcgaggaagccgaggccacggcgcagcggctggcggacagcctgtccctccgcgaggcagcgcgggaggagcaggtgcgccgtaatctggaaggcgcccgcgccgagagggccgcactggatcagcgggccgctgagctcgaggcgcgggtgaaggagctggacgcgagggcgcgcagcggcggggcggccgcgggtgacggcgatctagccgcccgcctcgcagctgccgaacacaccatcgccgatctgcaaggcgcgctggactcgtccgccggggaggtcgaggccctccgcttggcgggcgaggtagggcccggcatgcttcgggacgccgtctcccatctagaccgcgccgggcggcaagcgggcctctggggcgagcggaccgcgaagtacgccgccaaccaggggggcctcgcccagcgcctctcagagatggccgggactctccagcggctccccgaggagctcgaggagacgatcaagtcatcctcgagagacctcgcccggggggcagtggagcttgtacaggcaagctaccaggccagggacccagacttctccccgtgggcagcgctggacgagttccctcccagaaccgaggacgacgcgcgcgcgcaggtccgggacgccgccgaccacatcgtccacagcttcgagggtacggcccctcggctcgcgttcgccctcgactccgacgaggagggcggcgacggtggtgtggacgacagcgaccacgaggccggcgactcgggagcctcgaagtgagcccccaggcccccgccaatcttaaatagtttttcctttcttcttccgaggccttcgggcccccttcttgtataaactaatttaatctgcaatcaaataaagaagaaatttctgtgtcaattttatttgttgtgtgtatgagacgaggatggtctgtgccgcggtccttctgtgtcttggcttgaacaagggctcgtgcccaggtcctagcctcaaacggcgcgggtcggggctagtgcctggggagatccacgtgtcgagactggccaggccgggagcgcggtgaccgagggttatggggacccgattgtaggcctttgccgattcccccccggagttcaccacgccccggggcacggctcggttctgggccccgtttggcgatttccgccggcccgggccaccgagggcagggtcgagcacgagcgtgctaattcaagccaagactcttcaaaaggaaacaatggcacagacacagtccttaggaaatcgaaaaagcttttattgaaatacggaagagagaaaaaagataagtatatgcatatgtggtagcccccggccaaccctgcacgcccgaggggggtgcggggttggcccgagcccgagacctgacacccgacccccactaggggtagaagcgacgaaggtgttcgatgttccacgggttaggcagctctgtgccgtcgcccgtggccagccgaacggagcccggccgggagacgccgatcactcgatacggaccctcccacattggtgagagcttgctcagtccagcacgcgtttggacgcggcgtaggacgaggtcatcgacgcagagtgattgggcccggacgtgacgctgatggtagcgccgcaggctctgctggtagcgcgcggctcgaagggccgcgcgccgccttcgttcttccaagtagtcgaggtcatctctgcgaagctgatcttgatcagcctcgcagtacatggtggcccgaggggacctcagggtgagctcggatgggagaaccgcctccgcgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttctgcgttggcgcgctccacttggccattgcttctggggtgggcgggagaggcgaagcagagcttaatgcccatgtcttcgcagtagtcaccgaagagctcactagtgaactgggtgccgttatccgtaatgatacggttaggcaccccaaaccgagcagtgatacccctgatgaatttaagtgcggagtgcttatcgatcttgatgaccggataagcctcgggccacttagtgaacttgtcgatagcgacatacagatactcgaacccgcccggggcccgtctaaatggacccaggatatcgagcccccagacagcaaacggccatgaaagaggtatggtctgcagggcctgggccggctgatgggtttgcttggcgtggaactggcacgccctgcaccgccggaccaagtcgaccgcatcgttgagagccgtcggccaatagaaaccctggcgaaaggccttgccaaccaaggtgcgtgaggcagagtgggctccgcactcgccttcatggatatcggcaagaagctcgacgccttgttcccgaggaatgcacttcaggaggactccgttagccgcgtgccgatagagggtcccttccaccagcacgtagcgcttggagatgcgctggacgcgttcactcccttcgtggtcctcgggtagagtcttatctgcgaggtacgcctggatctcagcgatccaagcaatcaatctaagggagctgggagcgctcccctcgggtcccgaggcctggactccgacgggcctcgggggccgttcaggcgcgtccgtctcccctagggggtcgggtcgcgccgacggctgggcaagcctttcttcaaaggcgctcggtggggtctgggctcgcgaggaagcgagccttgagagttcgtcggcgaccgcgttatcccgtctgggcacgtgccaaagctctatcccgtcaaaatggcgctccatacgccgcacctggcgcacgtaagcatccatctgcgggttagagcactggtactccttggagacctggttaacgaccaactgagagtcgcctaacaccaggaggcggcggatccccagtccagccgccactctgagtcccgcaaggagtccctcgtactctgccatattgttggttgcccgaaagtcaaggcggaccaggtatttaaggacatctccgctcggcgaggtcaacgtgacccccgcaccggcgccctgaagagacagggagccgtcgaactgcatcacccaataggcggtgtgaggcagctgcgaagggcccgagctggcctcggggatggagacgggctcgggagccggtgtccactctgccacaaagtcggcgagggcctggctcttgatcgcgtggcgtggttcaaagtgcaaatcgaactcagagagttcgattgcccatttcaccacccgtccagtaccttctcggttatgcaagatttggccgagcgggtaggacgtaaccaccgtgacctgacgcgcctggaaataatggcgcaacttcctcgaagccatcagaatagcgtaaagcatcttctgggcctgagggtatcgggtcttggcgtcccggagggcctcactaacaaagtagacgggccgctgcaccttttggcggggccgatcctcttcgctaggggccgcatctccagggcgcttttcgtccgagaggccgcgcggggcgcactcggcttctgtgtcgacgacctcggggtcggaaggcgacaggcgcggccttcccgcagtggccctggggccatcctgggggtcgggggctcctggcaccgtcggacaagcgggcagagggccagctccggtcgtcgggggcctcgggccgccgttcggctcgggggcctctcctccctgctctctcccgggtcgagtcgatacagggtgctcttcgtccgagaggccgcgcggggcgcactcggcttctgtgccgacgacctcggggtcagagggcgacaggcgcggccttcccgcagtggccccggggccatcctgggggtcgggggcgcctggcaccgtcggacaagcgggcagagggccagcttcggtcgtcgggggcctctcctccctgctctctcccgggtcgagtcgacacagggtggggatgcgcggagcgagggtcgtcctcgtcgcgctccacgaccaacgccgcgctgaccacctgcggagttgccgccaggtagagtagcaacggctcatctggctccggggcgaccaggactgggggagaactgaggtacgccttcaactgagtgagggcccgttcagcctcctccgtccagataaacggcccggagcgtttgaggagcttaaataggggtagcgccttctctcccagcctcgatatgaaccgacttagggcggccatacagccagtgacgcattgcacatccctaagcttcctgggggggcgcatccgctctatagctcgtatcttctcggggttggcctcaatgcctcgggcagagatcaagaacccgagaagcttgcccgcaggcacgccgaacatgcacttgtcggggttcagctttatgcaggtggtgcggagactttcgaaagtttccgctagattcgagagtaaggtctcctggttgcgtgttttcacaaccaagtcatcaacataggcctcaacattacgtcctatttggctacccaaagaaattcgagtagtacgttgaaaagtaggacctgcattctttaacccgaaaggcattgtcgtataacaataagttcctacgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatntgccat

SEQ ID NO: 34242 - DNA, 722 bp, Oryza sativa
  unsure (1)..(722): unsure at all n locations
gagtgtacctgaggtaccaatcggaccaatgcaattagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttn

SEQ ID NO: 34243 - DNA, 21191 bp, Oryza sativa
  unsure (1)..(21191): unsure at all n locations
cggtatgacaatggtggaccnacnaatcttgtgcaaaactgttttcgtctccagagcgactcccacttcttgaagggtaaacctacatctgtttctctactagctgaaagtaaactcacacctttactatgcctgatttatggttttgtgcgtacaggtttagggtttttgttcctaagaatcatctttcattatatgagcagcttgttcaaagctatactgtgccaaatacatgatttgctgcactatttaaaggtaacactctcattctaattacatgaacattaagctatactatgcctaataattcctcactgtttaaagtttctatacatggagtatatttttattacatgatgatgtcactactaattatcatctatatggaattatttcataatttgtcaacggaatgttcttatatcattattgaggtgccagtgattccaagttgtctagtcgggactagtcgtaagggctccgactagtcgactaatcgcaattagtcgtgactagtcgtagattagtcggtgactataggctaggggtacccaggataatgtatagatgcttataaatattaaggataatcagattttcagagtttacagttcacacttgacttaaggtcttaaagttaaatcatttacctatcctagttgcaataagtccttcatcttttctcccgtctctcgtgactagatctagatggctggttagggttagatgaggggtacatgccttcttgggctgggcaaaaggcctgccactgaagtgtaaagtccaacacatttttagcactaacagactagtcgtccacgactaatttgatcgactaatcgtgactagtcgtgattagtcggacgataagttttctggttgaactaattgctttgaagttcctgattgaggtcagggtagagataaggacggctaatcgtgattagtcgcgactaatcggatgacttgaaaacactgtgatgtgcacatcattgtgtttttgaatgtgatattgtttttgacttccaaggagaagtggatattgggagaacattaagcttcagcaaaagattctttgaccttccaaatgcaaaaacacctcgaatgtttttggggttgtccataattactggtcttttatacatactccctccgtttcatattataagtcgctttaacttttttactagtaaaaaatttttaagcttgaccatgtttatagaaaaatttagcaacatctacaataccaaatttgtttcattaaaactaatatttaatatattctgatagtatgtttgttttatgttgaaaatactactatatttttctataaacttggtaaacttaaagaagtttgactagaaaaaaaaagtcaaaacgagttataatatgaaccggaggcagtattttgttacactgtgtatgcttagatgtcattaggccaacattcagaatgattctgcacccttgattcatggttcagggccaacctgaataaatttcaggttttatttgggctgattttcaagctttgtactatttattcaatggtattatttattgactgtttaatatcggctacttatccagtggtattttgttgactctgtaatacagcagatatcaagaatttgtatttatttggttcatatgttccttatctgggccatgcaaactatatcttttcttttaacatgtggagcaagaaagagtaggatagaatatctttacacacttattaagcctggaataggatgagcttccgttgcattgatgccctacaaatgtttgtaagataaattgactagatttccttttatctcccatatgtactgaatggcccctttcattattgatcagcttcattaggatggtaggattatttgagtttctgaccaccgtttgcatttgcagatcaatttctggaaacttctgtggtaaaatgcaacccgtgcttctcatatcataattgtgccctcgaggctttaatggtcaattcaaatagttctgttgaatttgttcccatcatctgggacagggggggcattgaagaagaaatgtaaagcctttagagttaactgatgtcatagttttctaagtgactaatgccctggcagttttgttaactaatatacattatccgattccactaggtatcatgccagccagtgcgttgcagatagtggagtatgtgtaccctactaggttaactaaaacatgtattttcttcatcgcgagtgaaactgcattattagctaaactagagtggattgacgggaattgcccacgcgtctctatatataggtccgtgtaaattactaaatcaataacttgaatgtaattatcttttgatattttttatgggaaacctgagcttaatacacatttggaatacttcgttatggcagaaattgattcaataatcattcccaacctaccttatggtttctgttgagatgatgtgtttcaggttattctgagtttctgactgtttaaccagcattccgcaccctctttttaaaaaatctgacgctattggcttctacacatattattaaccattcattttattaaaaaaataattatcaatattttgttgtgatttatttatcattaaaggtactttgaacatgacttatattttttatatttttgtttcatacggatgttaaaaagttatgacatcacatatttaaaaatgttgggagttgtaaaactaattttatgtgcagtgtaccttacatcatgagtttacatggcttcgcacgatatggatttgtattttgtgcattattattctcagtactttcgagtgaaaaaatttaagcaaatacattacaatcttgtgccctaatagtgtttcctactccggacactcttatcagcccattgcggtttcccacgggctgggcagctgacatgggctccagcagtaaggtcggcgaacgccttcagaatgtacttgtgcacactttgttcattgagctgcaggtaataaaagagcagctcctccaagaagtcccagtccaacggctgaggttcctcaccatggtgcatctctattatgttctgcatggatctccggaagtccgtgtaaggatccacggagaacagcattatggccgtactactgttgttgtcgtcttcatcacccgagcttgttcctcttgcgtcttctgcaaccgactctgaccttgatgatgatgtctctgccgctgctggctgtgtgaatttccccggagatggtggtggttgtcgccgctgctgatggttgtcgccgtcgtggatgtagagggaccggaagttgtcgaagaggaagcggtcgacgtcggagagcgtcgccgcctggtctctgccgttgctgccgtcgtcgtcgtcggtggtgcggtggtcgccgccgccaccgccgccgccgtgcagcgatggggttctggggaacctgcaggtggagaggaggcggttgctggtgatcttcgcagggatggctgagctggggatgtgaatcggtgggatcttcttgaggtttcttgagaggaagagctgtatggattttcgcagcttggctttcttactgatgttatcttcttgcatggctgaatgggattgtgagccagagggtgtcaagaatgtggaaactgaaggagatgagtgaatggtggtgttcttgttttatttattatattgcggtaatgggagttaccggcaggggatttatggtgggtttaaatggaaaaggagttgatctgggagcattaagggctgctttttatgaagttgagaccaaaaagctaaaaaccatggtttgcaaattaaggcatgatatatgcaactgcaatcaaggcctcattgggaatatttgaggattcctgtctttggaaaaattttcctgcaagagaggtttggaatatgaggatggaggtgtgaaaattcttatcgtaaataggccatgcgaaaattttaaaggctgaagtttagactgccagtatacattaataggccatgtgtggcccgtgaaaacttggccacgtaaaatgtttaataatttggcctgcgagaaaagtttaacactccaaactaagccagtgagaatattttaggaataagtctattttgcctccacaagtcatgtccctgttggattgcatccctcaagtgcaaaaccgggtataacccgttccctaacttctagaaccattgcaaatcgacttctcagatggttttggaggtggtttcgtcctacatcgttaaactttggtaggaggtgaggttgacagtgagtcggtgaccacgttccccttcgcctcgtagctagcgaacattgccctccgcgaaccgtaccgccggaatgagtcgccgatgacattgaggtcgcagccattgtcggggccaaggttgctccttgctctaccaccttcacctgattgaatgagagggtgataggaaagaagattgttgttttacttacatgtggatcctgcatggttttttattttttaattttgtttcttgtgtcacgtcagtgccacatcacctaaaaccacattcaatattatcataggactatatttgtatctgttttgaaagatgagggatgtgttatatccgataatattcagagactagatttaaactcgatatcaggataagggacaaaaagcgaacttattccatttattttcggaataagttcacttgataaccctcaaaagtgatcaaaatctaatacgtgaccctaaaccacaaaaccggatatctcgaccctcaaacttctaaaaccggtgcaatttgactccctcggcggttttggagggcggtttcgctgacgtggcgccacgtggcgcctacgtggtgatattgaccgagtcttcattccacgtggcattgatgtggcagcggaattaataaatatgcgtgggacccattagtcattcacacaaaaagaaatgtgggcccaccgacatgtggggcccacatgtcagtccttccttcttcctccccccttcttccccttcgcccgacgcgcgggatggcggcaagagcgagcagcgacgggcagcgaggccggagctgcggcgggagggcggcgagatcgagcggcggcgcgcggcgacggcgagggagctgcgctcggtggcgagagcgagcggcgaaggaaaaggacccccaccctagacaccgcccagcctggagctgcgctcggcggtgagagcggcggcggcagcgcgcagagctccaccatccttttcctttcttgatggcatattgccatcagacaaaactgaaaatgtacagcactaggctactacagtagcaatctagtactgcagtctacaagtacatttttctaagacaaaattaggtgcaggatgggaagaattacgctcgtcttcttgctgtccgcgtagaagatgaagagacaaatgtaggcgagctggaacaccgctccggtgccgttgacggtggtgacgagcagcctgccattggcgacccagggaagtccataccacaggcagatgaggcagttcagcagcgagaacaggtaagggagcccatcgaatcgctcggtcgatttggccttcaggatcctcttaaacgtcgtcctgaaacaaggaaaattcagttatgaacttcggctacgaatcaaagaaacaagaaaaaaaacaaaccgaacgtgtgcttacacttgtcgccgccgctcgctctcgccgccgagcgcagctccaggctgggcggtgtctagggtgggggtccttttccttcgccgcttgctctcccgccgagcgcagctccctcgccgtcgcagcgcgccgccgctcgatctcgccgccctcccgcccaccgccgcagctccggcctcgccgcccgccgctgctcgctcttgttgccatcccgcgtgtcgacagaaggggaagaaggggagagaaagagagagaagggagagaggggggaggaagaaggaaggccacatgtcagtgggcccacatttctttttttgaatgactaatgggtcccacgcatattttttaatttcgctgccacgtcaacgccacgtggaatgaagactcggtcaatatcaccacgtaggcgccacgtggcgccacgtcagtgaaaccgccctccaaaaccaccgagggagtcaaattgcaccggttttagaagtttgggggtcaagatatccggttttgtggtttagggtcacggattagattttaatcacttttgagggtcacaaagtgaacttattcctttattttcacatggccagaaagcccatcatagcagatgacttcacaaatactcccttgggcttcgagtcataaaacagtacgatgataaagttaaggctgagttctttcatgagggttcccaaccactttacctcgttttccgtgcgcacgctattcaaacggttaaacggtgcaatttttgtaaaaagtttttatacgaaagttgtttaaaaaaatatattgatccatttttgaaaaaaaaatttagctaatacttaattaatcatatgctaatggactgcttcgttttccgtgcgggagggtaaggttcccaaccatggccagcaaacagagccttaataaaccttaataagcttatcataatcaattttatattaaaataagtaaatcaattttcaaataagcttttcaaggtaaatcaacgcataagaatcctttaagaataaattgtactgtcggtacacaaactttattagactagtgtgcaatttagtaatttctccgttttatattataagcccttttaacttttttctaatcaaattttgttatgtttgactaagtttatacaaaattagtaacatctatgacaccaataagtttcattaaatgtaacattggatatacttttctagtatgtttgttttagttgaaaatgtcactatatttttctataacttcagtcaaacctaacaaaatttaactataaaaaaaattcaaagcgacttataatataaatcgaaggtaatacgtgaacttgtaaattgctcgtttcggtgaaaaacttgtgtagtgtatgcaaactaaagaaagaaaaaaatatgttataactaatttcactaaattgcacgctgagtaggatattatgtatatgatcagttagtaaaatggctctggctttgtacgtagttcagtaaaataaacgcaggttcgtgtttttggttgttgccttccatttttcttatgagattagtaatgctatgtgcttttttcccttctatcaattaaaatagcagagctcctacttgttttaaagaaacatataccaaatcaagcattgaataagttgtgttgagtgtacagagaaaaaggtatataaacagagaaaaaaacatataaaaggaaaatgcaatggatacaaataatgaataaaaacaaaataaatataaagtatatatataaaggttatttacacttaagatatgtctcatgtcctcaattatgcgtgtgacatcctaatcaaactcgaactttttttaaacaagaacatagcaggggaggcccctactgttaaatagattttattaaaaataaataagttacaagcacaattacagcaacaaaatccaatctctcactacatccttatccctctcaggtgaagaaacataattagtcacaataaatcgttttagatttagttcagaagcactagataagtccgtgcaccataatgattatttcataaatttatgtagtaaattacaccacctaacaagtttgtataccatcaacacaatttatatatttttaaatacacaattaagaagttattgacggtcaaagtttcaaaattttaattaaattttgtggtaaactttaaatatttcttatcgagcttcacgtgcagtaattcaattgtgcatgttgtccaccaccaaagaaattcacttaagccctttttttcttatttattcaatctgaaatgaataacacagtgcaatgtgcaaccccacaaaaatgggttaaatcagagatgctttttttttaacgatatatacctacttctcaaggcttttgcactttgcagtgaatttttttcatccacactcacatgcactttgccatgcagccggccaaaccgattcgttttcccaaatcaaccgcactactactgtttaggcccaaggtcaacgttgttgtgccgttttctaacgccgtcctttcatgcgttattcctccaaaaccgtgcaattgccggtcaccaatcacgacttcccatgcacatcgtccaacccagaatattttttgacttctcatttcacttgaaatcacacgacaccaactctaattctgagccgcagagacagagaaaaccatgcagattagtcgttagtggtgacagaaacggcaaaagtggtgtttccgttttttccagcccatcgaagttgaaactgaatccccaaaaattaatcatccactcagtactcactcgtcctgctaagatcgtagccggcccagctaacgcagcaatgacacgtcaagaactgaaaattaaatgtcacacacatgtaacgtatctcgtgtgacagagaggtctcaaactccaagtcaatcctgacgatccagacaggcagacaagcagattgaccgattcaccagaattcctgaatctctcaagtcatgatcaaacaaagcacactggcaggttgatcagagtggtagctgactctagctgcttcttctgcagctatatatacacataccaatccgtctgcattgccacaaccaacacacattcacaattcacaaagtgttagcaaactcatcatccagagtccagactcatctctacttccaagatctcaagaactgaattaagacagtttcatcaggctttcagttagatcgattttgcagtaattacaggttataagatggccaccctgaaggtgtacctgctgctgttcaccgccttcttcctctccggcctcatgcagctgtccacggcgacgcagacggcgccggcgccggcggcggctccggcgagggtgatcgacgccaaggccattgatcaggcgatcgcctacctgctcatgttcgcggcgctgttcgtcacctacttttcgcactgaagcattactgtggacggtctggaaaaaaaaagatgagattgtcgctaagagaacgagagcgccatggttctggtctctgttcaagtatggttcttacttttttttttagcgttttgtaattttgttgtgatttgattgggtgttgtaagaatgcataattgcatggtcaagtctagataaaagtctatcatttctttagaagcatgcatgcctctagctctgaagtgagttaaagaaggtcatggttctgtatctgttgatgtaacaatagcagatacttataatttaagtttctttgtaaatttgtttgaatactactatatttgttccatcaacttatggcttcacgtgattaacgcccgttctcatctcagccgtacgtagctatttgggtgacttgaaaatctgacagattttctaagcaaaatgtgtcgaatgatttttagacagtccacttactctaagatggtaagtctgaaacattttctttcaaaacaggaacagatatatgatatatcttaatgtaattaagcagatatctcatatagtttgagtttatttgtaaacctgtttgaataatgtatgtgcatatactgtttcctggaaagcctgaagcatcttttctttgcatagaaaaacatctcttgagtacatttcgtactatgggtggaaactcaaaaatctgcttatggtctagggttggatgctgaacatgttgtacaaagcaagaactacaatccaaaatactgatcgaaaacgatctatgcaagcagtgtttgtacatactaaaatgttgttacatatgtttaaattattaagagtgtttttatggtcctcaacgagatacaaaatgtactatatataaccaaaaatgtactactcctatggattaacactataaaacgtggtaactctccatactcctcatgcaagtaattgttttttttggttaaatttcatgtagtcattttctatagtaaaacttagagtaaggataatactgagttataagctaactataagcttatatggaaaagagagataaataaaagtgaggagtgttggcttttatgcaagagctagctatacacatgctcctagatatttacattaaattcatagtaagagaaatagataagatagaaaaaaaataaatcctatctttaatatgtgttaacatattatacatgttagctttaatatgtgctaatagccaataattagctactccactattaaacttgctcttaagtcatatacgcttaaggaggacagtaccttcagggttaggcttagggctgtgttctattgtacatgtgttgggaacttatactttccacacgaaaaacagaatgactcgttatatcatgattgattaaatattagctaaaaaaattaaaaataaattaatatgatttttcaaacaacttttccatagaaatttttttaataaaaaacatattccctccattccaaattgatctacatatagtttttttagtttatttctaaatgatctacatatttgtgttcattcattaggtctattcgttatttgtgcattggagtaaatggatattgatgcatgcatccatgcacacaagcatttataacccacatacaatatcttgatttgctattggctaggaaatagtggggatagtgcatgcattgagtttgttgatagagtaaatatagtatgagagagttattaactttttttggtcttggtgtacccatgaaatatatagatcaatttggaatggagcgagtactgtttagtagctcgggaaactgcacgtaggatacgaaagagtataattaagttgaaaagggggaatcacaagagtcaacaaaatattagtgcaaaaaatgtaattaatcgaccgagcatattttcagcttttcatgattcattgattcttcgactccttcatcatttttttttgcggggaagactccttcgtcattttaactaaggccgcatatatgttcatggtacgcatgacgtcgacggcatgagctgtacatcgtctattccgaaacatcgtcaaaaaatcactagcaaaaccaaatttatgttaattggctcgtgtcctcacggtggaatctacccacctgatcccgctgtgtaaaatgttaaaaggatttgagtgattttctcttgaagaaatattttaggaggtaacatttttttttaaaaaaacaatgacatccttctcgtatcctagtatttgaggaactaaattttatataaaaaatatatatgtgctacctcgtaaaatttcttaaagggtttacaatgttgatgagtctacgatggtggcttgcaatgctcatccaacaaagcgcgcgataacgcatttaagtcgtgtcaactgccaaatgacactgtaaccaatgcttactcaacgtgctcaacccgttcaggacgacaaatggccacacacatacaacggcttggtcagcattgctctgctcaacttctactctcaaacaactaagagcatctccaaccgtctctctaaatctaagggggtgtttagcccctctttcccaaacaccccctaactctccaaatgtctatttggtcaactctccatcttatttagtcagtcaaactcttatttactccaacagcctctccattcatactctctattatgagcctatgacagtgggacgcacgtgttggtctctacaaccctttcttcttcctcatctctcccccttttccccaaacccactctgctcagcttgcagtaggtgccgccgccgccgctcgggccgagctcgcgtggacgcggggcggccaatcggcgtgggcggtgaacacgacggcaggagcgagatggcggcgtcctctactacatgccgcaccggccgaatccgccggggcatggcgatgacgatggcaggcgacgacgacctcggagacgacgggacgacgacctcggttggcgacgacgtcgatgacagctagcgacggcacggcgtccgtcaacgacgacctcggagacgacggttgacgacggcgccgatgacggctggcgacggctcaatgacgacctcgcggatctggcaacggcacgacgacggctggcgacggcgacagcgccgacgacggctggtgacggcggcgtctggcaacgacgacctcgacagcaccagcgatggcatctcgacgacgacggttggcggagagagaaaggggagagggatgctgtcggcgtggggcccacgattggctaggctattttggttggtcaaatttggctagtggaaggaggactttggccagccggatggcttggccagctcgatagccagtctgttggagtgtgaaattgagccaaaattgctaaaatttaacttagagagggggataaggaggctgttggagatgctctaacttcatggccgagtttagttccaaactttttcttcaaacttccaacttttccatcacatcaaaactttcctacccacacaaacttccaacttttccgtcccatcgttccaattttagcgtgaactaaacacaccccatctcgtgtgaactgcacatgttcggacggatcgatcgatctttgcctgtaagtaaactgagcatatatatatagatttttgccaactaatatataccacgtgccggaaactcagacttaacggacatgtagatttttatcaacttcgaatgaatatttagaaatatacttaaataaatgcattgtctcctttagtgtcaaaatattagtgtttgcaccgtaagtttatgttaaccctaaatatctattgaaattgaactatgaagattaaaaattataagataaaagcataattatgtaaattatactaaatgagccataggtttaaaaagattgtaattcttggtggtggtagtgagtttgccaccaccaccaatattgacaagtggccatgatgcttgtttgtatatatactgcatatttctgtcgctttatctcgattaagaaaaaatctcacaaacttattagcatgtgatcgatctatatttaagtgctgatcgaaaaccaaacgtctatttctcacattagaaatgcaatcctaagcatggtattttttttatttcgttttcaagatgaaagatctcgtttcaaccaagtaaaagacagttttttcaacgagaacttaattttagctattttcaataatccattacaatgtatgggtatttggctagttatcttttagaaagaaacattaccttaaaaaaatgtacaccagccggcaagcatgtacatagctccaaagttcagaacatagagagagaacacctcctcaacaacactctcaggtcaatctcggccgacccaaacagacagaaaaacagattgaccgattcaccatgcatctctgcataattcctgaatctcaaggtcctgatcaactttgaatggagatttacaaatatatttaaatgtctgcatctatatatatatatacctaccaacccgtctgcatttgccacaaacaaacacatcagaagaaaagtgttggcaatccagcctgatcatctctagctgcttccaagatcttaaaaactcaagacagtttcaggctttcaggtagctttgcagtaacacacatcaagatggccaccctgaaggtgtacctgctgctgttcaccgccttcttcctctccggcctcatgcagctgtccatggcgcaaggcgcggcggcggcgccggcgacgagggtgatcgacgccaaggccatcgatcaggcgatcgcctacctgctcatgttcgcggcgctgttcgtcacctacttttctcactgaagttcttttctacggtagcactactgtggacggtctgaaaaaaaaaaacgagaatgtcgatcgctaagagaacgagagtgccatggttctggttctggtctctgttccttcaagtatggttattgtttttatagcgttttgtaattttgttatcgatttgtttgggtgttgtaagaatgcataattgcataaggtcaagtctagaaaaaaagtctttttatcttttctttagaagcatatgcctctaactctcaagtgagtagaagagggtcatggtgttctgtatctgttcatgtagcagtagcagataattcttataattaagtttctttgtaaatttgtttgaataatgaatactattatatatgtgtgtatttactttaagctagtaagtctgtaacattttctttctttcttttcataagtaaaactctcttgagtatatttcataatatgggtggaaactcaaaaatctcttagagcatcaccaacagtctccctatatgattcccaaaactgattttgagggattttagtccaaaaatcagctccaacagatcccctactctcctacccgagttttgaagttcccttctcctggttcctcgctccgtttatatgtgggcgcggaaggcgctcccaatcacgcaatcccgcctctctccttcgttcccgcgtgtgggagatagcgatctttctgcgcgtgaaagaaaaaaaaacggaattttctgttggtagtttaacagaagggcctacttttaagttttggggattgaatttaggctatctgttggatggaggagttttttcacttcctattttcggtttaggaaaccaaaaaacaaatttttaggagaaaattatagataatctgttggtgatgctcttataacctatggttgggtactgaaaattttttaggaagcaagagctgcaatccggaatactgaaaaatgatctatgctagcagtgttcttacgttgtactaatttttttactccctccatattttaatatatgacgccattgactttttaaccaacgtttgaccattcgtcttattcaaattttttatgcaaatataaaaatacttatgtcatacttaaagaacatttgatgataaatcaagtcaatataaaataaatgataattacataaattttttaataagacgaaaggtcaaatgtttataaaaaaatcaacagcgtcataatacggagggagtacatctctactactcaaaaagcggagtcatcctccttcccctcacgtgcatgttccaaaaaaaaatggctagagaaaaacaaaacagaagtaaaaaaaaaaagggttgctgcgcgcctgaaaaaaaacacaatcggtgaaaagaaacagacaaaaaggaaaagtgattaggtcgtaatatagaaaggaaaatctccaatccattaattttgtttttcaggaaaaaaatgatatcctcatgaggtactctctaactaattaagagatatagaaaattatatttatatcctcattaagtacattataactatttttccaaaccagtcgatctaataagttgattgagatgagctaataatgagagctatgacttcattgatatatggctgcattgatgaaggagggcagggagagaagttctttgaaatgtgagaatgacaagtattctaaataaaataaatgctagaataaaaaagtattatgaaactaaactgcacattagaaaatatgttacgtcctcaaatgccgtaaactttctcaaatgattcacaatgttcactactaccaaatattttctccatgcggccaaaagttatttttttgcatatggacgggcgacccgcctgtgcctaaaggtctgcgaagaaaatcggaattttgcatgccgtcaacgcagccgcatgcgaaaatccaattttcacaggtggacacttgagccgtccgcacgcaaaaataatttggcaaaaagaaaaatcaaaacaaaaaaccctagatccacaatacataaaccctaatccgccgccaccgtgtcaaattcgctgctgccgtcgtgccgggatccatcgtcgtagttgtcgcttaaggccgctgccatcgtggtcaaagtcccccgaggcccggctatggcagatcccgcttacccaaggcctggcggtgacggatccacacgcctgaggcttggcggcggtggattcggctcggtcgtcgcagtagtcgtcgccgctgacgccgctcgctctttcccgccgtccccgcctcagccgctggagtgggaaggggagaggaagggaggagagggagtaggagaggaagataagaggagtaggatgagtggataagaacagtgggagaggaaagatgcagtggagagaacaggagaaaacatgaaaatctattttcgcatgcagtctcttaagagccccctcctaaaaaaaataaatttttacatgtggtctcttaaaaggctcgtctaaaaaaataagtctattttcagagacggatctcttatggggccgtatgcgaaaaggcccgtgaaccttttcttggaaaacgatttttgcaagggcgagaagtttaactataaccaacctatagggttctcgtaaaaaaaatcgtttctatatagttgtgcttgatgagtctacggtggcggctgcaatatgctcatcctgataaagtgataacgcatttgagtcgtgtcaaatggcatcatacctatgatttactcaacgtgctcgatcgatcaacccgcacaggacggcagtagtggccacaatggcttggtcagcattgctccgttcaacttctgctctcaattaaacgaccactataacttcaactcgggtgaaatatacatattcagaacgtagttccaaagtatgtacgaccgtacgtaggttcagaacgcagagagagagagatcgaacaccttaacatgttgttaacaccctagtcaatctcggccgacccaaacagattgaccgattcatcagtggtttgatctctttctaataagctagctagccatgatcaaactaagcacactgacgattcatcactgcacgcatgctgaattacatcaactatatatataagcggtaatagttagttaattatccatcgctaattcaacaataattttagaatatttagcggatcctatacggccatacccgttattcgcagatggaatatccgatcgctgctggttgggatggacggtggatgagaggaggtgtatgtacacccggggaaggtacacaatgccactgtcacattttgagtttgtcccaaattgtccttttgcactagtatgtcactacacgagacgttcattgattcaaagcaaatttttattttgtactcgtacatataaaaaactattattatttttatctctcttgactttgtagctgagtaatatatattaagatttattgaatatgttcatactgatatatcatatatcttcttttgtatgaaatataaaatttgcaaatgatttgttaatgacatttctctaaatagcatttagaaaatgattttatatctctaaataaaatgtgcaaatggtctcctaatgttcatactaatgatatttctctgaaaataaaacctgcaaatgacacatctctaaatagcattttaaaaataatttatatctaaacccaaaacttgcattgactagaaaactgtgagaaaaaaattcttgcaagtgcaaaccaaagagaacacaaagtccgcccatagaaagataataccaccgttgagggggaaaatggaaatacattattcttgaataaaatatcaattacatatctaaagttgtaaaaaaataacaaaattatctcacaatatgttgtaatgaatctacattatatattttttagaaatataatgtcatgtttttatcaacatattaaataaacttaggacattactttgaaaaaaaaaggaaaaccacaaaaaaaattcattcgaactactgtagtactacttgagggccattttggaccataaaaatcataacatgtaccattccttaccgccactatgaagggaaccaatcaggtaggtacatctgtcaaactatgcatataggtgcatatgcaccttggttcatattatgcaactcagatgtgaaccttggtccatatgctccatgaatcctagccatccatcgttctcatgatgcgtgcggctagtacatgggttagtatgcactaaatattcagggcaagtacaaccgtgtagacagcttgctgtctttttacacaaatagacagcttaaacagacagcttatacaatgggttgttggtttggctgtctgtagagtgtttaattcatcctttgacacacaaatcatgatgatctagtgtataattgatctttgtagtcattttgttgcatacataagacaatgcacagtacatttaaatattccgcatgacttgtaaaataaacatgtatataataattatatatatttatatatgaaatgatcttagaagaagtagctgcagtcggtgaaggagcttggaggtggactagcctcgccatatccactactgcggtgctgtggcacatgcgccgtcgaccctgaactgatctgctccggcaccatcgacaccgcccgagctcctccctgggccttccgcatcagtgccatcgcaccctttcaagattgcgatgcagctggcttgcgcattcaagccgcatccaactttagcatattttggcgccgcgccgccgtcttctttcgtgcctgccgcgacatggtggccagatcgaaatatggttggatggggccgcaggggggggggggctatttcaacgcgcgcgagagagattttggcgggcgaggaaggcgcgaacctgttccgcgcgcgagagagctgatcccgcgcttccgtcgcctccccgcatcgggtcgtacaacgggcttcatcgccgtcgcgttgcctgggagcacgcgctggcctcgtcgacgaacgagacgacagatgggccgaagcgagcaccgtggggaggggggtttcgcaaaaaaaaaagtgcatgtcgacgggtatcgccgacccgttgtacttgccctcatgaagctcactgtgggggttaaacacgttgtttcacagtagtacaccggcacggcgcacagtcaatgctagtgtaggtctgacgtaggccatgtactccctgagtaagagcaagtcaaaggaagctaatcgtagcatttattcctccatttgaatattctttctttctctttcttttctcttgatattcacagaatgtagcataatttccattttagaaacttcactcatgcgatattttaattcacaatacatgtcaagttatatactatcattttgcaacatcattttattcttgacatcactttgcaaatgatattttcattatgttgtgtttccagcaacaaattatataggccataaattataaaaaaattaactatataggccataaattatagaaaaaattatgtctgggtgtagcatatatatgtaaaaataacaatcacatgttttttatttcactgtatgccaagtgatttatgctttttacggtgtcatttttggaaatcagttttgcataatgacatttttgaaatgttattttttttgcaaatatattgtattttcatggtgagtggacattcaactttgatattatgttccaataaaaccaaacatatttttttctcacatttcttttcaccctactaaaagcctggactgggcatgcatgccgtgttttgtcttgtcactgatatctttgaccaacaggacattgcactgattcctccataaataaggacatggcatgctcagtggatgtgatcagggtttagtctgtgtgctagtttaatttgttttttatttacttgattgtatatcaatactccaactcacctcggcgcacaaaactgtggagataattttgaaagcctttcgaaagatagctcggacaaaggatctgacattcactctggaaaattaattttacatttatttgtatatttaagtgagcaattgttgctagttagttgctctagagctattatcaaatttgcaatagatctattcgatttcacatgtcaagtgctattatcaaatctcaaaattagctctttaccgtggtcaacttggtcagattacattaccatgttaatgacaattggaaaagttatatatattctcataaacttagatattatgatgtattggcttatattacattactatgttaattacaattggaaaaaaaatagattttatgatgcaatggcatatattcgtaggaacaccagtcatttacttttttaagtttataataaatgccaagtgatatatcattttgcaatatcatttatacatcacgttgcaaaataacatttctatgcaaatatcatattttggtggtgagtggacgtttattttgatttttttatgtagattgtaactaaatcatattttagaatgtaacatatatctgtaaaatattaaccacatgtttttttattttcaatccgtggcaagcgaataagcgatatacccccaaatcatatacccagtagacatgacaactaacaaaaagagccgaaagtattttatgaatgagatttttagcttgtagtgatgatgacatgacattggtgtcagaatataggtgtggcatgcaggtgcggggggctttgggaagcatagaagcaagtcaacttgtaccaagcaaacaagcatgcatacgcagccttgtataggaacagagtggagtaggtatatattatagctgcattagtacacaatgaactagactcatccatagtgcaatgtgcatatgtgtcagccatacgaggtgggtgcatatgaaccttggttcatatatatatatatatatatatatatatatatatatatatatatatatatatatcccttgcccttgcattctcacacaataagacacggttggttctatcagcaaaatggcaggcgagccaatgccttacaatgggtgagcgagatgcacctcaacatttatgctgatgctgactactattctagtcttaatagggatagaatggcttgacgcagaagccgctttgggagcacgagcatttgctattatatctatttgagattcagactcagacagggcacttcttcttgtataaataacagaggctggtngatcttttttctatccttatgctagcatttgcttttacgaaaactgtctcg

SEQ ID NO: 34244 - DNA, 1577 bp, Oryza sativa
  unsure (1)..(1577): unsure at all n locations
cggcggngtgagannnnnnnnnnnnnnnnnnnnnnnnnnngtttcctctttcttgcatctctatcagaggctgttgcatctgattcttcctttatgctagcatcgccttttcgatcactgtctccagctgattcttcaccattggcacgtccatcagtctcaatataggttcttgtgcctgtatcgcgttcttcatcagatttctcactatcagtcttagtaagatcaaccatggcgaggttatccttgtgaaaccagatttctgatgcaagcaacttgcggtattcagctattatagcctgcattttaaggcacaagtacatcaggcagtttaacaaaaagaaaagaaaaggaacctatagtgtgaaatagcactaacatcatcacagtcgtctatacttttgccttcagcaattctacttgcgaaccacagcataaagaaaccacagtcattactgaaacaattattcaacaatgtaagccaaatagagatataaatgcagcaaagaacgggagaagaatttcttcaaggcagctgaaatattactagttgttttgctgcttttacagacagctccttatactcgaattcaggaagtccaagtgacttcaagtatccatcagcttttgatacttgcaagaatggatcaaggtaaagaaaaagaagtgtttatcactgagtatagggacaaatatttggggaaaaataaccataccacattttctgcagcacttctctgcccatgagattgcaatgaatcaagtatagatttacaattattcaccatgtcaaacaccactaaaaaccaatgttcgctgtggaggatgggtatgaaaatctgggaaaaaacatgtttagttcatggcctaaaagaagaaaaaaataacttgtcttgggatagggggcacaaactagttttgtgttggggcgcacaattcttctcctaagccggtatagcagagttctgctgtcgcccttactcaacaaaaaatcctacaataaaattgaatagattgtaatattggataaattaaacacaagatggaaaaatgctaactgctctaattgatactccctcagtcccacaatataagggattttgagcgtccccncctggcctctgacctcgctgccgacgacattgtccgtggagcggtggtcgaccgcgacaaccgccgacgcgtgcagcgatggggttctcggaacctgcatgtggagaggatgcgattgcttgggatccttccacgagtggctgaactggggatgtgaatcggggggaacttcttgaaggttcttgacaagaagaactgtatggactctaccactcggctttcttcagaggttattcctttgctcggtcaatgggattgggagccagagggtttaaacttgtggcaactgacgcgatgagggaatgtgggggtctaggttattattacaccgcggaatggaacgccccgcggggatttatgttgggtttaattgaaaggagttatctgggacaatacgggttctttttcttaagtggaccccaagttcaaaaccattctcgcaatcatacggcttgttttccacg

SEQ ID NO: 34245 - DNA, 5505 bp, Oryza sativa
  unsure (1)..(5505): unsure at all n locations
cactggcattgtttagcttcttctgcaagtagttcatcacacaaataaaataaataataatttcaaaaaaatttgaataagacgagtggtcaaacgttgcaagcaaaatctcaaaatcccttatattctgggacggagggagtactaaccgtggcagctatagaaagcattacattttgacctttccattgttcattccaaacatttaccagggcctggactacccaattactcatccaaccatgtggttggaatacatctacaaatgcatcttcagtaaacttaaatgtgcctaaatccactaccacccttttgctgctttcatctttgtttatcttggacaagataaacttgcatagaatttatctagtttatttacagtattacgggcttcaagtccaaataattcctccaattcttgggcacaatgcctcatttctttcgaggttatgtcttcaacagcatttctccacgacaactgatatttttctataatgtggtcgactttgatagccatatcagttggaaggtccaggtcatccaaatgagaagcaagcatatttctcatgttaggaacacgcacaaatgagtcattttgttcctcgaaggggcacttctccttcttgccgagcttcccaatcttatacctctttgcattgggcgccttatgcttgtgcttcttcttaagctgaaaaggggcacaagcgtaagggtgaacaagtgcactgcggtttctttcaatggcatgatccggtttttcctcaatatatcacatatttgatcggggacttgcaacataaagtagatgaattgaacgataaagtagatgaatttaacgaggagcttgctgcatgcaagaaggaagctggaaacacttatacttacatctggaatgaatgaatagtcaatcttgtcaagttgaacatctgggatgccattttttccatacactgtgtgtgcccaaggttttacctaaaaaggggcaaggaagggaaatgtatagttagatgttagtgggtagtgtagttggtagcagcactcaagtatgcctgtactagatagttgacatttgcttctataaagtaggagagcagctgcagctcaaattagttcagcagcaccaagtgtttgtgctctctgttctctcatcttcttccacctctcatgtgtgagctgtgtgcgtgagtgtgagtgtgagtttgagggacctggtgatcaggagtgaggtagtgctagcatgcatatgcatacatttttacataccttgatgtcttcaccaagacgagtaaaaacatcatccaccattgatgaagtatagtactgcagtcttggggtcttcatggctgcattgccagtttcatggcaatcaaggttgtccaaacaaaaaacctgctagttacttttagtcgtacaacatttgcttttgtaaaaaaagaaaagatttcaaagatgcttacaagaaaggtcaccgggctccaaatggtatatgattcaacgaagttttgaaaacctgccttcaaatgatccattaattgcttacaccaatcaattgtagccactgtctttaggtccaagactgatcccaaacattcgcgaatgacataattagaagaacttgtgaaggaagaaaagctgaacactgccgctaaaaaaagcctgacttccagcatagtgttgctagcattcctagcagttgcacatgctttgtcaacatcaaaaacagtaatagaattggctgggcgagttttcgcatcaggattggactctttttccatcaaaagagcatctagaaggtcatccacttcaacattttgacctacatcaatgtcctggggcatctctctagcccttggaagcccatgtatgattttcaacacctctagtggctagattttgtctttagataacccactctatgcatctcttattcctgatcattgtttgatgtgtcatctgctactgtgtctcattggctagttgagcataacactatgctactctctctttttgtttacttaagatcataccttgtcctcataggctcatacgctacacggctgttagttatctcatttagttactgaacaccatgttacttttcattcagcaagcttttaatttaaagaattttctgatgctaaaagacaaaaccaagaaattttagctacttatatcgaatgaaacaagcgagcccacttcttacttcttgcaggtttttgggaggcggctaagctacagaacttgtagttcaagtttacgagccagattggacggaaggagtataagattcagatttggagctaacaagcctagcaacagcttagttcttttgtaggtaatcgatcgaatctgcctagaccggggaagatttctaagaatgcaggtctagcattttaaacaacatttgccaatgcacaaagtatggtaagtaaggtaggcttagctgactgatgcttactaaatcgaaactttgacttctatattcaactcagtctttcaattaaaatctctgctgttggagatagggtgggctttcttatcggttcactgaagtcagcttgctaaatccactttgtggatcatgaatattcttgctgcttgctgggtcatgaatcctcgtgctactgtatttcattttcatctgcagaaacagttctactaggatttgcaggcgtaagaacatcattcaatgcacttatgttttaatatagttgaccatatgcagccccgtttctaatagcggcttatatttcatatgtttcagtccaagatgttgatgaaggaagggctgaaggtccatacttcacttacctttatatgtttctagttttctatcagcattgctgagattcttttttcataaataggagggttattctatgagtgcgactacgactgccccgactgctgtgagccaggctgtgagtacatcatgtatcatgtaagtgcatacagttggcatacattgcttcatatactgcaatttctaatgaacttttgttttttttcagccaaggtcacctcaatgaactgcgcctgccttcctgcaactgaagctaatgaactgtgtgtagagtacgggtgtagaggactaatgaactgttatgttttagcagaacaaaggatccttctatgaaactgtcccataaattgtctttggatttggtgatgtttacttttgttacatcgtgttatgaacccaaaactttttgtgtttctcacttctgtttatagtttaatgtaaactgaattattgaatgaatattatcatttcaatagtgcatctgtttttactcaattttttgttttcttgcgaaattagctatatgtgcataggttgagcagtgcaaccatctaagcttaacatgagatgagtttgatcccatccttcaagagcagtgtaaatttctagaaagaggtaacacattttaaaattatatgttatgttagtatttctagatttatcaatatatctagatttatcaatatatcttttaatttgtttgctatgtattccagctaaagtagaaatatatatactccatgatttattagagtatgttgagatgttggcccttgtcttttcaaacattttctctgaatatagatttctttgtttggtttattcaggaatgacagaggtgacgactgggtggtctggtttgctcatgatctagtgccccaaatgcagaaaagaacgcgttatagagcagactagcaaaaagtgaaatccaagaaatgatggaaatgcgttcttcaagtgtatggtgaacgaatgttagtcaagattgatttttttgatactatgttgattacatttttgctattccatatgctgcagtcttgtcagaaattcatgtgggaagatgagtatagaaaagagttgcttaaagcttgtaaagagctggagatcctacgatctgagaatgctcaactgaggagcatttttgccaatcaacaagtttagatagaggcattggttgtcaacgaaggtcagctttattagattctcgccctctcttaccctccagtcctctcttcctctctccggtcctcgcgtttcttgttctacaaatggccgggaattgagatctgcagcgttgctggatatgatcttggttagttttttcttgtagtgtagtggacgatctggtcacgattcagttattggtttttttggatttcagttattagtttttttggatttctcatatttcttcggcttttgttgcctaaacctaaccaacacttgggacggatgctgactggctcagtggggctctgccgctctgatattacaattatacatgtttaaacttgctgatcaaacactaaagcaatcactatagatagatggactatagtgaacaatgatcccgaatgctaattaggaactaaccaagaagtaattctctctaagcaaatcttaattacttagaatgatatttctattaaagcagagtgataaacaaagttcaagagataagagaggattatcgatactccggaattcttccgacttcttctacttaagtctcttcctattctaatatacaataaagtacactagagtctcttgtaattcagctcatgctttggtgtgtgtgaatgaggaaaagaagaggggtatttataggtgaagagttgccttgggagagtggagatgctccaagcatcctatgagcatattccctctagcttcatgtcctcttgacaagtgtcctcactatgacggtttccaccggtagaaatggccacaaccgtcattgggatgaggagtacaaccgtcataccgaaaatgggctggactgggccagctaggggttcggccgaatcctggttggcttccctggcccacatctttcttcaggatgctgacatatgggccccacttcatgatgctccatgttttggctccaaatgattgcacattttatatattgtagctcaaaaccatgtgagttcatcagagcaaaatatatttccattctttatgctcattctctcccaactttggtggttgatcacctgcatacaaatatacaccaacactcgtggaaattgttagaaataaatcataccactatgttggatgtttcacatttatggttttatcaggtattgacggcgttattttggcacttaacagccgttaacaataggctcatacgctacatggctattagttgtctcatttagttactgaacaccatgttacttttcattcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatgaactactgaccatctagtagtcatccgc

SEQ ID NO: 34246 - DNA, 763 bp, Oryza sativa
  unsure (1)..(763): unsure at all n locations
agggatggatcaccnnnnnnnnnnnnnnnnnnnnnnnngtcctaaggacttaaatctatatcctgcaagatgacttgttgccacatcagcagccaaatcaataacctgagcatccgtagacagtttgtctcctgagtataagagctgcgaagtagatgaacagccatgtttcatagaaagggtagagcgattggcaggagtgatctgggcaaacttgatatagttacttcttttggtggttggattcacagataatgcagttctctggttctcatttgctgtggtgacagcctagcagaagaaagaatacgacctataagtaccagaagcatcaaactgaatactgatcatctatgtgagtgcaacaaaattaccaaagcagatatagtctcctgaggtttatgtttgtctgcaagcagtacaatattatctgcatgtaacagcattttcacaaaaatgtaaatcatcaagagaatagcagatcagcagaaacacaatatagtaattaaatttggcagccacagcaaccggagctgcaagaaatgtctggttgtccagccaatggttgcactgaacaattaaaaaatgttcagggcttcaggacagcaacacatgttgcagaattatattcagcactcgacagctaggtgaaataggtaatttaaagaggatttaacattcaggagctggatcttggccccatactctataaatatctctcaagacttaatagtacaaaaaaaaattgaagatttttctatgn

SEQ ID NO: 34247 - DNA, 2579 bp, Oryza sativa
  unsure (1)..(2579): unsure at all n locations
catgagcaaggtagattcgntgtacagcagcacnncatcatgagatgtcaagaagctttttttattcaaaaggccgagattcagaaaaataatgacttgtagcttttctacccacatgatgtttgacatcaacaagccactggaggtaaccacgtgatccttaaaatcttatatgttaggttgatatagcacaaaagcgcaaagcgtatcttgagattttcaaagtgactttcttcttaagtgcttcgatgaaatacgatatggaatgcaaatacagagagattgactaagaaaggctaaatcagctcacatgtagaacagaagacataaatgttaaaagcattcattctgcagctagtccagttgaagcagaaaactaatgataatttgattccttgcttagaaggttatgattagttttgaacctttcatcacaataaataattgctccatagtcatggcgatgtctaatgacacgtccaacagcctgattgacagctcttgccgcttgttgtacataccattcctcccctgtcaaagcctacaaaaagatcacaaacttgtttctaaataattatcaggaattcaggatataaagcatatgaataggattgcactatgtgcatacagtatttttgtttctagttcctgatataactgcttgaagttaataagaacataactccgactaagaaatactttttctgtgcgcattaagctttgcactaaaaagtatatgatctgtcttaaggatgttagttaatgtattgagcctattgcttgcactcactaccaatacaatgttgagaggccgaaggcttcatgaactctgtataaaaccgaatgtcctccaaacagcttcagttcaatcttaaagttttactacaatctagagaggctttaagcttttgactccatctgtgtggctgcagcagttatttgttttataatgtaatttgtccaaacaaactgtcatttgatactttaccatcagagctatgatggtgcagaaaattgatgctccatgatacagcacggtaatttatcatgtcataatatttttggagttgcaccatgtaattagaggaaaattgatgtactttacttaatgagttatgataagttcgagcttaatataaagaatcattgaacaatgaagtatggaaaacaacttaacctttgagttcttgttagatgctgaacccagcttatccaaataatcacgcttgagccgaacctggaacaatcacataaaggaaattgcaaattttattgaaggaaaatggagcaaataattatgaggcttgatagttgttagtttgtactttgcgtcataaaacaatgaatattctagcattgtatcacacggtatttgagctttgtacgaatggagctgagcagctggaagtcacacaaggaggtcaaatttcataagcttataatgtgcacaggatagttgttactttgaatgtgcaaggaactcaaaagcttttttcccaaccaaataggtcccgttaactatattgggagaaaagggtgagcaagaaaatagggaagaccttaggatcagttggggtagcgaagggcattccagtaactattacagctcttccagcacggtcagcaaaatcaagaccctcactaacctgcataagtataaaatgcataagtagtagaactaatatttgaggttagtcaaaatgcaacaatctgaaaatgaaaagcctaccttgttaatactcaaggcatctatccttccaataatatgtgattattatgctttgtttgattatagcacttagtttttttttagcagaattatagcactatagttgaatggctactatgtttattagaattctatgttcagtcctgcttttagtagtgtgttccatcattcataagattgtagctgtacctattaacatcattattagcattacaatactctctttatagactcattgaatgttgtcgaacatgttttaacacaaaagaaaggactaaacatcagagcaaatgaattatatagatccaacaaccaaccagagtcatagaagaatataaactcaagagtatcgaagctttaacaaaaagaagaaagttaacattgaacttcaccagaagttaaaatagaaagtaaaaggagatatgagaatattagatggacaggaacaaactttgccccgacaaactgcaaaaaatattgccccggttgtagaagaatcacgtagcttggctgcataatcctgcaaatccaatgccatgcagttctatgagaaaatagagtttaaagttcaaaccgtgacttataaaatatcccacaacctcgattgcatttggaaagttcgatgactgcctaggctctataactggctgcttgtgcttgcagattcgttgccaaattgtgtgctcatcacttgaattttcatggttctgtaaaatccaatcctcatttcctcaaggccaaatacctcaataaattggaataactcattgaaattacacataccctatctttccagcagttgatacactgatctgatacgatgcgtgcatcaaaagcatcaaaatgccat

SEQ ID NO: 34248 - DNA, 2458 bp, Oryza sativa
  unsure (1)..(2458): unsure at all n locations
tatattcactctatgcagtagttcatcatgcaatataagaaaatctagagaattaagtatataagtaaacaattactgactcaaatgttaacttttaaatatttcgggttacagggaattgtatcaggagtcgagttaagcgtatggaaatagagaagaacgaatacaaacaatggaagttaaagagcaattaactcttgctcatggattatacatataatattgatgcaagtatgcaactaaatgctgcaggcttggagacaaatcttaaaagcagatcttgtaaattccaccattaagagatagttgtacaatattgatgcaactaaatgaggtcagcttggacacaactcctgaaggcagatcttgcagcttctgccaccattaattggatacaaatctataaaaaaatatgcttacactacggatatgaaaaaaacaattgtcaggtgacagcatgagagcatttggatgaatattattagataagtatgaattattagtaccaaaagaagatatgggcatcagctacagagccatgcaaacattgaaccagatttaaataacgagtgaccataatacgagtgaacttacccaaaactttaagagcatctccagaattttgttggcattcattcacatgaaactggaatgaaaagaatgagtgcaattgtaaaagcataaaattccagcagagtatgcaagcttatacagtaaagtgtgaaaagaggtaggatgaaataggggtgcaagtgggtttacccgcgaacccgcttataggcaaaaatagtgtgtaacccgccggtttgactagcaggttaactatgaatttgacttataaatgggtttataaattgatccacttgtatatttagatgcggcaagccgggccgcgacgcgaaaacccataaattattatttatttaaactcgcgggtcggcccgcttgcacccctaggatgaaaaaactgaagccctacttggaacacaggaattttggaggtaacagttcaagaaattgagaaaatttcctgtcttctaaacagggacaatggaagtcaggaagagggggggggagagagagagagagatgtatatatcatatattattgtgcatggttgctgcaaacattaaatgacagaagaaagcagcagaacttatctaaggtagagaaacttacacgataatactttgcatggctttgaccaccacctctaaaaattatgtcaagaatgtccctgattgtttccaatctacagacagtagccttcgccttcatcccaggtccagtttcagcagaatttcctaagtgtgcaggaaaaatacagacactcaactgctttgcatgaaccggcaaacaattatcaatagttatcagaaattcaatatgttcaactaaggtaacacttagagctagaaaaataatgaaagcttaaagtaactattcagatcgagaaaatggaatagtacatttcagtggaaagaagaaacctggaaaaattgattaccttcctcaagtaatagagaagcaccatcaattgtgtcaattagctttttggatgtttcagaagtaatattcagttcagagaggaactcatatatgtaattgccaggttttgtatggcccagctccttggaatcaatcaccacctcactaattttcttttcaagtgccattaaaagggctggggaaaaagttcgattattagtctattacagtacgaaatctcacagtccgaatcattaacataggtaaacactttctaactaagaatatggatacaggtatgatttgctgctgtaagaagaaatatggttcacctttgagaatagcataattttcagggtcaaattgtttatcagcagaattttcaaaggtcctctttgctgaacacaattggatgcattcctgagcttccgcaatgcaagaagagaggttattgggaagcaagtcaaaagatgcagcatctgcacatatactctcctgcataaaagggtaatggtaaattcaaaacaaacagaactataaccagacatatattgaatgaaacttatgtatataatattgagattggttcatttaactcaagtcttaagcataaagagagttttaacactaaagcaaacagatattcagatagttgtagattgaacaaaggactggagcatgtatttccataccaagttgtgtgcttcatcaaatataagtactgcattatcccatggtattccatttaaagaacgtcgatttcctggatcaataagatagttgtatggagcaaaaagaatatcaaccgacttggaaagttcccgggagatgtaatatggacacctaaaatggaaaataaaacaattgtagtcagcaaaatctgtaggcgttctgttgtgtgcatgtggtgtgcaagttagggcagnnnnnnnnnnnnnnnnnnnnnnnnagtagcataatgngcccaca

SEQ ID NO: 34249 - DNA, 36801 bp, Oryza sativa
  unsure (1)..(36801): unsure at all n locations
cgcgcgattggctttcactggctacttggtacagtacagagtatatcgtaaatgtatagagcttaatattatcacattccatactaagtagcattgttcttagacgaagggggtgtacaataatagtttctctaacacacaaaccgccaataactctaatgctgtgatatttttactgaaatttgtgtaatggttgctctttacatgagggatagctcattcactctctaatataatcctttctctcttccacatctgcaaatgagcctacacggcatataggggcaagtacttaaggggtttaggacaataacatagggggggtcttaagcctttaaggtggatcttatacattgtgagattaattcttacaggaggcatttggttaaggtggccatatgcataaagaccacccacaagtaactaaaaagtcactcttcactctcacatggtagtactaagggtgaaaacggaatcggtagcatctctttcaaaaagacgctcgatcggtcggtaattgactatatttatcatttaaacgacacttgtccaatacgatacagaaagaaattgagaaaaaaaaacaaaatttacatatagccaaaaacgaaatcagcaactataaaaaacaatgcccttcatacagaaacaacgcttggtcaatcgggaatttccatgaccattttcacccttaggtagtacttctctctgggtactcttgtgtttgtaaggtccaccttaatactgtctcttaccatatacaatgtaaacataacaatatacattgacagacattccacttatagtacttgctaaaggcatatgcttttttagcaaaatctctaacccaacaaccactagccatgagagagggatgaaagaaattatttatttatttcttatggctaagtaattaagtatattacattgtatttgttacttattagtcttataatgtatataaactgatagtagtattgtttattccttctcaattttaaagatacactggtgattctcttaatgatacgcagagagatgaatgtgaaaaaaaacgcagtgcctaactaatctcactttttgaacctgatatttaaaatctcacttgccatgcatggataaacattgcacttgttcaaggcataacattgcagtgatcacaacaaaaacagcagattgacggaagagctcgattatattacaattacagatgctcgtccattgttccaccacccaaataaaacgacattcagagatagataatcaccagaaaaactgctgcttgtcgtctctcaagtaagtcgatcgaggcaggcattaatgatggaaaatcgtcaataataaacagaaaaaaaatgaaagaaggggaatactaaatcatagcaagccttactgccgcataatagggggccggcgcattgaaaaaggaaaaaagaaactgaaaaaacaaagtgcatacatcatacacggcgaagacgaagccgtcatccagattatactctcagagatgcagatcgtcgggtggttctgtagcgagggaagcaccggagaaggctctgttgatgatgatgattatgatgctggtgatggtgatggtgcagcggatgcggaggcggtatatatgactgcaagaaggatggatcctcttcaagagcttctatgtagctctcaagtatggcgacgatgtcgtcgaactgaggccttctgtctgggttggtcgcccagcactgagttatcagatggcttattgccacagggcatgaaggaggcagtggtggcctagcattctgcacaaaagctattagttgcaaaagtccaatagatgaaggtcatcagtaacagataggacaagctaaccgactcttattttccaaacttatgggatcatatagatatttgctgcgcaacacaatgtgtggaaaaacaccatattttcagcctattcaaatttcatcgctagttgagcagtaattacctaaatggatcgagcatgtttaatatgttttttttttcaagctagaaaccatgtcaacagaattacaaacaatttttggggtgatacagaggatttaagcaaaaaaaaagttcaggcttaattaaatcctctaattacccgcaattttgataccaataaagttcaggctaattaaatgtccgccatagtttccataagggaaaaaaaacattttttactctcttacagaaagaaaccaaaattttctactggtactgcgactgaaaaggcagcagcatctcatgattttaacagcctacattatagccaaggaaacaaagatggacatgaagattggagaggtggcatgtcaaaaattcataccttcaaggcaacagcaacagcagcttgctcgggtgtcatctcactgaatggtaccaaagcagtcaaaatctcccacaagacaattccaaagctgtatacatcaaccttcctcgtatggtgtttctctttgatcatttctggagccatccacctatacgttccagtaaaacccttaccacttccgcactgcgattctaagcacgaaattccaaaatctgccacctttactgacatatctccatcgagaagtatattctctgacttcaagtctctgtgaagtatgccttgcgagtgtaagtagctcattccacgagcaatctctaaggataacttcaacactaattcaattggaacagaatgaggttcttgctgatgtagatatttcctaagggagccacctgccatgtactcagtaatgatacagaagactggtggtttcttgcatgctgcaacaaactgaaaaacaagagtttagatatatttcttatcagtttgagactcaacaaaatgagcaaacgagattaattggttacaagagttccttcacaagttaaaagtagtgggcatctttcatttcaaatccagcatgctttatatgtagagaaattctttatttgcctctgtaagttggccacttcccttaattacctctctgaaactgctcatccattcaatgacccttgttcttaacttttaccctctatttgcccctcccatcactctgcgcactgtgcaaatttcgaaggggcaaatagaggataacaggttagaaaaggggtgacgaagggatgaacagtttatctatcaaactatcagaaccaagacctattttagcaatatatttaacatggacagctaaaatattataacggcaaataatgcaacagaggaaaacgatttgagatcaaatgcggcctaacactcatataaaccaatttcacaaataattaaggttcttgcagaaatttgccagtattactgaagaacatttggagtgcaacttgcatagatgtcacatgatttttgtgcttactcaacttcggttggtttgacaaagtgatactttccatgtgatctgtgggaccagtaatccaggtaggcacttgataaagtgaaaagtaacatagatttttatctgtaggcaaagtcacgaactatcactctctgagtcaattctccgtattaaattcttacgagagacacttttcttggcatatgaaagcagttaagtttggatgtcatatatggtccaccacgcactttaattaggaaaatagcatcttttaacttctcatacaagtatctaacattatcacctataatgctgtatatggcatgaactcatcaagcataggataaaaacctgaatacaaccattggctggtggctctctttacccaacttcttcataatgaagccaattcacataagttataaaagtggtgcggacagtgattggactaatcaattaacctaaagactggctagcttttgcagcactcgtgtaaaaatatcctgatataccgccaatcaaagaaacagaggggttaaactttcctataaaccacctccagtggatggctaaaaatagttaggcggcttagagaagtttattagatgtgcttctccattaaatacgaagctctgttgagttttctccaaagaaaggaagctctattaagtaatatatatgatggaaagtgcacaaaaaaacattcaggatctcacaaaaaatcactaacaatcattaccagctctctgctcgatggatcgaaagggtgagatatgaacgtagagaaagagtagggaggagaacagtattgctgtaacatttgtacgtgactcagatttcgctatcttaactatcaatatcatactactggaagagaagtttttttttttctgccatgttcactccctcctcattgggttagtataaacaagcatgaatcatgtcgcacccagacttatcttctcgaccccatccttccgcccaatcaaaacaaggcataaagtaagaacctttaatgtgaagatcggttagcataacaaatcctacagcctagtgcacgcatggggcacaccaataaagcgtaaaggaactaagatgtgaaactaacaggctgttcaagtgagataatctagtattcaatatctggtacagacaaaaccaaccaaaccaaaacgcaacaacttgtgttagtagtaaacatctacgagcgcactagaaattaaattggacttgatggatggaagtgcacaaaaatgatggagaagtccccacaagatgcacaggacagaatccattataattgaaataataatagtaacaagttattaataaaggtactagaaaagaagaagaaatagaaattgaaattgaatcgaagaagaaggaagaaaggtaccgagatgatgttggggtggcggaggcggaggaggagggcgacctcggaggcgaactggcgctcgagctcggcggcgagggcggcgtcttcctcaggctggctaaccatcttgatggcaacgtcgcgggcggcgtagcggccggagtagacgcggctgtgcctgccggtggcgaacttggtccggatctccagcttggacaggtcggcgctccacagctcctcgccgccaccccggatcttggctcccggcggagccaccaggtacttggaccacgacaccgccttcttgtactcccccagcgacagccgcctctccagcctcttcccctgcccaccgccattgccgccgccctgctgctgctgctgcttgaagcatttcatctcctcttcctttctttctttctttcttttccgcgataagcttggatcttcttggaatcaatgcacgaaacgctcgcggaagtggaagcgaatcggcgcctggaatctcgctctcgctcgcggggattcaaagctttatgggaggaaggataaaaggcggattcaaagcgaaaaaatcgggattttcggtagaggataacaaaaaaaaagagcaggacacggatatcggaggggatttgcggaaagacaacattatttgtgggtgtggctgggaagatgagacgggcgattcaatcgcatcctaatcgaatcgatccaaacaaggcaagcaagaaaaagagagagagagagagagagatgattcttttgatgagagtgtaaaaagcgaacaagaagaagaagaagacgacgacgatgaagtggcaagtgcagccagcagaggtcgtcaggttattagtgaagagaagagagtgatgagctttttcggtggttcaggggtgccgagattagaacagatttgtttgttttggcggaaacagctgttgattgcaagtgtcgagtgacaccacgacagatgacctcacctcaatagaagacactctttcttttcttttctttttagttagctcaagagaagacgcgtttatatgtttccttcctcccttttaagtacagtacagtaatcacaggacagcgagctgccaagccaaagagatctgctttttctgtaggaaaggaagaaatcacaggacatccatccatgggagaccatgcattcgggataagctctgaagaaatgcccaacatttcgtattgcaaaacttgatactccctccgtttcgttttatttgacaccgttgactttttagcacatgtttgaccgcttgtcttattcaaaaaatttaaataattattaatttttttcctatcatttgattcatcgttaaatatacttttatgcatatgtataattttacatatttcacaaaagtttttaaataagacgaatggtcaaacatgtgataaaaagtcaacggcgtcaaataaaacgaaacggagggagtatatcatgtcccagcctcccagggagcagtacacgactacacgtctacacgatccatccatcaacggatcaaccgactagacatgaacaaatcaccgcacgtgggtgagaacggtcgattcctcctcattcgagcacacgaaatagtaaagtaaggtgctctataaaacatgtatatctcaacaatatactagattaatagtaaaccatctcaatagtatgtctatataggtatctatagctctctcatacattgtctcgtttttctctatagactatctctaagttagtagatagctttgctctctcttcatttaatatcttccaagtaggaaaatatgctgacatgagtctcttgtagagagcctatagataaccattgcgggtgcccttagttaaatctaactctgagtatagatcccaaggtcgcataattagttttgtgttgtattctgttcattgaaaaaaatgccgttgtatattctgttgcacttctctctcgtaaatacgcaagcgtattccaaataataaaaacgacacctgacaccgtatatatgaatcatcttagatacaagttgtgcagccaaataataagccaccgaaagcgttttatgtgatcaaccagatgcccgcacggtcgcctgatatgtaacggcacagcacaagtaaaaaaaataaaatacttcctgcatcttggtctaatggttaaaatacgtccaggattgtagcttactgtagcaatttttttaaagcgctttgcaccactacttgtagctgacgatctggtccgttcatcaacaaagtagatggctcctatagcttaacatgcagttcctatagaaactgtgcctgatcccagttcacttatagcagcaggttaacctccttacaagtggagtacaccatctatcctacaaaaaccaacgcctagctttcaatctggacataagctatatttaaattcaaagcagaaattgatgtatttttacagagaaagtactctattcgttctaaaatatattaacctaaattaaaaaaaactagcatgatggcccgcgcagattgcgcggctagcatcattatattttctctcatataatagcatatatgttttctcattatattattcaaatatattaaaataacaacataattttaaattttgcaataactttacaaaactactaatgtgtaatattcatattgcattttatatacgtgttagttattaattatttttaagataaaattttagttatttgtaaattatatatattcctatatggactctagactcgtcttttaatatttcttttttctgtaaattgtatttctatatagactatatgttcttcttctaatattatttatttttatttctgaaattttattatttctaattatatttctatgtggactctaaactcatctttcaatattatttaatttttaatttcgaattttagttacttctaaattgtattcctatattagcattaaactcttcttcccattttttcttaatttcgaattttaactatttgtaaattgtatttttatacggactctaaactctacttttaattttattatgtttattccaaattttagttagttttaagtttctatatagactctatactctacttctaatattccttatttttaattccgaatttcagttatttcctaattgtatttctacatggactctatactctacttctaatattccttatttttaattccaaatttcagttatttcctaattgtatttctatatggactccggtctcctcttctaatattccttattttttaattccgaatttcagctatttcctaattgtatttctatatggactccggtctcctcttctaatattccttattttttaattccgaatttaagctatttctaaattgtatttctatatggactctgctttttctttttctccgattaatgtgagaatttctaggccatgagagcgaacgtggaggctcatttttctattcctttaattatataataatagatagatatgatattttctaatctaaatggattagaaaatatcatatttttacaagtagacagcgtggtcaggccggtgtgcttgtacaagcagagtttgaaatagagcaggaattgtacgcgaggggcggcagtggtacaacgacctgggaatactggagcaagagtagaaagaattgccagtcatttgggttatggtacttacctacctagctatactatacaggatcaattaaaaatctagatttgttagttagttagagatcagcgcatatatatatgatggatcatatattgttgtcgatcgatcgagtatgtaccgtaggccactcatcaaggcattgcatatttgcatgcatgatgatgatgagttatttaattagcaagtggccattagattagagagagcaagtggatcggatatactccagtattattgtacaatatgggaggaggaccactgcatatatgtactcctacagtatttatgcaacttggttgtgggggatggttgaaggacggccgtatcacccatccgtatacggaagcaactcaactacttgtcttgtccgccacgcccactatcagccttgcattgcatatgctctacttaattaaaaccagcatcgaccaaagttattcattcagactaaactcttccttaaaatacacttaatttgcactggtttttagataatggaaaaataatactagctaccatgctgcttaattaatatactttctcaattctctccgttatcgcacagttgcaaattaaacacactcccgcttccattttgcttaccgttctactaattctcacgctgaactaggaggtacgataaattgcattgctattgattacattataatcatctttcaagaggtatagttatttatttttttagaagcttctaattaatataagtatgagtatggctgtattgatgaagggtaggggaaaaaatagcaccaaaattattttgaaatgtaagaacaacaagtactatcttaataaaaaaattaaatgctagaacaataattaattgaaatgtaagtgaacataatgcatgtatgaatcgatcgatcgatatcgctatccgatccctaccagctgcacaacgatggatcgatctccatcatcatgtgcccttcaatcctccaaccaatcacatgccaaagatgcttacatacatacagctaacgcattattgtcttctttcctagctgctttgccaaagtgttttcggcagctagctagctacctgcttttaactctgtcacacttggatagagatggtaattaactgtccattcacccttctaattattcgcctaaaatgtgtttagttccgttggatcggctcactttccatccctgtttttgtcccctatatatagagacagccaaacatatatatatgcaattgattacatcatatatgcttggccatgagtagagaagagagctgatcctcgagttatagctcaccaccaccaccacgtactgctacaaatatgaacatatacgctaggctagctagtatttgttgcatcctttttcttcttacaagttgccaaggtgtgtaaaaacatctggttgtcatgcgagcttggtctttggagagcagatatatattgtattccctccgtttcgttttatttgacgccgttgactttttatcacatgtttgaccattcgtcttattcaaaaacttttgtgaaatatgtaaaattatacgtatgcataaaagtatatttaacgatgaatcaaatgataggaaaagaattaataattatttaaattttttaaataagacaagcggtcaaacatgtgctaaaaagtcaatggtgtcaaataaaacgaaacggagggagtacaatatacctatctcttgtaaggaaacatatagggatataaattataattgttcactactactacagaacatctaaaaattcccggttgtaaacctggataggtgccggttttatagtcggcaacaattatatattcgtcaccaatgacttgatagaattgatatttttgggctccccacaatttaaagaaaatacatagacgccggctagaactccatattgattcaacaacaacaatccccatccacactgatcaagaaattcaattattattccccatccatcatatatcaacaccaggaagatgaaggactacacgagatcaagaacccactacccccctccctccagtcctagcggagccactaatgtcatcgtcgccaatctgcaccaccgtgttccgctagcggtttatggcaaggaggagcggcgtgggagacaatgactaccgacggcgtcgtcgtcgtaggctagccctctccgcgtcgaggtcgacgccgccagatcagtggcacgcgagctccaggcagcttggtctagtggttcacaagctgtgaggatgggcgacaacagcgaggaggcacgtatgcagtgaggaggagaaagagggaggagaggacaatgcagcggcgacgaggttgtgaagttgaggggcggcgggataagtgtgtgtgtgtgagagagagagagaggggggatggataaggaggggctggttgactcggtggggttaaaaggaatcaccatcccatgatctattggctcgggctagctttttataaaaccgacacctataatataagtataggtgccgattcttttgaaaaaaatccgcactagtattattggtgctggtctttatattagaaccggtgtctatagttgctcaaaggtgtcagttttttttttatcccatagaaacgaaaaaggttaatagatatcgattttaaatgaaccgacaaccatgagtcggtacctacggaggattttatagtaatggtccgtacttttatttcagattaacggctaataatatacagttccccaatgctaacagcataactgtgccctcataacctcatttatgtttgagtaattttacagctcttgaaaaattactaaaagtcatcatgtaaaatttagtagcacctgttaataccaaataccaagacatgtacataagctctagatcttacgcttaaagtttttctcttaattaaagaccgtgaaatttctctttacctcagcgtggacccaaagtagtgagcatgtgagtactatcttcacgtgcatacctgctggtttcaatttcttttttttaaaaaaaacttattttacaattaagcctttctaaaacttaataaaaaaaatagatacatagctcggtgccaagggtatttggagctgaagttgaatggtctcagcgtcaaataaagtggtgtcgaaacctaatcctcagcacctacctccgtgtgccacctatatgaacaacttccctctctcccctattacacctttttgaatcatattgatttgctatcaataggatataaaaaatgcttattgcatgcttcctaagcccgaagtaattaattcaacatctttatcttcaaggaaaaaaaaaaaggttacgataatactcgatttcttaattaacttgcaatgatttttttttcttttttttaggaattgacaatgagttggatccttattgggttcggcggtggtggacggcagggagagacggcaagaaagctacccaaagtgtggtgtgtgcatgcatttaattgagatatatgtgtacaacatatataatcgaatgaaatcttcgtttatcttgatttgtagagacaaaaatcttgcatcgatagtggaggcttgagagccttatcaaccccatgctggatccgtcctcacgctagcctgactgatgtgtcaaaacattcagatattaaaaattaagtcttagagggggttcgtttttaaaataaaaaaatataaaaagttttaaaaaaacggataaaacgggggagcctcaatacaggataattcgtatgtatgggtggatttttttccccctcaatacaggataatccctcaattggaagcattcctgttaatattgtttgtttggaccagagtaaactgcgaatttgtttaatcagaatgtacgtatacgtacgaattacagcattcatctagaacgtacgtacctcggtatacgtagcagctagtagtaggcatacatcgattgcaaattcaattcgctcgtgactacttcacgggcgaccctgcctaacaacaacgtaccatgctcatctgatctgatcgatcaatccccataattaatgtgactagtactccctctatcgtaataattttatttttagctcattttatttatctcaaagtaatttttttaaagcaattattccatcgaagtttgtaaaagtataaaataactgtatcaggaatagataaaatagaaaataattgtttgcattgatatatgtgagatagatgagaaatgaacttattttaagatgaaagatgtactactttctactaataactatttttttaagatgaatttgaataaacaactatcattaatctttagaattaattactttacgggaagtgcttctatgcttctttaaaaaaaacatgcacgaaaattaaagcacatcaacggtgaggattaaaagttgattaacagagtaatcccctttaacgaggggtaattttgtcctaagaaaaagctgaccatatctagcccaccctgtccgcatatcagaatcgactggttcctccttgacttgcacctttgacggaggcgccatcttcgccgccgccgccggcaccgccatcccaccgggtcgaacgaacccatcttgcccgacgccggcacgcttgccggcggcattcgacgacagccttgtggcgtccatgctcgcgcatgccggcgcctccgcgggctcctctccttgacctgcagcaccgtaaacggaggcaccatcttcgccgccgccgctgccatcacttcgtcctctccctgttcctggacgtcctcgccatggctcccggcggcggcgggggccgcggggcgggaagcctggagggcctgcagctagctgaagcgggcgtggatggaggactggagggaggagaggtgggagtcgaggtcggaccagcggaaggggaggaggatgggcgagtggaggacgaggctgtcgcaggcctcgcggaggcgttgcttcttgccatgcagcgtcgcgatggcggcctccacctgcgccggccgtcgtcatcgccatcagagatggttcagggcacagggccgttgccgtggcggcggcggcgagctgttgcataatctccatcgccatcgattcttcgtgcggccggtaagaagccgacgcagtttatatataggcacgcggccgcgaacagtccgagacggataggatcagcgcatacaaccaattctatgtaaattcaaaagattgtgatcagccttgtgttaagttcagttcaattctgaatgcatatcagaggtatcaccatatactgaggaataaaatggacatggaagctttggtaatctctgccgagaatcacgaagaagcagaataaggtgttgataatggtgagtgagggtgttgtgctcaatgaatcagccaaccagccatgtttcctgaaccacgagaatattgacgaacctgaaagcacgacgacgagcaccacctacacaacacgtcaacacacagctccccgaaggagagagctcgccggtgaaggaagcagcgacggcgtggttagtagcggaaggggaaaacactcttacagttacagggggtagaggatgagggtgcgggcgtgcggcgctgttcaccggaatgcgtcgtgagaactgccgcgcgctggccgcgaatcaatccatgagaagggatgtggatacggatatgggcttttacttctggacgaaattgccccttgctaatggtgattactcggttaatcaacttttaatcctcaccattgacgtgctttaactttcgtgcagttttttttttaagaagcatagaagcacttcccttactttacttgtttttacagatggagtaactcgtagaagcagccagcagttgtcgtggtcgtgagtgtcgtgctgcctgcagtgctgcactgcatctggatctccatgttgccatccatgtcctcctctcatcctgctgctgctttgctgttttttcctgctccatgtatctgtctctgtccctttcttcgtcttgccatccatttcatgccctcggtttcgatctcatcctaagtaaatggtggcccattgttagagacccacttgtttaagctccaatacaaatcacgagtatataggtgggctggaaggaacaacaactaacaggagcaagatttagaagattctgaatgaatcagtgagtaagaggatacattggttggtaggaagaagaagagagggaaggagagatcgacaaggaggcaagcccgcctccaggtcgccgtgccgccctttggacaatgatctggtctcttgggcttgcttggacttcttggaaagtagctgattcagcccatattgcagcccacatggctcctaacacccatgccttgcatgatcaagagtaagagtaatggtagtagtacattatctaaaaaaaaaaagagtaatggtagtagtagcaaattaactgtacctatctctgtctgagcagatctatcgagctgccttgcctggaattttttttagaaataatattattttaatggaaaattgcaaaagtagtagctgattagctaaaattgcaagtttgataccctgtcgaacaaccacagttcgacaggtacctgtcgaactacagttgttcgacagggttgtggttcacttaaaaaaacagaaaaggacaagaaagagcatggcagggggcctatcgaacatccaaagttcgataggtctgcatgcacagtggtgtacagtgctcatagtgattgatcttctttttttctatcattttttatcccctgtcgaacaggggcagttcgatagggtattttttataccctgtcgaacaatcgcaattcgacaggtaccctatcgaattgtggttgttcgatatgtacccctgtcgaactatggatgttcgacagggcattaaacttgtaattttaaccgatcagcttctacttttgcaattttccattaaaataatattatttttaaaaaaaattcccttgcctgcaaccatacatgagaccatgaccatcgtccatccctccatcatctgaacgccaaactgaactgaacaagagattttcttctccttttttttttttttgtgaaacgatacttagtagtaagagaactgaatttaacaaggagaaatggcaaatgcagaaacgatctttgatcagggatgcttccaatcgacgagatgagaatataggccagagtacatgccatgccatgttgctgtcatatcgatcatatcagaattttattagttttgctcttctgaatctattccattccactacacaccacatatacacatctgccctccatcgacatgaacggtctgccactacctatagccaaatatatatatgcggagaaccggctggcctgcctttgcatcgtgatcgagatcgagattgagatcgaacagtgatgcttctttttttctttttggacatgatgaggccatcagaacaatatcccaatgagaagaaaagcacaagattaaacggtatgttcacagcatatccggtgcttcttcttcagctgctgcctccaaaccaaaaaaagatccatccaatgatttgtcacacgctctcacagctaggctcatgttcatctgtggttttcttttcttcttttcggacgacacatcggtttcggatgggacttgcatctgaatcctccaatctttacatcagcatcaccttgctttttcaaacaattccttttgatctacataaagagattgatgtatacatatggtgctttcctctggaaaatatacggaaacatatgattgctgtattgcatttcatcgcaatgtatcttgaggaaatctgaatcctgagcaataagctagcagattttcagttgctaccctgatatgttttctctgagatctcgatcactagttattagtgaggacaagagctttgttcagagaaagaacttgcagtttcagatagcgggtggctgtcacaacttttcaaacagtaacaaaaagaagaaaggggtgaaatggaaatgaactttgcagttaggtagccatagctttaatattgccagtatttggcagtggagagttgagacacagcaggcacttctcctttggaacatctacccgttcttctgttgcatttgcacctgatccaaattaggggtgaaaaaagcttatggctaagattggctcaaactcgtaatcataatgaaccgtgtcgcgaccattttttagtaagttaatttaacgagccagctcatgatcgagctactcattagtacaaaagtcactatatattttcatatttagtgcttcttaagttgtgagtacttacactacacaatgacccacgttcaccgtccgtccattgtgtagacaaaagtcatgtttggcaactaagaaagtatcggcaaagcctgtgccaacagaattttcagcagtcggtgttgcagcccttttatatgtttgcctacacataatttgttccaaaatttagtcttttttccaactgacttttgttagcaaaagtggaccatggtgtagtgttagtcctttaatttactagcaaactaactatttgtatttagtgaatattttactagttattgcttatattatactaacatatgataaattggtaaatattgaaattttaaagttgatataaataagattgaacttactaacgagcttaacaagccaactcgtaagctaagccgagccacgcttttagctcgttagggttaattaataagccgagctggctagtcatgatactactaataacgagccgagccaggtcattatcccctcatctaaattaacaacacccaccaatgcatatgcttctcacaatgaaaagctagcacattgagcatggaaagatagcgtaagcttgaactgaatctcttcgatctcctacctttcaccgcgcgctaaattaacctgtgtacttcatttcactgtgctcaatcaacttcgacaattgtcaagagctagccgggcaagcttcaaattaatcttaattttttttagacaatgtaagagctctaaacttcatgaactgaatgagattgagtaaggcacgatcaatgtcctcgatcaagtcacataaacaacagaagatgcttacagtacagacaccacggcacggctagcttgatcgtcaccgaagaaaagatccacccaatgatttgtcacagcataagaatccttcaatctttccatcagcatcgtcgtaatagttagctttttcaaaccattccttttgactagggtatctacccgtattctctcttttttctacataaatgattaatgatgtatgcatatgtaagcactgcacgtgatttttcctgaaacaatcaagggatagaaaagaaaaacatgtgatacaaatctcctcattccattgcatttcatggcattctatcttcagataaatctgaacactgagcaacaaggtgactttcagttacttgattcttactctcttgcagattatatatgtcatactgagattactcgtcaatggattgctgctttgattttgtttatggacaagggattttgaagagaggaaaaattcagttgtaagtgaggactgaggatcaatatgccatcagtgagagcctctcactcgttgagagaaagcaattgcagtttcagcaaaagagctagtactgcttttgcacaatgcaaatgaactatatatggggtacaaagcatcctatttatctttgcaaggcgaatggctgtcacaacgttgcagacagacagcatataaagaaaagggggtcgaaatggaaatggagtttgcagttagctatctagagctttattaatattggcagtatatccttgagaagtggaatgttctgcagggttggttagcattttgcaggcaaattatgatattcatcagagatatttttcatatttttgcatgctaacagaaagaaaggaaatgtagcatagtgatggatgcattcagaacattctttaacagtgttggttctaaagctgttttgtgcatgagcatgtcctgaataatatcctcaaaaccagaagatgatgatgtgtaaagcatgcagcagaatattggtgaagctttctactccatcggttcgaaaatataaaccattttgaagaaatgtgacacattatatactatgaatctggatacggagcctgtccagattcgtagtagaggatatgtcaaaaacggagggagtatctagcagggacatcacattcgatcgacaacactgtcaagaatcaaattctgtccgttggatttgcgtataaataggcatcggaaacaagtgcagatagcaatcaccaatcagcacaacaactaactacaccagtggccactcacctgcactcctgcagtagtcttcagatcgagaatggataattcttcagattctcagaggtattagccaatgttctaactacattctgattatatatatatatatatatatgaagaaaagaaagaaagaaagaaagaaagaaattgattaagttaaataaaaaatatgaataggaggaagaggtgcgcggcgtgctatagggagttcaacaagaaggagcacctggtggagcacatgcggacgtcgctgcattcggcgcacgaccctcgctgcggcgtctgcggcaagcactgccgctccctcgacgccctccgcgaccacctcaccggcgccctccccaagccggagtgcgccgccgccttcgcctcccgcggctgccccctctgcctccacgtagtcctcccgcccaccgccgccgcccactcctgccccgcggccgcgccaccgctcggcggcgtcctcgccctggggtgcaagatggtgggcgccggcagcgacgggtccctggacgtgtgcgcccgcgtgtgcgtggtggacgagcaggagcgcgtggtgttggacaccttcgtcaagccgcacatccccgtcacgcactaccgctacgacaccaccggcatccgccccgagcacctgcgcgacgccatgacgcccaagcaggcggcgcgccgggtgcaggagctgctgctcaacggcgagccggcgtggaaggcgcggagcagccgcgggagggcccggatcctggtcggccacggcctggaccacgacctcgagtcgctgggcatggactacccggagtacctgaagcgggacacggcgaggtacccggcgctgatgaagacgagcaacagccgcctcagcaactcgctcaagtacctcaccctcgcctacctcggctaccacatccagatcgccggccgccaccaccacccctacgacgactgcgtcgccgcgctgcgcctctaccgccggatgcgtggcgcgcggccgcacacctgcagggacgccggcgtggggccgcacgcgccgccgccaacgccggcggaggcgttcccggcgtggaggcagcgggagctggagcgcatgtcgccggaggagctcctccagctgtccacctcggactactactgctggtgcctcgacgccaccgactaataacgaattattactcccacgtactacctaaactacttactcagtataattatgactaattatgctgctgcgtgtccgtctttattagtactccactccgtatgtacgaatcaggatgtaagaccatcgatctgatagagacagtaccgtcacagtacgtgtgacaaccacaggttgcaaaattttttaaaaaaggttttaaaaaagcgcttatataggagtattgcgtaaaatataccattgctatattctcaaattactttcagcgtcaaatatactcatatactccactggaggaaggaaataatatcagtgttaaaaaaaaagaaatactttttacatccttctctgatggtaggcaaaaattaaagtttctctgggaaagcaccgacaatgtgatggtaaaatcgttggtgtatgattttactcgtttaaattcaaatgaccacgaatattacatacaccatatgagtgagttttcaatagaaatttaatgtgttcagagatgtgatggtttccatctctttgagcatgccttagagggtgcattcacagttgcatgtatggatgcagtgtttatgtgtagttgtttgtgtgcgtctatatctattatataaatgtaaaaaagtaagcattttgtgtctttgacaaactcttaaactgtgttgtaaagtgaggattgggaaccttacatcctaggagggaaaacagagtgacaagttagtacatgattaattacgtattagtgaaaaaaggtaaaagatgcttaatatgatttttcaagcaatttttctatatatatattttttaaaaaaatacatactatttagtaatttaaaaagcatgtgggttgaaaacgagagataagtttgaaacatgtacaaacaaactcaagtctaatagaggatttaactaaaaacgatgaaattcttataaattcttgcgtttcaaaagaagctattgtatgagatgtgtgaaacttatagtactcctccagctttggttactcgttttggtgacaagatcagcactagcagtgaattttgggccactttgattgatgccaaatttttagtagtttgaatagtaaatatgatgttttggtttagaatggatggtaatgcccatgtttaatttggtatatttctagaactttcctcaccataatataaaatttggctcccaattaatatcaatccaaatacattacttacattgtgtttagatcccaaatttttcttcaaactttcaattttttccatcacatcaaacttttatactcacataaacttccaacttttccatcatattgttccaatttcaaccgaactttcaattttgccgtaaactaaacacacccttagtttgtgtttgagaggaaaggaaaagagaagattgagaagatatgcaaaacgagttaagccattagtgcatgattaattaaatattaactattttaaattttaaaaatggattaatatgatttttaaagcaactttcctatatatattttttgcaaaaaaaaacacaccgtttaatagttcaggaagtgtgcacgtagaaaacgagacaaatctcctcccaatctctagctgccgaatgcgtagaattctatcctactaaaatattgttagtgctaaacatgcctagattttgtcagtatactaccaatgtttgatatgtactaaaccaaacgagccctcctgtacttggaaaaaagtttgatgcaaatgggaaattggcgtgtggggccggagggcaaaggcgtaaattcgactccccaccgctgtgtcctcgatcttctctgtctgtactggtccgggctccggcgcggcggccggccgtcgccctccgaaatgccttcgcctctcccgtgcaacctcctcactcgccgccgcgcgctcaccgcctgcgctgccgtcgccgcactcacggccgcggcggcgctctttttgctggccacccctcccaccgaggaccccacccacccgtatctcctcgcctccctcctccacaacaacacaagcaaccagcccgactccgcggccgcctcccaaccgccgcttccttccacttccatcctccagctccaggtctcctctccttttctgtcctaaagatttctgctttccaaggctctccttcttcatgaatcatcatttctttctttgtaaatagtaaatgtgcgtgattttgcgaatacattgggttattgtaacatgtcaagattattggatatcagagtgcatcaaatggcggaatttgctttgttttgcagactaatttgccatctgggtttacaacagtcccctccatgtttttggtcccttcaccttctccagcagaaaacttagatgatggttctatggaggaaactgaccctccagatttaaaggtactcacctcacctgccccaccaatccctctttttcatacatacaattccattctatatttctcttaggtacagtagcatattacaaatgttttcatcttgtcctacatcactatatcatgcaagatcgatggatatccatatatctaatctaatagcatctaatcaaagttttacttaacttcaggaaaatccaccggcggaatcagctccttttctccaagaggtacatatctgcgccgaatacatagacttgtaactaatataatttctggtttttaacctccttacttgtgaagcccatttccagtggttctcctataaggaggtctgatatctataataagggacatgacatgaaggaccatgcaatgcttcctccaagaccagaggttgatgctttacgcacctttacaatgtgatgtgagctctttgtatttggagtaaaaaaatgttaaatatctttttcttggcctgtaaacttagcaggtgcctatacctctttggtcaacagcagctgatgaagagctaatctatgcaaagaaagagatcactattgcaccgctggtgtccaatgaccctgatctgcatgcaccactgttccgcaatgtgtctgtctttaggaggtatgactatggtttaacttcatatatattatttagctaacaatttgtgagtagcattattcttatcaggggattatggacttgcatgcccaactatatgttgaacaaactttttagggagggaaacaacttttttgttgcttttttttttatcatgaagataagcaatgttttagtgttgcatacatccgctttctgacaaattcccatggttggcatgttacttttcccacacctagttattcgtagtagtttcagtacatgtggcgctcactagtttgccttaaataagtgtaattttttcctctcacattctattttggtagcgtgtgattgaaaatgttaatagaggaaactgtaatgatagcttaaatttccttcatgtttataaattatcatgccattgcttgtttgttccattgttcaatggcttctgcatttcagaagatgactatttaaatttttttttctcatgcttccaggagctatgaactgatggaaagacttcttaaagtttttgtataccatgatggagcaaaacctattttccattcaccagagttgaaaggcatttatgcatctgaggggtggtttatgaaactgatggaagggaaccaacattttgttgtgagagatccaaacagagctcacctattctatctaccgtatagctctcgtcagctagagcacaatctttatgtgcctgggtcaaatacaattgagccattgtctatctttgtaaagaaatacatagattttatctccaccaagttcccctattggaataggacaaaaggagctgatcatttttttgtcgcttgtcatgactgggtatgtattcttcctttgagtacttctcgttgttgaatggtcatattgaacaagaatattagtgcatacaaatttgaatggaggctgaaacttaatcaagaaagaagctaacatgctgtttctgattctggcccttccttgcagggaccatacactaccaaattgcatgatgaattgagaaaaaacaccattaaagctctatgtaatgcagatctctcagaaggagttttcattcatggaagagatgtgtcccttcctgaaacatttcttagatcaccaagaagacccttaagaggcattggtggaaaacctgctgcagagagatctatcctagccttctttgcaggacagatgcatggacgagttcgacctgtcctcctccagtattggggaggaaaggatgcagacatgagaatatatgaccgtttgccacacagaatcactaggaggatgaattatattcagcatatgaaatcaagtaaatactgtatttgtcccatgggatacgaggtaaacagcccaagaatagttgaggcaatctattatgagtgtgttccggtgataattgcggacaattttgtgcttccatttgatgatgcacttaattggagtgcgttctctgtggtcataccggaaaaggatgtacccaaactgaagcagatcttattggcaattcctgatgatcaatacatggctatgcagtcgaatgttcaacgggtgcagaagcactttatttggcatccaaatcccatcaagtatgacatcttccacatgatattacattcaatttggtatagcagggtaaatcagatccaaatagagtagcacttgcatctgatcagcagcaaggagctattgtggtctgatttgaattctagtatgatcctgcagcttcttcatccgagaaggcgctgaattgtgttcctgacattattggtctaacagaagaaccctgacatagtggagcttagttgtgctttaggagctgtcattttcacatttgttgattttctaatctaacgggttgtaacagttaaacggagtgttttgggaccacagctgaagataaggtgtcccgtgaatttttatctttctttgtattttgttaaacaatttttcgttgtgttttggagtagtattgattgcaaatactaaaattcatcttttttgtcgcgtgtgcctgagatgttgagaactggaaacactgtaccgatgaatcggtgatactgataaaaagagaagacgaaagagatgaataccgtgacaactattgctttgttccgtgatctgtgtcgctgtttggttcacgtaactgaattgctgtttgcctttgcgtctcatagattcgaccatgtgtcagctgttgaaagtgtccttgcttcaacaatccgttgtagtctagctggttaggatactcggctctcacccgagagacccgggttcgagtcccggcaacggaattttttccacacctctttttgccactgctcctatcaaaatttaggacaaactgatcctgtcaaaaattgggttgggtaaagatgcgccagtttggaatcaggaaccaaagtaaccattaattaagccatgcatgctgtattgaaagataaggctttatttatctgtagcatccagacaatacaaaactttcccatccttcattattaaggcaaaaccgaatgcaaaactgtcacacaaattatatctataccgcgtcatctaagagcctagcatgatctcatatgaagctccagttttccattggacaagaatagcagtattcagttagaccagaatagtcagctctcttataccctgaaaaagctcaaacaggtcagctcctgtcaagtaggagctgactaataaaggagctgaggcatctcaggatttcaggaagatgacgggacatctatacgtttctcttgaaactgtgtcagcttctctctgtactcatgcaatttgcatgtgagaacagctcgattcagcataatctcatcactctggaagtttaagccggtcaaagagtaccaagaaactctgctcaggcacgctgtacaggaaaccaagctccgcacctccaaggtgtgggatcgtgctctgcaaatgaatttaacaccaattatcaaggatgatcttgtaaaaagtacttcaacgaaatcattgttctgggcaggattgggtaggtgagtaaaataatgtaaattgcattgataagttctagagattttgttatgcaaataccttctgcccagtttataatttgcaaatgaaaatgacctataatgttggacttctcaggtaccgtatacaaacctcggtacctggaccactaacttttttcaactgtggaagtcactcatagaagtgtcaccctaagcttcgatctggtgacaagaaccattttctccactaatgacctgataagacaatcgacgttaggctaacaacagacgctctaatatttttaaaaggaacgcttttcttgtaacttcgtgttaaatttcctccagtgtcagtcattccagaactccagatcaagacccaaaacaaaattgaagaaagttcatagcacaaaagatgcagcagaaatcaaaactttctttcactccacaagcatcaaatttgccatggtggtataatttcatatcctaaaacttccaaagtttagaaaaaaaaaaaggtatttcagtgttgacaacaataaacgacatgttcagctgtgagccattctttcactcaagacatgaaatagggttaaagaaaaccttgttaagcaatgttatggtcataattttttaatatatttcagggccattgcaactgcagaaaattattttaccttgccattgagcaccaatagctcaccatccacccaccggggatttttgaagccaggctgtgcaattctcccttgacctttatagctagcaatctgcaaaatcgaaaagttaattggaaaatgatatatgttacacacggcccagaagaagctgttaatttgcttaaacaaatacactttgaatcatcgcagactgcatgccattacagtctagtctaacaattcgaaacaacaattaaataaacagaagtataaatagaaattaccacaccaaattcttcagggtatgcaccacggttctcaagacgtttgcccttcccaatcttagcacggaatgttatctgtattgaacattattcattagaaagatgaccagcttgttcgttgaaatatacaaaatgcctgcaaacctgtccagcagggacactcagatcaccagtcaactttactgcttcaacatactcgaaaaactccacttcatctgtgctgttccaatggccgaactttcgacggagctgcacaacttctggtccatatggactaaatgctcccacatagagacctacatgtacaccaagaatccatcagtcaaagcagagaaaatatcaaggcgtccgtttaactgacaagacattaccactaaatggatctgagccgttactgtcagtaatgatcctattgaaaattgtattctcagtcagcttgactcgagccttgctgagggtaagctttaagagctcttgtacttctttatttatctgcagtgaatccatcatttcacagttaacttgattgcatgaaagaaatacagcctagaatactagggagtagggacaatggagagttgacaattaccactacaagtggatgaaacaagaatagacttgatagatagaatgggtcaaactatttctcaatgctcatatactaatatgttactttgtgaaagacatgatactattcaactaattgtgaagacttcaataaaccaaagcatacctcactaaatgctctaaactccagacttatatatagctaaaccaagtgttatgctcaccttcgaagaactcttggtcgttccccataatgccttcgcaacatcagaaggcataagttctgatgccaatttggcagccatatcagcaactttctgttttgcagcctttgtatcagccagatctcgatcagaaccttttccaggaatgtaaagttcgaaggaatccttttccaaattattgatttcagctggaactcgaacatatgattttgctccagcatcctccttgttatgaaccactccactaatgaagagcttcatttctggacttttactatcttcagctgagtctgaatctccatctggaacatcatcctgctgaagctcctcagtggtagaatcttccaatgagttctctgacgtgctcttcacatcatcttgcactaattcttctgacgaatctgaagctaattcagcttcctcagacacatctacatttattacttgaactttgaattcaggaatccgagacttgaagaaattcagaacgcttttcaacccttcaacactactatccttggcgttaccaacatcttgttctttatcctcaacatcttcatctccctttaatgtagtatctgtattcgcttcatcggtaatgccctcagatatagcactactttccaatgagctttcattctcttccttagctggactttctgcagttgctgatgatacggatgatgcacttgaagtgccttttggtggtcgcatgtgtacaacctgtctaaaaatttcgtaaatacaaatatcacanctagacataacagagttcttgttttttttgtgaactgcgtgaagactataatacaaactactaatatcagtttcatcagtgcaccttcattgtatatgtctcatcgtcatctctgacaaggaaaatttcaaataatggagttcctgacgatgcagtaaccaattgcctacaggaaagatgcacttaattatggatcacctagacaaaagttacttggttttagcataggttgcaaagagacataaacgcaccttgggctgaagctcttagccacatatctcccaacaccggggcttatccgtacgattctcccgatcgaatcatcggtatccttagcgtaccccacccaccaacctacctgcaaatcaagtcgttagaatacatcgcttatgtgtgatgtgtttgttaaagataatctgattcaatcaattaccaagttggttctggcaagctttgtcaaccttgaggcgtcctgatacctctgttcctctatagcagtctacatgggtggagaaacaatagtgaaaaagaatcgctagctacaacaacagcatctggggttgagatcctcaatcctggatcggtgacaaagggacgacgaacaggaagcagagtaccttgagttcagacatgacttgggcgacggcgtcgttgcccgtggcctcgagtatggccttcttgagcttggaggcttccgcgaagtcctcgttgtcgacggcctcctcgagctggaactgcgcagagtggatgcacaagataggtagggattagggtggattgaaatggatagagaggaagtagattagggggggatggtggcgagggtagggtaccttgaggagggaggcgtaactctcggcctggtcgacgtcggcgaagtggcgggtccagcgggtccaatcccaagtggagggccaggcggaggcaggggccgaatcggtgcatcggcaagcggcggaggaagcccggcgggaggcggcggcggagggaaagtgcccggcggaaggaggcgaacggagggggatgtggaggggcgggcgcgccgccgccggcgaggcgcacgcggtggctgcggacatggccgatcggtgacgtcctctctctccccgccgcgcgtgagcccgtgaggaagataagggctacgatgagataagtggctgccaactggggccccccgctgctgctaccccccctcctttagtagccttttcacttggatcacaaatacaaaccgtgcaagtcaatgtccaagtgaatttcacgtccaaacgtttggaccttttgagaatctgtcactactatttccttttcaagaacaaaatgtgtatttgatcatctcatacaccctccgtttcgggttattgactttgatcaaaatcaaattgctttaagttggactaattttatagaaaaaaagtagtaatatttacaacatcagcataatttcattaaatctataattgaataaattttcataatatatttgtcttgtgttaaaaatattactatttttttctacaaaattagtcaaacttagagtactttgcgaaagggcctcagtagcacattaggtcctggattcgactccccatcagaacgaatttttcaggatttaatggttttcaatagtgcgagtctgcgttgtactgcgtaattctcaaaaaattaaccaaagttaaaatgtcttataatctgaaacggagggagcataacttaattttgcacgataattctagaggtggtagctattaatatcattgtttgacgttttatgagtaacttcgtgattcgtcatttggagatattcgtataagttatggacaccaattatataaccgtcaatgctaaaaaggttatatgagctgtgtaccccgtatgccatctcaaaatggttgagggacgtaatggtttatattcattatttgtttttcatattctatttctgttgtgaaatatgcacatatcggggtaattaggctatacatatgtgcgtttttttatatatttggacaaaccaatgttcaatataaatcttgatggagttttaaagcaaacggggtgtgagatctagtaccataattatgttaaggctgcacatttttttagttcgttatcgaagaaatgtgaagggtgcacggcaccgaattgtcccattcgaagaaggtatatccattaccaaaagaaaagtaaaggaaaggaaaaaaaaggagatgtaacatgaaatgggccgagctgtgaatgacgctgaagattcacatatatgggctaggattggggccacggcaggcaaacaatggccgagtaaattcactctcttttttccctttctcatcatctctcaagtgataataatgaatccaaaacaaaaggtgatataagcaatagagtatgcatggcgtagatttcacgtttccatcgaagttagtttgttgtgcaatctacttatgctgttgcaaacgaaattcacttgcaattgtagtatgcttggatgggacgacacggcgtttaactatatatatatcttcaaagatgacaaaaaaacccttcaattttagtaataaaacggaatcaaagtatacacatatattctcttctattttttggtcaaaaggaaaaaagaaaactctgtttttaatgaatatgcgtgatgcttatggagaaatccacttatttttattcaggattagaacacagacaacataggccctgtatgagagggttctagattttcgtagcacactttccaaactgctaaacggtgtgttttgtgtgaaaattttatatattaaagttgttcaatctatttttttaagtttataataattaaaactcaattaatcacaagttattaccacctcgttttatgtaaaacacttaatttttatctccatctttatttttaagagattcaaacagagccatagacttcactactcatcttgttcgtcgttttagttggtgctaagcttctgtatagcagtatttctaacgtaaaataaagagtatagtacagcactatatttttttaataataaatttaattttaaaagcattgatttaggataaatctaaaatagaaaaatgatgaagaagtagttattccgatccaaatggcaaaaaaggcgaggaggctgggtcatcgtcttcctcgtgagcgtccgcgcccacccacctaacccaaagcccacctcgcctccgcctcccctccgccttcaatttccactctctcctctcctctcttggactccactcgccctcgcgactccgcccccgccatggacgccctcgcggggcgcctagccgcggcctccgtctccgaccacccctcctcctcctccgccgccgccaccgatggggccaacgccgaccacctcctccacgtcatgcgcgccgtcgagggcgccgaggccaccatccgcaaccaggtctacctcttatcctttcctacccacgaacctacccttgcaattccttcctcatcgcctcttccacaattcccctcctgtcccactcccaactcgccctattttatttccgcacaccactgaagtagctgattttgggtttccatgtttttcttttctagttggaagagaataatcgcctcaaagaggaactgatgcagaaaacgcgacaattgcagaggattgtaagcctgctttttttttcttttccttttagctatgtatatgcacaaaatgtagccatgtagtaacacccagcgtctttcaatttttgggatcagcgggaagatgctgcatcccaagcttcttccagtggagtagcccaagaccgccgctcattcgttgctactaagatggatgcgtcaaggtcacctgccagcgctgcgtcctcagataattcccgcaccccctctgcccttcaccacaatggcgcattcgaaagtggagagccttcaatgcagcagaccatcaggcaaaacaatgccctgtccaatggagcatctaaaagatcatcaggggagcagcctgccctcgacagcgctgccgtctcacagttctctactccatcctcccattccctttctcctactaggtaactcacctgaccacactccatgttttccctaccatttttgttgccggggaaaaagaacaacggtaggccgcaggccttccttttgtgggatggtcttgtttgcttgcgatatcctgacaaaatagaagcccttccatacaggcatagaaaagaaggcgagcatgatcctaggttgaacctagctggacaggggttattgcctgcttcagagatggcctcgaacatgtcatggaagcatgtcagtataagttgcttgcaaatgtcatttgtacctgtatcatccatcatccctaatgaagataattcctatgcaggatcttactgctaagatcaaagaaaatgaggaagagattgcgcaattaagaaaacatcttgctgactactcattgaaggtggcctttttttttttttttacaaatggaaagtacttcatttttgttgcctttccccttattatcttgtacctgactacataatatccctgacagcaagcacggatactcgatgataaatatatgttggaaaggcgcattgctcaaatgcggatggtaggccatttctttttatcataaactattagtcacttggagtaactagtgagtatatcatattatctcaaaaaaaaaaatctttcaggcatttgatcagcagcaacaagatttaattgatgcagcatcaaaagctttatcatatagacaagatattattgaggaaaacatccgtctggcatatgcagtgcaggtagttctctgtcactggaaatttctttgaaattcgattagtatgtttgtgttatattagtcaggcttattatgcttccagtcatacttcaatacctttctgcaaaatttaaaaaacgtgcacagaaatgatcataacacgtgtagtgctttaatgaatgttgttttctgtgcttacttgaccttgtcccttggtgttatagctcaaaattgttaggaacgatgcagaatgatatatctgttttttaatccatatatttacaacagtttttagaaccagctgtttgatgcaaggtcttgactaatggattttcctgtggtctataccaaggtagtatttgttgaaaatttctgtttatacctctatcctatggaatacatcttaacattaggttggatcattcattgccatggcccatggtgatgttcattttggatatatgcagctcttactattctatgggtacatcttaacattagataggatcataaattgccatggtgatgttcattttggatctatgcagctgttactataagataaatcagggcttgtagttaagattgtagttgttcttctatactatactgagttttgcttatgtcactatatgctataggctgcacaacaagaaaggacaactttcatatcttcgttgctgcctcttctgtctgaatatgaaaacctgcagccttctgttcttgatgctcaatccatcgtcagcaatttgaaggtttactcttttttctaatattttttctgccgtttcgtgggggcaacgtcgtatacgttagcaactagaaataaatttcactactgaatgcaaatggcaaaaaagggaaaagagatcaatgacattaatttcatctgagaaatatgccatactttcattattgaaaaagcaacctaagcatttttcttttttaaaaaaaggttcataacacatgatcaacacatcaagttgcttctgttcttgtaccttattgagttgacttttcactaaatgtgtccctttctgcaggttttgtttaagcatctgcaggagcaacttattatcactgaggtgagtctcaataagctcaagcaaatatgcatttacttttcccataaagaaagaagcgatttattttcagagacactaggggtgggcagtgcaagtgtacccaatagtgtccctctcgtgcatgcaaacttactaccgaaaattttctgactgaattttgaagtttccttttgtgcaaatttaaatggtgcaggagaaattaaaagagtcacgttatcagattactccatggcaaactgaattggcgaatgatgccactcttcctgtacactcacctacggatcctcttggaaaagcattggtgacttcagtatggcactatactccttgagttcttgtcataactattgcagaaatgctctaacctatttactttttcagaacaaaagcaacctcgatattgtgacccagacaccgtaccctcatatacaatctccaatgtcttcccctgttcaagttagaggtgattggggtgtagcagggaacaaaaaccgtcaagtcattccaactgatgttcctccaagaaatgttgatcatggtgacatgggaagaaactctctttcaagcaggtagtatcttctttaagtgcttaatactgtaccttcctgactgactttattctatctaccagcgttgccgttgcgcatgatgaaataattccattcttaaggtagcagctatgattgccagttcttgacctatgtaaattggctagcagcttctagtagtcattactcattacttgaattgcttttactaatttctgatatgttacactctactttctttagtatgctacaatcatgaaaaattcagggatgtgggaatttgctacaagaacatttcatttctttttgagaaaatccaagaaatatcattgaaaagctctcaattccaataaatgccatcgacaagtgcgagttccatgaaatgccatcgtgcaagcgactttgtcctagaaatgccattgccattagggtttcgtccatcccacaccgttaaatgcgttgtttatcctatagcacttaacggaggactgctaatggaaccctaacggcgatggcatttctgggacaaagtcgcttgtacgatggcatttcatggaactcgcacttgtcaatgacatttcttggaattgagcgtttgtcaatggcatttcttgaattctctttgttttttgtcgctgccgcactattttcaaatagctaaactgtttttgaggaagatttaataatcatttttctagtcaataattttttttattatatagaggcatcacaagaacattaaacgtggtataatttatatttaatagcttaaaattcaggagggatgtttcttctcaagtatctcagcatgatccacattctgtcccattggactttgagcccgagaatcaaaacccaccattcaagcaccttagtagaagtgacgtatcggatgcttcggagggtgctgaagtccaacatgcacgagaacattctgctcattggggtcatggagactcagttaatttggtatccggcattgaggatacaaacccttcatatccgtatcttcctactgttcttgaggagcctggatcttctttctctgaaggtaattactattagaaataaatttatatatttgtttaacactaatgcaatctgatgatatattcctcttttatgaatatgtagctgctgaggatgatccactgccaggcatagagggccttcgaatcacaggtgaagcttttcctggaagagaactccaagcaagcgggtactccaccaatggaaccaccagttgtaattttgaggtgctcttcgtaattcatgtcattccacattctggataaaagaacttctctaccttatattgttcatatgagtttcaaactttcatggcaatctcactgtccaaaaaatatattttcctatgtgcagtgggtgcgccatttagaagatggctccgtaaatttcatagaaggtacttttttttgtcactttagctctgtgagcttgtcacttgcattaaataggattctatgattttcaagaaagttgggaaataaatgttttctgttggcataggagcaagacaacctaactatttggttactgccgatgacgtggacacattactagctattgaagtacagccccttgatgatagaaaaagaaaggtaattattttgcgatgtggctgattttttttttatgtgtgatacaatgttgcattccccaaaacttctggtaattatgaggctatatgcctatatatcttttctatgccttctgaaatggcactaaagacaatactagctgtttagcatccttaattccatggagtcatggagactgaaaaagcgcatctaacgtacaggattaaacttgaaatacaagaactgaggtatttatataattgtatttctcgaatgctactgaacccagcagttaaacctttacttcttttatgttaatcaccaaagtagctctgatgnnctaagcagcattcgatatcaatngtgccct

SEQ ID NO: 34250 - DNA, 23605 bp, Oryza sativa
  unsure (1)..(23605): unsure at all n locations
naattaggcaatcggaaacttcatggttgtgatttggacctttccctttatgtttgtggagatccagagctctagttaatgatacataatccaacctttgatgtttatggagtttctttgtttggtttcactgggacaccatgtaaaatgagttaggtctgttgtacagttaaatttcttatgattaaactgattttctgttattacttccaatgttaagattcgtccttttgtttgagtttcctattgcagggggaaattgtaaggttttacgctaatgatcaaagaaaaattacttgcggtgagtatatggaacctttaattcccaaaagagtgattatttctggtgatggagtgtttgacataattccactcctagagggaatgttgaatcccctatatatctaattaccaaaagagtggtacttctgatattctgtttaactaataaaagttttccaattatgtgatgattatttaaactaaatagcagcagcacatgttttgcacccaaccgactttgaataaaccatcttcaatgcagatcctgaaacaaaggagcttattaagagaactcttgaaactggtcatgtatcttatgaagtccaactacctgtatgttctctattacttggaattatctatcaaaagcattctcactaatttcttatgatttcatgcaattatttcaaatgttaaatcttcttatagcaggtgaaatttttagatatgtgggaaccagctattttggcaataaagagggaaggctacagtattaaatgtactggtcagcgtggtgttgttctcacagagaaatttcagcaagcaacttctgtacgtccttattccgtattctttagcagtacatcatttgaatttcaggaagtagatctcattctaaaattgtgagcaaactctgttggttccttcagtacctgggtagcatgttggttcacccaaaatgatggaaataaacccattgtagatggatgtaaattgatggttaccttgaattctggccagagacaggttttgttatctcatatggtttcaagatctcagatttatgtctgagatatggttaaccgctagattacactgcatctagacaaacgtcatgtctttctttgatgcattgtctctcatgctatacatgaaaagaaaaatgtaaaaaataggccatgatctggcctatttctgttgacctaaggaaatgggaacagttgagcttctttcctgatgaattgtcttcacatgcttgatggacccacaccgaaaaatctggacaggacgattaaatggtgtgcacataagtcataagtgtgatactgcaagtactatactgagacaaattgtctccgataataatttttttctgctgcttttgctaattaaccatattataatttttgttctgcaatcatgtttgtgtttttttgtaaatcattgctgtagacatacaaaaatgtggtatgattgacaacaacttttgttctgtcttttccagattaatattccttacgggcgtccgacagagttcttgattacatctgctgatggtgttgaatataatttaaagcctgcagaaaatgcactgtgagtacccaatcgagctagtgtttgcatcattatcagcagcccaagatctatgaataaattaacattagtattcattattccttacactatatgtgtcttgatgtgcaactgtacttctgatttagcagcatggctcccccctactgctttccctacaaacaactctatgggtcatcacttcttgaaacatcagagttaaaaatatgctgcatatgtctaatagttacttcttaaaactcggaaggaatgcctcaaggtcagcagtgccagactgccagctcatcgatcttgtcacaaagcccatgttgttttcagtaatgtggtcttctatagctgtctgatcagcgtgtgcaagccgacctgaccgtgccctagtgtgttcattcttatgtctttgaaagcatagcaatttaggatatacttaccttctaagtgtaatcagtggaggtttataccaaacttgaattgaacaccctgtccttggtcttttactttattactgctgtgtttattttagattaatgccaatcataattcataacgaacatacataaaatactgcttatcttgtgttctccaattttgcaggccgcgggataccattgttctggttttaagattgttcagaattatggtatgagctcgttatctcttgtgcaagacatatattagcacctcccttcattatctttatcttcattcaacatcatcgagtgggtcatcatgggatgatggccctccactctattcaagttcaaaaccgagtattatttgacgattagcatgtttgaagaacccacagtagcatttttctcaagagaaaaaaagatggaaaaaaaaatatagagaagttaagtgtacgctatcagcattcactagtaggctactagttgtgtggctggctgtgctgttcggcttttgttgttacaaaggctaatattatctttggttaattaagtaggcggaggttaattttacagccctctgtttattcttcaaaagaaacggcattcccagccatcatggggatctcttatatagtagcactttatctaaagatagggcactatgaattgtttgtaaagagctgtgttgtcaaagttcatttcttgtgttttcccccaaggtagcatatctgaatggtgactaacaggttaaccgtagagccaggattagctgcctgacttgatgagaatatgtcgtctcacgttccttaaatactgatgtgaaacatcatgcattttgcaggctgttgagaagaggagaggaagaaagaagagccttttcttcaagtaggtttggctcctataccgtggtgtataatttgtattcgtgattggctggatgtatgtaattaagcgggtgataggtttggcatattctttcggctgtatcttctgctgtaaaggaccataggcgatttaaacacaagggccccaggtgatgggagttttcttcttcttatttttttcccttattccttttagaaacatgagttttgtcgttgcaagggatggaagcgtgccgctgattagaattgaagctaatttatgctaatagaatggaaaagataaataggcaagtcctaggatgctctggaaatattccctgcatcgtagggtagtgaccatcatcagttcacgggtgacctccctgcctgctggttacttccaacgagcttgcaattttggagatgacgcatagcagtacctgaacatgtatacaagtataactgatgtatcatatgctgtgtaattatttgagacgaagtagacttgcagtagtttaagataacaagggcatcttagttattccagcgtgtactgtactgctggaagaaaacacttgcattattaggcagttgtgcgtagaaataatcgtgggttgcagttgtgtctacatcctatgaacattctgtggatggtaacattgaggcaggctatgtccacaccacactacacttgccaaacggaatgtgaatgcatttagggcctgtttaattggtgaaatgaaaatttttgggtgttacatcggacgtttgaccagatgttggaaggggttttcggacatgaatgaaaaaactaatttcataacttgcctagaaaccgcgagacgaaccttttgagcctagttaatctgtcattagcacatgtgagttactgcagcacttatgactaatcgtagactaattaagctcaaaaaaattcgtctcgtgatttacatgcaaactgtgcaattagttttttctttttgtctatgtttaatgctctatgcatgtgttaaaaaattcgatgtgatgtttttttaaaaaaaattaggaactaaacagctgatcaaacatccaaaaatttttatttcacgaactaaacagggcctaatcaaggccttatttagatttttactcctggcttgctctcggttgctctctgttcggaagtcagtgttcccaaccggatcagtgcgcacggaaaacagagcagtccattagcgcgtgattaggggtgaaaacggtacggaaattttcgagaattccggctaccgtttccggtttgcaccgaccgtttcaatcggtatcggtaattgtcggtatcggaaatggaaacggtaatctctttcggaaatggtagcggaaatgatatggggttttttccgaccgttttgtcggtaaccgttttttatcggtaatttccgtcaaatttccgacaaaattccgaagaaggaagtcggctgggcctggctagcaagaggaggagcccattaggcattaaggagcagcccattccgaataaagaagccaactaggcctgaccgcatcgtcgtcttcatcggcgctggggcaccgccgcgccatgttgggcgccgccaccaggtcgccgacgccggccgcaacctccttcgccccgacggcctccgtcgcagccggccaccttccctcccccacgctccaccgccggctttcgtgccaccgagccaagcgccgagcgccgccgcaccgccccagcctcctcctccccaccgatgccgcccctttctcctctctccttcccccaccgccgccctgcgccaggccgccatctccggcgcctctctcctctcgggcgcgcatgaaggagccaaaggcagagaagagaacgagagagaaaacagagaagaaatcgagagagcaggaaaaggaaccgagagaagggaaggataagagagagagaaaaaataaaagaaagagaggaaaagaaagactgtgggatccactggcgggccccaccatcttgactcctctctgtgatcgacctggaaataccaaaaagtctagtttagcatgaaacttaattacaacagtagttatacagtgtcaacataaaagttcttatgcaatgtgccactgtaggacgacgatatagctatgtcaattgatgatgaaataatgaatgatgtttgacaaggagctgatcagctgaagccatgccagcttgtgagcttggtgttctcgaagacttcaaatctatatcctaaaaaaagtcggacaatattagttatgctgtaatcctatcatgtaagccacattgtatgctttagccacattgatgttgaagtatcattgaactttatttatattatttatcaatcttattgtcaacttattaatcatcatataacggtgttgtgtggcagcgtaatgatgcaagggtgaaattataaggtcatcttcatacatagttaaatgcgggatgataccacagttcgctgtttccgacatgaattttcgacttccgtccgatatcggtatattcccgttccgacggttccgtttccgagataccgatataaccgatatcgttaccgtttccgagtataccgttccgattccattttcgagaaaataaaatgaaaatggaaatggtagagggtttttccgaccgtttccgaccgttttcatccctacgcgtgattaattaagtattagctttttttttcaaaaatggatcaatatgattttttaagcaactttcgtatagaaactttttgtaaaaacggcaccgattagcagtttgagaagcgtgcgtccggaaaacgaggcggagggagttggtaacaagcccttccgaacagagccgctccaaggcaagttttgcgtcagatctgtatttcaaagcaatggtccattgaaaaggtatcaccgctgattaattttgttctgttgttcacctcttgtagagttctactctgcagttatttgggatgttctttgctacagtacttagctgctgagcgttctggatgtcttttgatcaatacacatacgcaggttgtgctctgttcagtatgttggcaccgaagtatgcttctttgtgttcttattctgattataaaataatttccagatgtacaatgcaaagtagttactttgggcttttgactgttgagacataaggattaggtttatgaattttgtgtttatgtttcttggttcaattatcttttatatgaattacaaaggtttagtacaaggtccatggattgactaagtatcatgacccgaggccatgacgggataaacaccgccgggaagatagcagggcggcgtcggctcctggagaagggatgtagatttaggctagggagaaaaacattattggaagggagagattagactaattgatattcattgcttgcctgataatagacacaatcccatccttatatagattgtacaacttgacctctaagtaaaaatctaatcctaataatcttcttatcttatctttaactaactaataatcttcttatcgtatctctaactaactaatattcttatctctaacttaattgatattgggctacctataggccttggcctacggcccaatgcccatgacactatgctgttaagcacctacttctaaatctctgcgtaagttacttttcagtatttgtgatataatcagatggtgacattcactactactttagtcaagcttggaagaacaaaggtaagtacatggaactgaaaatggccacttggagatgacagctccatggtcagctgttgtggctgccatttgatttcccagttccctctggaagaaacaaccagcaaaaaggaggctagcaggaagcagcagaaaatactaagcatgatctattttcccatcatagcatcgctgttagggcacccgcaatggttatctataggctctatataagagatccatatcagcatattttcctacttggaagagattaaatgaagagagagagcaaatatatctgttaacctggagatagtctatagagaaaaacgatgcaatgtattagagagctatagatacccatgtagacatactattgagatggtttactattaatctagtctattgctgagatgtacatgttttatagatatcaccttactttaccattgcgggtggtcttagagcatgcatttgttttttggttcgtacgagaaatttcagaaagcagagcattgcaatatcagaaattaggcttattccttttgtttgacctcctgtgctgtttgatatttaattttctaggttgatcactagctgatgtcttttcatttttttaaatatgtatttctgactgggttgaaacctccctttcttaaaaaaaaggaaataattggttacaaaccattaaactggatgttaaggtcgtatggcttgctcaagttgtttgtgcaaataaccattctctcaagctgatgaagtgacttgagttcttttgttgccctaaatatttctctttttgaagaaattaacttgcaagtgaatgcattttgtatgaacatgtgaaggaatctgagactaggaagaatacaaggtaatagatgcctacctcagtacctcacagtctttgtccgcataattctgaaaatatggatgcattcttcagatttctttatgtcaaatggaacactgtaattgtgatgatgtggccttgagaagctgttgtgagtcattgactcatcagcaattattcatgtggattttattgacttgtatggctttgtcatctcaaatgcgtctttccatggactgatgctttgtagaaatctatagaacaatactgttttctgaactcatatttgattacaggatggaaggacggtcttggatataagcttatgttttggaagagatttcaagtcttatgatttggcaaagcttgtttagttactttcgactaacactatgtacacattgatggacgcggagtgaagccgcgcttatttatctagttccacaacagacgcaaaacaatatacatttctgaaaactagaaaatctaaatgctgaattgacatcacaaaatcagaaaagtacacacaattgttcatgccaaatcacccttgctcagatctgaaaacacagcgacatatcactttgttcattccacaaaatcacccttgctcagatctgaaagcacgatgtctaagacatataactttgttcattccacaaatcacccttgctcagatatgaaagcacattgtctgaggaaaaaagatagcacaccatcactccccattcgaatcaacacacaaatatcagaaaccatgtggcttcctttttttttgagaggaaaagaactttccattaacttaaggactcagcaaaatcgctggccaccaagtcctccatgcccggaggcatcatgtcccattgttcaacagtattccgaggacatttacaacccaaagctgctaaagcatgcgctactctattacattctcgtggcgcaaaaacaaaggaacaagaaaggaaactacttccgatcagcttcttcaattcataaatcaagccacccgttgctgcaagtctgtgatcatcggcatccatagcttgcttcaagataatggaatcagtttcaaaaacgacatggcccattcctagtgcattcgcggcccttgctccggccaagcacgcaacaacttccgcctggaaagcatccaacagataagatattctaccagcacttgacaggataacctctccctccgaatcccgaattacaaaaccccatcctccttcccctgtttcagctatatatgctccatcagaatttatcttcagtttacccacagcaggtctgcaccttacaaaatctgttgcattcttcccaacaaaaccatgtggcttccttgttgcagaaaataaactaactcaccttgtgaatcgttgtggactctttgttgcttgccacaagttgagaaatcctgggattcatgatgagaatcggttgagaagacttggtcatctcaaccaccgacgcagggatcgccactgtgcgcgaatggctccatggaagcctcgccgacgatcgccggaatcgccacgagcacctccccgactgccgtggggacaacaaaacgtgtctcgcagacaaaacacaacgaccctcctcccccgcgctctctgccaagcccaagggtagcacgagggctcctcccgccggagaagacgacgacagcatagcacccctgctgatgcgtcgccgccaccttctctccttccctatatgctccttctctctcctcaccgataggggaaagctccttctctctcactttctcccgtgcgtggcggagaaagaaaatggaaagggggatattactgtttttcgaactgtagcggaaataatgggctgaaaatatgtgacgcgaggcgagggtcccgctgctgcttggttgctgggcttttagggcatgcaattgcttgggctggagcacaattccttggctagatcacgttggagcacacgaatcttcaagggagatccaatggctaaaaaaagactgacaaagacaaaaagaaaaaaattctcttctttttattggcaccgatgatgaaaatattttaaatcttttaagtagtagagatagagagaagtactctcttctcgtcctgtttattttgatagttgattcatgacgataatgataaataagaatccaaatcgcatctccgaccctaatcctaatcgctgcccgccgccgccgctgattctcgcccgcccacgtcgccagcgacgtctgcctcgccggtctcagtgccaccgccggaacacccacgcccgcgcctcgaatccccgcctggtcgtctctcccctctccctcgcgtcccccgcctcccctcgccgcactaccctatcccctctccctcgcgtcccccgcctcccctcaccgctgcctccgtcagatctgccccgcacgagccgccagcgacgcccgcctccttcgcgccctgggagcagtaccaacggcgggttcgggggtcagcgccggcttgatcgaggcgtggcccgtgctgaccaacggcgtcgccgccgccgccgctatcatcaccggcaccgacctcaccgagaggtggggttctctctctctctctcttctcgcctgtgtcagtatgtctcttttcgtctctgttttctatgtaaatataacatgtattttcctcctatactaaaattctaatgatttgttctctagagtacaaatatttgtagagatgttcagtgcgtttagcaaatacttaggccgtcatacaataagtgtttatgctgaacgatgcatttcagaaagatacggtcaatttgtttcctgtcaattctgcactcatatgattttttttttttacatcactagaatatgaaatcttattgatcttggacttgatatttggattactccatatatactcctattatcttcggtttatggtaaaatgggacagagcgagaggagagcagttccactctcagctactagcttaccttagctatcagttgatcatattagctatggctgttctattcattgcttcaactgctccaaaaatttctttcaccgttatccacaattagtctacttgtttcaagcaatggagaggatggctgttacgcaatgtaccgaactcgtgatgaactttactttgtaatgttaagtgttcaacttttctaattgtcatctaacatgattcagtccccttcgtcgtgagcagccgtcacgtcgtcagatcctcctccaccgctgtccatctgccaacccctacgcacccaccgccgccatctccgaaaggtacagatcccccccccttcctctatctataccccgccatctttctgtgacctatttgattttggctgtgatgtacgagcagaccatggacattcggcattctattgaatgctgcagaaactttctgccaccctgttaatcaaacaaatttgtagtcaatagtaggaaactattacaccaatatgttatgatgctggatttgtttataacacaattaccaatctgtttctctacattgccatgcctatagggttttaaataaatttgtgctaacaatatttttactagatttagaccaaagcgacgatccccttcatttatgttgcctcttttccaattaaaggaattaactaagttctgaattttcaagagactaatttacatttatggatgataatataattttgatagtttatttctcatgtttaaccttgaatcatttgtactaaaaaaattctctgcccattaatagtcccggcgctgatcttcggtcaacgtcgtgactttcaaccccgcagccgatcgcaggaagaggcctcaccacttggcagtgccccgatctgttctgcgtccgctgacggcgtgaacgcgggcgagtttggtctacggctaggctgcagaattaaggtctgagcccaatccccggcctgctccactcatttcattggtgtatttgtttgataaattattagaaatgtctatataaaaatgatggactgaagttgaatgggacgtgtgtgtatatacattatatagcagtgcatgaaatttgattatgtcgagatacttgctgccggcggatgaagttcgatggttattatacttcatatttggttccttacagttattttgaaattagaacatttgtctcatttatttgcttgatcccatcttcttgcaggctacagccatcctgggtttttttaagtgctgcacttctatatatatatctaggtaaatttcaacccctcatgttcactttctcgagagaatccattttctttgctttaatttcaggtagtatataacctgttctgatgcttcttgtgagatttcatgtttgattgattttttttgaacatattagcaaatatacgtgtgtcactgcgtgttttgatatttgatttagtaaatatctcctataatttttcactgccatcactccaggaatattcaacttatgcttgtcatattaaaaaatatgaggaaaaacagtatattaggatcttgtaaaatagcatgttggaccctagtagaacctgggccctagtagaacctgggcgccgtgaaggccatggtcgcaaagctgatgatacgcaggagatgtaaaagttagcctattaagttgaacaaatcatattgttttacattgtttcagacaaacctgatctgaagttagcctattaatattttatctgaatttaactttaacattggttatccagcgactatcaagcatcacccttaaaagtgtcattgataagaatgaattatacctaaatctgaccaatttgtcacatagctgataatacacatgtgaagcgtactgcaccgataatagttacatggaatatgtagattctcattgcccctggttgctgacagtctaactccttaacattcatattcattctcatcttgaggttggtcatttctaactccttaacattcatattcattctcatcttgaggttggtcattttgtttgctctgtacctatgagatttccccttgcgctgtgaaacatatgccatgtcacttcacggcagcaagctgaggctttgttctaattgtaggttcaatatatcaagagggtggaacctaattgataagtgtgcaccagatcgtggtcagactaattcacggtaaggctgtgtctgtttctcaacccttgatatatagtgtatgattgtgttgtgttgggtgtatcctggaagaaaaacaaatgcatgtctgagattgtttcttcgagattattaaaatttagctgtcaattgagattgtaactatggtctatattacattaacgcatatatatgcttatattttttttcctttttaatttttttagatggttcgtccatacaacttaaatgaatatatttaattcattcattgtataatagaaatatagggcgtatagaccgtataaaataccaaccatgtgcaggaattataatgccgatatgtatacgcatacgcacgccactcaaagttttattgtgcctacgcaatatcatagtctcgtaaaattttattgtgcctacgcaatatcctagtgttgtactttacgttacatatatttgatgtgcgacatgaattgaataaaagttcaaatacacagatcatataaaaatattttttgctaacatgaaattttataaattatttaggacaaaaataaaattgcagcgtagcgtttagcacaggcatattactagtctccttaaatccatctcctttggctttcccctctaacaccgtctccctaatcccagagtctacctaccccacccctcttgttgccgccgcctctccatcctctcacgggccatgggttctgttgccggcgacgccgcccgcctttcttatccacccactcgccgtgacaattccgtcgtcgacatgtaccatggcgtccctgtcgccgacccttaccgttggtaagtactccaaccttgcttctcgggggaggtcttatatttttggctacttatgttgtgtgcggcgtgcacgtaggctggaggacccagagtcggaagataccaaagaatttgtggcaagtcaggtggagctagcagagtctgtgcttgcgggctgcttcgacagggagaaccttcgccgtgaggtcactcgccttttcgaccacccgcgccacggggcgccgttccgtcccggcaacaagtacttttactttcgcaactccggactccaagcccagagcgtgctctacgtgcaggtatgccatcaaactcgattaataaagcacgcagtggatctaaggtttggagctttgcgggacatgttgttgtcccgatgatgtgaaaataattggagatgggtttcaatagatttcgtgaatatacatcttgactttagaaactactgtgctgtaggagctgaggctagttcagttagtgaatgttgcaatgtatacatctctattgcctaagccggagacctctttggcttggctgcttgcatacctaattcttcttgattaaattgaatctagtttattaaagtatcattagttctctgataaaattaaaggcaaaatctatagtcatgtgattgtttgttggtatgcaagctttgcgatactcactcttttccaacctagacaatgtgcaattggacaggacttattatataccaactgtgcttgtgtaatatttgctatgcacatgttttggttcctttgcccacccttccttagcctcgatgagtaacattagtgggcatttgttccagtttgattttaggcaaggaagtccaccctaccaagtctaggctagcaaatgaaccaaacatgctttacataaaaatgaaccctgtgagaatgttcaaatctcatagtcaagttccacagcactgagcaatgctgattgttttgctttctctgtcatattcatgctttcagtttctcataagattatttggtgttcttaaaataaagaaacaagtccacatattccgtttagtatttcttttaccctttttcgagtgctagttttgtttatgtttgaattctgtcaataaaaggctgcataattgtcttgattcgatgaaagggttagaatgaatatagcatgtacttatcaattcaggatagtttggatggagaggcggaggttcttctggatccaaatgcactaagcaaggatgggacagttgctctttcgacgtattctgttagcaaggatggcaaatacatagcttatggcctaagtgaaagtggcagtgattgggtcactattcgtgtgatgaacattgctgataagcagactttgtctgacaaattgtcttgggtgagcagatgcagcttgtaactattatttgaaattgtagtgcttatgtgttacctattggttcttataaccaaatccaacatatatgttccatcaattattggtgcaggtgaaattctcatctatcagttggacccatgatggaaaaggttttttctatggtcgataccctgcaccccggtaggtttacaaacttctgtatttctaatgtactgtaatagattgcttagtttctcttactccttttgttagagaagtggaattggatgctggaactgaaacaaacattaatcttaatcatgagatatattaccatgtcgtgggatctgatcagtccgaagatatattatgctggaaagatcctgaacaccctaagtttcctttggtgcatcggtcacagaggatggaaaggtaacaacacttcctctttttcccatttgtgtaccagtcatatctatatgcttatttacttctttcatcttttggatgagactacaaacttgatttctcttcttctatggttgatgcttcatcttctagtttaaatgacagtacagacaattttactacctgaacttctctcgaaaatattttattcagtcccttgcttctgatggagcttcctgcattatctaggattatcttaatttctcaagtgctcactagaatatttggtgcttcttggctttctacatggcaataaatattacatgatcgtataatggattttctcaatcaacatgcatgcactcatagcactacttgcagagacaacataattcaagtagtaatagagtaagataaacatgttgaagaagatccatgccttgctcacagaggccagctcctgtcatgaacctacaactccttggaaccttacatatacctgcttgtctaagtgaactaaacaactaatacgaataaatactaacaaaactcaatcttgtctaagtgaactaaacaactaatacgaataaatactaacaaaactcaatctatctatctaaaccttactaatcgtgcactttttaggagctctcaagtcaaccaaaaagatctagccgttgatataataaatcataacatcacaaccatagatcgtaatatttttaacagccacataaatcggatcgtagaatcctatatggtttattagtaggaaatatctcccatagatgtatggtcttgatgtccgatccgacaaattaggtccatagcaaaccaataaaccgatggaagttactcctatctcctaatgaataatcatgcatgaatacgtattgttgtacaacccctgatgcttgaatacgtattgatgtccagcaaaatagtagatccatagtcataacaattaatttcggtaatctctatctttgtgtagagaacaaactatttcctaattaatcttcctccaaactaaataaacataccatcaaaaataatatgcacttcattttattaaaatttagtaactccaaaattctagattaaaaaaatatgatgttttttttattttaattacgaaattttgattttttttttttaaataatattgaaactgtacaagtaagctaaagttgacgtgcacttttaatctaaattactacaatttagaaaatagcctgtgtatgttaaattctatatatgtacaatatgaataataataataataacccacacaacgcgcaagttgatgactattataacttaaaatttctacagttgctagctcatggttatatatgacatgcaaaaagaatgaatcttacctgtcgtctaagtgaaataaatagccaatacgaataaataccaaatagagctcaaaattgcttgcaattttatagtagctagctcatgggtttatgtgaatgaattgcagaaagaacaactcaaacccaaggtcctgagcaaacattatggctattcaaagatttatttggctaaaagtgcaaaaatgattgcatattagtttcggaatccttatttcatccgaatttcaaaatctctgtgcaaaggctttatatgatgaggagtataaaatgcaatgggcaaacctgttttgaaccacctgaaatggagctagcataaattagttttggagcttgaaattaattgaatttccaatgtgaaaattattgattttctgatttttgcaagggttgaatattccattgagttcattgcattagcatttcgtgatggatgttgcagtagagtgtgatctttatggtctacatgtttgttgcaccaaccttaaaaagcagagtatctcttcacatctttaattaatgacttttgtctaaatcttttaatagcccacaaaaacagttctctcataacctcatcttttgttgacagtacatcatactaggtacttatgaaggttgcgatcctgtcaataagctatactactgtgaaatttgtactcttcctcaagggatagaggggttcaaagagacaaaggggatgcttccatttgtcaagcttatagataactttgatgcccaatatcatgttgtggcaaatgatggtgatgaatttacatttttgaccaatagaaatgctcctaagaacaagcttgtaagagtagatatcaagaagccagaattgtggactgatattcttcctgaacatgaaagagatgtgctcgaatcagctgacgcggttaatggtaaccagttattggtatgttatatgtcagatgttaagcatattctgcagataagagaccttgtaactgggaacttgcttcataagttgcctctagaaattggttctgtttcagagatctcctgtagacgggaagacatggacgtctttattggcttcacaagctttctttcccctggtattatttacaggtgtaacctcacatctgcgatcccagaaatgaagatatttcgtgaaatttcagttcctggatttgatcgaacaaattttgaggttaagcaggtacatgccatcactgtcttaggttgccatatcattttctatacaaagaataccaatgaaactaaatacttcgttaaaatgtggtttctaactgtttttggtttttcagattttcgtcaatagtaaggatggaaccaaaattcctatgttcataatgtcaaagagagatattgaacttgatggatcacatccaactttgctatatggttatggtggattcaacataagtcttactccttctttcagtgttagtcgtgttgttttatgcaagaacatgggttttgttgtctgtgttgcaaatattcggggtggtggggaatatggggaagagtggcacaaagctggagcacgtgcaatgaaacaaaattgttttgacgacttcattgcttgtgctgaactcctcatttctgctggttatacgagttacaggcagttatgtattgaaggtggaagcaatggtggtcttctgattgctgcttgcgttaatcaggtcatacagtaaactcctgttttctacaatgcttcttcagtctgtataagttatcttgtactccctcagtagaaaaaaatatgggtgattttgaaagtcttaaaagacaagctttgattgttgatttcttaatacatatagaacaaaattttatgtaagctctttgaatatctattgatatagttcttttgctcgaaatgcacttgtttgactagagttgttcaaaatatgaatgtagtagttatgatagcatactattgtgatgtggttataatatcatcctattgtgatatcatgcataaatttgatttcctgtctttcagcggcctgatctctttgggtgtgctcttgctcatgttggtgttatggacatgctccgttttcacaagttcaccattggtatttcttttgttctgttgtgtatcatctttgttttacctgtatattgatgcatattatcagtgaatgcttcatgtttttttgtaggtcatgcctggactaccgactatggttgttcagacaatgaagaggaattccactggcttatcaagtatggaatttctgttatttccaacaccacttttactagaatatgtgtttcagttattagttcattactccagtgattgctggtctagtgggctatgtagaatactgctacaccactttattcttgaggtttgaaaattacaatttcgtagctgacagtttccgagttatatgtgctgttcaggtcttttaattgagagtccagtagtgcttaattatcatgttaatttcttcatttttcctgcttagtctgaatattcctagactaaaatcttgcatatacgttaatccactgagtccatcatatttaattatttgtggtgataatatttttctatccaattttccgtctcggcagaaaaaaggcatccagtgttccaaaagagtctttttagtcattcagtaatagagttcattgtgaactctgaccaagttgaaccttccattttccaaagtcacgccatatcttttttcagtgttttattagatgtattacacatctatgctgtactgatgagtggtgaacatgtactagatattccccccttcataatgtgaggagaccttgggagcaaagttttgttaactgttgtcagtacccagcaatcatgctgttgactgctgatcatgatgatcgtgttgtgccattgcactcattgaagttgttagcagtaagttacatttctttattccatttctctgcattttcatttgaatacaaagcatccagtccacaatataaaaatcattggttctgttaggcataagcatattcaaaactgaaaattatcaacaatatttgaatgtagtgcaaaacgtaatgagcatggttgggataaaggcccttagacctagtcgaggtgttcctggacccaaatggtgtgatggtgccatggagatgaggatgtgactaaagactctttatttatttcttgcttaaggagtagatatgcgtttccatccatatataaatgtgacaagacactttaaggaacttctaagattatggaaacaatacaaaataaataaaatctgaacagcccatgtgaacagtacaacgcttgaatagtaatcatgcacgtgacaaacaaatattttgtaaacgttgacaattttatagtgaagaatctataacataactggcctgttggtaggatctctttatagattgtgtaaatgcaagcctgtattcttgtaattgttgagcctcaaaacctttgctttaagccttccagttatgacatcgtcttccacatagaacttggcttgaagcccacttgacaaagccaatccaattacttaacccgccttccactttgaacggaagctgaaaccaaatctgtgggtttgactcatttaccatcctgggtccaccaagatacttggcatcatgctagtaatgattaccacgccatgctactcgtacttagttaaagtgcgaagacattgtgtgtaggcctttagggaagtattgggaaagaatggttatttcatgccagttttggacagaaattgtcaggaatgacacgttgatggataaatggcacaaacaaaaagaggaatttgattgagaagtaaacagataggggtctttgttgtaaaaaccaaatttcatgtgtggcgtgtgacaatgataagtttggtgtgtttctgttaactggaatgtcaagcaacattgaggtgctctgaaaggattaatcggattctgattatgtatttttattttgatacattaaacagttgtttgattttctaagcaccgtgattatgaaagtattggatgatggattagtcgttcgatttccgaatgtggtttttcacctctttagttttatgttctcacccctttgcttctcttgttattcagacactgcagtatgtcttgtgcactagcattgaggatacaccacaggtcaatccaataattggtcgcattgacgtcaagtcagggcatggagctggcagaccaactaaaaaaatggtttgtccaattctacatgtaccgccatagtttcatatcaatatatttatgatgtttgcaatctattgcagattgatgaggttgctgatcggtatagcttcatggcgaacatgttagatgcgtcatggacggagtgattcattttgtcctgcataagttggagatggtgagcgttgggcacgtgcaacggtgcaagacaggccctttcaaacaaatgatctgtgcaagaactttgtaggatttttgtttgaccatttggaacgaaggactggagcactaaaaatcttttgggatttctttggaatggcccaatgtatgaagatttgagatgaaagttagcatgaggtgtaacctgttagaaaatttctctcttgaatttctaagttttttctgtggtctgttttacaatcctccaatttacacttccattttatatcaaaatcatacgtttacgtttcctctatgcttgtgttttctctgttacaaaggagtccacatcaaccctccagacaaacgtgcgcactaaagttttgctgtaagcttggaaagtaaactttgtactccatccagcctattaatacttgttgtagtgcactttgtccagctgtgttgtcaaagttcatttcttgtgttttcccccaaggtagcatatctgaatggtgactaacaggttaaccgtagagccaggattagctgcctgacttgatgagaatatgtcgtctcacgttccttaaatactgatgtgaaacatcatgcattttgcaggctgttgagaagaggagaggaagaaagaagagccttttcttcaagtaggtttggctcctataccgtggtgtataatttgtattcgtgattggctggatgtatgtaattaagcgggtgataggtttggcatattctttcggctgtatcttctgctgtgaaggaccataggcgatttaaacacaagggccccaggtgatgggagttttcttcttttttttccttcttccttttagaaacatgagttttgtcgttgcaagggatggaagcgtgccgctgattagaattgaagctaatttatgctaatagaatggaaaagataaataggcaagtcctaggatgctctggaaatattccctgcatcgtagggtagtgacgatcatcagttcacgggtgacgtccctgcctgctggttgcttccaacgagcttgcaattttgaagatgacgcatagcagtgcttgaacatgtatacaagtataactgatgtatcatctgctgtgtaattaattgagacgaagtagacttgtttgaatttggagatagcaggagtagataagataacaagagcatcttagttattccaacgtgtactgtactgctggaagaaaacacttgcattattaggcagttgtacgtagaagaaagaatctgggttgcagttgtgtctacatcctatgaacgttctgtggatggtacagtgacattgaggcgggcaatgtccacaccacacttgccaaacagaatgtgaaggcgtttggcataaaggtcaactggaactttcaattacccgtagtaattgaaggagataacgtggcatctacacgcatgtggtatgacgtgtggctgctaacatcagcagcagtgttcatgctgcttgctgttcatgaattaattagctgtccatccctcctataattgcattcttttttactacccctccttcgttacctatagatggaattaaaacagacaaaattatgattaattagttgagaaaaaagaagtacgtgaagaaattaattgggatggttgtgattgatttagattagactatatggaaaagttgttctatgtttgggacggggagagtggtcaataaatttctctccacgggtacaggtcaggcaaagggtatgaacttggagacagtatgcatcaggactgcttatcaaggaattcttcagtaggtcctccctgagacaaatcaataaaggcgagcgattagactttctaatttgactattatttctagagctaaaccacatacttcatccatttcaaaatataaggagttatagatttccatccatccaggggcggatctagaaaaaaatagtagcgggggctaaataaactacatcaatataaatcgaacctccagtcctcacatcctatagatctatggaaaaaaatttagtgggggcttaggggggtctccattgtcccgggggcggtagtggggtctctcttcccattgacccccattagtccccccccagcgcttacatcttaccatataaggcgttatgcatatttacagccgcagctgaactataagtggtcgcgcgaccaccggctggtgcctcccaatcacatgctttcctaccctttactgacatatcatgcaccatgatccacccttttgacccttataataacttacaccagccttagacccatatacctgcttactctccatatgggcctcttctgatccaccatactactagaatgccacagctaacgtttttctatttcccccactacaaaaaagtgatcttctgtgaagccaattatcctcgtcaactctcagttttcccgtgcataatagtactacacacctcttcaaagactgtagttttaactagaaaattcggccaacaaaaaacaaatgtatttttaaaagggaggctattagacatcttttaagtccctttgatttatagaaaacatacaaaattttgagaaatttcaattttatataaaaagttttctattacaggttttgcaaaaaaaaattaattaagagattttgcagaaaacttaataagagctcttaatctcttggaaaattttttttgaaatcttatttcgaattctctatttttctcttgcttcaatcaaaccaacattcatttgtttt

SEQ ID NO: 34251 - DNA, 14490 bp, Oryza sativa
  unsure (1)..(14490): unsure at all n locations
nnnnnnnnnnnnnnnnnnnnnnnnnnnnnnnnnnnnnnnnnnnnnnnnnnnnnnnnnnnccctcgcccccccattgtggatccgccccagcatccatcctaaaatataaggtgttatggatattttgggatggaggagaagtatcattgtcgatcgatcaccggctgctgctacccaatcacatgcattttcccccttcgctgccatattatgcaacaggatcgatatttcaaaccctcattttaatttgtacgatcttcaaattaatttcgctggagactatggtggagagctactactcatacagtcatactactagaatgcaacagtaaatgtattaatagtggcaagacaaagagaagaatgggctacagtgaaacaaataatccacaacaataatcaataatcgtgtgaataatagtactccccacgtcttcaaaagactgtagttttaactgaagaatttgtccaacaaaaaacaaatgtatttttagagtgaggtctattagacatctttaaggtccctttgatttatagaaaacataaaaaatttggagaatttcaattttatagaaaagttttctataaaggtatttgaaaaaaaaattgaatcaagagattttgaagaaaacttatcaagagctctaatctcttggaaaattttctttgaatccttattcgatttctatatttttcctatgcttcaatcaaacgagtattcatgtgttttttctgtgttttacaatcatctgtttttgctattgtattgctgtcagaatcatgtgtttttcttatgcctccgtttttccatttatgcaattcaaagggagcaattagtattttgttcttgttttctctccgtaataataaattgcacggcagtctttaaaactaactttttttaagggacataggtacggatggagagcattacgatggatacatgcatgaaccgcgagagtgatacaaactggctagtacagtacaaacagtagctacctagtcgttgtggatacatatgcatgcatgcatatacatgtacatgtatgtatgtatgtacgatcaggacaggcatatatatctggatctgcttaattggatatattattcgtagccttttgttttgtttttctagctacagtgtacactaatagtgtacccttccgtctaagaaaatctaatcctaagtacaaacgtgaatatatatgtgttcagatttatagctaacgttttttttttttacggagtagcagtacttggactgatttcaccgctcgtaattatatgcaggtccatgtcgatggatcctctctcagatcgtctgcgccacacaggacaaaccagtagtatatatgcatcctgaccatacattgtatacacatgtacatacatgtaagggtaattaattaagtctaattaactattgcttccataaaaaaatattacttcctatatcccaaaataaatacagtcgtatactttaaatttggacaacacggctgcatattgttcaaattttgggatgtacaccctccgtccaaaaaaaaagacaaaccctagatttacgtgtccaacgtttgactgtccgtcttatatgaaatttttttataattagtcttttcattgttgttagataataaaacatgattaatactttatgcgtgacttgtctttttaattttttttaaataagacggacggtcaaacattggacacggaaacccagggcttagctttactacatactcctgttctaccaacaatcaattgtctctgtttgtttgagctataacttattttgaattatagaattgacttaattttagaaattactttaacaatttttcatttgctcaaatctcctcaaagtatgttttgttctggtccccgcccggcctgtatatatggtggaccaaaacgacatgtgtatatatatcgtcctgtactatacatatctgccaatctatagctaaagctcgactagtgtgactggacagctagaacctgcaatattccagtctcttgggtatgtatgtttgtcgtatatgcagaagtactattgcagtatggagtatattctttccgtcatgcaatttttgacgttttactagattatttaccatatattaaggtttgaaaaggaatactatagtgatcttattaaataatatatgattgaaacttaaaaataaaagggtgattgagaagagtaagtagaaatttggaccaaaaatgattaatgcatgggacaaatattagtaatactttattgtctaaattttttatgataaattttaaattttagagagagatagtaactagtagtattttgggacgggacgtgtgtatatgttaaactgaataaagtttgggctgtggctaacgtacctgtggatgtaccaagtgtattgtacgtatatgtttgttggtttgtgcagctgtgctagctagctgctactacagcctcttgtgccttgtgtacatttgtctcctatctacagtatctgtttcatatccatagatattagatgtatgagtatccatccatcttgtaggctgctagccagtcagcagttacaaccacaacatcaatagatgcatgtgcaacacatacacacaccttacgtcacccttgctgccgtcaccagcaattaacgttagttaatgctcaatgccagcacacgctttagttgacacactatcacaaccactccctactcctacgcgcgcgtacgagtaacatgcatttagctggaatattgttcaacattcaattcaaggcgatctatatatcatcaactgtttatgttagcgctatcaagtttaataatactgtatatatagcgctacaagaacgtactactctccctttgcaaaatttgataacctataatagaagattagacctattttagaactacgaatttaaatagatatgaataatttttaaattcgtagttataaaatggatctattctctcattttagttcgttatatattgaaacgaagagagtagttttagaggttatataaaaggttagtattagaactaattagcggcaacgttcggatgtgctggcgcctggctgccatagtagagcagcaatgcaagcttgggtcatgcagcatgcagctagctgtggctgctacgatcgtatctagcggcaccgaattaacactccctaacatttagtacgtacgacgctagttataacactgttttcatttttatccttcccttttaatttctgtacttaacgcaactcttttggagtacgtgcaatatatatgtactggttcttgtatgaaaaccgacaccatttatgtcttttctttagttaatgaaataaaatctcggtctttactcaatgagatgtaatcaattagtataaatttgcgtagacaaaattgcacatgaacaagtcataacaagcacaccgaaaatatgaacggggtagtatgtcatcagtacagaaaatagttgagagattagcatgggagtcagtgtaatactagatggaatagagggcgaaatgaatgagatccagaaagagcagactctagctcctgcaaacactgtaagagtacggcctggtttagttcctaactttttttaaaaaacttttaacttttttatcccattaaaatttttctacacacaaacttctaattttttctatcacatcatatcaattttaatcaaatttttaattttggcgtgaaccacaccctacgcttgtggaccctggctatcgcaagtgcatttaatgcagggtcccagcagcaccacatgaatttgcagccgtcctggtggtgtagtggggctatagctagctgtaggtacgtgtacgtgtaaatactatagtatacagggatcatatattagttacgtgctctaaaatatgtataggctaccttgctatcactaatgttttagaacacatatatattgtgttgctgtgtttggtcatatataatatactacccctaccctagaatataaagacattacatagtataatgaatctagatatgattatatctagattcgttgtgctatgtaatgtcccatccgtgctgtatagtttgggtttttttttacggaggaagtatatggttagacacgattactaagaaagtggtaaaattaaatgaaaaaaatgttgtaactggataagaagtgtaggcatgtgagaaaatttaatgatggatattatgattggttgggatcagaatgttggtgaaaaagttattatattttggaacaaactttgatagctaaaaattattatattttaagatagaggaaacattgattgtatgcatgctatatatatatatagaattatacggaataaatacaaacggaagggcctagctagagctaccagctgcgtgcaaatttattccgtataatttggaaggatatatcttgcttcattttgctattagcttgctttggctatcttaattaatatttaaaaaacgaatggtgctgatttgctctctcatctttataaatatgagcactcgtctctctgtacatagagagagtgagagataacgcgcgggcgctagctagctagctcttaatgtgatatgtatacacaatttttcctttatctgtcaaggaatgggtaaatgcatggttgagagaattaattgagtttcagttatagatatatagctggctgagacgaccagttagccatcgtcggtcgacgaccaatcagatcaatcagttaactaattatggatcaggagaaggcggacggcggcggcaggaggaggaggagcagggcgacgagtagcagcggcagcggcgcgagcagcacggcggcggcggcggcggcggagaggaaggagatggagcgcaggaggcggcaggacatgaagggcctctgcgtcaagctcgcctctctcatccccaaagaacactgctccatgtccaaggtagctaggaattaggatcgactactcactaattaatttttattgagttttagtttgctactacaagattgttgatcgagcttatatatgctattggatgactaattagtgttcaatgctggttaaaataatgttcatatatgcactaatttctttggtttgctctaaggttaattagatctagttttgtctcatcggtccttacatgaaatgttaattaatgtaaatccacatgaaattaggctactatactagctagacattgttagagagttcgatcttgcgcgcggtcttaattagacaatcctcaagacttcattgaatgggccggccgggccggcttaaaattgtgtgtctcgatcggatccttccaaattgcttgcatagcataagaaaataaaatttctatatgtcgagattcggatgtgccatcaactcaattccactcattttcttcatgtaaatagttctgatcaaatttcagccaccctgttatatattacccggtgcaacgacgggcattttgctagtagatgtaaaaaatgacaagtaaacttattattagaagcacagagctagggtacaatatttttggtaggataagatctctctctctctctctctatatatatatatatatatatatatatatatatatatatatatatatatatatatatatatatgcgattaattgttgggcagtaaattaattagttaagctggttggagctagcgaggaaataaataaaatgaatgtgcatgcagatgcaggcggcgtctaggacccagctgggcagcctggacgaagcggcggcctacatcaagaagctcaaggaaagggtggacgagctgcaccacaagaggagcatgatgagtatcacatcatcgcgctgccgctcaggaggaggaggaggaccagctgctgctgctggccagtcgacgagcggcggcggcggcggggaagaagaagaagaagatatgacgaggacgacggcggcggcggcggtggtggaggtgcggcagcacgtgcaggaggggtcgctgatcagcttggacgtggtgctgatctgcagcgcagcgaggccggtcaagttccacgacgtcatcaccgtcctcgaggaagaaggcgccgacatcatctccgccaacttctccctcgccgcccacaatttctactacaccatctactccagggtatgtactccaccaccacctatatatacgccaactaattaatttattatatgtattcgtcaactaattaataactatatactagttcattcagatataattcgcatcatctatctctgctttcagatcgatatatactcaattaattagacttcttcttgaactgtatgcaggcctttagctcaagaattggcatagaggcttcgaggatttctgagagactacgggcattggtatgacacctgaggtaccagatcataactgtatatatatgtcttctacacatatatcattccataaacatatatatgtgaatgtatttatataatgccatgcatagagagctggattttcatttttctaagagaacatttctttgtaactgcttgctgcaaaagtacatttattcttatgtgtgtatgtacttgtagcaggtgatccggtcttgaaggattttgtgatgggcttggcccaactataacctgggctagctaagaatttccaaatgggcctgatccaatcacctcatgagtagtccagtagatatctcgatatatctctactattataaaaattgaagatgtttttgccgatactttggtacgtcatccatgtatgagtcggtttttaagttcgtttgcttttggaaatacatattcgtatttgagtcaatttttaatttttaagttcgttcgcttttggaaatatagaaggagtcgtataagaatttttttaaaaaaactcgcatgctaacttgagacgatcggattcataattgcagctcataattttctaaaaacagaatatatatatccaagcaaattctcacataactaaaccatataacaataatagattaaaataaataaataatgttcacccggtgcaacgcatgggcatttgttctatatattatagaaaaaaaaagtgaaaattgatggcgacaaaaagtaacctatataaatattaaataagttcaatggaacgctactgcatgcgtgtttgcatgtaaacgtgacgaatatagtttatagcattatagtctaccttggttagtttctagaataattaattaatcatgtatactttgtttcatatctggcaattgatatctcgatatagcgtgccgaagaatcgcgagaggaatccccttttccttctgctgagaaatatgaatggttgattgctctactacttaataataaaatcacaatcactctctagtctctactttgcatctttacctaacactccacatgtactagtacacacgccatgataaaattagtgccagtttccttcaataaataaataaattagtgtcaggtagggtccattgagttgatcatcttctttttttttttttagaactgagttgatcatcttatttatacttgggtttctttcgacaggccagcaatgagtaatataatctcattacatcacatgcatggtgcgactatagtactttaattacatgatactattgtgtactattgctgcacacatatggtggataatattgcatattatattttaactagcaaataattaattagcataggctgaccaggtgtccacttgcaatttttttaggggagaaagttgcagcttaattaagttcagatcatgcatgatatagctagctattgcgaaggacgtgcatgcatgttccaatcgttagctaagcacgtaccccccaactgtcattaaccgttaattacaaccgccacattaaacttaaaattctgtaatgttaaattgtttatttattaaattaagataatcacttcgatccactcgatattgttgcatgtttttggataacataagtatcatgggcttaatttgcaaaatcttaattaattttttacgcgtcgccctatagtgtgtatatatatatagatactcggttagtacgcaacttcggctggagtataatttatcatcagatattcagatttctggaagcttaatatttaatttagttagtcgtaggtatatatttcacgtggcatcacactgaccgagggggggaacttggatgaattcgattatataaatatttatacagtatactgctcttgcaacgtggagtaaggacacatatatagctccaacttctaagtttggtgttgggtctggagtggagttgagctgtgagctgtctaaacccagctatacttctctagttccttttgtgatagggctccacctagctctgctactattttaggtggagctgaaactgtttggctgagaggtgaagctggagctgtgccaaacatgccctatatatactccttatgttctgaacaatcactacctccgctttaaaatagttatctttctaaaatttaaaatttatcctgaaagacttatcactctagttactacttatcacattcatctcttttcattcaaatttctttctattattgtatttttcaagtactactcaactttcaaccgtatatcatttaggccctgtttagatcccactctaaaatttttcatcctgccacatcgagtatttgaacaccagcatgaagtattaaatataggctaaaaataactaattacacagattgtgactaatttgcaagacgaatcttttaaacctaattgcttcatgatttaacaatgtggtgctacagtaaacatttgctaatgactgattaattaggcttaataaatttgtctcgcggtttaccgacggattatgtaattagttcttttattagtgtccgaataccccatatgacaccctatataatacctgacgtatcacgacgaaactttacacccctggatctaaacaccccattaggagcactataatctcttttttaaccattatgctagataacgtgttttttggatggagaaagtactccattcatcataaaatataataaccgagaatcaaataaaaagtatctatgtccactcgtagtattttctaggttgctatattatgtaaacagagggagagggagtaagtgtgaattactaccgtgtactccgatctctctctggatatacatacctccccgggagaaggcgaccgatactttccccttctctcgttcccctcctccctctacagtactctccccaaaatctctcctcaccggcccctcttccccttcgattctggcggcttgccaccggcgagggttggaggagaggtccggccacctcccctctactagtattaggttgttagatctattattaggtcgtcaggtgtctcctgtagttagggtttgtccctaattggtcttttgccgacgagctccatgggtgccggtgtggtcggatgcggcggcgggtggtggcggtggagatgcgagatccgaagaccggtggatgaatcgacggaaaaggctggttccttgcggcggcggcggcggctacatcgtcgtcggcaatcgggagaagccggctccttgcggcggcgccagttgcttcgtcgtcggcgtccgggatgtcactgtcctgatgaatcgacagaaaaagctggctccctgtggcagtgtcagtggcttcgtcatcggtgtccgggaggtcgctgccccgttcctagagacggcggcggcagcttcttgaggcctgcttcgccagggcaagctatcgcccagagcttgctgctcgtggtgcttgactgcccgttggcgaggtggcggcgattctgccggtgcatgcttgagtgcttcctatgccatggttccataagtcaagtctcgcaggatttctctcccccattcccgcatgtcgatccaagaagacagcagtttatttgccaccattcgagtgcttcagtgggtttggggatctggatgtgggctccttcttcctctgtgtttcccaccagctcattccatgcagggtttgttgttcgggttgagctcacgctcctcagatttaacgacgaactccgtggacttctcttgctgagtccggtgatgctccctcaaaatctacggcttagcagcaaacctccgttttgtgcagtcttcgtggaggcaaccggatggagattaccggtttgtcaagcgtgctgcacgccaaaggaggcccaaggttgcattcgtcgcggcattgccgcagctccctgtcgatgtgcaccttctttgcagtgtggtttcatcacgaagtttgtagccttaagtgcagtttccccgttctttcgaaacggatggttttatgcttccttttgatctgtttgcaatgtactgggatttattcccgtgaactctgtcgccctgtattgatggatgtttaagtttaaaaaaaaaaaacatacctccccggggacggagggagtatctctgtttatgtgaacgttcgtacggtctgatcgacacgcgtaagagtgatgatcagacgcggttgatatatgcacgttagtcatcctctcttgattaattaattagtgccacattttcagcatgccaaaggaccctaccggtaagataaaaaccttaaaaactactccacgtttatataattaaatatataggaggagcagtcaactctgcttctccaacgtccaataatttttactagaggtagcatgatatcaatttaattatgccacttttggtactcacaaaattacttcaacctctattatactccctccattatagtttagggccaatttagattgctaccctaccaaaatttgtcctaccaaaattttggtagggtagcaaaccaaacacctctactactctaccaatgctataaatttggctttgcctatgaacttgtctcttataggcaaattttggcttcaatccaaataaatattttcaactctactctaccaaaattttaatagcaccaaaacttgcccaagatttggccctaccaaaattttggtagggcatcaatccaaacatgcccttaatcatcttaaaaagagaccaagatcaatgacactaagatattcatcactctcaaattaatcacatcaattaagatgcttcatcgtttcgtgtcctatcaattaccaatagaagttaattttgaatgtatgcatacaacacattcaaagaaagacgcagcatattttgcacggcacacgtactgtagcgcggttgggtggaggaacaacgcgccatttgagtttgacccgcatttatctgtcagaattaataaaaccatccacaagccacgcgcatgtgggacctgcatgtttaaggcgagctcaattgaattaatatccttttattggaagttggaacagaggctttaatcaattaaaaacttgtgccagctcgggcgcgatcccgtttgaacacgcaggtgtctaatttaattgttgttaaatctatgtttagtttatacgatttgatgccatttttaacttattttacggttttacaattaattcaactctagttacataatttcgtgaattcaatagtttcataaggctatctatagtcgttagctggcattgctaattttggggttttattgagagggtagtgggctctatccccttcccgttgttgtttggaatcgcagtaacccagttttttccttggtcttttattgttttccctccttccttggtataagtcggtctggttgattgcattgtataacaaatattcttttcttctaatacattgacgtgcaatccttttgcgcgttcgagaaaaaaaatcaataatttcaaagaaaacggtagattaagagtagttataatttgcaaattgtaatctgtagttattagttaagttctcggaaatcaaaacttagttttaattagtacctttcagaaattagtctgtagttattagttaagttctcggaagtcaaaacttagttttaattagtgcctttcagaaattagtctccccgggaaaaaaaaagtgtctacaatatggagaggatatatataaccacatgtcaatatattgtcaccacgccagatcgacacatctgtaatggatcaaaatgcctcgttacgcaaatgaccttatctttgatggactagactgaagcttgtcgttctatgtaaggcttaatttgggtatagagtgatctacctatgaatttaacttgcacaatcacaaataatctaaatatatgggagtatagtgtatatgcctaataaagagcgatcgatcgaatcatgcaagtatgcatgcatctcttcgccaaaaagaaaaaggaaataaaatacatcataaatggacggagctaactacagaggtgagaacagaacaaaactatatatagctctaggtcaacgccctggaatttagcacgggaatgtactaagttaacactttgatgagttgagattacgacataagctagacaagttgctcgcagccactggttgattgattgctttcaagcattttgtgtttctttaaaaacatactccaagctagcaagagcacagacgtgtgcaaatcatcacgtgtacgtgttcatttgcatctgttccaagaaattaaaataaagtactcttgtagtaattaactacatacatgcacggttgaattgtttacaaaccgatagtagttccaactggtacgtagttaatttcttgcaacaaagactgttgagaatgataaaaatacgaatcaactagcatgaccatcaaaataatttattcatgacatatggagcagaaaatgcatgcagttggaagatgtgatgtgtgactgtaacaagatagtactactaattaaaaagcatcaactggtgatggtgaagcagcaatttttatttcttgtttttataggcatgttgaccatgcaagtagctggccaggtttgcaactgtaataccctaattgtaaacatggaccttcttcgtttatttaatttcgagaaagcaattaacaaaattgttatatgtgtcttgtggcacatgtttgattgaaaattgatgttgtccgggatggtcgtttgcccttgtacagtggttgaattgttgccagactagtccgagataaaatttataggagaaaaatatgaagaaatagtggtggcacagagaggctaatccagttcacaattcacaaagaagagtagtctgcagggggtgatatactttaaggatacagtgaggagagattaattaggaaggtaaaaaaagaatcatgatgtttgcttaggctgtgttctttccctattttcccgaccagcctctctcgttttccacgcacacgctttttaaactgctaaatattacgatttataaaaaaaactttctatatgaaagttgtttaaaaaaaatcaaattaatctattttttaaaaaaatagttaatacttaattaatcatgcaataatacgagcttcattttacgtgccggggaggaggggttcccaacccctccttccgaacatagccttagtaaatgcagggataaataattaggctgcgtacggtatatcactttcttacctttttgcttcattgattttcacacgcatactttataaacgttcattgaatggtgtattttaaaaaaatcaaaaaattattttaaaaatcatattaatatatttctcaaatttagtgagctacctcgttttatgtgtaaagaaaagttccccaactcctcctgccgaaacaaaacagggcggatccatcatgggagcgttggggctcaaacctccactactgtcatgaggatcatgggagcccccacgaaaccctaacaatctttttttttttgccatatgtagattggaggagggttgtagctctgttttattttaatgagacccacctattttttctttctcgatctggctcaaacataatacttcttagagctttctagttaagaaatattgaagttccctacgaagattacccctacaaaaatgttagaatcggatgcccactcttggcgggcttcaaaactcccggatgattttcaccaggccaacatggtcatcatatcgatccctcgccttcaggttgttgatatactttatgctggctaatttatcgccttcaggaattaatagtgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggtcgggttgcgcttgccccggccccgagggccgaggcaccccgacccccttaaggaagtctgcgccacatatatgggataagtgagcacagctgtgctcacctaacagcatttattgcagtctggtcaggcgtgtcacgctgcnnnnnnnnnnnnnnnnnnnnnngaagtcgcatatcaaanntctcc

SEQ ID NO: 34252 - DNA, 19409 bp, Oryza sativa
  unsure (1)..(19409): unsure at all n locations
nnnnnnnnnnnnnnnnnnnnnnnnnnnnnnnnnnnnnggtctgtgaccagtcacagaccggtcagatcacgggttaggtggcgactggcggtctgacgcacgccttaccccatcccgtcaaggtgtgagcttctaagcactcgtccccagctggagctagcgtgttacatcccagagatggcacgttaaccccgatcgatatataccaggcttcatcctaaccattacaggcaaggtgttacacaaggaagggcaaacatgcatgttgttaaactgacgcgtggtggacaagaatgaccggtctggcactggtcgcgtcagcaacgggcagccacgatcccacgttgcgcctgtctccgccgggagtggaggtaggtgtgggctgtcccatcggagtgtcattcggacagcaaccataccaatctccgtcaataaagagaagaaaagtccagtttggaaagggaagggtgcatgtggtatccccttgaagtataaaaggaggaccttgcccatagagaagggggggattcttttccagatttagagcttagaacggggaagaagttggctcacacttggtagctcattcatacacaaatccacaaaaacacaggagtagggtattacgcttcgcagcggcccgaacctgtatacatcgccgtgtctcgtgtgtcttgcgggcagacgatctttccagatacagagggagagcgagagcttgagatttcaccctaagcccccggccgaactggcaaagaggggcctgcgcggtctcccggtgaggagccacgagctccgtcatctggcgcgccaggtagggggctcagcgtgtgttttctgagctctcagactcttccgtgtgcgccaagtttttcttgttcagcctaatggccgagcaaggaaaagcgcacgacctctctccgagtgcgagcggcgacgacggggagccaaacccacgccgtcgagctcgtactcccccacctcctccacaccaaagtcctaagcagggggaggcgctcgagagggttgataaatccgcagcatcaccggtcgcgggtggtgcaggagaacggcgagatggggagcgtcgcctccttgtctacggcgacggcagcacgcctcaaggcgcgcttcaggctgtcggcgcgctcctacgtcacccgcctgtcgtccctgacccggagtctccagcccagcgatggctggacgatgtggccaatttggtcatgacggcacaacagcgcctgggtgctggtggacggtccgccaccaccaagacctccggcgccgctaccaccggctccgtgtcgtcaaggcggagggcgcggcgagcggcggctgctgcgcgccattcggccgccactccctcgtcgacacctccaactcgggaggatcagcatggagagccggatgcccgcatcgacatcgagcgccggcgtaataaccggcgtactccccgcgcaacggagggcgcctcttcgtccagagtgtcacctcgacctggacatgagaatcagccctccgtgcccccggccggtggtgttggctgtagagcctttgtggcgagtcttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggatggctaatgaacctgccacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccatgcatccctgcgcacgcggtgatctacgcgttcagggggggcgtgcggcacaactgcatgctcgaaaagatcgcttccaaagagccccagactaccgcggagctttttcagctcgcggaccgagtggctcggaaggaggaagcgtggacatggaactcctccggttccggagtggcagcttcggccgcccccggatccgccgctcagacagggcggcgtgacaggaggaggaagaagaggtcggaccgttccggcgacgagggtcatgtcctcgccgtcgagggcgctccgcgggccactcgaaaggggaggcctgcgtgcgacaaaaagaaagaggctggtactcccagcagggagcgccccgccggcaggtggtgctccgtccacaacacctccctccacgatctcgcggactgtcgtgcagtaaaaaacctggctgagcgaacgaggaagtgggaggaggacaggaggcaggaacgccgtgagggcaagtccccggcggttccttccggcaaacggcgaagtgaggccaagcagaaggcccccgctgttgacatcgatgatggcgatgatgacctaggtttccaagaacctggggccaccatagccaccgtcgatggaggagcgtgtgctcacgtctctcgccggagcttcaaggctatgaagcgagagcttctggccatggtccctactcatgaggcgatgcgtcgggcgcggtggtcggaggttgctctcactttcgaccagaccgaccacccaccgtgcattgcctggggagggcaggttgcaatggtggtttcccccaccatctgcaacgtgaagttgggacgtgtcctcatagatggaggagcggccctcaacatcctttcccccgcggcctttgatgctatcaaggccccggggatggtgctccagccgtctcaaccgatcatcggtgtgacgccggggcacacatggccgttaggtcacatcgacctaccggtcaccatcggtggacccgccaacttccgcacggagcgggtgagcttcgatgtggcggacctcagtctgccctacaacgcggtcctagggaggcccgcgttggtgaagttcatggcggcggtccactacgcctacctccagatgaagatgccgggccccggtggccccatctctgtccatggcgatcttaaagtcgcgctcgcttgcatggagcagcacgccgaccgcctcgctgccgcgtccaagcccgagggtggtgacgagaggcttggcacctccgcccccaccgccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggctagacttttggaggccgggttcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcatcgactccactgcggggtgcgaccttttgtgttttctagatgcatactctggttaccatcagattcgcatggctagggaggatgaggaaaaaactgcgttcattacccccgtaggaacttattgttatatgtcaatgcccttcgggttaaagaatgcaggtcctacttttcaacgtactactcgaatttctttgggtagccaaataggacgtaatgttgaggcttatgtcgatgacttggttgtaaaaacgcgcaaccaagaaactttactttcagatctagcggaaacttttgagaacctccgctccgcccgcataaagctgaaccccgataagtgtgtgtttggtgtacctgcgggcaagcttcttgggtttttggtctctgcccgaggcattgaggccaaccccgagaagatacgagctatagagcggatccgcccccccagcaaacttagggatgtgcagtgcgtcactggttgcatggccgccctaagtcgtttcatatcaaggctgggagagaaggcgcttcccttgtttaagctcctcaagcgctcggggccgttcacttggacggaggaagctgaacatgcccttactcagttaaaggcatatctcagctctcccccggttctagtcgccccggagccaaatgagcccctgctactttatttagcagcgaccccccaagtagttagtgcagcgttggttgtggagcgcgatgaggacaatcctcattctgcgcacccccactctgtgccgacttggcccgggagcaggcagggaggagaggcccccgagtcgaacggtggcctaaggcccccgatgaccggagtcggccctctccccgcttgtcagacggtgctgggtgcccccgaccctcaggaaggccccgaggccactgcgggaaggccgcacctatcgccctttggccccgaggctaaccctgtgctgactcgacccgggagaaagcagggagaagaggcccccgagccgaacggaggccagaggcccctagcgaccggagttggccctttgcccgcttgtccgacgatgccaggagcccccgacccccaggacggccccgaggccactgagggaaggccgcccctttcatcctccgaccccgaggtcatcggcacagaagacaagtgtgccccgaaaggccacttgaacgaagaacgccccgggggtgcggcccctagcgaagaagatcggccccgccgaaaggtgcagaggcctgtctactttgttagtgaggccctccgggacgccaagacccgatacccacaggcccagaagatgctttacgctattctgatggcctcgaggaaactgcgccattatttccaggcgcatcggatcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagactgtctcaatacccgaggccagcacggacccctcacagctgcctcaaaccgcccactgggtgatgcagttcgacggttctctgtctctccagggcgccggtgcaggggtcacgttgacctctccgaacggagacgtcctcagatacttggtccgtctcgactttcgagtgactaacaatatggcagagtacgagggactccttgccggactcagagtggcagctggactggggatccgccgcctcttggtattaggcgactcccagctagtcgttaaccaggtctgtaaggagtaccggtgctctgacccacagatggacgcctacgtacgccaagtgcggcgtatggagcgccatttcgatgggatagaacttcggcatatacccagaagggataacatagttgccgatgaactctcaaggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccaaagggagcgctccaagctcccttagattgattgcttggatctctgagatccaaacgtacctcacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgctgacatccatgagggcgagtgcggagcccattccgcctcgcgcaccctggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgttgcaatcgacaagttcactaagtggcccgaggcttatccggttgtcaagatcgataagcactctgctcttaaattcattaagggcatcacggcccgttttggggtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcgaccggggaaacgcctttcttcctcgtctacggcgcagaagcggttctcccgtccgagctcaccctgaggtctcctcgggccaccatgtactgcgaggctgatcaagatcagcttcgcagagatgacctcgactacttagaagagcgaaggcggcgcgcggccctccgagccgcgcgctaccagcagagcttgcggcgctatcatcagcgccacgtccgggcccgatcactctgcgtcgacgacctcgtcctacgccgcgtccaaacgcgtgctggattgagcaaactctcaccaatgtgggagggtccgtatcgagtgatcggtgtcccccggccgggctcggtacggctggccacgggcgacggcacggagctgcctaacccatggaacatcgaacaccttcgtcgcttctacccctgaggaagggggggagtcgggtgtcaggttttggcttaggccaaccccgcacccccctcgggtgtgcagggttggccgggggctaccacacatgcacagtcttacttttcttatttcagcatttcaataaaagcagtttcaattttctaaaggttgtgtctgtgccgtttttttccttttgaagaatcttgacttgaaataatgtcactcgtgctcaaccttgccctcgggggctcggttcggtcagctaaaatcgccaaacggggcccagaaccgagccgtgccccagggcgtggtgaactccgggggggaatcggcaaaaacccacaatcgggtcacccataaccctcggtcaccacgttcccggcctggctagtctcgacatgcggatctccccaggcactagccccgacccgcgcttttcgaggactgggacttgggcacgggcccttatttcaagctaagacgcaaaaagaccacggcacagatcatcctcatctcatatatagcaaaataaaactaacacaaaatttttttcatcatttctcattgcagattaagttaaattgtacgaaaaagaggcatgaaggccttagaagaaagaacaagaaaaaagttaagattggcgggggcctgggggctcattcaaatgcgcccgggtcgccggcctcgtcgccaccgtcgtcctcgctgctggcgtcgccctcctcgtcggagctgggggcgaacgcgagccgaggggccgagccctcgaagccgttgacgatgtggtcagcagcatccccgacccgcgcgcgcgcgtcgtcctcggtcccgggagggaactcctccagcgccatccagggagagaaattggggtcccgggcctggtaactcgctagcacgagttcaaccgccccccgggcgaggtccctcgaggatgacttgatggtcttctcgagctcctcggggagtcgttcgaggacccaggccatcctgttgaggtgcggagcgaggccttccagattggtggggggcaccgtcgtctggcctctccagaggcctgcttgccgaccggcgcgcttcatgcgggagaccgcatcccaaagcatgtcgggcccaatctcgcccgccaagcgaagggcctcggcctccccggtagaggagtccagcgctcgctgcatttccgcgacggtgtgttcggcagctgcgaggcgggcggctaagtcgctttcgcccgcggccgccccgccgataggcgcccttgcgtccagctccttttcccgcgcctcgaggtcagcagcccgctgctccagtgcggctctctcggcgcggacgcattcgagattgcggcgcgcctgctcctcctgcgccgcctcgcgaagggacaggctgtccgccagccgtttggtcgtggcctcagcctcctcgagagctcgctcccgctcagcgagtgcgtcctcgcggaggcggagcgcgcactcctcctcggcgcaggcggcctcatgcgccgccagcgtcgcctctcggagaccagcggcggccttgcggtccgtcaagcccctatccacggcgccggcgtgttcttccagcgccatggcacgggcctcaagggcctcctcgcgccgccgaaacgccgcttcagtctccgttacccgccgctctcgggcagcggcggagtcaaggaccccttgggcggcgtcgagctttttcttcagctccgcctcccagcttgcgtgctgaaggcggagagtgtcttgcgcctcgatcatcgcggtggtagagatgagggcggccgcccgctcctcctccacctcacgggcgatctccgccagcgccgctttccgggcttcaagctccgagacatgacggcggtgagccttacggcccacctccaccatggcgtccaccgagcgccgcccctcctcaacacgcgcccatgcggcctcgagctccgctcgttctgcacgcagggcctccacttgggtgttgaacccatccagcactgcggtgtttgcggcggccagggcctgcagaaggggctcggcgctcagcggggcgacagaagatgaggagaagagccgccttggagaaaaggcgacgcggcttggccccccggaggatgcgctgggctcggggatgtcccccgggcccgtttggtcctgggcgtcgcccggtgaggtaggcccaggcgatgcgcccgcggcctcgtcgcgagccgcctcggaggatgtcgcctgagggccgcccgagggagtaggcccaagtgacgcgccagcagcagctgtcgcctcagcctggcgagcccgggcggcctcctcccgggcagcttcttcggcttggcgagcccgggcggcctcctcccgagcagcttcctccgcttggcgaacccgggcggcctcccgggcggcctcttcagcttcccgaaggcgggctgcggcttcacgccggtcagactctcgcctccgctcctctgcggccgctggatcttcggcctcggactggccggatttggggtggcgggaggaatgcgacgggacatcgctgaagcagaagaaaaaaccaaaagacgaacaaaatgagtaagaaaaaacttctctttgggagaaaggtggttgcaatgagagtgagacgaacctgcgagggggtcggttgaatgaccaccttggaggagaaatcaggttcccccggcatggttccgtctcccccgtcttgcggagccgtttcttcttgcgctccccctcgggctgcgacgtcggcgcggccccctccgggcgccgactgctggcacgcgccgccccgccccctcggggaggagatgggggaggtgttcctcccagcttcctcttcccctgggcgtcggcagggcggctgctccccgagcccccggcgcggggcccagaagcacgaccccctcttggggcagattgttcccctcggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccgcggagctaagattcagcaccctttggaccacgatcttgaagtcctcgggagcccaatcccatctggctccctggtgggtccgcatgtagtcttcaggcccagtgtactcccaggcgttccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggtgcccgccagctggagacctgcgccgggggctggcttggaagtcggaggcgcgcttcgttggcgaggggggtgtagaaccagtcgctcttccagtcgtcccacttcttgcgaaggacgcaggggatgtagcggttcaataccggcccccgcggctggaagtagcagccgccaaccaccgacggcggtgacaccgactgcacggtgaagaaccaccggaacagctgaagagaggggcgcaccccgatgaacatctcgcacagatgcgcgaagatggccaatgtcatcaccgcattgggggtaaggtgcgccatctggaggtcatagaactccaggacatccatgaagaaatgagaaaatggcgggaccagcccagccatcgcgaaggggaggaagaagatggaccgccccgggtagtctggtgccgggcgcccctcgcccagcatcactatctcccgaccggtggcggactccggcatgaagcggcgcggcagtccggcgtgcctctcattcacgatgcgggaaggcggtagtacactgccgtcgagcagagcagagccccgtgccatggcggcggaggaagagatgattgagaacgagcgcgtgtggcgaaagtagggcgtagcagagaaagagttagagctcaggtggcgaaggcaagaggaacaatggcgaaaggaaggatgcaaatccttttctcgatgcttttatacccttgccatcgctgggcctgactcctcgtttctcgcgcccactacctcgctccctcgtatctcgctatctcgctccctcgtttcccgtgcccacgcttccactaatcccattcgcccgcttacggcgcattgagtggatatgcggttgtggcaatcgaaatggattgtatcgtgcgcgcgttaattacgctcgccgtccgaagcggcgttaccatatctccgggcgagacgaatctgctcacccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcacagggtggcgtcacacctgaccgcttcccttgggaagggaaattgctctggcataacgccgggggctactgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggtcgggttgcgcttgccccggccccgagggccgaggcaccccgacccccttaaggaagtctgcgccacatatatgggataagtgagcacagctgtgctcacctaacagcatttattgcagtctggtcaggcgtgtcacgctgcatgcagcgcagtacggcgcgttcctttatccggtctgtgaccagtcacagaccggtcagatcacgggttaggtggcgactggcggtctgacgcacgccttaccccatcccgtcaaggtgtgagcttctaagcactcgtccccagctggagctagcgtgttacatcccagagatggcacgttaaccccgatcgatatataccaggcttcatcctaaccattacaggcaaggtgttacacaaggaagggcaaacatgcatgttgttaaactgacgcgtggtggacaagaatgaccggtctggcactggtcgcgtcagcaacgggcagccacgatcccacgttgcgcctgtctccgccgggagtggaggtaggtgtgggctgtcccatcggagtgtcattcggacagcaaccataccaatctccgtcaataaagagaagaaaagtccagtttggaaagggaagggtgcatgtggtatccccttgaagtataaaaggaggaccttgcccatagagaagggggggattcttttccagatttagagcttagaacggggaagaagttggctcacacttggtagctcattcatacacaaatccacaaaaacacaggagtagggtattacgcttcgcagcggcccgaacctgtatacatcgccgtgtctcgtgtgtcttgcgggcagacgatctttccagatacagagggagagcgagagcttgagatttcaccctaagcccccggccgaactggcaaaggggggcctgcgcggtctcccggtgaggagccacgagctccgtcaaatagttatttaatttatggctactaattactatcatattttaatatgtaagaccggataagacgtttcttatattttacgacggaggagggagtactatattaaaaaaaaatcatgtgagggcatatattaaataaaataaaaaaaggaaagggaagaaaagaaaagaaaagaggaagtcagtgacgcgtcaggcagcagacaacgtgggtgtggtgcgcgggagggtgggccccacacgaaaaccctggggtcacccccatcccatcaccccaccaggatggatctactgtaagcaccagttgaccgcatttcatttccctcctccctcaattgtgttgttgttacacacacttgccacccgctataaaatgaaccagagcagatcgaccacccaatccaacccaaccactcatcatccatctgctactgctactgctagctccatccattttattctagctccatccatcctttaagagaagctgagatcaagaaacgtactcactcttgcctgcatcgatccttgagtttaattaactcaaggaagaagcaatcttcgcttcggtggatgaagagcaggaagaacagcacgacgagcacaaaagcagcaggcagctgccacaccagcagcagcggaggaggaggaggcggcggcaactgctatagcagcagcagtagcaagatggagcgcaaggatgtggagaagaatcggcgcctccacatgaagggtctctgcctcaagctctcctccctcatccccgccgccgctccccgccgccatcaccaccactactccacctcctcctcctcatcgccgccctcctccaccaaggtactactctctttttatccacaacatgcatcaatcatcctcttgtttcagatactcctccatatgtttgttagtaattgctgctgcaactgaaatattttttacatggatcgaccggaccatacattaataatagatccacacatatatagtggagtacagtactatatcacttgcaacctcctgcttactgaaatatgctatgtagtattctgcagccattttccttctctaactacaagcctagctagcctcttcattcattcagctcaaccccctccatcgatctggactggactagtaattattttcttctctaccaggagtatatatgctactcttaactcctggagtaccatagattcttgcttgtttgtaaccacgcatcttctttaattaaaatcacaaacactaccaaattaatgatcaaaatcaggttacgtaggagtaactgcgtgcacacaccattcatttactgcctttttaagctgcatatatataaacagaggcgtttacagatggccgcgaatgcgtgcgtgcgtgcgtgtaaaaaaagccaagcaaaaaaaagttaaaagagaaaagatttcaaaagggttggctgggtggctaaaccttttttgaattttgagggtcaccaatgttttgatacttacggagtggaaatgatatgagttgacatggtaattggtttttgtaggactaatactagtatttctgatagtggagtataacaattagtggagcagtatcttctttttctactagtagtaggattgagtatctatctgtgtttgtgtgagtcgtcgtgcactcgaacgacttgagctacagtttcaggcacgtgctggaatagaatatatattttgatatgactgattttgtttctcaaaaaaaaggcccctcactcacttagacagcgatgcgcttccaatggatggatctcgcatcctttttactagtactattttctttccttcctttctttgtttgtaagaaaatattttgtcaatggaagagtagtccagttgttttggctgtagccacgtgacggattggtagagcacaacactaaccgacgaacaacacaagctcaatataatcaattcacaattcacaaacagtgcagatcattgttctgctcaaactgaacccaccaataattcattcatccagtgacccacctaccactacctcaaatccatccaatccagtgcgttcaggtcacagcagcaatcactttcaagaaaggaattccttcctcagcatcccttgcagaaaaacaaacaaaagcaatgctactaatcatgccaaagttcctgtttccaatagttgaatactggtacaacgatgagcttgacacctcaccttacagtgttggatcaacaacaacaaaaaaaacgtggaaaaagtatgtagtagtagtagtagtaactgaattaaactgtggtggtggtgtactgaataattaaaatattactgatggatggtgcaggaggctgtgacgcagctggatcacctggagcaggcggcggcgtacatcaagcagctcaaggggaggatcgacgagctgaagaagaggaagcagcaggcggcggcactcaccaccagcaccagcaatggcggcggcggcgggatgccggtggtggaggtgcggtgccaggatgggacgctggacgtggtggtggtgagcgaggcgatcagggaggagagggagagggcggtgcggctgcacgaggtgatcggcgtgctggaggaagaaggcgcgaaggtggtgaacgccagcttctccgtcgtcggcgacaagatcttctacactctccactcccaggcgctctgctccaggatcggcctcgacgcctccagggtctcccacaggctgcgcaacctcctcctccaatattaattcacaccactctttcactctgctcagaatgagataatactctctactctactctactctgtactgtgatgataagaagtataaagagtagcagaccagagagcctctaggtagctaggttaattagtgagaaacaagagtttacactaagctaatggatggcatgagcgggagcaagctgttattactactaactcttggctaacgtttttgtatcccctagctagctgcctgccctacgtatatgtctccagtctatcatgtaggagtactccagtagtatactgtgtgtgagtgttctcttttgtgcctgaaattaatccagtccgatgtaagtacgtactagtatttggtttactgcatgctctctagcctcgcatcattatttttgagaggcaatgatgtgataatccttaaaatgggggcagtctcttcttaattctatacaccagcaaattcgccttgctctttcaaaaattataatgggggcgatccttggaaaaggaatcatggctttgagaaatatgcagaaagaagtaagccccaggaccagatatgatcctctgcatttagctacaagaaggatgtggattacaattgacacaagtacaatagcagaacttactactgcgtaggagtatttgctacttgtatgaaaaggtggaagcagaatttcagtatccgtgttggcgtgttgctatcagagaaacgaaggtggtatagtggctgttgtgcatgtgcctaactattgttcgtactactacgagtagagtatcagtatagtacttagtactggagtagtatctaagtactagaaagttggttaactgatagtgatgtttggaagaaatggagaaagaaaagaagatgatacagcaattcatgcacgtggctcaatgcatacaaacgtttgtgacggactaaatacaggaaatgagcctgaaaatgacaaggtcacattttagccgaagcagcttcatctttacttactctagtagtagtacagtagagagcaactcactccaatcatccagtgggtcgatcgggcagaggaagtagaaagcagagcagaggagaggagaggagaggaggaatttggtcgagctgagcctcaaattcctgagaaggtgtgagagatggagcctcagctttcgcggtgcccggagacggcaacagcacagccggagaaaggatcggagccgatcgaacggcgacggccacgttcccccctcccctggctggcctgaactagaactagtagtcctaaaactttggatttgcctggccatagaaagaaatgttctggtttatgtggaccctgtgcaccgctgagtgttagctacagggatatgatatcctggattacaagcaaaaaggatttgatgccgcggtagccagaatttcagtttcagtgttaccgtcggagagatgaaatgaaggcagtacagtgaagtgagtggctggtgtgagtgcttggcccgcgaaatgtaccattaggatgacataaaaccatactagtagtaacatgattcaaccctgcttgagagagtgatgtttggaagaaaaaataaaataaaatataatgtagaaaaactagtcgaggatgaaataattgatgatgcatgtgggtgaatgcgatttgtggattgaaggatggatgtaaacgtttgtgagcgatatatattggatgcagggaatgaacctgaaaatgacttgtaacatttgcctggcagccggcggcttgatctttactgaggacggaggaggaattacgttagctcgagagatagagagactactcctgcagggaagtgaggcgaggaggaagaacgaagcaattaagcaggaaggaaggagagagcaacagcgcatgtattgtatgcagccggagcgccgaggatgcggcggcgccggcattggggcaggagaaagaagaggtcgtccaacggcggagacggagacgattgattgggttcccgatgggccgtttctgacattcagcccacggcccaaaaaccaccctccatcgtgccgctcttcttcctgggccgaacgctctcccatctcttctcttaaaagaaagcccaccgttatttgtctgtccatcgagaggattttagttttttttttgttttctcggagaaaaatgtagaattttttgtttcagaacaaaatgcttgcgaaagaacgaaaattgaaggagaaaacgaaggactgagacaattgaaggagacgtccgatttgtagtttgcctgtactagtacggtatgtgtccaggcatttttgttttctattttaatttctgatgagacgctgattacgaaatgaccaagcagaactgaactgtgctataccatactatgtgctgcttcgcaacggaaaagctagtgggcgatcaatctcccctcctcctccacgtgatttccttttttggcaccatattactttcctattttagtaaatttatacatctaaagtttgtacatctcaagtttacacatctaaagtttatacacataaagtttagagacccaaagtttataagtcaaaagtttatatatatatagtatttctatacataaatttttctaactatttttttattttttaaaaaaattatggtgtcgtaggaagagaagaaggggagaaagaaggggggagaggagccgtatagggaggggatgggggtcgattagggctcccataggatggcctattcaaccaaagaaaaagccaaaatttgaattttcaaacttaattttgatattgattttgaggtatttttaacgtagtttatttttcaacattggcttttaaatcaccaagaacacatatataaaagttttacctataaatttatttttatcctctaataagccgttaaaaagccaaacgatgaggcactagctttacccgcttggcaaatccagctggagtagctccctgggacgtgacgtggcttgggttgatttactagagtagtatttttttttcttaaaacgaaatgcacaagaaaggcaggggaaaataaagaaaaggaagaaaaagagagagcggggaagcggcgcgggggtgggggcgagtcgaccgttggggtgcgtaacgttccaaagcccatcacaacacaagaaaaggaagcaaacggaccattggttgtgtttgctctggattccatcttcctcctcagctcctcctcctcacaaccagcttcttcctcctccacctcgcccaattctctcctccacggctccacctctgctcgatcggatcaagatcagaatcacgatcaggtatctcctcttgttcatcatcaagattccatccatccaataattcgcctctatttcatcatccccgccccacgccttcaatcgcagatcgatccgcccgccatgagcacgctatccgccggggtcctcctcaagctgctcgacggcatgaaggccggcgcagccaagcccgtcggggagcaccgcaccgcgctgctccaggtcaccgacatcgtccccgccgacctcgacgacaaggacctcctcccccgccatggcaagttctacgtcaaggtctccgactcctcccactccatctacgccaccctcccgctcccccaggccgatctcgtcctcagcaacaagctccagctcggccagttcgtccacctcgaccgcctcgacccgggctcccccgtccccgtcatcgtcggcgccaggccccttcccggccgccacccgctcgtcgtcggcacccccgacccggccacccgcgccaagcccgccgcgcccaggaggggctcctggggccctgagaaccatgccggaatcctcgcctcccccagggtcatcaagcccaccacgctcaacttcgaagacaggacgcccgtcaaggagagaccggccgcgccctcgccggcgcggagcaccgccttctccctcaggaagagcagcagcgtcctccccaggatcaccaggagcaagagcttcgtcgccgacagggctcctgaccaccccaagatccccaagagcccattccccgccgtccgtaaccttacctctatatactccctcttcaattcgattaga

SEQ ID NO: 34253 - DNA, 16882 bp, Oryza sativa
  unsure (1)..(16882): unsure at all n locations
cgcgcgccagataagatacggctgcgtcagcaacaccncatcatccggtgcccgggaagctcaatctcctggggaaggcaagtccctcaactcaatttccatcctgaattcgcagcgtcctgatgcagtcgtctgattgggttgctgatttcacttcgttccttgattcaggaagccatggagcagagggagcaagctcagaaggccgccctcgaggcgctgcgcaacgcctccgccacggacaacgtagtcaggatctacaagtacgatcctttctttctcttttccttctctatctgatggcaatggtgaatgtggcgattctcgcttccaagcaaattcgattgaggtgctagttgctgtattacttatcattgagtgatcgattctatgttggtcaaccggaccaggatgttcgctgaattgagcaagacggcgaggcccgacgcaccggccacctgcttcgagagcttcctcagcttccaccaggaggccgtgcaggccgtgaccgacatcgagtcgatccaggcggccacctcgatggccggcgccgtggcagccgatgagccgccggtcttgcaggagattgcgcagaacaggtcgtcgttgtccaagaggagaggagccctgggcgtgtccaagtcggtgtcgttcgcgccgggcacgctggatgacggcggcggcaagaaccggagctccaacgccagcagaaagtgccttgtactagacaagatcggagaagacggcgacgagaagcgatcttcttctggtagtactaccaccggtgctctcgggtcgtcgttgaggctggcgaagcagatgcaatgtgaggcgtcgagctggtttatggacttcgtggaggctgcgctggagactggcctgaagaagaagagcaaggcgtcggcgacggcggatgggcggaagcagagtagctgctgctgcccgcagtcgctgatactgagggtgatcaactgggtagagatggagcagagtggcgatggcagcagcaggaagcccagtcacccgagagcggctgccattgccaggaagcttaggataaaggccaagaacccttaattcctgctagtttattcttttgcttgttgtaggcattgagaaggttatctgtagaatctgtagatcaaggaaaggaagttccaggatagagatgcggattcttttgcttcatggtatatgaagctgttctgccctcctccctgtgacataaattgacatccatactatacagtagtcaatcagccacagaaggaagaaaacacctctgcttgagcaagtgctacgctctagtttgagtacaagtagtaccatccgttattattcattttaacttgttttttttatcattgtcttatcttgtgttttgcatgatgggggtaagacaaccatttgcttgactaattcaacctgctttcgcggtgatagaaattgttctgatcacgtggcatgaatgctttgctatacatgaaagtttgaaatttctgttttatctgatgaatggactgttgtgttgatgtggtcctgtgcaaacttgtatatatccgatgaataaggagattcagatgtagtaaaagtaccatgtaggaggagaggacaggaggattgctgctgcatttgcaatcgagccattcagctagttggtttggaacttgaaatccagccacttcacggcagatgttgtaaatgtaatgcgctaaagcttcagcaatccagatgaatgtttagttcacactgaagtttggaagtttggttgaaattggtacgatgtgatggaaaagttgtgtgtgtatgaaagttttgatgtaatggaaagttagaagtttggaaaaaaaactttggaactaaacagggccgaaattgacttgttgatactagaattttaaggccgtcagaaccttctctggcctgcaaaacataatgtgcaagatgaatgaaggaacccagaagcatatgatgacaaagtcaaaaggtatccatccagctttacatgttaagcatattggatatgctttggatcggtttggcacaaagtggaactacaaattgaaatgagattggatcataccttgatctcctgaagttcccatctctctgtctatgttcttctttcttctcttctaatttggaagcacagagagaatcatgtcttggttcttccctgtgtttcagtgggtttttcttgatcgggtagcaagagaaaacttagggtttaacacttaggtattgatctctatttatagccattgcacacagggggaaccgacactagggtatggcggtaatcccccgatcagggatgttcatgagagatcgatcactgtagcgatcgccctaaacaaaatatctctttgccgactttaggtttagctgcaagatcatattttgcgttcacactaacattctcccccttgatcgtgaggctaaacttataagtccatttctcaataaaatagtataccaagacaaaagattacagtgaccaatataaagcatcacagaatccagtgactatagcataccattatattttaaaataaacttctttaatcttacgagctctttgaacttattacattaggcttatacaaacttatggactcacttttcaacaaaacagtatatcaagacactagattacagtagtcaaaatgcatgccggcaagtatatcaagcaccactgaaccaagtgactatggttcctatttaatttcaaaatgagtccgtcttattttttatggggagtcagtgccatataggttccttcttattccaggatcgaaggcttttctaccaaacgcatgccggcaacatgttctttaaatacaacgggtggtaggccttttgtgagtggatccgctaacatcaacttagtgttcatatactcaacgcttattgtctgatcctggatcatttctttcacaacatggtacttgatatcaatgtacttggcagaagcacttgatttgttgctactcgaatagtatactgctggtttgttatcacagtataatttgagtggtttcgatatactgtcgaccactctcaatcccgggataaagtttttcagtcatattgcctgcccagtagctttataacatgccacatactcagcctgcattgtcgacgatgcagtaactttttgtttggagcttttccacgatatagctccccctgcaagggtgaatatgtaacctgacgtggatttcttatcatcaatacaccctgcaagatcagagtccgaataaccgacaacttcaaggttttcagactttctatatgtgagcatgaggtctttagtgccttgaagatacaaggtcttcttagctaatttccagtgttgtagacctggattagattgatatctgccaagcatcccggtaacaaaagctaagtcagggcgagtgcatacttgtgcatacattatgcttctgacaactgaagcatatggtattgacttcatctgcgcaacttcatactcattcttaggacattggaattttccatacttatcacccttcattataggagcaggcgaggctgaacaattatgcatattatacttcttcagtatatgctttctgagatagccccaaaacaccatttgatctgtctcggtaaatctctatacccaacacataagtggcttcaccgagatctttcatttcaaacttagaggccataaatttctttgtttccagtagcatatttttgtcattattggctaagagtatgtcatcgacatataatattaggaagatgaacttactctccttaaacttagcgtatatacagtcatcctttttattctccttaaaaccaaattgtcttatgatttggtcaaactttagataccactgccttgatgcttgctttagtccataaatcgatttctttagatgacaacccatatgttcttttcctttcataacaaaaccttctggttgtgccatgtatacatcttcgtacaaatcaccgttcaggaatgccgtcttaacatccatttggtgtaattccaaatcataatgggcaactagtgccataataattctaaacgaatccttagtagagactggagaaagtgtttcattataatcaatcccttctctttgcgtaaatccttttgctacaagccttgctttgaacctttcgatatttcccttgaggtcacgtttagtcttatagacccatttgcagccaactgttttggctccttcgggaatttctactaagtcccagaccttattagtactcatggacttcattttgtctttcatagcttttagccattcagacgaatgttcactcttcattgcttctttaaatgagatgggatcattatctagtataggctcattcacctcttcactcataggttcattcacctcttcattcatgtaagtgacatagtcacttggaatcgctgactttctaactcgtcgtgatcttctgacgggttcgttatttttctcatctatcacaacatggggctgctgagcattctcattattctcatcatttgatacactactagaagtagttgcaggagcttcagcaggtgttgcatcattatttctttctattaaaggtgcaacatgagtatgtgttgagaaaacgggttcttcaattataggcattggaacataattccgtttctcttccagaacaacttctctgggtgtcatactccccttgattatgtcattttccaagaacacagcgtgtcttgtctcaataaactttgtaaactgatttcggcagtagaatctatatgccttcgacttatcaggataaccgataaaatgacaactgattgttttgaggtctaattttcccatgtttggattaaaaaatcgtgcttcagcaggacaaccccacacatgaaaatagttcagggttggtttcttcccagtccataactcaaaaggtgtcttaggaactgatttactgggaaccctgttaagaatgtgtgcagctgtcttaagagcttccatccataactttaccggcagaggggagtgacttaacatacttcgtaccatatacataagagtgcgattatgcctttcagctactccattttgctggggttcacccggtgctgagtactgggccttaatgccattttcttgtaagaacctcgcaaaaggtccaggaatttgaccataagtagtatgtctaccatagtattcaccaccatggtcagaccttacaattttgatctttcgatcatgttgattctcaacttctgctttgaaaattttaaatttgtctaatgcctcagatctttctttgattggatagatatatccatagcgagagtagtcgtcggtaaatgttatgaataaatcaaatccatccactgactttacattaaatggaccacagatgtttgtgtggatgatttccaaaactcccatacttcgatttgcacctttcttgatttgcttggaatattttcctttgatgcaatcaatgcagtgatcaacatctgcatctgagaagtccaaaggacagaggatgttttctttaatgagacgctcaattctccccctcgaaatatggcccaaacgatagtgccataatttcgaagaagtctcattatcgttatgttttcgtttggtactgacatttgcatttgaggagtcaacattataggtggcatcgcacacagaaatttgataaagttgttcctgtccaacggcgagaccaacctctttattatcatgcataattatacatctattgtttccaaaagtacaatagtaaccaccgttatctaaacgtgaaactgaaactaagttccttttcatagagggtacataaaggacgtcatgcagttgaagtttaaagccagtatgaagtgtgagagtgaagtctccaatggccttaacttcagtttcaactccattagcatctctaattcttctttcccctcttcttagggtcctcctcatagcgaatccctacaaggaatttgcaacatgaattgtcgctcctgagtcaatccaccaagaattggtggcataatcaatattcagggattcatcaacaaaagaaataacatcagtacctttcttactaagccatctcataaacccaatacattccttttgccggtgtccactctttccacaaaactagcacccatccttttcttttcccttttcttctgtatagggatttcctccagatttattctgctgggattgatttgaacattgccccttttctttaaattaactaggcttaggcttcaaatactccttaaatttcttatacttttttcttctcagagtgtttaaatagatttgcatggtcaactctttctgccttaagcctttcctcttcttgtacacacatggctattaattcatcaatgccccacttgatcttcattgcattataattgatcgtaaatggagaaaactcctggggcagagatgacataatgaaatggacaagaaaaccttcagagatttccatttccattgatttaagcttagaagccctgtgacatttcttcataatatgttccctcagatttccagtaaaatcatatctttcattgaccaatcttttaataagagtggtggcataaaccttagaagagcctttaaattgttcttcaactttagcaagatattctctggttgtctgagtatctgggactgctcctcttattgcgtcaataatggagctcttgataatcataaggcatttacggtttgaaatatcccattttgcctttacttcatcatatttcctttttagggtctcataattctcattttccggtctaggctcaaccggaggatcattatggagggcataatcaatatccaacagagctagagtaatttccagcttctccttccatgaagcataattacttccattaagttgttcaatattgcccattattccggcaatttgtgaggcataagatgctgcataggagagaatcagcagctaaataagtaccttcttttattgatcaaattcaaaacggctttggccagagaaggaaatgaacaataaaattttgtgaataagtatttattaatcagctttggccagaataataaatacaaaccacactttatcaatttgtttaaaactccttttattaattcaatcaaaacagctttggccagatttgaattgaattaataaaattttgtgatcaaataaaagtcaatcagctttggccagaatgacaattatttgtcacacttaattataatatttatttgtagcggaaataaactcataatacataaaacaataataactttaagtaataaacataatgtaataatcataaaataaataaataaatgaaagagaattttatcacataacaaagtcacttattattcttattatcattaactaaaacataataaaatttcttcaatgtttaaacacaaaaaaatcataatcataattcttcaaaaaggaaaattttaattgtaatattatatcagcccaattcttttaattaggcccattactatgcagcccgttactatgcagcccacacattttttttaatcttgaactgggccgctttctcgagccaggccgaatgcggcctggcccgttattgccgcgccgccttccgcctgggctccaggcccatcaacctgggcctgggccggcgtttgccgcctcccgcacggcctcatcagcccgcgtcgggagcgagccgatccgagccgtccatctcatcggacggccgggatcgctcccgcgcgggacaaaaccgccccccccccccggcgaaaccctagccccattctttccccttctctttctctcacacccgcggcgacaatgagatggcggcgagccagcgcacgacgggtcggagatagcgtcgtcgagctttgcttgccggggctgcgtaccgccatatctggcgcgcatccccatcgagcaacgctcgacggtgccctaagcacccgtcggtcgctcgcgcaaggaaaatccgcggcggcgacggctacctcagcaaggcggcgacggcgagacgaggctggcgacgagcacgtgaggaggaggagccgggccagcacggcgggtcgcgaggccgctcggggaccaagtcctcagccgcgcgctcgcctcttacagcgttggtggcgacgcggtgttcgccgccggccaccatggcccttaggtaagcccgccgtgctcctttttccccttgattttagggttagggtttcatgatttggggaaattttggggtcttactgtagctagggtttcggttcttggggaattatctgagatttgcatgaattttgccttccccttcttctaatctcttcaagccgaaaccctagtcggcctaatttcatttcttacacctcgggattgcatgattttgggcttaactgaactttaacagagggatttgggcatgaacacgaagaacaacttgaacataaacacttattgagttccaatttgaggccaacccggtgctctgataccattgttggatatgctttggatcggtttggcacaaagtggaactacaaattgaaatgggattggatcatgccttgatctcttggagttcccatctctctgtctttgttcttctttcttctcttctaatttgaagcacagagagaatcgtgtcttggttcttccctgtgtttcagtgggtttttcttgatcgggtagcaagagaaaacttagggtttaacacttaggtattgatctctatttatagccactgcacacatggggaactgacactagggtatggcggtaatcccccgatcagggatgttcatgagagatcgatcactgtagcgatcgccctaaacaaaatatctctttgccgactttaggtttagccgcaagatcatattttgcgttcacactaacaaagcatacagggaacgtatcataaactatgaaactatgcataaaaagtttcaagcaattaccttcgcactacaacaaaaacattatataaaggcactttatataaaactctaagatcaggagttttatagcgtagagacactttatagaggcactttcaaaattttctagaaaatttttactctagagactctttagaaatatttttagcacattttattagattttatcttgtagaggcattctttcggcactttaaaatgtgtctaacatgtaaagacatttgcttgagacactttaaactctgtagagacacttcttacaataaaaatatactaaatggctaaatataagtaacttaaggcataaacatatacaatgaatgacatggggttgagttggttagtgccttgaagataagaatgatttgttcaaagaagataagaatgatttgttcaagagatcatgagttcaaggattggcaaaaacaagggaaaatattttattctcatttttacattggtttcgtatggttgtggtacaatttaatgtctctagaaaatgtctctaccaccttatagacattttataaaatgcctcttcgtttgtagagacaattcaccataaggcacttattagacttttttaaaatgcctctatagtattgtaaaggcatttgaaaagtgtctctgtagtcctagaaaaatatctctataaagtatttttcttgtagtgtcggtaagcaatattttactggatatgagttcagctaatcaaaggtttcaagcaattaccagtcccaggtccttcatttggctccaattttatactccttctatatgagtagctgcagcattacttttctggaactccttaagctgtgtttagagcgctaactacttaccagaaattctccacgcaagcaatactgagaaatcttcccagctgcatcctgcgggggatagggacaccaaagaaaagattcagcaccgaaacacatttgtgacgattcatttaccagagtaattttgattgcttgtattcagatttatttgtttacactgacaagtgattttgtagcttagtactagtagtaagtagtattgacttggcagatatactcttcacgaaccaagtactagcattagaacgtacgggggatataggacgtgggtgcttgtttaagaatgagaagtacaacaggaaagctatcagacagttactaataggtgttcgacagtattgatatgatacagtcgatatgaacaaaactgaaattcctataaatgagatgcaatactcatctctcgactattgtaatccttgcactcccaaggttgaaggttctaatttggaagatacagaattcagtaacaactggagtactcctatatatactgcatagagaaattaaaatgagtggcagatgtggaagcaggacggctggacggttttgtgtagttggttcgccgccgcccgccgagcaccaacagagacaagatcatcgccgagatttgctttacctcttgttcatcatcgtggtttcattttgctgtgtactgaatcgaggattgcggcgatcacgagaggagggaaccacggagggtaggattggagaggagtggggccgcgaaggaggcgtgccggcgaaagaagcggcggctgtggccggcgacagtgaggtggcgtttacgggacgggaggggaggggcgtgacgcgaggcagcagaatagacgcacgtctttcatctaacggctgagatctccctcacccgacatcaccagttttgcaaaaggaaaaagtaccccgaagatcccttaacttgtcatcgaattacaaaatcgtcctccaaccacaaaactggatacaacgcatcctccaacttacaaaaccagtgcaaattagatccatcggtggttttgactacggttttgtccgacgtgacggctgactcagcgtggaacccacatgtcaggatgccacgtcagcaccctctctcttccatttcctctccatccctcctctctctctctctctcacttttctccttctctgcaactgcaagcggcaagccgcccggcgggtggggagaggtcgtcggggcgaggcgggagaggaggaggcagcgggcgacgaggcggcgatggcggaagctgcgacgctggagggcaagccgcgccgacgctggagagcgaggacgatggtgacgcgttgccgccgtcgtccatccgcggatccccttgggtgtgccgtcgatgtgagccactgctgctgccaccataggctgacggccttgtctccggtcatcccagcgtgttcatcaccgcgtccttggcgccgaccaccgtgctcttcacctgctcactcgcctgaaacacaaacgaattctcctcaaaatccacaacaatggtgttcgacaaggagaaattaaccgaggttgctaatggtgtgtacttgttggaggacgctaccggtcttgtccttgccagcgacggcggattccttggtgtactacgccgtctcggtggtcttctgcttggcggcgccggcggaggaggatgaaatcctgatgcagcacacgcgcttctgatccatctgcgtcaagtggctcaagcgggacgcgaacctacagatgcacatgcgtagacacagtgacaagtacaagagcgtgcccatgctgacaaagccgccggcggcggtggtaaggacaagcagcagctggagcggcggtactcgtgcacgttcactgggtgcaagcgcaacaggctgcacgcaaacttccagccactgaactactgattactgaagacgatcttgtgcattgtttcatcatccttcagtaaaaaaggttgtgttcaaaaattgatttgataaacaaaaacgatgattagaatataacaaaaggcagccggcatggaaattgggacaggtgcagggagccgatgcagaaccctccaccgcgccgtctcgtcggtctcggtggccttctgcttggccttctcggtcttctcgccgaggaagccgctagtctggtccttgctctcggcggccttgtccctcgccgcctacgccgtgccggaggtcttgtccttcgccgcatgtgccgtcacaccgccgccgacttcctccggagagcccacctaaggcagctcactgcgttcctccgccggcggcggcgtggggggaggccctcctgctcccgcgtcgtcgccgccgccgcctcgtcgcccgtcgccgaccgccggagtcccgtctcccgcctcccccaccggtctcctccccacacccgtcggttgccctgctcggtgagagaaaggaagaggagagaggtggagaggggaggggaagaagaggctgaaatgtgggacccatgtggcccccacgctgagtcagctgccacgtcggataaaaccagagtaaaaactgccaagggatctagtttataatagttttgtaagttagaggatgcgttctccggttttgtggttggaggacgattttgtaatttgatgacaagttaagggaccttaggtatactttttcctttgcaaaatgccccctcgttcggattttgctgctgcattcgcaaacctagcagtgtcttatgtttttgggctgaggcccagattggtttaggaagccggaaaaggaggagcaagccgtcaatcagttagatgatggatcatagtgggctgaaagaaaatatgtatagcccgtttcggcctaaagcgaaatgcaagccagctcagactgagctcgctctcaccaccactgcaccacaacaactcctggccatacacgtggacgtggaatagaagaagaagaagagaatattccctgggcattgggcgatgaccgacgagtgggcccgcctgacacgtgtaagagcaagtttaatagtatagcccactactagctccgaataatctatacccgatgtaatagccaattcatacaatagttgcttactatactattaatatctggtcctacctgttatacatacattacgtcttggagtccgtgctgcagctggctatagatctgtaacccgctgctcttatctctctttctttgtttttttaaaatatgtttatagctagcttatagtcttttattgtacttgctctaagcaaggctgagaagccaagcaaacaaaacgaaaagcaaccgtcaagtggaaataaccagcggattaattactaccactaccacaaataattcattaattcattcatccatttattcatttaaaacaacaagcactaagaagcagaaagaaggaagaatccatgttgcattttatcctactggtaccgtttcttttctatggatggaacattttattctagcatttgcttgctttgcctaacgtactctcctccttaattatccattcaatcaaaacaagcaggactactagaaagcaagaggagaaaaagaagaaggaagaatccgtgttgcattttatcatactgtttcttttctatggatagaacattttattcgctagtattgcttgcctaaattaaatcgcgcacaagaaacgtaaactcgtccataccttaattaattattatccaagcgcaaacatgaaacatccctcccgcattaaattggcatctcctaataaatctcacggacttccatatctactcccggtttctgctggattccttcctttttctcatcgcctcgcctgcctcttggccttccccatccccatctctcatcagccgcaaactgctgcaaaccccactagcgctcgcccccaccgtaatctcgcgcgattctcggaggaggagatgggcgagtactgcggcgctgctccggaggaggaccctgccatggccctcgtcacgccgctccccaccaccaccaccaccaccaccacggcggcggcggcggccatcaagcaaccccactactacggctgcttcgaccgctgctccaccaagcaggtcttcgacaacctccacggcaacatctcgctcgacccggttcgttcgttactcctacccctaccatcccattctgcgggattcgttcctcttccccaaccctccgtctcgccctatctcatcacgctggatattgcttctactgttcatttgcttgcttcagattgtttggttactagtagtaacttggggctagtttttgtctcccttttcgatcggttactgcttccatactcggatgatgatgtttttgtcccttcgtgatgattcattgtgccatgcttggatggatggatgctgctgcgatttcttccgattgtcctcgctgtctctatgtgctccattcctccatagattgaacagattgcatcctcaccacgtgtatttccacttaattcatgtgcttctagtagccttgcatgtgcatgcactttctcctttcccttttcttttcaggtttatttattttcgcttcatcatctatatgtgttgctgttggtgtagcgcgtcaacattagtttactaggagacgcatgcgcatttttttccttcatattttaaatggaggggcaatagctgtttatgctccttcctctcttccttccttcttagacctttgctgactagaatattttacgtccacattcacagcgacatgaggtattatggaggtagtaataaattatctgcttgtttattactccttcgttgacgcttgggtccttttagatatgactgctttcaattaacggggtcttattgttaattgttgacattctaaagggtttttggtcttcactcttcagattaaacgggctaggctacctgaacaaaattgttcagttttttttcagatatattttgggtgggttggcagttttaccttgtgtacgccactactgatgtgtctgaaacacgtgctctccttgtcatgtggtggtagaacaaccaatggtgcgaatggaaagtttattatatatagcagttgttctcacgtgttggatgatcatcatgtttacattcagttcccatttagtttccgccatgtagtgtcgcatgttgtatctactagtatatgatgacattagcactgaaaccttttgatgattctaaacattagcactaaaaccttttgatgattctaactcaatgtattgttgattcccacttttaccttttcctgcctgcatccgtttcaacttggaagtacaaatgtttcagttctactgtgtattttcttcaggttgttaccctgtatttaagtctaaatcatacatgcattcagggtttgaagtaatggcatgctgaatcatatacatgtgaataatcatttacttgttcagtggtgaacaattagcccgctctcattttccgttttggatgcttatgctacaatgacactttatcatactgagtgctgttttcacaccgacatatcgtttctcttattagtgttatttatctatttaatttggccattgagtcattaaagctttaagcaacttctgttcctcccacttttccttctcagtaacaccgataactttctctgatgtgcagttggctcgtgagtttgtggatacgaaggagtttcagaggtgactttgattaacccaaattatcgttgatcgtttgtttattcaacttattcatcctctttatggcttcatttgattgcattgtgtcattcaggctgcgggatctaaaacaacttggtgagttattttatcatcattgcagaaatcatttttagcctaatgtattcaatatagatgaaagtgtcaaaatctaaattgaatttcaaaccttataattgtaatttgttgctttttgggtttagaaaaattaaggctacacaatggggtcttgtcctggaaacattttatcccctttactcttttttttcgataatggaagctttattaaaactcagtcaaatacaccaaggtgatacatttcaactgagcacactcctggcctctgcaaaagatgcacacatccacacacaaagaaagacctatctagacccccttcacgaaacagagatattagtggctatcaatccgtacactagatcgccaaccatgctcctgggtaaaaaaactcccgtgacacctagtccaaacgtcgcgataccaccacaatagtatcccgaaggcccggttctttttatcccctttactctatctgcacagagttatttttaatcaaatttactgttaaccacatatcctttcactgttgtggataattttatttggagtaaagtccataaccggttgctaaacttgtaccgctgtgtcatcccagtccctaaactcgcaaatcgaccgttcaggtcctcaaacttgtttgactgtgtcatcccggtccctaaacttgcagatcactcgtttaggtcctccaacttgttcagttgtatcaccccggtccctaaacaggacggtctaaaaactttatatcaaaaagtaattcataactttttcatgtgaactctgaggaatccagacaaaatattcaattgtttgctgtggtcaccaactaaacacaaacatgcatatatttgctaaagaaattatgcacccattccaaaaagtttaaatacgccggttagaccaagttgattaagaagttgaaaagacaaagtacaaaaccttggttgggccaagtaacatgtgcttaaaactctcatttacctgtggaaaaaattatcagagttcctataattcactttgattaaatgacaaacaaaccttctgtgttcttcaatcagatttcagagggaaaaatattactgggataggatagaatctctgcttgcttgctttaatacaaacaggggttgatctcactagagatataatatcggcgcaagtgccccaattggcaaggaccggttgaaattgatacttatgacgattgccatttattgtgtaataaaaacttcccaaaccggttggtctgagttattaattccctcagacatagtcgtattttn

SEQ ID NO: 34254 - DNA, 7476 bp, Oryza sativa
  unsure (1)..(7476): unsure at all n locations
cgggtttaatacaacacgaagagggaaattgcccccccgaaaaataaccccggtggcccagaaaggttgccagcagacagcgcctcaaacaggtattacagccaagtctcgaattacaacagtaaagggacccaaaatatgtgcacatgccttataaaaaatggaccctaaatctaaacatgacaatgtggcaccaaaaatcccttaaattaaaaaaaaataactaccaagttttatatagcgtcgagggctacaaattagaaataaagtttgtcttcattagagttcacatgaaaaagttatgaattattctgaaaaagttatgaattatttttaaatataaagtctttagaccgtcctatttgatccagatgatattcaaatccaagtttagagactggggtgacacaactgaacaagttggaggacctaaacgagtgatctgcaagtttagggaccgggatgacacaattgaacaagtttgaggacctgaacggtcgatttgcgaatttagggaccgcaatgacacagcggtacaagtttagggaccggtgatggactttactcttttatttgtctaaatgggctcatgcttataattagtgctaacctgtcccatggctactgaattttggttagtttgctgttatcatttgtgcaatagcacttactattatggctaactgaatgttctaatgtttagttctcaaagtaacataatgtgagcccttctctatgtttatatctactttttttttaatttatcatagtttataatcgatatttgtggtaacatgctctgtgtacctttcaggccttacatatctggtctacccaggagccgttcacacacgttttgagcattcattaggtgtctattggctagctggggaggctatgaacaatcttcgactgtaccaggttcttacctttgataaaaaagtccaccgatatatttccatgtagcagtttaattattttgtatgaaactaagttttgtttttcttttgacagggagaagagcttggcattgaccgtgttgatatgcaaactgtaaaacttgcaggtctgtttactgaatcataactctgccaaggtttccatattgacaatccttgtgttattctgtttaggccttttgcatgacattggacatggccccttcagtcatttgtttgaacatgagtttcttcctcgtgttgttcctggatcaacctggtgattttcctttcatatatgtggttatgttgtttctaatttgttagttgttttacatatattttccatgtccttagtatgagaagattcaaaatttaaagcaatacatatttatgtcatggcggattacaccacttaaaagactctggtcctatgattattatactagcattacaacttctattttcttcctatccaaactatgaattttagtgtgtatctatgtggatatgatgacatagggtgataatttctcatatttcttcacttccacatgcacgttagcctgttgaaacattgtgagactgcagttggtttcttaattaaactggtccattttgtctattcaggacccatgaaaatatgtctgcactgttgctggacagcattgtcgacaaacaccaaatagacattgaagctgatcatctcaaaattgttatggtaatccacgtttttattcagttattgtggcatttatcaattgccatcagattaacccatctccttctgtcactaagaagaatggctcttagaacctcttatttaatgttttaaaatctatgaatttgacctttccactcttttttcttgtcagccttaagtattcacttcaaaatgtgtgctgttctaagttgacaaagtgtaaccctacatcttgacaagcctctctctctcttttttttttttgcaggaaatgattgttgccagctctaagttcactgcaacagaagtatgtaccttagtctgtattactgccttagttatctgtcagttgaaaatagatgtactaaaattcgatgcaatgaaacttgtttcttcacagagcacaaaggagaagcgctttctttatgacattgttgctaatggtcggaatggtatcgatgttgacaagtatggtccttctatacttctaacttctgatattttctgcattgacatttgtttttcaatcatttggatatgccataagatagagtaaccatgcaggtttgactacattggccgtgattgcagagcatgtggtctgggttgtaatttccagtactggaggtaccttttgttatcatgttttaagtttttttttactaaaccaatctgttaaatttgagagtaggaatacaagaattaaccaagtgttttacatcatattataggaaaataagacatgactgaggaaataataaatcagacaaactgtctgtaaagttttatttacaataaatgctaatgtgatagtcgtcaattcaacggtacttgccaattggcgcaccttggccgatattaaactctagtgagatcaaccctgcttgtattaaaacagacaagaaagattctatactattacagttatatttttccctctgatatctgattgaagaacacagaaagtttgtctgtcatttaatcaaagtgaaatataggtactctgataattttttccacaggtaaatgagagttttaagcacatgttagctggctcagacaaggctttgtactttgtcttttcatactctttatcaacttggtctaatcggcgtattttaaccttttggaatggttgcataatttcctttgcaaaaatatgcatgtttgtgatttgttgctgaccgcagcaaattactgcatattttgtcttgataacccatttgatatattttgacatgtactggcacagttactaacttgctatcatgctgttgtggttcttacctttttgcactgcaggctcttacaaggcatgcgagtcatgggtgatgaaatatgctaccctgccaaagattgtaggtctattattatcttctttttttgtgctatttgttccttttctttttgatatcatgtgacacttgacttgttaacttttcattttgaactacagatttgagcatccataaattgtttacgacacgtgctgatcttcaccgcactgtctatacacatgcgaaagtcaaggtaaggataattatattatgctggccacttttgtgcagcaaagaaccacactgtcctgtccattgccttctaatatattgttatgtaccttaggctgttgaactgatgcttgtggatgcacttgttgaggctaacgaatacttgggaatagctttgcatgcacaagatccagcggacttctggaaggtttggtatcattgcaatttttattatgtatgtagttttattagttgccttcttacttcaaacatctctggaaatttcagttagatgacacgatcattaaaagcattgaaactgctcccaacgatgaactgaacaaagcaaaagggatcattcaacgtattcgccgaagagagctctataaggtagtactactttcggtcatgaatttactatgttcttttatcatatcattttacatgtttatcagagctattgtggcttaaaatatgtgtctgacatcttgtacttggatagctaaatcttccttttgtggtagtatgaaacaactttgttttctttcaacttgcagttctgcaatgaatattctgttccaaaggacaagctggagcactttaagaatataaccgcacaagacatagtttgttcacaggttcatgcctactttgatcctctgaagatctgattttttttcctgaagaatattagttgtatgtttatgattttacccatcttcagaaatcttccaaggtgctgctgaaggaagaagatgttgctgttagcaatgttaagattgatttgacccgtggaaaagataatccccttgaaaggtttttgatttataaacccacttttcagactcttatatttcttagggcgacatatcagattctgacctgttacttttgttggtctgcatatctactatccccagcatcaagttctttaaggtaactatacctgccttgacagtggaatgtcctcataattctcatgtggtctaaagtaggaattcttgttgagccaggattttggttgcgatgagaagttccccatcacagatgagcgggtcagccacctgctacctgcgtacaaccaggacagaattgtccgggtctacgccaagaagcacgagctggtgagtgacaaaacattctggcagagccgctttaccatggatgtattatcttgcagttgcataatgtgttgagtgaaatattgggtgcaggttgaagcggtgtcagaagccttcgagaacctacaactgaggatgtatggtgagaagacacaagttcatgacactcccaggaagaagcgcattagattccactaatcttcagcaactccttgttgccaagtactgtcatcagtgttagttagtagtagctcgtagcatactagtacgacaaaggagaaaggatcataggtagacatacggaaggaaggaaggaaccttttattactgagcgggagcatccaatactactaattacgggttttgtttttgctggtaatctgcacgcataagtaacgcgcagattagttgtacaggtgataggccacagaaaatgtcttgggcagtggtggtgtcacatgacggctggctaccatagcagatagtagtagctgatacgccagtatcgtgatcttctgattttttttttactctgagcctgggctgtctgggactgatggcgttgctcctgctttgctagtgaatggatatataattatattatatatatatatatattggcaaacaacgtttgttatgcttactattctctcattttgtaatgtgtattagtcatctcacgagccgcgagtaaaatggcatgtgaatggattttaaatattcgtccgtgtgcattttgatgcagcagaacgaaatgctgctgtgtaaaaatgcgagtactaataatgtcggagttgttagcgtaatataggggtcaaaatgcggtgaattttaggctgtgtttagattggaatgttggaattgttaagtgtaaagttttggtatatcatatcggatattatataaggtgtcgcatagggtattcgggcactaataaaaaaaatctgttagtaaattgcgagataaatttattaagtctaattaatccatcgctagcaaatgtttattgtaacaccatattattaaaagattcatcttgtaaattagttgtaatatgtataattagttttttttaagtctatatttaatactcccttcgtcccaaaatgtttgccgtcgttgacttttaattatgtttgaccgttcgtcttattcaaaaattttaagtattttttaattctttttctatcatttgattcattgttaaatatacttttatgtatacatatagttttatatatttcataaaaatttttgaataagacgaacagtcaaacgtgttttaaaaagtcaacggtgtcaaacattttaggacagagggagtactttatgaaggggtttgaacgtacgatgtgatgtgaaaagtttgaaagaaaaaggctgatctttcaaaggtttgaacatcgagcacatttttctcctatgcccttttgctgaatgtatttgggatagcatcaagcaacattttgatttgaagctatgcaggactgatctgtcaaatatgaagcagtgggattttgatttcctggggagaagttcaagcatccaaaagacggcgctggctgtcacgttgtggcatatatgggaggctagaaatcactccaggaataatcctaccttagctaatccaagacaggtcatccagaaaatcttggcttatgtggagatgattgaacaacactgttgccgtgctgcgcaggcggttaggctggatttttcacattttgatccttttaaaaaacttatttcgcaaatagacccctgaaaaaacttatcccagaaatggtcctttttggggcgccagagtggctggcgccgtcatccaacgggagtcctcctaccaccgtggcgcacgcgaaccgacgtggcaggaggagggcgccatccatgctggcgccgccccagggaggagggcgccagcatggctagcgccgccgcctccattcctgtttctctgtatggagttgcaacggtgtcatttttattttattttttcggatgttttttcacactcaggatcacgatacaaccaaccacaaaaaaaatttaaactcgaactaccacttagctaagtctgaaaatatctagcataccacttagtctactttgcacattcactaaaattagaccataactcctttagtaaaaccctttgatcagcatgttaaacataatgcactctaccactatataaattacttaatctaattcaaaatataaccacatgaaatgacatatataagttaaacagtacatagagatgtaatttttttatttttatttcatttttttgatatttttttcacacttaggagaacataggaaccaaccgtataaaaaataaactcaaacggacaaaatatgtgacatgtagaattttccaaaactctaccgaaacggaaaaaaatatgccatctattaaaataggcgtaactttctcatacggactcggaatcaggcaaataatatatgaacggacatctacagaaaaagttctgtagattaaaacctctaaattctgcttgcaagattgtgttttcgaggagagaagtttttcggtggagctttggaaaattccaaatgtcacatatttcgtccgtttgagtttattttttacgtggttggttcctgtgagttcccaagtgtgaaaaaaatatcaaaaaaataaaataaaaataaaaaagttgcacatctctctcctctgcactagttcggagagaggagaggagaggaaaaattctacatgtcacatgttacgtccatttgagttcaatttttctatggttggttcttgtgtgtccctaagcgtgaaaaaaatatcaaacaaataaaacaaaaataaaaaatttcgggggggaggggggcgccagccactctggcgcactccccctagccacctcaacatcgccccaccacgtcngcggtgggaccgggctcnnatagntatancacattttttcctacccggcgctagagcccgctatttgtttgagtatccaatttcaaaccatcgatttcttttttacggctccctaaccgttccctatgtttcgtttcaaaacaccccatctcttgacttctccccgtatatgttttcctttgtgaaaccttccgtttgagccaaatcatggctggtgcccacacccttgtcctaaataaatttcggatgcttcccgcttttggtttctttaacacaacactcctcg

SEQ ID NO: 34255 - DNA, 757 bp, Oryza sativa
  unsure (1)..(757): unsure at all n locations
gcggttgattgacatgggnacccattaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgcttaccg

SEQ ID NO: 34256 - DNA, 775 bp, Oryza sativa
  unsure (1)..(775): unsure at all n locations
catggcaggtgatagactnacactgtaagnagcncatcannnnnnnnnnnnnnnnnnnnnnnnnnnnnnnnnnnnnnnnnnnnnnnnnnnnnnnnnnnnnnnnnnnntggtttggggtccggctatgtcggcgacgataccaaacagaagcattatccgtatccgtaccaaacaccaacactgcgaattatatatatatatatatatatatatatatatatatatatatatagatatatcttcctctacatctacacgacgtacacttggatactgcaggtagattagattagatgatcggccggccatggccaccttccgggaccacctcgccgtcatcgccgaggcgctctgcgcgatcgccgccgacatgaatgcggncgcccgcgccctcgacccctccaccgtcatcagactcgtctgcgccgccttcaccgtcgccatagtgctcgtctgctacgccgacatntggggncgcctcgacacgctacactcgcagacgcagacgccggcgggggaggacgaggacaataatgccacgccggcggaggctcctgctgcttctttccttaaaggaccgcaagcgctccagcaatggcaccgacacctctttcttctcggagtcgtcgtcgtcgtcttcgttttcatcaaccgagttctcgttcttcgtcttcgtcttcatcatccgagtcctccttcctcgtcgtcggatgatgacctagcgcggcgacgtcagcagagaaaccctttctcctccgcggagtacaagaggaag

SEQ ID NO: 34257 - DNA, 739 bp, Oryza sativa
  unsure (1)..(739): unsure at all n locations
gtgggccntttgtatggcactaccagtatggtacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatcttcacctttcatttgatcn

SEQ ID NO: 34258 - DNA, 746 bp, Oryza sativa
atgtcctggagctgtcgtcgcccatttccatacagaatcttcgactgatgtcgcgtggcaaactcctgctgaccgtggagtccaaaaagtacccacatctgcgcatccagggacacatcgtgacccgagccagctgcgaaatcttccagaccctgctggcgccgcacagtgccgaatcctcgaccaagagcagcggtttggcgtgggtctacttgaacaccgatggatctctggcctacaacatcgaaacggagcacgtgaacacccgggataggcccaacatcagtttgattgaggagcagggcaagcggaaggccaagctgaaggatctgacgccgagcttcaacttcaaccaggccattggtagtgtggagaagttgggtcccaaggtcctcgagtcgctgtatgccggcgaactgggcgttaatgtggccaccgagcatgagacgagcctgatccgtggccgcctagtgccccgtccagtggccgatgctcgggactcggcggaacccattctgctgaagcgacaggagcacacggatgcacagaatccacatgccgtcggcatggcctggatgtccattgacaacgagtgcaatctgcactacgaggtgacgctcaacggtgtgcccgcccaggatctgcagctgtatctggaggagaagcccatcgaggcgattggagcgccagtgacgaggaaattgctcgaggaattccactgcagtagaagctctcatctggccagc

SEQ ID NO: 34259 - DNA, 899 bp, Oryza sativa
gcgcgtatgatgactctctgcaagtacctcatcaggttgggaagatattgaaattctaagattattgaatttttggcctaaaggaaaaggatttaattaaaccctttttggaaaagaaaaagaaaaggaaggagggaggaaatttagactttcctcgggcggctagggtgcggcccaagggatttggggcggctcggccgagcttaatgggccggccggcccaaaaggcggcccagagcgcgcgcgggaggggaggagagaggggaccggtggaccgggctcaccgcgcgcggtcccgggtgggacccgcttgtcagcggctcggctcaccgcgcggagggagcacgcggtgcacgcgcgcgggcggggaagggacgcggtgcatgcgcgcggtccgcggtggacgcaggtgcggcgggcccacgcgcagcctcacggctcgcggtggatcgcgcgcacgcggagggaccgaccggggtcggcccgacccggtctggctgagctggcaccgacgtggcgcctacgtggctgccacgtgggctggcgggaggtagacgacgatccgtccgcgaaaggacggcgggcggcggcggcggcgagcggcggagcgaaccacggtgatacgggcaaagcgagcacaccgggcggttgttcgtgacgaggggagacgaaccaacggctcggattcgccggaggttgctcgacggcggcggcaaccggcggcgggagaaggggaaaacggcgacgaagctacgaggggtcgattcccgcggtgagagcatctacgcggcgtcgggaactcgacgctagcgtcggattggacggaactatgccgagcgaggccggcgacaagcgggtgctacggagcttgggcggggaccggggcgaacacacggcgg

SEQ ID NO: 34260 - DNA, 32824 bp, Oryza sativa
  unsure (1)..(32824): unsure at all n locations
agtggtgtcgatgacatggccagtagttcatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttaggatgagatctcttaactccttcttggccggtacacagatgcgtggaccgcaccaaactgtgccttggttgtctatggagaaattggtgtctttcttctcctgtattccttttattaattcttttatcccttcgtcgtctttctgagcctcccggatttgcgactctagggtaggctatactgtcaagctggcagggacacctgactgtaccacggtcagccttaacttctccaattctctgcacaggtgatcttggtcaggccgtatttgagctacattgtgataggccttgcgacttagcgcatcagcgaccacgttggctttaccagggtgatagtggattccaagatcgtaatccttgattagttccaaccatcttctctgtctcatatttaactcggtctgtgtgaagatatacttaagacttttgtgatcggtgtatacttcacatctgttcccgattaaatagtgcctccagatcttaagagcatgaaccacggctgccaactcgagatcatgggtgggataattgacttcatgaggcctgagctgcctggaggcataggccacaacctttcgttcttgcattaggacacatcctaagccttgtcttgatgcatcacagaagatctcgaaatcttttcggatatctggcaaggtgagaactggggcagtggtcaaccttttcttcatttcttggaagctgtcttcacaggctgcagaccattgaaatttcttttccttctttaacagctcggtcataggtctggctagcttagagaatcctttaatgaatcttcgataatatccagctaagccgaggaggctgcgaatctctaacacattcttgggcgggttccaagcaagtacagcttcaaccttgctgggatctacttcgacaccattggaggaaatcacgtgtccaagaaatgctactcggtctaaccagaattcgcatttcgagaattttgcgaatagttgacgatccctgagcttttccattatcaacctcaggtgttcagcatgttcttcctcgttcttggagtatatcaggatgtcatcgatgaataccacaacaaactggtccaggtattccatgaagattttgttcattaagttcatgaagaatgctggagcattggtgagtctgaaggacattactgtgaactcatatagaccataacgcgttgagaaagcggtctttgggatatcttcagatctgattttcagttggtggtaacctgacctcaagtcaatttttgagaaaactcttgctcctttaagttgatcgaataaatcgtcgatccgtggcaacgggtacttgttctttatagttacttcattcagggctctatagtcgattaccattctctcagagccatcctttttcttaaccagaagcactggggctccccaaggggatgagctaggtcgcacaaaacctttactttccagctcttcgatttgtcttttaacttctgctaactcattagctgccattcggtagggtctttttgcaattggtgcggtgcctggtgccagttctatggcgaactcaatctctcggtctggtggcattcttgttaattcttccggaaatacgtcgggatattcacaaactatgggcaccgactccaatgaggtgacttgtaaacaggttaagatagaccgacttgcggtaggagtgttaggggtaaagcggacttgctttcctccaggtccttgcaaggtgatggacttttcggcacaatctatctgtcctttgtacttagccaaccaatccatccctaggatgatgtccaagctttgcgagtctaggactatcggtttggctaggaagtcaacttcctcaattctaaggttaacttccgggcatatttgagttgcccttatattccttccaggggaatgtactatcattggtacacgcaaattttgggttttccaaccatttcttttcacaaaagcttgtgatatgaaagaatgggaagctcccgaatcaaccagaactattgcgggtatggagttgacagagaacatacccatcacaatgtctgaagcatcctgagcggtttcagcttgaatgtgattcacacggcctcgaccaaagtggttggaagcacgtgaaccttgtccacttgcctgagagctaggacgagactgagctgccgctgggtaggagttctggcagtgctgccattcgcatgccctgagctggtgttggtagggttctgagggcactgtctagcatagtgacccatctggttgcaccggaaacactgaactactgtcggtccctgtggtgacttgaacgaggtaacactgtttggcgcagtattgccactaggggcacgctgctgtggctgaggtgccggacggttcatctgaggacgaggggcgtaacctggctggcggttagcctgagtgaccgactggtggtattgcatgggttgtccgtagcgagggcgaggtgcgcctcgggaagaatttccctgatggttagacttgcgtttcttgtattcttcggtagcctcttttctagcatcctcgagtagaagtgccttgttgatcatatgttgaaaagtggggaaatcatgagcaatcaactggagtctcattccaactgcgattcctttcaagaatttcctgatcttcttctcgtcggtgtccacttcctcaggggcgtaccgagccaacttgttgaacatacttaggtactcattgacactgctgttgccttgcttaagtctgttgaattcttctttcttcatatcaatagcgctttcaggcacatgagctgtacggaaagccatagcaaactcatcccaagcaatgttagtgggttcagggtgtgcattgcagtaattctcccaccaatctgcagcaggtcctcttagctggtgagaggcgtagagcgtcttctcaaccggagtacactgcactaagttgagttttctatcaacatcttttagccaatcgtcagcctcgacgggctcgacggtatgagagaactctggcggacgagacctcagaaagtctgtcagcttggatctattgttgcccacgtgagggtggccatttccatgcgcattatgctgaaaactggctatggctgtggttaatccctgcaagatttgtgtctgaactgccattaagtgctgcatgttgttttccacatgaggtggggaaggaaggcgttcttctccagaattgtgactggcagtgcggtgagagcggtgagattgttccatctctgcattacggaaaactgtgcgatgcgagcggttgctgcggcggggttgctcaacctctgcgttgcgggaaacagtatggtgtgaacggttgctgtggtgagactgctcattagctgattcatgatttgcttctgcttcaactctaccatcttcaaaaccaaagcgggctggtgcacgagctgcacggcgggggcggctagccatctaaactcccagaaaagggcggggtaagagtcagataagcacttaggagggcaaggagcaatagcaactcagatagcacacactaggcataaactggatttttcaaatcataaaaacacctgatacaacgggtgtggacaagtcacagagctacaccgagcttgactgtgcgcacaccacctaggagaaccagactaccaaacaacacccacaacaaacacacgcacgcactacctcgccacgactccaaaagagttggcggcggaacaaaagggcctatcacacggacggctgctgaagactgcctcctctactcctcgtcggcctggctgcctcctgtagtcggctcctcagtcgaagaaacgtcgatcggctggcgcgaagggaccggcagaacctgtcgagggccggcagcagcacgggccgctggcggtgggggagctgggtggcggaaacggaacacggtggaagaaccaacaacacgcttccgcgcggtgcggataaagcgtgggccacggcgggaggaagcaactggggtgtgtccgggggtgtaggaagggctaactgggtgtgggtagggggagtacactggtgagtacggcgcacgcgagctgggggagcgcgggccgctgggggtgcgggcagagccgcgggagctgtgggaggacaggtggctggcgtggcagaggcgtcctgagtcccaagagatagtgtcaactgaggtgacaccctcctcggccagacgggcctccaaggcggcgtagcggcgggcaagggagcggtaagcctcaaggagtaggtcgtgctgagtggcctgagcctccgaaagctcaaccatgcgagtcagcactggctgagactcgctgtacggacaagggtacctggcgtcttagtggccagagggaaggcgtggaagctgccggaaggcggagcctccgagacggtggctgtagtcgtgggacaggcgacgaagcgccgtccaggagaggtcctggtacgcgatctggagagtgggcctggccacggtgaagtggtgtgggcgaaggccagctccgtgtatacctccacgggggtaatggtacacagagagctcacagtgagggggaacacggtccacggagtaccccgtgtactcgggacacgagaagccaaggaaacgggagaggtcacgccccgaactagtcccgaccggaactagcccgtgacactccaaattaacctgttaatcgataccagtcccaggaaacagtactggtatcacagggagacagaatatcacagcaacagaggtctctttattatagagtagttgtacagtcatgttgggctgcggacagatcccgagctcacaactgcattacaaaaggaaagcggaagccaggacttggaccaatcaacacaggcgcgacttgggaactaggccgaaaccctaaaacacatcgtagccggcttgctcctagaagaactcctcatcagcaggatccgcttcatcttcttcagcaactaggggggggggattatttatatagagcaagggtgagtacgggagtactcagcaagccaggggaaataagtgtttaatgcaggcttcaaggaaaggctgttgttttcgtaaatgattttatttgaactttttttctaaaaacatctaggtgagtgcttctcaaacgacatggttgagacagtgcgtcccgtccggtcggagtatgtgcaatgtatcagtctttagaatttaaacaaggttggcacccggccaacagctttttcaacggccacccgggccaacaactcttcaaacggccacccgggccaacaacttttcaaacggccacccgggcctagctgatcccatcagctgcagatttttcaaataccgaaccccttttcacacagcaatttcacaagcagtagtcaaaccaaactacgctaggaatcacctcacatccgcccatgaccgtgggcacggctgttcgaacagtttgttaatctctgcagagggggtacactttacccacacgacattactaacccggatcacccagcccgtggggatcagccacgtcgggagacctccaagctttcatgacaaggcatttccaaagctgacacaggcttaccatatgccgacgagaggggttctagaccaacaacaggttaggtcccagaccatactgtgccaggaagcccaggggggtcctctccgacaccaccccggcgaatccacatgtctctcggcatcatggctcccctgataagctagttactcagccaggggtgtcccattccacccatgtggtcgtacttgtcttatgttcggatgaaattccaaggaatcggtccttaagtgcgggagcgggaaaaccgtacacccggtacgttccccggtccgcggttttagaaatttatttagttcgcaagcaccgacccaggtgtcgggttttccaaatcttttgtaaaacccaagttttacccaagttgtttttcagattttaagtttgaaggcgaccgtcgatactcgcacagagtgcacgaatatcgaggcgcaactgggtggttacaaggggacatggtataacaattaacaatggaaggatcaaatgcaacaagttaggtaggtccgccaatctgccctgcaggcgggacaaacagattaagtgtgatcctatcaatgcataatatttttcaaacaacataattaaatttcaaatataggctcaagatgttcaaaggtggcttgccttgctcgagatctggagcttgatcctcgaaatcctcgcactgcgggtcttcgggctccggaactacacgcgaaacgggacaactcaacaaacggcgaaaataaagccctattaatgacctctaagcgtgccattagatagatctcgagatttggggaattttggaagttgaacggagtcaacggatttacggttgggaagatattgaaattctaagattattgaatttttggcctaaaggaaaaggatttaattaaaccctttttggaaaagaaaaagaaaaggaaggagggaggaaatttagactttcctcgggcggctagggtgcggcccaagggatttggggcggctcggccgagcttaatgggccggccggcccaaaaggcggcccagagcgcgcgcgggaggggaggagagaggggaccggtggaccgggctcaccgcgcgcggtcccgggtgggacccgcttgtcagcggctcggctcaccgcgcggagggagcacgcggtgcacgcgcgcgggcggggaagggacgcggtgcatgcgcgcggttcgcggtggacgcaggtgcggcgggcccacgcgcagcctcacggctcgcggtggatcgcgcgcacgcggagggaccgaccggggtcggcccgacccggtctgggctgagctggcgccgacgtggtgcctacgtggctgccacgtgggccggcgggaggtagacgacgatccggccgcgaaaggacggcggacggcggcggcgagcggcggagcgaaccacggtgatacgggcaaaagcgagcacaccgggcggttgttcgtgacgaggggagacgaaccaacggctcggattcgccggaggttgctcgacggcggcggattgcggcggcggcaactggcggcgggagaaggggaaaacggcgacgaagctacgaggggtcgattcccggcggtgagagcatctacgcggcgtcgggaactcgacgctagcgtcggattggacggaactacgccgagcgaggctggcgacgtgcgggtgctacggggctcgagcggcgacggcggcgagcacacggcgagcgaaggcaacggccggggcggcgccggctaactacggggaggctactcaagctactaccgaaagctaggggaaggagatggagcgaggaggaagaacgaagagaggcactaccgtgcgggacagggcgctgtgacgagaggccgacggcgcgggagtaatctctccggcctcgggccggggaagaggaaggagagggcgcggccggagtcctccttcctcttccgcgtccttgctcgtgccggctcctccgacacgcgcaacgacgatcggcgacggcgaaatagagggcggcaatggcgcggaggcgaaaatgagggagtttggagggggagggcttgggcttaaatggacggcaatgtcggtttgggagaggggaaccgacattggacggttaaggcgcgagctggcgctcggcgcttgcagccaaagcggcggcaggaggatgacgccggcgaggaggaaaaggggaaaaggagggggagaaaggggcttgcccctttgccgattcgggaaaaagagggggaggggaacgggagcatcgcggcagagggaggaggggcgcggctccatcccttggcggcttgcgcgcggaggggcgggggccgggcgatgacggcgggccggtttggagcggagcggcgacactggcgacaagcgcgtgcagaggctgccggcggcggcgatcgggcggtcggccaccacggcacgcgcgcgcgggaagcaacgggcggcgtccgcgcgggcgcgcacacgctggctcgcgaggacgagcggctgcgcggctgcaggcgcggcagagcgaggggaaagggagggggcgctcggcgcggcggctcacgcgcacgcgcgcgcggcgtgcgggcgaggctgagcggggagagaggcgctcggggcggctctcgcacgcgcgagcagcgtacgggcgaggccgagcggggggggagatgggagagcgagagagagagagagagagagagagagagagagagagagagagagagcgcccggggagaggggggccgggggagagatgggccgagcggaaatcggcccatcgaacccgggggaggcaaactagacttttgcggaggaatttggtttggagggattggattcggaattgaactcgacgatagatcggggattgagatcttgagatggcacggacactagacaacaagcaaggaaacaaatttcgcaattagggtttttaagagataattttcccgctaggcgccacgacggaacgggcgctacactaagctgccatcagctttcctcttcactttgtatacccacttacaatcaatgatatttttgccttgctgaggaggtacaaggtgccatgttttgtttctcattaatgcagtatactcaacatccattgcatttctccatctttcatcagttaaagcctcatctaaagtttgaggctcacctgtagcagcaaacccagtatatttatatggaatggttccatcagtatataccttaggtttgcggattcctccttgcaaccgtgttttcggtgttgtaggttctccccctgtctcaggcatcagtatcgtctgctcgacagtactatcatcaggagtactacttgcatctgcagcaggagcactggtgtcaataattatattattcaccggtgcatgcgtcagggagggagtgccaacagcttctccctctctttctgttgatgtggacgcgcccggttggtcagtaccgacgcaagtatgcgacggtgttgcagtgccgctatcacttccatctatctgcatggagctgtcgcttccatctggctgcatggagagttgttctgcttcctgcacaccatcacttgcacccagattttctgcattttcactaggagcattagtggtattaggaaaatcaagcacaggattatctatttgttctcccccttgatcatgtgcaactagagagggtgaaagtgatgtaatttctgcacgcaaccgtgcacctgcattgggcttgaggctagaaaaaggaaacacactttcatcaaatataacatctcgggaaacatatatccttccagatgagacatcaaggcatttaaaacctttatgctgtgtgctatagccaagaaaaacacattgcttcgaacggaactgtaatttttgagaattatatgggcgcaaatgtggccaacatgcacaaccgaaagtgcgaagagaggaatattcaggactttggtgaaacaatcgatcaagaggtgtctcaaaatcaataactttgttaggaattcgattaataaggtaggaggcagctaggaatgcctcatcccagaacttgagaggcatggaagcatgggctaaaagagagagaccaacttcaatgatatgtctatgctttctttcagctgacccattctgttgatgggtatgaggacatgagacctgatgggagatcccaatttggcgaaaaaagctatttagtttttcatattctccaccccaatcggtttgcatggagataatttttcgatcaaaacgtctctcaactagagcttggaattcatggaaaattttaaaaacatcggctttgaactttaaaagataaacccatgtatacttgctataatcatccacaaaactaacataatacttctttcctccaacagaagtgggtgcaggcccctaaacatcagagaaaatgagttccaaaggaaagttagagacactattagacttatgataaggtagctgatggctcttggccatttgacaagcatcacaaaccgactctctactttccacaccttgacatggcaatttatttttgctaatgactcgagacacgataggattagcaggatgtcctagacgaccatgccaccttgcaaaagacggcaccacagcatgagcttgttttgttggtgaagtggatgacgacgaagtgggcaggggggtagaggccttggcgacatctcccctcaagcattgtggtcctcatggctcgatccttaaccaagaaatatttaccatgaatttcaacaaaggcagagttatcggaagcaagttttgatgcggaaacaagattttttgtggcttgtggaacatgtaagacatttttcagatgtaaattgcgcatgggggtagaaacaaaagattgacctatgtgcttgacttccatacctgctccattggtggtgtgcacatgatcattacccttgtatttgtcgcggatggaaagtttgtcgagctcgctggtgatgtgatctgtggcaccggagtctatataccaattggagtcagctccataggcatatgagactgctgctgctacatgacgctcttccggcacatagttctgatcgaacctgtgccagcagtcagacgcagcatgtcctcgcttgaagcacacctggcacacaggccgggtgtcattgcggccaccgccaccagtccggccgccacggttggcgccagcgctcggagctccacggccgctgccgcgatttccacagccaccgcgactggagaagccaccgcggttgcctcgccctgctgcattggcagcgatttctgctctcctcatctcgagcctgttctcaaaacttaatagttgtgcatatgcatctgacagtgtaagtggttcaaccctagcaactagagccgaaacaataggatcatattcgtcatctagaccatttagtataaaagcaatcaattcttcatcatcaggtggttttccagacgctgcaagttcatctccatatgccttcatcttaccaagatattcagagattgtggatgaccccttctttgttgtgcagagtgatagccgcacgttcatggaccttgctcgagtcttcgtagtgaacataccttgaatcgcagcccatccttcaaccgccgtctgcaccgtggctacctgagacaagacgtctcgagataacgaggagaagatgaagccgaggacctgttggtccgcagcgaaccactcgtcgtacgccgggttcgccatcctgacgatcttgtcgccggtcttcttgtcatctgatggagtcttgtcgatctccttgggaggaacttcggtcttgccggtgatgtgtccctccagtcgtgccccacgaatcgtcgtgagcacttgagctgaccacagttggtagttctgcttgttgagtttttcggagacatgagatccgaatagaggattggtttgggaggtggaagaggaagaactggccatggtggatggatagattggatctaaacttcagagctcttataccatgaaggaaatcacgagaactggagtaacgtcgcccttcacgctagggtcaacggtgcgtgtttcacttagtgcacaaatcggcacaggtaagtacatatatatgcatagacttgtgaggctcggctggggttgtttacataacaaacttgatcttgtctaactatctaaaccaccggccaagcctcatcttgtctatgtttgttacatgggatagtatctctaacactcagtgcctctcctccccatccggcgccggaaacggattccccgagccccggagatgcttccgccgccctcaatcgatccctcgttaaccgccgccgtttcccctctttgctcgccgccggtatgcgccgccgcgattcgtcgccgccggcctccctccggtgaatccgggccggtggttcgctccttattgtccctcccgtcgctccggtgacctccctctcccttgaatccccgtgtgctgccccggcgaatgtcgccgccgtccgccgtccatccggccacggcctttctccctcctcccgctcgccagcgtggccgccacctcggctttgaccgagccaagtcggtcagccgcctcctccctcccccaccctcacgcgcgcggtccacggtgcgccaaccggctgcgcgtgggcccgccgcatccctagtccatccggtgcacgcgcgtgaaccgcgctcacccgaatcctagcgccacccttacgtgcgcccatccctccatgagtcgcgtcaccgacaagcgggtcccactcgggacaacgcgatatgagcccggtccaccggctccctctctcctcccctcccgcgcgccctaatgggccgtgtctccttaggccggccggcccgttagctcggccgagccgcgcctcttctctcgggccgcgccctagccgcccgagggaagtctaaatctcctccccatttcttttcctttttaaaaagggtttaaataaatccttttccccctattccgtaaatcaattctttattccaaaaattccatgaatcattttccttggttccgcacgtcagtgactgtcaataatattcttgagaatattatttctataaattccataaaccattcctctcattctagaaattccaaataaacttccgaaatccatatcttctcaaccgctcatccgattgactccgttcaacttccagtaattccgtaaaattaagaactatctaatggcactattaattagtctaaatagggtctttcttttgatcttttgtttaggtttttgattgtttgcgtatagttgcggttgcggattttcatcaatcaaggatttctcgaagattcgtgaagcttcgtgaagaccttgagcaaggcaagtcaccctttgaccaattgctcctataatcgaaaaaatcattattattttgtttgcaacttgcattattagaatcacccgtttaacttgcttggcctcggtttgcatgccaaaccgacagacctacctagtagtcgcactaattcctgtaggctatactaccctgactccttgtagctccacctttgtggtacctcggtatccatgttctttgagcgcgtataccaaatatcctacatacaccgttgtttgtcgaaaacttgggaaatgggtttgagaagccttgaaaacccaacatgtggtgtcggtgtgtttgaaaataaaataaattgtgaaaactcacgatgtgggggttgtgcctatgtggcactgtcccgtattcgcatataaggaccgattcctgtgggaaattcatccgagcatataacaagtgcgaccacatgggtgcaatgggacgcccctggctgagtaattagctaatcgggggagccatgatgccaagagacatgttgattcaacggggtggtgtcggggagaaccctcgggcttcttggcacagtatggtctgggacctaacctggtgttggtctgggacccctcttgttggcatatggtaaacttgtgtcggctttcgaaatgccttgtcatgaaagccttagggtctcccgacgtggctgatctcacgggctgggtgatccgggttagtaatgttgtgtgggtaaagtgtaccccctctgcagaggttaactaactgttcgaacagctgtgcccatggtcatgggcggatgtgaggtgtttcctgtagcgtagatttgtttgcttgtgctttgtgaaaagttgttgtggtgtgggaatcgttaccagaatcagcctatgtggcagatggatgacctgagtggtcaagaaacgaatctgtgtgattcgggatgtctacgggcatcatagactagacttctcgagcggaagcggattgttgtgctgctgggcagctggactctgggagtccgagaacatgaataaggctctgggagccgcttaatcaagtgaaatggctctgggagccgagaagtaatgatctgacctggggggtcggtacattaccaattgagttgttgaaaaacatctcttaaagtcgaatcgagacgcaagcctcttttcggcccaaacttagaaagaagtaaaccacttagtgatttcaaaatgatttcaaaacaaaagatttgcaaaacaaccttgcctctcttccaagcttgcattaaacacctaaattcccgtgacttgctgagtacgaaagtactcacccttgctctatataaatatatatagttcctccgtcctgaagttgaagatgaagtaaagtgaagattagggtttcgtcctggttcccagccgtcgcctgtggtgttgggtattagtccgttggttccgctgctgctgctgttggtgtttcctcgtccgtatcgtcggttgtattctcgggctgtcttgagctgcaacctaagttaaggtaaataagtcctctatttattttaaggattgcaatgattcatatttgtcaccgtgggtaccaacgctatgtcctaggattggtactgagatcgcggtttcgtaggaagcggttcgcgccgtttttcctactatacactcctgtcaggtgccgttgtacggtggtgccagattggggtgtgacacaatggaatgtgaggcaagatttatgatgtcatttcatttgcccttgtatgataaacacgactgcaaaaattccttacaataattgattgcggagcaataagaaatagccttaagcttaagactagcctttactagcttataactcatccataagaaataaaaaagtgttctttctcttacttcctttcatcatgtttatgtttgtgtctgcaagctttactattctggatatcttttttctcgtgggatccaccttatggctttacgtactattttgtttttattcatagaacaccatgaccagcgtgagatctcaattaagggtcgtatgacctccatacattgaggatgcccatagacgattatgctgctaagaagcatgcgaacgaaacaaaataggagcagcagttctgatataaatgcagccgaataagcaccgaatctgacgttcctgctcagctagcaccacgaacgtgaagaagccaagccgatcgaaggatggctgccgtgtcgtgtaatcgtgttcgtgtagaaccacgtgaagaggctgcataatttaagaagctgatcctgaaaatgtttgagaaattcacgaacttcgatccctcgagtcagttatgaaatcttcagagttccggctatggatgtatggaactcatcgagtcctctcgtttggcgtttggcgtttgtatgggcctaaaactcggcctgatgatatatatgggcctaaattttagttcgactttcttagcctatgccggatctggccgggattgatgagacccatccaaacaggtaagatcgtaacagatgtggaataggtccgttttgctttccctatctttgcattgagtttaaatcgcaactctgaatcactcaataatgagtattttttataatgtaagactttctagcatgcattgtccatgaatgtgagcaatgctagaaagttttacattgtgaaacgaaggaagtagaaatcttgagcacctaacttgtaaaacgggattaaattagatcctctgaaagtatagatgattggtttccctgataaaccgaatgatcaaacaagatagaagcacatgtcattactttgccatgtctcttgtcttattgatgtcaaaggtactagacaaagacggatagacggaggcacactataccacatttacatagaagaggaactccttttctatagagcattaactatatttagtactattcaatttcataagataataattagtacatgcttttgcccactgattgatacttgagcagatataggagtggggtacatgtagtaattctatactaaacttctctagacattaattaagtataagaaacagggtttatgattctgagatggtcttccattttgggctctagcgaaatgacggttttcgcgaaatctagtggaaagccggtagattccgaacaaattttataaagcaaaatttgaatacaaattccttgactttaccagttggctttgatgaaattctgagtgaaatcatcgaaatttcaattggtaactagaaaaagaggtgaactgaaagtgcttttcttttttttaattcgttattcttttctctcttaccgtaagttttagtaaatacacgaaatatattatttttttcgaaaatttatatcccaatatgttatatgaatatcatactatatataatattttatttgatattttccttttttatcaattcaaatttgaatttggatataattcattgaaatctcagacggtatctactttcgagccttatcgaaaccttgaaattttacggaatttgaccggtttttgtcggaattgtgaaccctattagtatcgaggcctttacaattatgcttaggccccattctaaactacaattccaaattattttttcgttagcgtgtccataactgctaaatggtacatttatttttaaaaaaattatataagagtttctaagagaagaattaaacaaatttattttaaagattataataattgatactcgaacacaaccttagttgagattacagtgtagtagtcatcaatcctatacatgtgagtaaaaaaagttataacatattttatgtatgccaaactaaacaattctcaagttataaaatgtacaagtgtacaaacacagctaattcgataggtaaattaaaacacaaacatgacttggatcataggcaaacagcagctcactacaaccaaaagacacatttacagttaatcatcactgtttatttctgcaatcctccacccatgaaattaaacacactacacctcttagcttccaggcgtaaacttcatgcagatcggtggcttaatcttagcgagagcaaggatagaagaagggaaggtccaaatgccatcgccacacatgagcccagacgcaacagcaggcaccatgaaggcagcctccttcttgttcatcttgttccaagcaaacagcaccaggctcccgacgcacatgtcgatggcgaagctcgcccctacgaggaacggcacggccatcgccgtcggcagcggcacgagcttcttgtacctcgccggcagggcgtccctcgccacgttcgtgagcacggcgaacgcgaagaacccgacggagagcgagaggcagtgcttgggcagcgccgagatgccctcgatcccgaggatcgccatgttgcggtagatcagcgcgtatggcgccttccagtagccatcggggttcccgatgtcaaacgccctgtagaacagcatgaacgtcagtggcgcgatgaagcagccaatgcctgtcccgatgagctctcccacgagcatggacctcggcgatgtcaaggtgagatgtcccgtcttgagatcgtgcatcagatcggcagagacgagcaccagctgcttcaccagggtgccaaccacaaggccggctatgacgccattgtccttgccagcccaagctgcaaagacgaagagagcgatcttgccgtagttgtaccccatgttgatgtccgtgagccctgctccgtaggaattggcgaatcctagcaccgggccgagcgcgtaggctatgatcacgtagtaccacttcacttgtcgaaacattatcggtatggtgattaccgcaatgatgcttagcaagaagtaaccactgtatgccatccaagaagggacagtacccctcttgaatacctcatcacgttgtagatcatctaatgaaaccatatcaccctcctctgatgctgcaattcatttcatttagccatcattaacagtgttatgagtatgtgaaaattaaggtgatggaagagtgtgagaggcattccatttccatgtagttgaatttgcaatggtttcattttctcacctgtgttgctaacgctttttcggttaaatctattatgtaaactcttagcagtgacaccggtaactttaacaaaatggtacaggccatcccccataatcagagcaatgcataaaaacgactgcaaaaggagcaatttacataagttatctgatggttttgtaagtagtatctgcttttacattaagcattgagaaaatatgagaccttgtaaccatacaaacttgtcatgctgctttcaggtatgtttgcagggtaccagtcccccttatgtttgctgataagtggccacattattccccatgaaatgaccgcaccaaggagggtagagaggttcacaaggtgtgagcaaatcatccccgcaccaacatatgtgaggctaaaatcaaagaagaatctgatatccaaacaaattcagacttagaaaatttgtcaccgcatgctacaatttatataaatctgtgatgaacaattaggaaattagcatataattcttacgattgtttccaggctttcagaccaaaagtagggaactgaacaaatccacaggcattgcctcccgtgtagaaccattggaagaagctccaaaataagctaagcccaaaatattttagaaacccatggagttgcaatctgtcatgaatgcagattgcagaattagttcatttagggtcaacgactgtctaacaagaataatgcaatgagcacaattaattgaggtgaaaacacgtatactttgcattcttatctccttgggctgtgtggaacccgttgataagaacagctgttgcagttccacttggataagttaatttgtagtctacgaccaaagcctgaaagcatttagtaccaattaatttagtaggaatagataattgagacctattttttatccttaaaaaatgttttgtgtcacatcactacttatataatgctactgtagtccatgaatgttcccatcctttgggctctgctttttttttttacattgctgccacgtaccaactgcatcttggatttgttatttccaaaggtttttttttacttgattgcattttcttactgagtttatgacagctttgtcaattgtcaaccaactggctttagaaattaggagagggtggcgcagtttgaaacagatcattattgagcggattattgctacgaataatctacttttatatgtatgtatatatatatatatatatatatatgtatgtatatatatatatgtgtgtgtgtgtgtgtgtatatatatatatatatatatatatatatatatatatatatgtgtgtgtgtgtgtgtgtgtgtgtgtgtgtgtgtgtgtgtgtgtgtgtgtgtgtgtgtgtgtgtatatatgtatgtatatatatatgtgtgtgtatatataaagaaaatattttaataaataaacttaacaaatctatactgctttaaaagattgtggtggtagtgttcagccaccaatccaccaccaacaactatcatgtaggggtccatggaaagtgagataacactttgattttttttagccacctcacacaagagagttatgataactgaatatcctttttaaggaaattttattaatctatgatatattagataatagggatgacttttctaaaggctctaaaaatatatacaatgaattattttttaaaagtgatccaaacagtacactagtagaaagttttatcagaaaacacaattttcaaacattaagtaaataatttgtttcaacaattctataaacaattaaaaagaactaaccgaagtggatcaaattaagggaagaaaggcacacctttcttaggggaatcaagctgaggttacccgcgaagctaatagccaggaggagccctaccatccagccaatcccaggctccttatagctccctggcacattgcctggtgagttcccggccagctcgtacgtcctcttgttcaggcccagcaatgtcgatccgaacccacctgcatgaaccactcacaccgatcgatcaatacagagcacagatcaacatctatgtgaggttcacattctcggtgtaaatttccaaaatttcaggttttacggtggtatcggtacaattttccaaaatttcactaagattggctctgcttaaaaaaaaattttgaaacataaggcggaatgaactttgttccacttttatatttagaagaagagaattgatacagtttataaggaaaaccggatccgaaaaccacacaattgcacggttaattataaggaaactggctgaaacccaccgctacacaactaacaacgacggtggagcccaaagcttaaaaaaaattcgcatatgtataaattagctaaaatatgtttcaaacttcaagaaagttattccaaatttttgaatttcggtccttttttttccattttgaaatataaaaccctgcttagagtcaagttattgaaattgaaaaacatttcaggagtactgatagaagcgaaattttagaaattgtgggaatctcaagatgttttggacgaaattaaatacttaaatttaaacaaaatttatttaaatttaaatgttttcttgaaaaatggccgaaagaatattctattggaggatcaaaatttcggaaattccgttccaaaaatggaaccctctgcctatatagtaataagagatcgacgcagaggctgcagcccggcgacgtaccgccgaaggctatggtgtagcaggcgacggcgcaggtctggacgacggtgttctcctgccgcgtgaagggccgcggcgagaagccgaggcgctccagcgcgcgcgtccagccgcggagcgcgaggaaggcgagcagcgcggcggagatgttgagcgtgggcaccagccccgtggtgagcgcgatcttcatcacgatgacgctgaacacgaacccgatcagcgccgccgccaccaccccgcgcgccgtcacctgctcccgccacggctgcagccgctccatctcccgcgcccgcgccgggtccgcctccgcgtcctcgtcgtgcaggctcccgatctcgggcgccacccgcgtgcggtccgcgtcggcgtgctccatggcggcggcggcggcgtcgatctcgcttagctgctcgatctgcaccacgaggacaagaaagaaacacggaattgattatctcctcttcagcgacgtcgaattccgacgagcattatttgggccaagatcgatgaacacggcaggatgcttcacctcaagttcgcactgctcgttcgatcagtgcgccaatggaacagttgctcactgctcaacgtgagctctgcagcttgcaagttcgagtgatgcaggggtgatgctaactgcgatcgatggcatgtatttatacccacgagctctggaaaaggtctacgatatacgtacaagattttttgtgtccaatttgtcacaaagaaattcccggattacttttcatgcgttggactagttttgcttcttctataaatgtttgctgcagtagagatgcacacacaaacgcattctatctgtgcttcctcccaaatcttatcgttctactatagatatcctaatcgcggttccatttgactgagcaccacttgtctaggaactttatattcttattgtgtatcactatatattacgtaatcagtggcggcacttttcttgccgtcatatcattgatgtggaattcacttcggcaatgctctactcatgattttgttgaatccgaagctgatgatatgtaccgaggaaaaatgctcactaatagtacggcaaagtcaaaaccccaatatggttagttcttgtttttcttaataagtgctctaataaggaagcggaatcattaaaccacaagtgtttcatggcagtgcaaaaaaaattaacgtggtcaacttcagtttatagtaagctcgtaaattaacctgaaagtaacttttggttgtacattaacctgctattttttaaaacttttttttaacgaattgacgatatttttttcatagcttgatttttacaaactttgaaccgggaaaaaagcatgaggaaattcagcaaaaaacattgcgatggagaatctggagacatgctagatttcgcactacaaaacttggcatgttttcctgttaagccggctctaggcctctacttatattaagtgatcaatattcatagagtaacagaatatatatactccctccgtttcaaaatatttgacaccgttgacttttagtacgtgtttgaccattcgtcttatttaaaaaaattaagaaattatttattcttttcatatcatttgattcattgttaaatatattttcatgtacacatatagttttacatatttcacaattttatttgaataagatgaacagtcaaacatgtgctaaaaaatcaacggtgtcaaatattttgaaacggagagagtaattaactatttttgtagaagactatataaaaataaccaaaaccacactgacggggttatttgatgaataaagcaagtaagcaactgcagctttcggaatgtcaaacgagagagaaaagatgcttatcacgcaacgccaaatgcactaattcaataagtccgcggagtcaaatgctatactatatgcatcatggttcatcatttcctggcataaaaaagagtagtagaacagtacgcccatttcatgccgctttgctcttagtcttagtggcctatgccccttgaaatgatgggttgaggtatcaagcaacaaatgcttttgtgctctctcttttgattttaaaccacgattcaaggatgaatgacaactaattgccctctttaagcgaacctggtttaagaacgtgtttggttttaaaactattttttgagatgaatggtacacatgtctgatgtttagaggacttgtttggctgaaaatcatacaaaattttggtagtgccggttggcaagttttagcactaccaaaaaattagtaaggtagattttaaaacccatttgaattgatgccaattagacacatgtatatgggtaatgccaaattgttttgtgaggtatcaaaaccaaacaggctagaatgtttcagtaatgccatagccttgcctgaatacttggtttcggcccaaactatgaataaagaaggaataagtttatctgaaatttgtcaacgaatctgattttcatccttcaacctgaaaaccagatacaacggatccctcgactgttaaaaccggtgcaaaataagtcccaatgcagtttgtatggcggttttagctagcgtggcgcctacgtcccaagaccgagttaaactagccacgtaggcggcacgtcagccaaatccgtcttgggacttatttcacaccggttttgacaggacccattatatctggttttcggattgaatgatgaaaatcaaattcgttggcaagttaaaaacctcagatgaacttagaccaataaagaagtgcggtgcggtgctgggctgggcggcctgcttgctgcccggcaagccacaggcccacaaacaccgaagccggcccgcctcgccgcagacgttcgcgccatcctccctcaacaaaaatggaaggcgctgcttccagctgtcctcaagccatcctccaccggctactcgacagcgcaacctagctaatcacctacacctactgcgcagcgcagctttactgcttaccatctccccttgccaattctgttttccgcttgcattgtcacgatggagaagagggaatgagggatggagggcgagagaggtcgggcgccatggacgggggcttactcaccaagggtcaaccggtcgacgtcgcgcttgacgccgcagtgggtggcgagccgaggagatctcaccgtgcatgcaatgcagcccctgtggtggctcgggaccgggaggaggggaagccccgggcgacgtgggccgaggcgctcgccagctgttcgatgcaatgcccacgcctgcctctggttcatgtgcctgtgggaggaatcgagggggtggagtagtcaagtgagatcacagacttccacagcttgtttcaggcaatgaggcaagtgttagtcatgattggcatagcttctttatctgaaagaggctatgaacttatcatggcatcttgtgactggtatgcagataacttgagagtatatgatctgaaaacttacatggcatacacctatatcataattcataacttacaagctcaaattgtcaagtgctgatctacagctagactctgaaatgctactgctcattatgtagtttcagtggcctggcttgctgaagtctgtgtacaatacactgactggtgtcagcccagagttaatttgcactatggacactcttctcctttgctggactagaactctggaagataataaccaagtcactgtgagctcatgttttgtgaacatcaagtgctatgggttgccaagattgggtcggatttcccagaaggacggaatattgattatgttgatcatttggtggccataatcgaaggtcagcagttcttctagttctattttcgtaaccaatgagttaagtcgttaagatattgatcgatactaagggcatgtttggttggttccccgtaattagccaaactttcaagccacatgttttgtatgatgcaattttggtggtggcaaaagagctcagtgccattgtggcaaagtttggctaagagatgagcctgttgtggctgtgtacatccttcgggatgtagaagtcgggttttatttaacccattatctaaaaacgagatgaacctgtggcatgtaaggattggggataggaaaaggtggcaagtattgggtgcaaccaaatgcttccaactgtacgtcaaacttgcctaaattgtgcgtgacaagtttggcaataaaccacaaacatgccctaaaattcatgtttactagctaaaaatgtttttctgccatcatgttccgttatgcactttacgatgttgcacggtggtaatttctaagtattcggtgtgctttgtgattagtgtttagtacatagtgttctcttctcaaaaaaaaaaaaggaagaagaagaagaaggaagtacgtagtgttctgtttttttccatgtgggcagagatccttttccaagccagtcaaaagaaatatatactacagcatagtaaggttgtgtttagttcacactaaaatttggaagtttggttgaaattggaactatgtgactgaaaagttgtgtgtatatgaaagatttgatgtgatggaaagttgaaagtttggaaaaaaactttggaactaaacagggcctaagcttaaaaaagagacacatgaaaattcttaatcctaactattcataattggaagcaaaattatgactcacatgttagattctcccatgagaaagggaactgttacagtcaaccaaatcacttattcatcactaataaagaaaatattaaaggggaaaaaggacaatttgttgaagaaaacacaggagatcagtttaagttttaccttacaaattacaagaaatcaagaatagagtgcaacatcatatttcatactaatggtagcaggcaacattatttcatactaactgcaagatttttagtccatgcaaatatcaaatcaatcacaatttttttcatacggaaacattttcagagtctacattcacaagttcagaactcgtaacaaaaaagagaaagcagaattacattttgtatttacaaagacaccacaaagaactcctcacagtattaactgtaagtctgatgtttgactgaacctacagaattgtgtattacaaatctacagtaagcaaaatgttggatctttttaaagtatttatagtgataaaaaagttgactaatggacctacctttacaagcacatcagaataatacagtcaagaacaccaactcttgcagaagtttatgttggagttggagcagcagctgccctcatgagcatgaatctcctcctcgcaatattgtttgcattttcacctagcgcagccaggtgaagcatccgccgccttgctgccgccacagcaacatcatctgcggttggcttcccaggaacctcatgaggtggtgagctctcccctgatgcctcgacgtcaccatccaattcgttgtgctgcatcacttgctttatgctctccaccacctctctcatagttgggcggtcttttgcatgttttgcaaggcagctgttggccaatttggcaatttctctagtgccctgcttagagtaattgtgcctgagtctgatatctataatcctgctgaacctcttagtctcaacaggatactgcctcacccattccaggagtttctgctcgttcttgggacgattcctttccattgaacggcgtccggtgaggatctcatataggacaactccaaagctccaaacatcactcttgtttgtgagatggcctgtctcaacatagtctggagctgcataaccataagtccccataacctgatagcagtaaagaaaattgttcttggtgagctatgaaatccatgttccattatctattttgataagaactggaatgtgcagaagctgcatagaggaattcctttactttgatcaatgaaaataaatcagtacttaccgctgtggacacatgagtgttatctgcagttggcccttcccttgctaatccgaagtctgaaagtttcggtctgaattcctcatcaagtagcacattggatgctttgaaatcacggtatatgacctataaaattttcaagtctgaaacaagaattttctgtgtttcctcaagcaaagtcaaaaccataattgacaggattgcatttttaaggatctcttaaaagccatttacaagctggaggtaacattcatcgttgggagaatagccactatggtccctgaagtttcgctctgagatcattttagtccctgacctttcaaattgtccaagcaagcccttaaactttatcatgtggacatatacagtccttggcccatcgaaaattgccacgtggacatgccatgtcatcttccaatgcaaatatatgatgacatacccaattttcccttacacatatcgtcatagggaaaaaagagagaaagaaaaggagaaaaataataataataaagaagtaggtgatcctgcatattaaatatccgttagagttttaacattgaaatgcaactacttacatgaaatttatttggcatgataattatatatttagtggttgtagctaatttaactttgtattagcataatccagtgaaaaaagtttgccatatatccagtcacattgaataaagtttgtaaattcttttcattattttttatggtacatggaagggtaaattggacattttaccatatattttgcatgagagcataacatggcatgctcatgtggcaatttaagtggaactaaggactatattagcccacatgacaaattataaggactcgtttggacaatataaaaggttagggaccaaattaatcatggagcaaaacttcaaggatcatgttggctattctcccttcatcgttcatggtaatcattttctttcaagtatgtcccattcaatcaatatgtcatatgactcaacggacattcaaaatacttgcaataaaaaggattgagtaatatgtccatccaagctatatgattagattcattccagatctccagtcatgaaatatatagttaactttaaaattcagaagtgttgcaaaaagatcaacataattgacttgcagacaaccattcttgcacagcatttgctaaatcacaacattaatatggtatggctcagggacaccaacaaactgtgaggcctttagcaatataactctattaaaagctgtcctatttcagactttaggggagaaaatgggtaatccgttatgattcagatgaataaaatgaatttcttgatggtgagttgccagcggtgttacctgaacttccaatccctcatggaggtacaacaacccctcagcagcacccaatgctatcttcaacctgatgtcccatgggaggacgggatatgctttattgaatagatgatcatccaaggtcttgttcgacatgaactcatataccagcaacctctgagggcctcgttcactctgagcggcacaatatccaatgagcttgacgagattcgggtgctcaacaacccctagaaattgaacttctgtcagccattgcttgtgaccctgatcagaattgggataggacagaaaaggataaggtaaaacactgaatggtttctaggctcttaaatataagcattgaaatgaacctacaattttaattacatagaaggcatgcatctatgtacaccattagaaactacagaacaaagaagtgagaagacaaaaacattgaaatgatacactaacgccatcacaaatcttattaccgtgttagcaaattccatattatctactagactatacatagttattcagaccatgctcagcttaggaagccaatatgccgcagagttgcataattcacatattagaactaccacaatagaagtcagaagtatgaatgtcaattggcaggtacttataaattgtaaagtactggctagtgatcagggattccaaaagtttgagcccaaattttttaattgaaaaacagctgcattttctttgtttaaaatttttgggtttaaacttcagtttgataatttttttctagtgattatatactagtaatatagttggattaacccggacaacaccgcccaattggacaattaaattgcagaggaaggatacctgtcggctgttgggattgagcttttttatggcgacctcggtgccaccggcgggccctccgggcagccgaacgacgcccttgtagacgctcccgaagccgccctcgccgatcttgagcaggcggctgaagtccctggtcgccgcctggagctcccggagcccgaactcctgcagggagctcgcgcccctctcctcgtacagctccgggatgctccgcgccgacgagaccgacccggacgacctgctccacccggcggcgggcctcgccgccgccgcgctcgagtcctcggtcgactggctcgtcgcgacggccgacgacgacaccgtggaggtggagtgggacgagccggcgagcgccgacggcggcggcggcggcggcgctggcccctcgtgcggcggcggcctcttcttccccttccgcttcttgatcatatccctcacgcggccgaagcagcccatctccgaggaacagtaagctggagagagggggattcgggtcagctcgtggtgctcttctccatggccttcacctcgtcagctcgaatcgtgaggagaaagggagcaacctttcggcgatagaaacggaagccttcttcttcttccttctccttgctgatcggatacaactacaagaactattttctcctggcctccacgaaacacgacaacaaacggagacgaacacgaacgaactcgcgtgagtcggtaaactgacgcagaatcgtttgacgcaagcaaggacgagggaaggatgacaccaatttgtgctgggtgaacaggaagttcgagtgtattttccttgttctttttcccctgggaggcgaagaattttgagccacgcttgctggacaagtacgggagtagtacttgaggaagcaaagaaagcagattaataaaagaggtggttgaagtacaaatctcgaatcgcgggggctcagaacaaatcgtaagaaaaccttgtagggggtcaaacgaaatgggctgaaagtgacaggagaggccgcggatgcaaaactgcaacaactactcaccccggtcgcagctcgacaggcccccacgagactcgtagggaccacctatacatttgtcgataaattttctattaaaaatttgacagatataattatagtacaatcgtagtgtaattacactgtaacttgtatgtaattacactgtaaattgcaagtaactacagtgtaacttgtatgtaagtttcatgtaattttgaatcgttagatctattacaagatttgttctggtgaggaagaaaaaaatcacagcacacacatatgtgaaaggatttgttcccacgacctctattttactgaaataatatgttaccgagagattcttgaaagttacatacaagttacattatagttacagtgtaattacatacaagttacagtataattacactacaattgtactgtaattatatctgacaaatattagggggagaaatttgatgacaaatatctagcaaaatcggactcgtttggtgtattttctattgtgcttagtctttgataaaatccaaccacgttacaaaaaattttgtaggtttaacactaattttgtttgaagtgttcaaacacgtgaacaatcaaccaccaccaaaaagattcacacatagacacgctatggttcgtccatgaaccccctttttttttggaacgataatgccgttgctaacgttttatatatagaagaagatgtctcactctaaggagaaaatgagaccaaaccttatagcgcacagttaattagaaataattggatgaaaaccacaactacaaacaactcataacaaacaaacctaaacaactaaactataagaacacgaaaactgacaaccaggcttactaagtagtgaacccctttttatgctcttgaatgcaagtttatacaagagaaaaactacaacaagatcgagaagtgtacatattgtaatcacgcacaaaatataattaaggtaagtgatatctatatggtattttgctaaaaaaggtttaacaaatcaatcaaactataaccgtcggatcgcaaaatggatggtccagattaatccttatctcctatataaagttcacttgccattcccaaaaccctagttctcttcctcccactccactggccgccttccgccgccagcatcaattgtccttctctccgctgcttgcctccctcgttcctcgtctttcatggcagcacaaccttcttcgttgcttgcttttctccttccttgactccgcagcaccactgccttctttactatctcttctatcttaccccttacttgtgagcaccgactaccaccctcgctcggcccggcgcgtcgccaccccttgccatccctcttgtccctttctactccaaccccaaatctaaacaagaaaatacataggagaggatggctcatcggacttataaacgacatcgaccgtggttagagcatggatttggacttctatcctaaggttaggatttctattgtaaaatcaaaagttatttttagttgagcacaaaagggatcagatgtaacatatgttagaagattggaatccgtttcaaaatggtgtggtatcaggtggtaccaaatctgatacctatgagtaccagatctgataccaaggtattggtacccacaggtaccagacctaatacctgtgtatcagatcttgtacctaagtattttacatgtaccagcaacaggttccatcctaatgggtcatgtgcaccattgcggagatcgggcacaaccggtgatgtgtctgtgctagtggccagaagcaggtcacaacgctagtgttcgccatggccgtctgcaccgagatcgttgttacggttgtgttgctagttgttattgttatagtgatcatgggggtcgatgttgtggaatcgtgcgggaactgtacaaaggagatcatgttgttgtcctcagcgccaccgttgcattcaatcatgaagcaaacgatggcgcagagggcccgcgagttgcttacgtaatggctatagtctgggttgagacgcgttggagagcaaggtggaggcacacagtggttgccagccagcgaccaccgcatgcgctgcatatcatcaacctgcatcacgtcgatttacagccacatcaccttattgccctggcaaacccgccccttgtcgtcattctcatggaagttgatgtcgcgtggaggactatgacggtggcacttgcagcgggaacacctagctaatactgtcgtgcgctgcgcacgtgatctcatgcactagcattttcaatattagaattcctatttccaattattttatggtcatattttgaacctatgaatccaaaacttcacgattctatcctatgctttcgtcgacatgatgatcaccctctctataatactcctggcatagtacttcctccatcatagaaaaaaggggattcctagttctccaaaacaagaagagtagtgagaagtaaatactaaaatgccactcattaataagaagatagaattggtggttggggtgaaggggtatggaaacttggaaatgatagaatttcgtgatggacccgggtagatgagaaggtataagttgatttatttttggataaagtttaaattttagaagttgttcgctctttttttttactgagggggtatgattgtgtccaatccactgaagggctctcccattttcttggcggaacagatcccctagcaagactttagcttagaaatatatttcctatccgtctagattcgtagtattagacggataggaaatatatttctaagctaaagtattgtgatgaggntgctgtaccatgagttgttctagtngcccac

SEQ ID NO: 34261 - DNA, 1413 bp, Oryza sativa
agaacgggcagtccataagctgccacaagctttcctcttcactttgtatacccacttccaaccaatgatatttttgccttgctaaggaggcacaaggtgccatgttttgtttctcattaatgcagtatactcaacatccattgcatttctccatctttcatcagttaaagcctcatctaaagtttgaggctcacctgtagcagcaaacccagtatatttatatggaatggttccatcagtatataccttaggtttgcggattcctccttgcaaccgtgttttcggtgttgtaggttctccccctgtctcaggcatcagtatcgtctgctcgacagtactatcatcaggagtactacttgcatctgcagcaggagccatcccctattagattgattctttttgggacgcagggagtaggtgggcataattaaataggcttatgtgtgattagttgggaagataaagtaggtggaaaattaaatgaggaatgttgtaattggttgataagagaaaaataggtgaagttaatatatttggcacaaaattcaactgctagaagttgttatatttttggacgaaggaagtagtacgagtgcttactggtatttagaatgattgagaaatttgatgaatatcgttaggcattcattcttttatgggcatgagccggatcgaatcctgaatgtggtggatacttgtcacgccccgagctagtcccgacttgaattagcccgtgacgctccaaattaacctgttaatcgataccagtcccaagaaacagtgctggtatcacaggaagatagaatatcacagcaacagaggtctctttattatagagtaggagtacagtcatgttgggctgcggacagatcccgagctcacaactgcattacaaaagggaaacggaagccgggacttggaccaaacaacacaggcgcgacttgggaactaggccgaaaccctaaaactcatcgtaaccggcttgctcctggaagaactcctcatcagcaggatccgcttcatcttcatcagcaactgggggggaatatttatatagagcaagggtgagtacgggagtactcagcaagccaggggaaataagtgtttaatgcaggcttcaaggaaaggctgttgttttcgtaattgattttatttgaactcttttctaaaaacatctaggtgagtgcttctcaaacgacacggttgagacagtgcgtctcgtccggtcggagtatgtgcaatgtatcaatctttagaatttaaacaagggtggcaccccggcaacagctttttcaacggccaccccggccaacaactttttaaacgggcaccccgggctagctgatccattagctgcagatttttcaaacaccggaacccttttaacacagcaatttcacagccggagtcaat

SEQ ID NO: 34262 - DNA, 967 bp, Oryza sativa
  unsure (1)..(967): unsure at all n locations
cggcgtaggatggacctatgagatggnacagnacctcatcagggcggcggagcgcgtgggggaggaggctccgcggggttctgggcggcgcgcggcgccggtggttgctacccggcggagacggagacggtcgcggtcgcggtcgcggagcccccgcgccgcccgcccgcgcgcggagtcctcgcggcggcctacggcccgccgtgcccgtgcccgtgcacgtagcccctcgctagagatcatcgacgtcgacagcgggagcgacaggggcgtggtgcgcgtcaaggaggagccgcgttccggaagcgactcggactacaatggtgcgagaggtcgtgcgcgtgcgcgggcgcgggcgccggtcgccgccaccgccgcgaagaagaagaagaggaaacgaggaaaggaagctccaagcagagcccaggagagccgggaggttgtccgcgtcaaggaggagccgaattccgacggtaatggtgcgggaggtcgtgcgcgtgcgcgctcgccggtcgccgccgccgcgaagcagaggaagcgaggaggaagagaagccccaagcagagcccaggagagccgtgtgcccgttcaaatcaaggaggagccgtattccgggagcgattccgacggcaatgtggccggtggccgtgcggtcgtgccggccgccgacgcgaagcaggggaaacggggaaagaaaaccccaagcagaggcaaagggcggcgggtggttgttcgcgagacttccacacccgctgctccgtccaatggtgctccctccgtcggcaggggaaaaggtagagggcgtgggagaggtcgccagagaagcaagggcgctgttcgtggtcgcgctactccggtgaaaagagtgagcacgggtgttggttgagaactcggtcacgcttgcagancaggggaagttttttccaaaanntnngngnggnccatgggacgtatcaccaagcgcgcg

SEQ ID NO: 34263 - DNA, 663 bp, Oryza sativa
  unsure (1)..(663): unsure at all n locations
gtggggagtgagacctaactnnnnnnnnnnnnnnnnnnnncattcgcgccgcccgttgtttcccgcgcgcgcgtgccgagtggccgaccgcccggtcgccgccgccgtcaccctctgccgcgccagcccgcgcctgtcgcccgtgtcgtcgcgccgctccaaaccgccccgccgtcatcgccgtcgtcatcgcccggcccccgccactccgcgcgctagcctccaaggggcggaggcagagagcccctctccctctgccgagtcgccccgctccctcctccttttcccgaatcggcaaaggggcgagcccctttctctccctccttttcctctttttctcccctttttcccctctcgccagcgtcacctcctgtcgccgctttggacgctagccggagcgccagctcgccggcttgaccgcccatgtcggttcccctctctcaaaccgacattgccacccttttaaacccgtcttccccctcccttcctttcctctcccattcgcctcctcaccgttgtcgccgctcccgtgctctgccttgcctccgccgtccatcgccaagcgccgggagagccggtgcgttcgtggacgcggaaagggactccgggggcgcccccttcttcctctttctcggcccgaggccggagagatcactcccgcgc

SEQ ID NO: 34264 - DNA, 10243 bp, Oryza sativa
  unsure (1)..(10243): unsure at all n locations
gttggggnattagagaccactggtagtacagcgccactttaatttgcttaacctgacctcggtgaagagccgagtgagctgctctggggataaaaaaaacatatggaaaattctactttagtctccacaattattcttttgttctttccattgtagttaatatgcgtcaaaatcataaaagggtcgcaatgtttcacccccacgttccttagttttttatctgttcctcctatgtaatctctctgtataattagtttggcatatatatcaggaagaagctgtatgcttttaccggttggaaatctaaaaggacgtcaagttagcgcttttaggatgtttcatgatcgcagcatcaatcctaactttatagtacgaaaaaaaaaaccttttaaataaatcaaaggggaaacagctcaatatctagctctatactcacccctaatttttcacatggcaaaagagctggaatgcttggaaatcttcgatctacgtcacattctattctctgcttcggtggtgatggtatcaggtatgcctctgcaagtcatctccgcttgcatctgagaatcgcctttttatttttgaaaccgatgaatcattgagggtcctctgtagtagtactgctcactaacatgtgggctggattgtgaatcatttgggtaggagaaaaaaaagttaaaaaatgtactgatgaactgaaagaaaaaacagcgtattgggttctctgcttctcccaaaaaacctaagacttgttcactttaatgttatttctaaccatatcttttttggtaaagttgccagaaaaatatatatgtttagtttgttgccaaatttgctcagtacataagaaattctgccattttgtcaatattgctatcttgctaaaattttagcattgccaaaatttgataaggtttattttgactacaatctaaacaggtccccaatgtccacttttctagacttcaggctagatgcccagcttgttgaaggcccaagcgtgcaactaggggtggcgatttcccttgtggggccggggacccacccctataggggcggtggtaggtggaaattctaacccgcgggtgcggcggggcggggccccgctcattttcaggggtgggagcggggttgaaaaattacccgctggttactcgtgggcccctaaagtacacaatgcatagaaggtggcccattaaaacaaataatctggaggtagcttagtttcggtggggaataagttcactttgactcccttaactaatggccgaatctgattcgtatctctaaaccacaataccggatatctcgacaccctcaactattaaaaccggtgcaatttgactctctcgatggttttggaggatggttttgctaacgtgacgcctatgtggcgttgttgaccgaagtatttgttctttgtagtgttgacgtggcgcttaggtggcattcaaataaaaatatatttgtgggacccattgacatgtgggcccatatgccatctctctcgtttccttcctcctctctctccctttctcttcggtcttcacgttggcccgtatgcagggagcgggcgccgaataggcggcgggggctggaggggcggcggcgtgcaggatgaggcagcgaccggcgacgactgcaggtactgcgccggcaccttgccggtgagcgtatcgtctgtacacgtcggcctcctgtgaggctgtgacagccgcttgttgtcctcctgctccggcgccatgtagcctccgaggcgggcagtggcgtgcgcgggctaaagagtgccaggtagaagctggcgacacaggcggcgccgtccttgtcgagcaggacgttggtggggcacggtgacgacggcaacggcggctacggcggcgtggcgccggtgccgccgacatcgaggcggtgggacgccgccgacccgaacacgatcctccgcgtgctctgccaccgcgacgacgaggtcgccagccagtttctgaagcgcacgttccagctcgccgagcgacgatgacgcaaaaagcttcgcgtcgtctcgtctccaagctcataatctctgaattaaaacctcataatctctctcgaacgaactgtgaacccaacacaagtatgaatatctaaaactttctggcacggatctaaaattttcaatcttgatgtcattcctatagttgcattcgaaagttttctactgaaaaagcttacgatacttttttagcaattccctataactcccgcacgctcctcatccccagtccccgccctctcgctccgcctcctctcacacgccgctgccgctccagcgcccgccgccgccgccgattcggcgcccgctccccgcatacgggccaatgtaaagaccgaagagaaggggggagagagaggaggaagaaatggagagagatgatatgtaggccccataaattttttttttgtctgaatgacaaatgggtcccgcacatatatgtttgtttgaatgacacctaagcgccacgtcagcgtcacgtggaacagataccaggtcaacaacgccacatagacgccacgtcaacaaaaccgttcttcaaaaccaccgaggaagtcaaattacagcgattttaatagttaggggtgttgagatacccagtattgtggttcagggatacgaatcagattcggccactagttaagagagtcaaagtgaacttattcctttcggtggacaccaagcccttcataaagaaggccacatctagctcagttgcagcccaattcgatggatgcgtacaacaaagaaaaccgtagatgaagtcacgagcagccagatgatttgatcgatccccaaattatctctcagcaagaggccgtgcgccgcgccgccgccaacgtcgccaccagcatgaggccgtgatccgccaaacacctttcccaggtcacgccctcgctccacaaccctttcccaggctcaacactagcagccgccgctaagccaccatgccgccctgatgcttcgtcgtttgcgccatgctgtctcgtctcctcgtcggtcctctcccaggtgtcgcccagcagtgacttgacggcagccgtcgtcgtcccatccatcgccgccgctagccagtgtcggtggcctgccttcgcctccccaagccgacaccatcctagccactgccgctcctagctggtgttgcattgtcgtcgtccatcgctagcgccggtggccagcccgccatcgtctcccctagccggcacctagctggcgtcggtggccagtcccaactccatcgtcaccgactcaccgtccacacctgtccctagcctgatgctgtgggtccccggctccccgctcacctggcgagtcccttgcagggcctagggcgggtggggttcttcacccgacaagcaatgcggggcggggggcaaatgcggggagcggggccggggccgttcttgcccaactcggtcccgtcccaccccgttgccatccctacgcacaatgcaagcagcatccgccattcaggaaccggagaaaggagaggacgaagccgcgaaactgccaaaggccgaacacctgagtgagtacgtcagtaacctgaccgtgccgcggccgcacgaacgcacgcgcgcacgcacgggaataatcaaatcatctagatttttagagtcaaacacgtacgatcaccagggcgcaaggcgcgagctcatcgctactctcaagtcttcaccgagctccaccgagcttttcttcttcttcttcttcttctgtgtgcttccagtgcatcatctctcggatgaccacgacgactgccacgcagtacgacaaggatcatcatattcagaagaagcatgccgcgccatgtgacccgaaatctgaaaatgtaagccgctctctggttgtgatgtgattgatatctatccatatccgctgttgattacactctgccatgcctatgcctatgtcctcgacacgtcggtggcacgcatggaaagaaggtaaggttgcctatggtgtttagtttacggtgaagttagaagttggttgaaaattgaaacgatatgattgaaagtttacgtgtgtatgacaggttaatgtgataggaaaaattaaaagtttgaatataaactttaaatctaaacacagcttatgtacacttgcttgcacggcgagcggccacgcctagcatttgcctcgcatcgcatgtgcatcgcgccacattcctatgcccttgatgactcagccgggagcaataatttacgccggccttgtcacggattttaggccaagaatcttttggagcacgaacccctaccgagatctaggtggtcagcatatgtgaccaaagtctctgcagattaatagtagtaatgccatgttacaactttgatgtttcatgctgtcgctgatcaagtagtaaattaaaggttttaggcgcacaatttcacatgattctccggtaaaatcggagcgttaggacttaggcgttagccattagggcagtgacaacaatcagttaaaagatcagacggtactttctttactttgttatatgaggatacacgtgcgaagtataccggaccggaggctctctgctccagagcagagggaagtgaaaggtgtagatatctgaaagaggatttgctcaattgttctagtagtacaagataatttagtgttgttatctgaaaaagatgtgttcattgttgagaatggcacaagaagtttatagatacgacttgattgattaggtgacggtgcttaattgccctgcatgttgatttgggttcgttagtgaaaagggcatcacagaaagggtaaatcaacattattagatcctacgtaggacggtaggagaccatcatatgaggattaagtaggagaactttaacaagctcgttattaatatttgacggcgccccttttgatgaacttatatcacacccacgctacctatgcatgatcattgtttaaagttctaaagtcaccattaaactatacttaaaggcaatagtcctcgcatgctcaagctacgtacttgagttattgttttcccttttggaaaagggaagtacctgagttgttgtatatcacacctaaacgatcgaaccaaaaccaaaagtccataagcgtggtgctaagctagcaatcaacaacgcacaagcaagcatcatctgttgaggtatatacgttgattgtggtccaaattatgatgagccatcatgttttccagctttctttgctaagtttacatgatcgtcatccaatgttctttttttgaacaaaaatggctgtaccagtacccaaaaaactgaattttctaattattttcaaaacccttttaatttttaatgttagataaacccttatataatttatttttaaaatttgaaccctatcatgccacaacatttttaaaattttataattttaaacccttataaaatttgttttatcccgcaacgctaattagaccggtgtggccaaataacattgtcacactagccagatcggtgaggtagtgttattttgccatgtcagcagattaattaacaatttaaaagattaaaaaaaaactagccaagttaaacaaacacggacataaacgtccatccaagcatgggccggccagcactaacacagattgacgcgaattcagcacggacactaacccttctacttatcgcgagacgcgagctacagctcttctagttatattccgttccaaaccacaaaacgctatcctgacttcctgagacgtcccagatgaccccgacaccgactacgtacgtgctacacccaccatgcaccgggccaacaacacacacatcacatccactcccgaccaccgtggcggcaggtgcagcgcacacagcgccggggtgcgcatccccccatccaaacccaatccactccactccaacaccaccacaccagcaaccggtttggtgtcccactcccacctcgcacgggacgggagagagccgcccacccgcgcgtcgccacggcgcgcacgcgacgccgcccgtccgaaccgcggaaatccatcgttttctggccgtctttttttctcctctccccgggggagaaaagacgcggccgcggaaagcggaggcaggccgagcccagcgaggcggtgtcgggccatgttttgccccacgcgcccgcccgcccgcccgccggccgcggccgatcgacccgactacccgagcgaccgccctctttttcccaccgggtcgcgcctaaccgtggactgggacgtctcaccacatcacatgccgcgacccctgttctctgagctgtaagcctgtaactgtacacttttctttctcttctctgtacccgttttttccagctttcaatcaatgcttacgataacctcgaacgctgatcatgttactgtaaccatttgtggagttggcatcgctgcaatggtaggacatgatccgttgtttacgtgcgttgtagattacagcagttcgtcacgtaccatccaaaatccaatccaccacgggggtaaagatggccacgaagcacggattcaaagcaagagaccagagtagatgagcgatgccggttgctgagaatcgatcgaggtgtttgttcggcgaccagagctgcctttccgatgaagaaaaggtggatggggttggaggacagtgggcagcgcgcgggcgcgacacagcgagcatatgattcgcgttttcgttcggtgcagatccactgaaccaaatattgaataatggaattcgaaaccaaactgtaacctcaaagctagcatgatgcaatggcgacagctgagtaagctgaagaggtacacacgtaggaaaaaaaagatctttattagcagattcagaaaatgacagctcaaatcgatcgaatggtaccgtctttttcccgccgatttaattacaaggagatccttgggtggttgaagtagacgacctatgaattggggacaatacattaataacgacacactagccatttgtatctttaatatatcaatccatgaacagggaaaaggtacaagatgcctgggtaaaccttcgactgtgctcgaatctatttgtcacattgagcttaaaaaccggttattttcaccttcaactttaaaaaccggaaaaaatagcaccctaaaccatcttacatggtagtttctgaacttgtgatgatgatagtggaactatgaacttcaatcatgtactaaatgacatctacatcatcaacaaaagcatgtataacaaaattagagtataacctagaaaaagaacaccttaatttcaaacaaaacattaaagaaaatggtgcaagatgctacctatccagttacgaagnnnnnnnnnnnnnnnnnnnnnnnngtacttcaggttggaaaatggacttcaggtaaaatttaagtgcaaaaatagacttaaactagcaataaaaatagcccatgttgagaaaacttgtacttgccctttccaagatgcagtcgacaatatattagtagtacttgtattgtctatgcacagcctccacacctaacagctcaaaagtacccgcccttaatctgccacatcaggacgaaatcatgcagatctgcatctctgtacagaaattccatcctctcaattaaaacgcatatgccccaaatcgaacaaaagaaaaaaaaaaaaagaaaagaagaggggagaggagagggagcggcgaatcgaagcgaagcaagcagcagcagcagcaactcgcgctgttcatttattcgcaccaaaccgaaaggcgagacgaggcgaggcgaggcgcggtggcagaggcagccaaaccaactgacggacgcgagcgaagcgaagaagttcttgaagttgaagcagccgcctcgctcgcctcgcggccctcgcttgcctaatcaggaggggggctatctctttctctctcttttttcctttcctttcctgcgtccttgggatccgcccgtgcgatctcgccgtgggtggagcgccgccgtccatccgtccccatggatccccgcagtcgcgcggatcgcggcgagtagggagggaggaggggaggggagggggaagcggtttccgggaggagaggcgtcctgctcgagcaaggagcttgtggggggaggtagatggacgcgaacgcgggctcattcgtcgccgtccgccggctcgccggctccgagcgcgccgcgggagcggccgccttccaccactcgtcttcgggtactctactactactactacctcccttctccgatttggctgtctccatgcccgaattgtggctcgtggtagcgcggaagctcaccatggttttgtgctgctgctgctgctgttgctgcttcgcgcgcgctcgtcggtgcagcgaagttcgtgacggggtcgacggcgtggatcggaaaggggctgtcttgcgtgtgcgcccagagaagggacaagcgacgcgcgcctctccttcgatttgacgccagttcaggtgatgatggcttttcccttctgtgtgatttgatccccacagttctgcttccatggtgctaataatactgtgttgagttctgggttctgttcacaaattttgaaagttgcttttggtcatcgccgaattcatctccgaattactatccttactctgattctcgcgttttatcaggcatgtcctgcctacattttccatgctcgcttaaatggcttcaattctatttttaacataagtattccaaatattagtttactgttccgtaccatacatgtgcgccacaagataatgagtttttgcatgtgttagttgaaaaaaaaagtggaacagtggaagtaacaattttcattttctgtcccaggaagagtgcctacagaggttacagaaccggttagaagttcagtatgatagttcaaacagtgatcatcaggtacttgtttttggctgatacacgacacctaactgttggtacataggacttttgatgttccatatttttctcttttgatgaagcgggggtgccacaactttatattaacgtccagaacaagatatgagttggaaacattctctaaagttgaataaccagaattgattcaactgaaaaagtatgattaaaaaaaaggtccgtacatatgtggaatttatgaggaaatattagatgttagtaactgaatatatttgatttcagatatttgtagaggcaatagattttcaggatgtagacagtcttttgaggttacaatgcaacaactttggtcgtttattttgtattttttatttaggcctcttattctcagtgtggcttatccctggagaactaaatccttaactcttttgtgaagttatgcatggcaatacagaactccagatcatgtgtgattctccagtattgttcatttcttcttggagatgacacttgaaaaatgttggaatagctactcgatgtgacacctcacatttcttcaatcaggaagcattgaaggacctctggcgtgcttcttttcctggagctgagcttcggggactaatatcagaacaatggaaagagatgggctggcaagggaaagatccatctacagattttaggtattggcttttctccttcattccacccttttgtcagtatttcgtggctaaaatagataagaagaaatgtattgtcattacagaggtggaggcttcatctccttggagaacttagtgtacttctccaagaacttcccagtaagtttgaatccttgattccaaagatacttgtaccagcactgatgatgactaacgagttgagattcttatgtaccccagtacttatgtttcagtataacagctataatctactagatccgtttctggttatagagcatttaatgcttacctgaaattaattttcaccatttctggctgtacagaatctccttactatgaaaaagaaatgaggaccgtttcatgcatctggttggccaaacataaataatccacagtacatccgacaaaacagagtgctgaaaatggttctgttaaatacttcctctgacccaaaataagtaaccaccttaccacttattgtctaaattatgaggggaggtaaatgacttagatgccccttattaattgagggatgtatgtgcgtgagagggtagttgggggtaaaatgggaagaaatttgaattagaagtaattaatgacataagtggtactccaaagtgatcacttaatttgggacaaattttgaatccaaagtggtcatttattttgggatggagagagtagtatatatcgggtgatattaaatgttat

SEQ ID NO: 34265 - DNA, 17532 bp, Oryza sativa
  unsure (1)..(17532): unsure at all n locations
natcttcaatcaggtttgttgaccaaaagttctttgcttatcagctattggatgattggatctatttattagacaatactagttcctgcagagttgttgaaacgtgctagaaattcatgttgaattgacacttcacttcgatttcctctgcagttaaaccaaggtcgttcatcggagcagtttttctaaagctactttctggtaaagcctatgtttcataatcccttaggatctacaggagatgcttattgtttgtttcttttttgaacctaaactgagtcatgcatttgttcctttgcactccattagtgacctgtgatcaggctttagggtgtatgattgtacagatgttgcagctacaagaatttgtgtttcagtatatttttgttatataaaccagctctattgattttgcaaatagatgactattgtgttatgactattgatagtctacgtttgctaaattcactttaatggtctaaggtataccacactagtcatacttcttgaaacagacaacatatattagattggtgaaggatttagtaataattccctgaatatttgtttcatattatagtgctactaaaattgattccaaattatagtgctcctaaaatctatttcagtatagtgttcctaaaattgatttcaccaatttttggtccagaaaatgatcaggcttttgacattctctactgcataaccttcaagttgatggatcagcaatggcttgacatgcgtgccacttacatggacttcaatggacgttgtctttctatcccaattctagtagcgtcacacccttacccctattgacccccttttttttgtaccaaaatcttcagagacagacaatggttgatgaaatcacccatccgtcttgacttaaaatgtgctactaaaattgcagacggtcatgaagtccacacgacgtcagctagaaagggagctcttgcttgaaaatattcaacggattgaggacatgccctcatacaaacttttggcccgctagctagtaactgaaccataacatggctacgtgctgcaaggcttgagttgcataagggttgcaactagtgcccacaaacagtgtgaatttcaaaacgcagatgcacttgtttcctctcaagtttaggtactctgttaacctgtctccaaattacaagatagaggtctcttggccatagcacgccacgtagggtaactgaagtgtccgatcagctgccagggcagagtgtttgtaggttgggtgttttgttgcagtttggttgatgcccgtcataccacgaaatgaagtgcttctaggttttcctttttcctttataaacaagaggctcttgtgaaagctaatctgagtgtcttctgtagtgtaccatatttgcataattgatagtgttcagttctccgagtgtgcagaaatcatgctagctgtttctgctagctccgcaatgatgcaaatctgttgtttccttagttgtcctggggcatgaagtttgttcctatatagtgcagaccatttttgtggtacagcacgcctttcttgattgaatggattctgagtgctcatttgctgcttgctactgctggattgaactgctctcctcaaacaaatgaatgcagagcgaaaagataaaagataagggattccaacaacaggaagtggacaaaccatactaatcaacgaagaacaaacttgatatgtgacttaattctgttctcaggggtcaggatatgatatcatatgaccctgcataaagctggagcgtgcctgtgcttcctaggggtggtggtgcttgcctctgctgccgggctcagccgttcaggacttcaggggtggctactctttggtcggtccagactccagacactgcaggtaaagcaacaggtcccccagcatccatgtaattgttgtagcataatgtatgagcgacagaatgcgtatacactaaagctggcagctgctaatactagctcatcgttaaaaaaaaaaacactctgaaaatgacttaaagaagccgtatctgttgtctggatgttgcgtttttctactaaacaaaatgcatagttagaagaggaacgctataaagaaaactgaaccctcgatggaagaaaaagaaacacagaagtgatgatcaagcagcttatagttgcactggtaaccgtaaacgcgctactagtagctttgtgccggctatgcttctacgattcttccaaccaaacctcatacgagcagttaactaattcctagcctggatattcggttcgctgtagataatccgggaacatgttctgcaaaaacgaggacttgatccagaatagctccaacagttacgacagtttccatgcattcttgttagccattccaatttccaagagattttttttaggacttccaagcaaaaaaagatcacttctttggcactcatatgccctacagtacaggcaaaattcacgatgtaacctccgtcaaacaacgatatccaaatatgcataatgtctaatgaggctgaataatttttgcttacaatgtccaaacaagcttcgataaaatttcaaagaaacaaaacaatcttaaaattttaaaattctctcccctatggggatcaaagaaagccggccggccggccggtagtggtgctctctgtcgtgtgccatcttatggtggatttgacatgtgtgcagtcgcgaaagatcgcaagagatctggtcgcctccgttcgtcgccgggagccatcgatggcacgaaaggcatcatcatggcgaggaatctctggcgagcgttagatttctgccgtctcctcctcagctgatctctggtagtgataccgtttgcctcaaataatcgatcgattttttgagtcttaccaaccctacaacgttgaaagagctgggcccattgtcctacctcagctaccagtaactatacacaacaaatgttcatgtctcgtgatgtcgatatgtacagaactagagaaatgatattagctggccgtgtgcatttacattagtccagcatgggccaatttactgtagcaaactagctctagctagctagctgggctcgaactatttagctaagcagaaagcttcttttttacacttaaagatgtacttacttttcattcttgtggtaatcagttgaagtaaggtgtgcgtgtctgtgagttgagatgctacaaagctgcgtgatcacttgctgcaaacttgccactctaggtcattgagcacccagctcactcaaaccatgttccaataattttccacctaaacgttgatataatcccctcaaaaataaactttgatataatccgtgcacgcactccgagttatttttgtgaagcaaatgaactagcttgtggagctcctctcctcctatgcagggagctctataagcaaggtgaagcaccgtggaggtgacgattgatcagctatgaaagacttgagctgtcaagatgacaccacgcgcccagttccgggttatccttgggcaagttcggtaaggaggctggtggacagcaggacggaggaggcctcagccaacacgtggggaatttgcagcgggatagagggttaattttggcgacgaggtgcagtggaggtcctgctggtgacaggattaaaagtgggccgacagagagacgttggtccgatgtggcataggccgcgtgcagccaacgtttggatggtggtaactaagatggtgggtgacaaaccatatgtagatagggttacagcggttctaggcgaaagcctagcccagccattcactaggacgacagtgaatataccctcgggtgttataacccctctggagatgctatcgaggtatctccttcctcacctttcttgacgagaatcttcgggtaaaaaccacatctaagtttcttagacgggtgacaacgacgtccttagcatcacaacctccgtggaagcatcattttgaagactcggctctgtggttgtctgaacctaaactccaatagcagggagtcatgtagcccccccttttggatttggccaaggagcaaatggcggatgctaaatttgggccgcgcgagacaaagtgaggcaaaatgattatacaggtttgagccgctcagaggcgtaacaccctactcctattgagtttgtttttttagaaacacagtacaaacgcaggtgctcacaacgcgcacacacaccctacccctatgagcacctccggaaaactgggtcggcatgtcttgagattgacgaagtcaccacaggcgcctcgctgtcgacgggtacgtcgcctaccactgaaagaataattagccgtaaaagcgagcacccatgtcaaatctatgatttgaacctgggtgggttggttccaccacaaggaaccaaaccagttgagctacactcactttgccctattgaatttatttcgttgcttggggttcaaatcttaaaggaaagagacttagcaaactagggctactttggtttgatcccctacttctgtgatcttggtcctccctttatagtctaatccacaattgctagtcacttacaagtgagtcccatatacacaggagttaggtagggttagtcgtatcacgtgctgacaggtggggccttctattttcagtgtcccgtcggaggagctggcatgatagtggacaattgccttctagctcactgcaccctcagcgccgatgctgtggatgacatgacatgccatgcatggcccgagtttggtgacgagactgtggatgacacctaccaagctcacttctcgctttgatagacatgcgcgccaagtcatggtatggctagccaatcgatgggttaaggacccacgtctcctaacagtccacacccccggatttttaggagtgatgatatgtcgcccgtcacctgccacgtgcgaccgccggatttgtattcggcgcattgattaataatgcaagatcgggcagacgatgtgcaggaatgatgagtcaagtccagtcatattaatggcaccctaagtccttgagcagcccatggatggtcaagctcagggcatgctccgtgctcaagctctgcttcgtgcttggggaacctctgtgttcggggcctgctcttcgcatgcgtcctgagcacggggcgcaactagccaaaccatgggggccaggtccttggctccactcgcggttgatactgttgagcgatcttggaggcccttggtgccctgagcaactggaggtggggactcgggtttccactttttcatcattggtgttattgtaggcccgatgacaattggccatgcactacggtgccggtttggtgctaagccattcttagtgatatgtgtttgtatggttagctgtggttattggtcatgtgtgcttcagtatacaacaaatcttgaaagccttctgttgacaatagtgtttttggtaactttttccccctcaaactcaataatatttgaatgtcctcttcttgggtcatcccggtaaaaaataaattattcgcaagtagagtacgaaagggaaaagtcttttgtctctagagggggtgtttccatttcttacatgtcatttaaacaattatattttttaaaaaataaaaagatacattaatacgtgatatatcattatacataggcatgtaaattcaaatttaacctctacgattgtaaaaaaggttttctaacatggctctaaatacatgctgtgtaggagttagagtttatttttcttacaacatgtgaaagtaaactctaaattgttggttataaaataatatatcatatattaatccatcttctcattttttatgtcaaagaaataaggatatctatcctgtctacgaagaataggcccaatgtacacatcaccaaatgaatctgccccagcagagcgacctactacttgtgtgtgcgtatgtgtgcaactgctcacgtgtctgctacgtagtagtacaagcaacattaatttccaacccgtattcccggtcggtgcgtgcacgtcaaaagagaatcacaggtacacacctccgagagagagacctggtatctggccgatcgagcagcagattcgatcgtccatgtcatttaatttgactcggaatcggatcgaaacgaaacgagaagcaggtgcaggtgccgagatgacacacatccacgcgcgcgggcacatgcgcaccgcacgggctcgtttcctcgcggaaatgatgcggttttcctctctccgcgtcggtctgatcaggcggcagcgatacggggctaagggccggggtgtgagcgcgcgcgccgaaagcctgttgccactctgcactgcatgccgcgcgcggcaccgcgtcagttcagggtttgtgcttaaccgcgtgctggtcctccacgggagaaaaagtttacgggttcggcaggggtttcaaccatcgatcgccgcgtgccttgttgccggggacctgtacatggcgaaccgcgcggcgactcgatcgatcgtgcaacgcatccagccgtattgatgtattgtatcgtgtcacaacgacacgagcccgcgcgcagaatcgaatcatcgatgtgtacaggagaacacacatgcatgcgtatactgaagctcgtgctgatcagcgcacgcgtttgccgaaacaacacatcgcggtcgcgttctcagcttgatcccaacctggcttcatgcatgatcgaaaaaggtagtaatctgggccgaagggccaaattatcatcattattctcatgacagagagaaagagatcagtggtgttgagacttgagagtcatgatgtctctgatcactaggccggttgtgtgcgtggagaagcaagggcgcaaagaccaccattttggagggattcgagtggcccattgtaccactcaaaagcaggaactaaatgccatcgaattgaacaaaccaggaatgctaattcacgtatacacactagcagacgaaatcgtacgcgctgggttagggtttcgagggtcgggtgtggggggtggctatggggagggagagtggggagttggggttagagggatgacctatgaggtggcggaccagcggtgggcaatggataaggcggggtcagcagcaggcaaaggttcggggtgggggagggggggatgaggccggctagccagggtcatgctagcacattgatgactttcggcaccagcgtggtcgagacgatgacattgtgtgcacgtggggtgggggaggtggcggtggaggaagaggggcaattcaccagaaggaggaagaaagggctcgcaggagagttgtcatcgtcgccatcgcttgctccgctccgcttgcgtgcactaaggttgagaaagagagaggaatagataaggtggagaggggggagatagtaggaggtcattgtgtatgacttgtccatctctctcacgcgcatcgaatagaattcccttgaatgaactgcggtctaataccaacggatcaacccgccgtggacctctatatgctggtgggtgcatgtgtttatgtatgtaatacatgaatggattttacaattttggagaaggtactaggaagtactaagataactggaggtgctaaatttacatatagatgagagaagtattttcatccttagaccccttcattttttgtgcgccattcaaataattataaaaaatttaacatgatagatattgtgatatatcacttcgcaaaaatgaatgtttaaattcgacctacaaaacttataacaaaataaacaaacaaatatgttgttttttacaacttgtatgtcaaaatttaaacgttaagagatatattacatattattgtatcttattaatttttttcacgatgatagatggggaaccaacacatttagacttctgtgagccaaaaaaagagagtcgtgcttgacttgatgaatcgagccaattctagcatcaagctaaatcctttagatgcacagctcggtcgacacatccagaactatcaaatacaaaagaacacatccaatcaataatttcatgttcctcgaatcaacacatgaagaacaaacaataacccctagatccccatttcaatagatggacgacatatcccattcccaaaatcaacgcatgaacaagaacagcattcaataatcccccaagttctacatacacctagatctagaggcggagggatgcaggcggcaaggtcagaggctaacagggacctccaggcagctggatccggtgacccccaacctccatgctgctagatccgctgccctagtcactagggagaagaggaggtcaccagtggtccatgatgaagtcttgctagcacccgtcatcgttactgccgatctcgtgacggttagatctagttgccaccaagcttgtggcggcaaatccattggcctggccaccggagtccagagagaaggagagggagaaagtgaggggttgtggcagcagtggtggaggcgaggagaggcactgaggcagtggcggtggcaacgagggtgaggatgagagaggaagagagaagtgaggggagaaggagagagaggtggaggacttgaaaaaccaaaacgggctcgctcggctccaatcccaacattgtcggttttctttaaaaaatacgttgatatcagtactgatgtacttacaaaaatgtcacatatattattggtgttaaatttttaattgagcaaaacttacaaaggagtatatataaatactgatctttaattttagaccccgcgaaggaccagagaagagagcaaaattaatgccttatataccggcgccacagataatatgttccctgtcagggattctgtggtagaggaactagggtatgtgtctattgattccctgctcctagacacataaaacaaacggagaagacgagatgacgagagcttgggacaacgtatctgcagccttccttgtcgctgcaccctagatcaggcaaaaaccgatcacgcaatagtagttatgcctataccatgctatctcccagctgcaaaatgacataaccatttccccccatcaacgcgacaggccgccggagaggccggccggagctgcgaatgattccgattggcgatggcaacaacactagctagctagctgctagctagtacgtacgtgcacagacacacacgcacgcgcacagaatagtacgtgttgtccatcataccgttcgcgtttcatcgatatcgtctctcgtctcgctttcatacgcgtcgatctcctcttgtcccctagcttttgcccctcttctccgtgtatatctccgtcgtcgtgatctctctgcatatgcacagtgctactatacccatgcatgcatcagggattgatcagggcgccgccactttggggtttctattcttttctcgcacgccgctgcatccgctgatgatgttttgggacggcagtagtaggctcgcgcgcggctgcttctgctactacgacatactattctgctactacatctcgtgcatgcttctgctgttctctgcagcgctgtatagtacaagctctttgtgtctcaccgtttctagggcacaccatgcgagtccttggggattctgtgcaagtacagcagggaggagtagtagtagtagtagtggcgatcacatgtctctgcctgatcacgtcttcatggaccaactatttggatatattcacgcatgtgtcaattgtcatgtgtactcatgtgtgtgctatactcaatttgatcattgcatgtttatgtgcatgccttgcaattgcatattcttttttgaattggagatcgctgctatgatggcagatgaatagtagtggcccaattggaggcccctgaagaagaggcttttgcagcagggtgcaatgataggaattcccctccatttcgcctgctgcaatccccgtggctaaggccgtgtttagttcttcggctaaaacttttttaagtatacaaacacacatttaaagtattaaatataaacgaataataaaataaattacagatttcacctgtaaaccacgagacgaatttattaagcctaattaactgtcattagcaaatgtttactgtagcatcacattgtcaaatcatggcgcaattagactcaaaagattcgtctcgtaatttacatacaaactgtgcaattggtttcttttttcgtctacatttaatgctttatgaatgtgtctaaatatttgatgtgacatttttgaccaaaaatttttggatctaaacacacccttaatctggatacatcaatgtgagtgcctgcagcagctagctagcagcaatttgttcggtttgccaacatcttttgcaaccccccacttttagtttttttttctcagtgaaaaatcatactcccatatttacccgatttttaagttctttttcttggaaaagatcagtacggcctcgtgaatcctgcatttctgcggaagccgcatcattgcactgcatgcataagcttatttgtgattatatccactttagagaaatgcatgttacttctgacattttcaattaaatcgccacccaaatatgtgttaatatagatatttgccaactgaatactccctgccgaagaatataataaggacatctaaagttcaaaattcgtttaataatattctatccgtttcaggttataagacgtttttttgactttggtcaaaattaaactactctaagtttgactaactctatagaaaaatatagtaatatttacaacactggcatagtttcattaaatccataattgaataaattttcataatatattagtcttgtgttaaaaatattatttcttttttctataaaatttgtcaaacttaaagtagtttgactttgaccaaagtcaaaacgtcttataacctgaaacggagtgagtacaagatatcctcacctaatatagttatcgttatcttaaccaattacaactttcacttatttaatttcctcaactattttctatcacaaccatttctcacctaaaccataatctcttaaaaaaaaactccatatgttcttatattcctgaacagactgagtaataaacgcagaccatgttggtttgaccctgctgagttatctgtataccttttctaatctgtttaagcttataagaactaattagtgcatgaaactcaataggctttcaagctaagatgcgttgagtttgagatcttgtggtagggtttcaaaatgcgatgataattgataagttatcatggttatcggtcttattgaaccgaccatttacgaaagcctctccgtaaactagccaagttaaagaaaatcaaacaaaaattcaatattttggcaaaaaaaaatccaaatttaaccgctcgattatcgatgaaaccgccaggggttattgactacgtaccggttgcattttaaaacctttcccggtgaatcatgtatgtaagtatgaggttcagatgctttcaaaaataaaaactagttatttgattgtttttttaaaaccttgctacataattttttttcagcagcaactagctacttcctcagtcccaaaaaaataaattaaccttatattggatgtgatttaatctagtaccacgaatctggataacctcatgtccaaatttattgtgctagattaagttcatgtccaaatttattgtgctagattaagtcgcattcaattttaggtttgttttcatgggttagagtgcgtagcccgacccatcaaccatgggccacccatgtcacattaggcctgctcccccacaggctaaacatgagccacaactttaggtcctggaccaacaaactcaaaagattagtctgatgggtgatgactgccccaccttttaagtcgtactccccatcattaattattgatatgggactaaatccaacaatctccccgtcacacatcgggaacaacaatcttccccgtcacatcaacccatgtgaccctgaagacttattacctggcctcgggcccaacaatctccccgtcacatcaacccatcacctatgtgacctcgaagacttgttacttggcctcctcaccatgtgacccatgaaaatcgttccgggttctaaacttgggctctgataccacttgttaatgtgcgcagcccggcccactgaccgtgggccacccaggtcacatgaggcctgctccaccacaagctcaaccggagtcacaactttaggtcctggacctacacaacccaaaagactagtctgatggatgaggaccgcccctaccttttaagtcgtgcttctccatcatcaattaccgttcattgggcatttgggctgagtactgtttcactgagtgagttgttcacgggaagcaactgtggacggcaaggacaagttacaacgatgcattttctgaagtattgggatggcttgtgcatggaacaagctgattgcatgctacgttagttatgcacagggatttggttagttgggaccatgctgtgtgtaatggttaatttgtacatgaggtaaagctgaggtgatatggcaagccaaagtattggttcggcaagattgcaagggtggcttaacttagttatgcagttgtacgagacagttagaaatcccgggaaacagtgggtgaaaatcgttgatggaatcaacgggccgtttggcagtacagggtatatccagaatctgcggggcttgcataatggggatatataaaatatgcgtcactaaagatgaagagcaatcgctatgttggtaatttcttcgggtgatttaaggcaatggtgaattttctcaaattatcggatattcagtctacggatgcggaaagcgtggatgttggatttattagctcggttcataagacaacaagaaagaaagggttcactacatgtctggtgagtttgatttatttatttggtgatgacgtcggttatctggccatggattagatcaagtcaactttaagacggtagatggagttgaacatggtcttcggggaagtctatgatgtgacagttaggaaggaattccattttgtttggcaagacgactgtggtaataggtgagaaggtggagcactgttgtaggtggagtcaagaagaagaaattacagggatagcaggagttgactcttgttatggtgagcctggtggagtcttatcggggcggctcggcgtgaacggcgaaaagggatcaactcaatttcaggtgcacggagtttcgtgcaaagaacaaattcaggttggcgtggcatattcatcaaggtggagtttgttagagtttgtgttgaatatgtgtacgcaatcggttacagtttaggacttggagttgtactaggtgttaggattagagtaagagtcggactctatcataggctctctcataaatagaggagcgtgcctgttgtaaccgatagggcgacatagcatgcaagagggagtggctcccggctatagtccgttggtaactttaatacactgtaatatgctggatcgggaagaagcgttcataattaatgccctggagatgtaggtctcggctgaactccgttatcaaatatcacgcctcggtgtcgtcaccatgtttagatctcctatggtgtttcttccgcgtttggtttccgatgtgatttcgggaccggctttataacacatgggatgggaggtaggtaggtgagaccaggcagtactgcagtcaaatgttttattattggtttaattgtggatattaatttgtgaataaacatcaaaaccagtccctttcggaagacacacgtaccctagatatacatacgcacccaataaagtaggatagtgatgattcaggaaaagactagagttgattcacataggtgcgcatcacagagaactatgagcaccagtatgatcttttgtgaggagcatctatccaaaagtcatataaatgatctggcaattgcagggaacaaaaggtacaatcagtgctatcctgtacgcggaacaatcgctgcaataatacatgcgcccagcctgaaaaagccctgctgatcacagattcaaagtagtggccaaaagtttctggcttacacaacactaaagttgcaattaactagctaatctggtatagaaacatgaaacatatatatcgactgaaacaggaagctcgtggcactgatgaaagttcaagaaccaaatatcatagcaacagcgtttctcatagaaaacatgattaacgattaatcagttgtgatccgacatctatataagtagtacacatatcagctacagaaggcagatccgacatcttgccaagagccgataaattagcatgcactatacctagctagctcaaggagagggcaacagctactgaagcaggcactgtacccacgacacaatttgagcaaaaagccctttaaagggcagcctagactccaaagtccagagagccatagcccaccacttagaccctgaaagcatcaaaccctatcaaaaattgacaccaaaaagacagggagaggagatctatcccaagaaatcctatgtcccaagagccactttgatcgattggcgatagatagagatcactactactgccacaaacgccacacacgatatagctatagccatatgcatacttgcatggaaggaggtggccaactggggacttgtcttccgaatttctatcttttgccagatcaccacggcatgcctcttcctcctccacttcaactaccgtgccatccgaagctactccagatgccattcgaccaagaagatcagcccggaatccatggcgtgatgctctcttctgaccactgcgggctgtaccctctgccggcgcttccgttaagcaactccgccgccgccgccgccgcaaccgtcgcattggggaagcacagtgcagccgccggttccatgcccaatattggcggcgctgaggaggtaaactggctgggctagattttattctgattatcaacaaggtctcttttcttgttccttactaattctcatagagtatgatcttgttcttcaggtggccaccactgtaaccaaagctggcaatgagagtactacttgcaatggctccactacatggtacgcgtgcatatagtgaaaacataagatagatgcaaacccatgctgagatctccagttgtgggagcttgcaggtggaggggctcgacgatggcggcggcgggggagaaggggaagatgaagatcaggaggaagatgagggagccgaggttctgcttccagaccagaagcgaagtggatgtgctggatgacgggtacaagtggaggaagtacggacagaaggttgtcaagaacagtctccatcccaggtacatatgctcaacttaaccaaaaccctacatatttgatttcttatatcatttatacatatgtgtagataatagattccccgtttcttatcaattaactaattataaacataaacagaagaatgtctcgatgcctatttaatttggttaattagtaatacgcaagtttatatataccagataaaatatcaattttatatgtacagaactgagcaatgttgatcttgttttttctcctaaagggcttcttcagaacatggaaaatttgtaggattttcacaggaaacatttcaatttctccaaaattctcgtgaaattcctccaaaccaaatataccaagggtactctctatggcagaagagaattaatgcatgcatggttaaactaacttgtcaacaaaggtcttgatatgaatagattagaagctgatttaagacaaggcaaaatatctacaaatataattatatatatgcaggctatattattacttttcctttttatatcaatatagttaaaagcgattttacagtacttaagagatgttaggaggtgccaccgtttttaatgtaaattctggtacctctgtaattagtatttaaggtactaccaagtctttacaatagaaaatgtggtatctcttaacaagggaaatgtaaaatttctcatttaatttggtatgtgcttatctattagctctgtacttatgatatatatgtttattttgcttctacctacaatcgaaataaacgcagctactcctataacatattgctgtcaaattatatgatccatatgtcaaaagtgttcgccagtatatggaaaagtttcacacacttgtcatcagatgacccttgcaaataatcttaattatgtactagttaattaaggtccaagaattaattggtattttaattaaattggggttcactttgttataacaatgaaattaatctattgagctgaatctgacaggctcaccttctgcacagttttattaaaaaaatatttttaatgcaaattgttacattttggtgaacaagcttaattagttactagttacatttcggtgacaagtttaacaaactcatcatacataactagccgtatcagttctttaatttatgataggtactgtcatccctgatgcagataaagggacgggtcataaatagattaaggatcgagttcttaccacaaatattctgaatatgcatgtatgaggagtcttggggtaattaattaaggtataacggatcataatattggcaccatgaaagagaggaccctacatttgcaaaactaaggacgatgcatgccattctacacacatacaacacaagtagtgtaagccttagctatttcatgcgataaaataaacggcaattagcagccaattaacataggcacaaaaggtacattaataagaaagatgcttcagttccaaattcatacatccgtttgtgagaagctgtgttaggagtatactgcactgtatctggcatcttatatatctatgtataatgttcatataatgatactatttctttatctcattaaaccatatcacctcaattgtctttgacacttagatgattaatttatggtccaaattatttttatcattttctttctcatacgaagttatatcaccttagttttgtctttagatgattaatctatattatttctccttttttttattttgtcgttgaggcatatcaccttagttttactttttaatgatcaatttatatatgatttaaattattaaaaatcacgccatctaaactatttttaacttttttcatggtcgatcaaagatgaaaattatataaaattacgtcatccgtcatctagctatttttacatgttatttgttctattattatacagaacttccgctgcgatgcgcgggcccaatctaactctcatctgcttgcagaactcgatcgataaaaattaattaatgttgtcaattagctaattacgtcgcatgcgggagtcatcgcactgccaaatatctaaaaaaacatgtaatagtcctttcatttcagtaaataaacacatttatatttttttaatctatatattaaattgagaaatggaaatttggtagtcaggacttccttcgtcccctaatataagggatagactagtactttattcctttcacaatgtgagtcattctaacatttcccacattcatattgagggggngngnnnnnnnnnnnnnnnnnnnnnnnnnnnnnnnnnnnnnnnnnnnnnnnn

SEQ ID NO: 34266 - DNA, 3859 bp, Oryza sativa
  unsure (1)..(3859): unsure at all n locations
cgcgccttgattgcctatcagtatggnacagnacntcatcaattgatgttaatgaatctagtctagattcattaacatcaatatgaatgtgggaaatgttagaatgacttatattgtgaaatggaggaagtatataggaggacaccatgaatataatctcttgttttgcggagcttctgatctgttggagatcagaactacaaacaggcatttttgtgtgatttggatgtacacatgccaaaactgatcgacgatatatatatgaatgcgcatatgcatgcatgcaggagctacttcaggtgcacgcacagcaactgccgcgtgaagaagcgggtggagcggctgtcgacggactgccgcatggtgatcaccacctacgagggccgccacacgcactccccctgcgacgacaactcctccggcgagcacaccaactgcttcagctccttctgaagattttagcactttgcattttcgtcgttgatccatccatcaatatatataccgtcgtatacctatatgtccaccgtttgatcgattaactgtggctagctctagctctctttcattttgatggttgagatatataggcgacgtaatatcgagccatgcctgcgcaatgtaccagtactgctagctatacgtgagatgtattgcgtgcatgcacgtacaatttacaagcagcagtcaataaattaagctatgtatttcttctataaacacatcagcacatgcaaagtttgtgttacacataaaaaactccaatattggaccaatatagtactagatgttacacatcctagcactacgaatctggacatacctctatccagattcattatactagaatatatcacattcagtacaagattcgttttttttaagacggagggagtatatagtactggggaaagtgttttcatgaacgcagttcactttacgactataactagctattgccgtgtttagttcatcgtccaaattttttttaagtatatggacacacatttaaagtattaaacgtagattaataataaaacaaattacagattccacctgtagactgcaagacgaatttactgtaagtctaattaatccgtcattagcaaatgtttactatagcaccacattgtcaaatcatggcgcaattaggctcaaaagatccatctcgcaatttacatgcaaactatacaaaaaaaatttcgaccacatttaatgctccatgcgtgtgttcaaacatcaagacttttttgaccaaatttttttggaatctaaacacatcctatatactcactttgagatcagttcatggatgcagtactacactgcaagtccggtgatatgcaattctgcatgcatgcgcatacaggtattcccttcctacgataaaaaataaatctagtacgttatctcatattttatacgatgtctcgtaaagagtatactcccctccgtccgataaagagtgcattttttttatttttatagaacatttgactcttcgtcttatttaatttttttatgattagtattattattattagatgataaaacataaatattattttatgtgtaactatttttttatttgttccataaatatttcaaataagatggacaggaaactagatacagaaatccaaaaatgcgttctttatgggacagatggagtaggtttattttttggttggaggtagtatccgtgagtcctaagttactccctccgtcccaaaacaactgcaattctgtactattcatatctaacgtttgaccgttcgtcttatttaattttttttatgattagtatttttattgttgttagatgataaaatataaataatacttatgtatgactattttttttttaattttttcataaattttttaaataagacggacggtcaaacattggacacggatacctattgctacacttattttaggacagaggtagtagatcatactgtacacctttattttttttttccactttggtgtactaagtttgatcatatactacgtactgatgagcgcaggcctgacagaacacacaacacaggaactaaaaggaggagaaaaaacaacacaggctcatcagcgcggcgctcctttgcgtacttgtatgtactcctacgtatatgtgcatcgatgcacatatatgcttcgatcgatgcgcgctaatgattgttgcaacagagaacctgcagttccggcgaaaacgaacaggggctcgcaaacaaaaccgccatcaacactcgcgtgctcgcatctcctcggcgtctttcagctggtgtgtgtattcagaagctagccatgcatagggagggcatgcaggcatgcagctgcacgcgaatcgatcggtctggtattgtggtcatccatcggggagggcctcaaaatgtggtcgctgaagaaaaaattaacactgtgagatcgatcgagcttgccatgaaatcgaggtgagtgggtgtgtcaccttcgaatctttgatcatgagctccacctacacgcgctggcccatcatgatggcctaggaaacacggcccggtcactgcgtgcgcagggatcccgtcccggcccaacttgaggaggcaggacgcacgttcgcgggcatcctggttgggcccagaggagaagagggtgacacggtccaatgcgccccaaattgcgttgatttcctccagcgccgtgcggagcacccgtcccggcggatgcggcgagcccgctatttttatctccgcggtcgcgactcctcacctgctgtctgctgcggtggtgcctgcgtggctgcgtcccatgtatcgcctctgtttgaagggagcatatctatgcacacatgtcctcgcgtgtacacaccatgtacaccaactaaaaatttttacaaaaaattctagaaaaatttatacatgtacttttaatagtattatatctacgtgcaaagtcgcatattcaaattcattctacatagagaataacaaaaaagataaaattctgacaaaattgcaaccttaaaactgtcagattttttgttttttggtatggctaaaatataatgaatttgacgttaagattttaaccctaggtgtaatacaattgatagtatgtgtatgattttttttagattttttggtgatattttttagttggtgtgaacgtgtgtatacgtgagggcctgtgtgcataggatatgttgccgtgtttgaagactattttttgctgaaatgtcatgcaaagaccttaacagaaccggcggcacatctcggggatatcattttccctcttgcttccgttccatataacggattccgtgctctctcccgaacttcagctgctccccaccagctctgaggccgggtcagcacatcacgtgcgccgccaacgcgtgcctgcggagcgaggcaagggaagccatggcccagggcgcatagctggtgggggagagcgcccaccaggacatgccgcgggtggtcgccgcgctcgccggcatcctggagcgcgtcgcggggcgcaacgacgcggccgcgacgcccgcggagctcgccgcggcgccggcgtcgccgttccgggcgacggccaagccgggcatctccgtccgcgcgtacgcggcgcgcatcgcgcggttcgccgggtgcagcccggcgtgatacgtcgtcgcctacatctacctcgaccggctcctgcgccgcggccggcggtgcctcgccctcgccctcgccgtcgactcntacagcgtgcatcggctcctcatcaccgccgtgctctccgcagtcaagttcatggatgacatgtgagttttctctgcaaactctgctgccactcttcagatggactacacacagagaagcgntcacccactccg

SEQ ID NO: 34267 - DNA, 21463 bp, Oryza sativa
  unsure (1)..(21463): unsure at all n locations
gcgcccatgaaggtangacaatcgctccnacccngcnncatattgggttcaacttatagttggataatttcaatcactttgtttcttattcctactcgacatagttttgttctattcacaaacttcccttgttcgagacactgccagctaggaataaactgggagtgtcttcgaagtaactccagaatcatttcggtccctagttcaggaatttttctgtttttacaattccaaaatgagtttttccttacagtcttgaaacggaaggcaaagagaacctccgaaatagttacatctgaatatcacagcaaccaccagctattaattgtcggtaatcatgctccaaagaagccactgggaaaggtttccacctcaactttgctgtcaaaactaggctttgcaccgggtacccaaagtgatttgtccacgcaaacaaacgcagtacatggacagaattatgcttgtccagcaaagcaaaaaaaaatgaggtggtttcatttcactattccttgcgtccaaccacacacatccaccgtggacccaagaacacaaaccagaattccaccctgcacaaggaccccctcgcctttttgtttggaatttaattcagtgccagttgtgggggattgggactggcaacttgcccttgctgctgatgtttgcagctcaatttccccgtgtcagggcctcatcgggagcatctcttttttctagctttttcttaagagtaagagcgacactactgtgacaatacttaattgccaacttggcgtactgaatgagcccgtttggtgccaattcggtgatttgtggttgcgattttgttcggtcgcttgatcgatcccttcgatgctactggtgattgtgccgtcaatcattggagagcaatcataaacgatctgaaagaatggacggagcatacaggcaatatacaataatactgtcattaatttctttttgtctgaaaagattaacagccgaattgttttgacttttgacatgatcgatcgatctgtatatatatatattcagatgctacaacaacgcctacttcgccaaggtcgggggcatcagcctggcggagatgaactacctcgaggtggacttcctgttcggcgtagggttcgacctgaacgtgacgccggagacgttcgccgactactgcgccgtgctccagtccgagatgctctgcgcggcgccgccgacgaggctgcactactgctgcctgtccgaggacgatgccggcagcagcagcagcagctcgctgcgtgaagcggccatggaagcaagctagcatgtcacactgcgtacatacatgtgatctgtcctacgtgctggagtattagttagtgtggcagttgctttgattagtttagttagcctgctagctatagtagctaataggtggtcgatcgccctctcctcctgcatgatgcgtacagcagtgcattcttgctgtgcactcctttgttctttttctttttttctttttttgtttcggtgtgtactaatggtgtagatcagtgaaacatttatgcaatttgatcctatgtaaattttgatggaaaaagtaattttcaatcttggaagtgaagtatgtagtcgaccatatagctcagactggcgttctcacacacggtggatgcgccaaccactactgaaaggcaagagatgtgaccgtaagcaatgggcgggaggggggctcaccaagctcctatgactatcacaataattacaggcaccgaaatcttgggtactggagggaaatgaaatactatgccagtagtatctacggccgctccgttccaaattagatgtcgttttgatttattgcttttaacgtttgaccattcatcttatttaaaaagttagtacatatataaaaaagataggccatacttatagtacttttgataataaagtaagccacaaacaaaataaataataattcaataatcttttgaataagacaaattgtaaaacgttataaacaaaaactcaaaacgacaagtaattttgacagaggtagtactacagtataggaaactattctaattttttaggagatattctctcgttatttgtatgtcattcaaatgattatgaaaaaaaataatagattaatatgtgagaaatcactccacaaacatataaaatcaaatttaatttctacgagttgcaatgaaaaaacaatttggctacgaacatatgttaactacccatagcttatgagcttacttgtcagctaattaattatcattcttttaggtaataagatagaagtacggtatctatatccataagtagatatacacaactaaatattacacgagttcattaagatacatagaaaaacaagcaaactaaaagaaaatattagaagagactagcttcaaattttccctcatcacttcaaactttaggggaatgcggagctagcccgctctttcacctccacaccctctcgttgttgttacaaccataaaagttcctctgctccgtcatgaacaaaggaaggggacagaactagtccacccaaccgccttgtcatcgataagcaccggtttagtgatgtccgaacaaactgtgctccctgaacgtgaatatgttcatcgctgtcatgtcgtcgtcggcatagactaacacctcccctgagctgccacagcttatcttgccaaaattcaatggcgctatgatgtccccctcccccccaaaaaaaaatcattgccgcataacctcacctctgcaaagccgtctaagcttatctcaccggagaacatccgccgctacgtcttctttgtccgaaaccatgacctccactaagttgccgtagcttatctcgtcagtgatatgctactaccacgacattgtcatcgtagaccacaacctaagccgagctaccgtcacaacctatctcctcgaggagtcgtcgtcttcactgctgacttccgccaccacgaataatcatattgtttatcacaacttctctctccttttaagaattgaaacacaagagcatatagaagaataggagaattctgtaaccttcataagaaaatatgtgtagtggattagttagtgattgagccattacttaaaaaagagaggcccaaatattatttttcatttatacagttaccagaatccccacaaaactgcagtaggccgaatactaatgaaggccctgggcatggcccaattagtagtgaccactgtactctgaatatgctgaaaagtttagcccataatgaatattggcccatggtttatattatagctttgtacactagggcataaattatatgtttaattggatccatactattataaattttcgactttagaaacatgttattattattcatttatttggaatcatgctattacaatttcttgattatttgatatgtatcactacttacccttcagtgtatttattttatgatttctagaccaatggagcccgagatagggtgctagagctcacggttggatgtggaggatgagagagcggcgcaatcggtgagggagagatggatggcagaggctgcagacggtgaaagggatgaggatggggatggggagcaagccgtggttggaggtgccacccttctatattataagttgttttaacttttttttaagttaaacgttgttaggtttgaccaagtttacagaaaaatgtaataaaattttaaacataaaacaaagaaactaccaaaatatgttaaatgttacatatattaattgttattctaggttgtttagcatatattgagatttgagaaaaaaagactataataccccttgtcaaacggtttataggtaagagtggagagtagttgagggcaaaataggaagaaatttggatgagaagtgattaataggatcattagtactctattgtgataattattttgggacaaattcaaaccctataaatacaattattatgggatagaggtaatagatgtagtgaaattaatttggtgttatataagtgttgttatatttttctataaacttgattaaactttcaagaatttaacttaaaagaaaatcaaaattgccgtatttcacatttggtaatccatagcagctccgctatacatcagacaatagtagcagactagcagagaatttatgttttcatgccatccaatacgttatgccgaatagccttcggttacatctagctttgcttcagaaatctgacatgcaggtcgattattcaggaagttggaaacgcaagccagacggaattccgccacgaacacagcgcagaagcaactagctagcatggcgtatcaccaattcacaagtcgagtactatattggcatttggggcatgaaccatcgtagtagaaggtactaccagttacaaagcctgaagaacacagcacgtacggtaccgctatgctcaaattgaagctcgtacatcagcgttccccagttgataacgtagcatggatgacatgacactatatatatcttaggagattcctatacattgctctagttatgaagctcatggttcgtctcatggccagaggaggaagacgaggacgggcggcttcagttgttaccgccaccgtccttctgctgtgtcttgccgccgccgccgcggaagctcccgcgcttgctccagtttgcaccgacatcgccgccgccataatccccgccatatccaccaccttctccggctccgccaccaccccctccaggttccccattatagccaccaccatagttgccatatcctccaatgccgccgctgccgccaccatagttgcggccgccgccgccgccgccaccgccaccgccacctccaaagcctccggggtggccaccgtatcctccaccgaaaccatatgctcgaccgcttcctccgccgccgccgccaccgccgccgccaccttcgcctctgctgccaccgtacccaaacccgaacccggagcccttgccgccagggctagcggcccagccccagccatacctccaagcaccgtcggggctggacccctggccggaccccgagccgcccttccacccgggcggcagcggcggccccgtctttcccggctcggccgcgccggcgccgtccccctcgccgtcggcgtcgcccctgcaccgcacgaacgcggacgcgaagacgaggaggagcaccgcaagagccgccgccgccaccgccgccgctcaccgcttctttccattgcaagctctctctcactcactcttgctctgtttcttggctctgcgtacttgtgttgcacttgcagtggatgtcccgtgccatgcccctatttatagcgtccacaggcaaccgatcgcgctcacgcaccaccggcccattgccacgatttgatcgatcgatttgctgctgctgccttttgccattctgctttgccatgcatgtcctcttcgtcgcgtcgatcgccaagctttgctttgcgcagctgcgctgccgaccgagcgttacaaaagtctctcgccaaagccgctttcacctttatcccgtccgtgccgcgtcgcactgtaatggcatgagaaggaatgatctctgttttcttttgttccttcatgtgcgtgcatttttcttcgtcgagagcgaggccccgtgagctagagaatccggttcgctgatggctagtgtcgaggtgtgcaaatgtgctagcaacagctggacaaaaaattttgatgttgccactatgcagctggccctgcgtcgttcgtctgttcccagaggttcgtgttgatgacaatgagagatctctcggcggctagcggctagcgcgcccgtgaccgcacgcatggcaaagaggagaaaacgatatgggcgtgacgtcgatagtgatttcgtgaacacgagtacacacactcaatcgggagtccgtttatttacactcatagctagctagtgctgtacattactggagtggtagtactagttatctagcggtttgatccaaagatgggcgcaataatatttgatactcgatcgtgccaatgcggcgtgcttgaacgtcgtaatcaagtagccaagccgcggcctaagatatccaaggccataatcacgggcatcaagatagtggtaagcaagcactgaccacatacgtagccgttaaatttgaccctcggggttaacaaggatatatgaagccttttgtgataccgtcggcactgtgcccatggtaggacacacttaataatagtacaatactacaattacagcatccttcctttaatggcacccacaatggtaatggcacccacaatggtaaagtaaggtgttctctgtaaaacatatacatctcaacaatagattagattaatagtaaatcacctcaatagtatgtctatatgggtatctatagctctctaatctattgccttgtttttctctatagactatctctagactagtagatagctttgctttctctctcttcatttaatctcttccatgtagaaaaatatggtgacatggatctcttatacatagcctatagataacaattcaactctagtctcgcgtctcgccgcctcacaaccaatgcatgcggtgcggtgcgtgcgtgcgtgcgtgcaatcgtgcgtggtcggccgggggaaaaggggcacgacgcagacatgcggtgggatcgatcggtgggagtaattcaacgagacaacgaacccatcccgtctccgcgcgtagctttcgactgggctagctttctcgtgcgattcgatggcgatggtcacctcgcccccatgtacagtgaggtgtgtgcacagtgcatgctgcagctcgtcctgggccgccgggagcgcgcggaacggcgcggtggccagggcaatttccggtcgacgggggcgcgccgccgaggggatgggacggaaacgattgccggcagctgggtggctcgttacaccggcggagcccagcagccacgtgcaccgtgcatatatggtgcggcgtatcgtgccggtgcaacgacgcgtgtaggcgcaggatgcgggcagagcccaccgcgaagcggttaggcacaaaaaaaggagaacttttacaggatttgcattccaaaaaaatgtaaaaacccaacgctagttacttagataccagataaaaacataagtgcactagttggtagaaaatggtagaattgtccctaattttaatcggtaccgtataggtaccagttagtcatttacgggaactagcttagtgtttcttatttgtatggtttcctctatatttacgttatgtactttgctattcttatttgcatgattttctctaaatttatgttttgtttcagaaaacacgttagtagagtaaaagttattgatcatgtttttttttctagatttatgttatgttctaaagaacatgtcaaaacttatccctttaattcatttgagacttatatttattttacgcggagagattatattgtgttttaaaaacataacctgttaaaatataatcgaaggtttgcatcgttttaagttatacattttattgatttatccgtataaaacatgaaggataattcgtcattttaagttatacattttattaatttatctgtataaaacatgaaggattgagcttcttccacgctatctctccttgtgggtgtacccattcaaacccttgaagaacatataggaggagatctcgattcaatttcttattcaaggaatttgtaaactacataaatagctaatcaagtgcgcacatatgtcctagatatcttaccgatgcgcttgcatctagccgtcgaccggccgatctcgtctcttcttcaacccttaaccatgtcggtgcttatccctttgtctcctttggtgaaccatttaaagtcctagaacaataatgaagtgaaggtagagaagaaaggatacatgatcttttctttttttttcctcattacagatcgaatcgatcgctaaatcaatggagtatccatgattcacgtttttttatctacagcaataccaatctatacaacaataccgatcaatagagccaagtattcaattcatatgaaatgtccatattttactaattaattactctactgccgtcatattataataattttgttccatactttgcccctctcttgatcaatggttcatattgctccacctctaagtacctcgcaaacaccgtgctttatggttatgggcccaaaagttagtgcacggcatgttgagttgaaggtgggtacccacttcgtgtgcggttatggttccctgcttaagagcatcttcaataacctctccaaatgtctatttgtctaactctccatctaatttagctagtcaaactcgttgtttactccaacagcttctccatctactatctccattataagtctatgacaaataggacccatatgtaaatctcttctgcccttcaacggcggacggcggcggcgactcgtgggcgcgaaggcgacagacgtgggaggcaggccgggggacagtagcgagcggtgagtggagacgacgctgagctggcgggctgcagcgagcggatccgctcctcactggcctccctcgctcctccctcaccgtcgtcgccgctcgggccgcgtccccatccgccggcgccgccactcgggccgagcttgggctccatccccatccgccctctgctgccgctcgggctcctcctgctggtgctgctctggccgagctcgccgtcaagccacatcgccaccaccaccgacctcactgtcgagcaaagccgcatctgctactccctccatcctcgcccccatctcgtccttccacgagttgatgcggggcagaggcggcgctaggagaccggcacccaccaccatgtcgtcccgccctcgtcgtgccctcgccgtgccgccggcgcgccctcccgctcttgccctcgccgtgccaccgtcaccgtcatcgtggtctcgtggtggattcggctagaaccttttcatggtagagagagagttgtggggcctacttttggcaagtgagtttggatggccaaatttgaccaatgagtggagagatttggccagccggatggcttagccatccagttggagaggctgttggagcatgttattttttgctagagttgtcaaattttaacttggagagatagttagagaggttgttggagatcctctaacacaaccaaaccaacgtatcgtactccggctccggtttcgcgtagtcgcgtttggttaatttcgagctttggactagtcggtaatctctacaccctccctcgtttccatgagttgagacaggtggttactcttttctccgccgatacagccaatagtgacaatcttgcgataagatggatacgtcgagcgtgttcctcttcttcttccctgcctcgcccttaaggacggtgtagattcaaacaagccggtgatataattcagcatccctgagaagaagaccacctgtgacaacatggttgagcacttgaggtgttgaagaacaatagcaacagggttggattctgtgcataatgtcaccacctccatcttccatgtcctttggaccaagattcaactgcctgccacgcctaccaaatactccctccgtcccataatataatagattttgactttttacttacactgtttgaccattcttctcattcaaaacaaattttggaattattatttattttatttgtgacttactttattatccaaagtactttaagcacaactttttatttttttatattacacaaattttttaaataagagaagtggtaaaacagtataagaaaaaaaattaaaatctcttatattacgagggagagaagtactgacttcagcagttgcctcctctccggcacgccttctcatctccggtgctttgtgcttctcgatgagcctgtctcccctgtgcttttgtactgttgtgtcgacgaggagtggacgaggtacaagtacgatatttgggacgcaggccgtcaaagaaaaactgcccatttgcccgatagcagcttgtcaggggaagtttttactttaacggcctggccggctagctaggcgtgctcgagttctgccctgcgcctgtgttcagcaagatcacaacaactgacgtgattgacggatatttttttttcgggtatataaattacgctcatatttatatctcgtcaaatctgacgacgaactctacatggcccgcaccctgtttggatacgacctgaagacaatttatgaagtctacaagatggatttttggctacagcggtgcagcagaattcaggagatcgaagggacatcgaaggttgagaatgtcgacgaacctccagtgtcagatcgattattgtgggatcctgcacactgaaccatatgatatgatactggtttagtggtttgtattgtcttctctcatcgtgtgttcttttgccgtggcttgtaatttgtaaagagcttttaggttcttttggtttatatgtaattagttattttccaggaactaaaagaacctaatgagaagtaatgagaatgctgatgacctaaaaattaatgagaatcgtctgacagttgcttggttatccgaagagtaaggtgaaaaacgaaaagaaaggggaaaaaaagctatacatactcattttcttttaccaacaaaattcttactaacactaatttatcatgttatgagtgtatatagattttttataatttttatctatctaaatcaaatgtttgagatgattgttagtaaatttagaaaataagttattccgtgtagcagtattcaattctcattaattttgacacttgttacacaacaaatgaccaagcaactgttacacgagggggtaatgaaggtggttttcagcgaattacacactgacaataccaccttcatccaaaagttccatttttttttcttccaaaagttattactattttatttttatcaccaaaccttcccaaatataacaatgttatctgagcagccgtgttagtttgattagtttgaaaatcggttttgaggacacactgaagaaaaacccaatctcacgttccaccatctcacaccatgcagcaacaaattatcggcagtactgaactgagcgttatgcaaatctgataagatggggcgatagtgattggaataactgtaattaacggtatggaaagctgaacaatgtacatatattgtgaattgagttgacaaatttagaacagaattcaggagaaggaaatttctgccgaagaattgtccgcagaacatctacgaatcagttagatcctcttctcagcttagccgccaagtagctttcacactaaatctccatgcataaacataatagaaacatagtagaggaacagactgttaaataaagacaaaatactacagaccctcacagtatgacaatgcaagatgaataataaaatataatcagctgcttgttatgcaaaaatcacaacggatattgcatactacaaatacatctcatagtccgcatattgtcattacagccaatagtacaaaataagattttacaggttggaagtgttcttgtctagttctgatcttgtggaataactgctcttttcactgtctcaatagctggatcttgtggaataactgctcttttcactgtctcaatagctgaattcacaactcgaacagacaagtttcacatgaaatcaacatttcatcgaacttttagaatttatatttattaaaaacacaggttgatcaaaatagtgagcttgggtatgcattcaacgaaggatttaacagcactagctctcaagcctggcagggcgaaagctattaggcagtaactgcagatgctatgagaaattttagcatcattaggcgtccatcaacagctcacttacattcagtaaacattaattatagaagtggcaaaacaataatttaaagagaatacagttggtgttgcattgcatcagacatccaaggaaggaattagcagcattagctctcaaacctggcaaggcgaaagctcttaggcggcaactgcgaatgttatgagaaacaagccttgcttttagcatcatttgccatgcagatcaccaatttacagaagaacaacaaataaacttgcatgaagaaaatggctcagacatccaaggaaggaattaacagcattagctctcaagcctggcagggcgaaagctcttaggcggcaactgcgaatgttatgagaaacaagccttaaatttatcatcattgccatataatcaagggaccaaaaaaataaaagcaaaacaaaaaaggttgttaattcaaataaatcaaatgtaatgacagatacgggctctgtagaccgatggagatgcagtcccaggttcctatcaacatgtgaaacgtaggaaaccaactctgttttggcctaatcaaagcatcaccggtcaaagccgtagctacaggtgacgtggcatcaggcccaaactatcacaaaataacagatacaaattctatattattatgagacagcttcgcataatccctcaagagacccgtttaaaatcacacacacagctgaattaaccaattgcaaatgggtactccatcccagaccaaaccacaaaggttatggtcgaaggatggacacttgcaaatgaaaaaagcagctgctgtttaaagtgtcatacggcacttcctatggtcatagaatcctcactgggactagattgcaactcataatacatgaacaaaatctagatctttatacactacaatattactggattataaagcctcaggatgccagacaaatgtcgtcatttgataatctgacggtaattccaacaatatgctaatcatcataggcttaaaatcgtagatataggaaggagaaaaaattatagaacacgcaagatttaaagaaaagaatataaaaatgatctttaaagcatcatcagaaagaaaagccttctcattcacagtgttatagcactgtgtcagaaggtgtcctaagattgttataaggtttcatcctctgatactgtaaaaaatccacataaaaccataaacgataagatctgttctgtgattggattcagatgcaaagatgtgtaacgtcacatggacgacagaagccgtcctctgatcaagtgttggattatgcatcaattacctcctcacaatccaaacagatctaagaaaaacaacagaaaaaacatagcagaacaaattgaaggaggatttcaagttactcagtggtggctttgttaattggttcgattctgccagcgagtgtcctcaatgccttcagaagagggagcttaatatcctcatcgcaatagactcctccagtgcaaagaacacgaatataaaccaataaggaatcgagaaagatagcaatttttaacagaaaaacaattaaaccagataagaaaaaagagcaaaatcagatggctcggttcagcggaaaaatcggcatacaaatcaatccctgaggagtagatccagagagaaagacctgtgatttggtctgttgagcttgaatattaccaggtcgtcactgccatcgcatcgcttgcataataaaacaacaaaacaaccgtgaaaaaaaagatcaaaacgaaacaaaataaatcgcaggatgcagaaaaaagtgcgcaagaataagcggatctggctgtggctgtggtagggagggactggagggagattagggatggcaacggggctgcccccgtcgggtttgtgcaccccgtacccatccccacagcataaaaaacagaacgttccccttccccatccccgcacagggggtagatttcccccgtccccgtccccgcagcgggtacggggcacccgccgggtctcagcacccgaaagaaacagaaaaacagcaagcaagcaacaacaggattacaggaagaagaaaacatagtaaacttactccaacaaacattaaacttaacaagttcatcacataaacttaagcagtacatcggtgcatgcatagcatcatagcagcacatcacatgcagtacataacaagctcacatgttttggagttcaacagagtacacatcacatgcgacggcggctccacacacacggcagcggcagcggcacgctactaacctacgacggcggcgcagggagcttcgaggcggcgacggcggcgcgcggcctggaggcacgtcgctgcctcgctggctccctggcgtcgcctcgcctcaccaatcggacttctattcagagaaaagagaggaatggggaattagggatcggtagatgggagaaagaaaaaacgcgatgtgttttctgtgcgcacgtggttgtgagcggcggcggagtgggggtgggacggcatcacgggattagggtttttctatatatattatctctaagtgggcctcatagttgggctgttattttttagaatggactgacaccctagggatttgctcatgggctgatatatcttgggccccatggggatacgggccggggagtggtggaacgaccccgtccccagcccacccgatggggcctaatttcaggggttaattagatccataccattaaaaatttactggttttaaaatgtcattactatttgcatatttgtaacgatgccattgctatttgtttgtaatcttaacggtgccaccgaaatacgtattttgcatatattagacgaaaatgtcctcatcttctacatctctctcttccacatcttctacccctacgccgcctgctccaccaccattgctgccgccacgtcgctcactccgctgctcctgctgcttgcgctgctcgccgcgccgtgtgccgctgctgctgccatcgcggctgctgccgccgccgggctgcgcgtgcgccgctgttgctgccgccgctcgccgctgcgctgctgttgccgccgccgggccgagccacgccactgctgcagccgggccgctaagacctgagaaggaagagaggaggaaggagaaaggggaagaaggaagaagatgggaaaaggggtattttggtctttttttttaatgtatccaagggataagaagtggtatcttttgaatatgtgtgaaattataatggtatatttccaaatacgcaaatagtaatggtatatttcaaaaccaacaaatttttaatggcatgtatccaattaaccctaatttcagccgttttctacccccgtgggggatgatttcaccccgttaactcaccctaatagaggaattctccgtcggagaccggggaacggggccccattgccatccctaagggagatgcggcgtacaacgatggggaaaagatgaggaggagatttgctgcggcgggggtggaggcagcgatgggaataacagctgcgaaggctgtggttatatatgggacgggatggatgatgaattagggtttagggttcgaggggtggagcttctggattcttcagtcgtggcggctagttgggccgtggccagtggattaggctaggccgtggcggcgggttgaagctgtagaattgggctccgacttgcgagacaacctcaggccggctgctaggatggctttctccaataagatgggagtatggcttgcaatatgtgagagatatcagaagtgtggtttcatcccacttggcatcaccttttttatgaggctataccttgcgttggccatgcccttagcccaaacaagcatccatagtggacctaacttggatggtttttgcaaagatgagaagaagatttctggtattatagtttagggatgtcaagtaaattcgaggtaaagctgagggacgacgagtggacttattccttcttgtgctgataggggatttttttttaaaaaaaaaggttaagtctgttttacaacaaccccttcaactacaaaagttcgatttacccctctcaaccacaaaaacagacaacatacacccttcaactgttgaatatggacacttaacccccttatgccctctttctattaagaaggaaccattgtgggggtagattgagctccctttcagatagggatggcaacggggcggggcgggccgggttgggctggaacaaccccgcccccaacccccgaccccgactcgagatgtagggccaaatcaggccccatccccgtccccctccggggccccgcattaggtagcgggaggctggaggggagagggagagggcgaccgggacggcgagaccagagtgcgtggttctggttcatgggactcggagtccggaggagaagggagggagcgaacgactgggaatggcgaggggatgcgtcatgcgtggtgccggtgcgctgcccctagcgtcctgccgcctccctatatgtgatatgggtgcgcgcacgggagatgagatggggagaccagagactgaagagataaggctagggtttcgtgtatatataagtattttattggattgggctcttttagaccttatatgggctacattgtgagggttaacgtacacccgcggggggcccgcgggtgaaatgtcccccgtcccctccccacctaaatgcagggccccggacccgactcccccgtgggtcaaaaaatgaacccacccccgctccctagggtctggtccctgcaggggacctggctccatggagaaattaccatttctactttaagatatgtatatggtgttattgttggcacaacggagcttcacaaacatgacgccagtgagcgaaagggcctgtagcctagtggttacaagagcctcagtagcacctgaggtcctaggttcgactccccatgggagcgaattttacaggatttaacggcgttgtgctttcagtagtaggcgatgtacccgtcgacaacgaggtgcctgtggtgactttgtcaatctctccagaatttgccggcccagtcttcgaagatgctcataggggtagggtttgcgtgcgtgtgttcatagggatgagtgcgcgtgcgttgtgagtgtttgcgttgtactgtgtaatttaaaaaaaaatgacgccagtgacagctgccagtgacgccagtaaactaagctagcccaccaaaaagctagtcgagcttcacaaacagagcttcacatatttattatgacctttttacacattaaactaaggaaatacatagcaaaacgacaaaggcaaaaacatcaagagcagtgctcaaatttagaccacatatcattgttttctgctcgctagcttaaagtagagccaaccgaggctatggatgatggatctgtttggtgcctcattttgccacactttttttttgcgaggaattttgccacacttaagttatattagtttgaccaaatgtttcttaaaagagaaaagtttgatcaaatgtggcaagtgtttgattcatttccacaactttgacaataccatactttctattttttaaatcccactgtaaactcttttttaaccaaagcttattagaagtgagatcatcaatttttgagccacaccttttgacataaaattgtggcaaattaaggatttaaggtggacatccaaagtccaaacagacccatatcctatcttactttaaagttataacccactaactcctaaagcttaaaatacaaatatgccacatcatcatccactaacaagttgacacatcatcatccactaacaatcaatgcatttagtatcatacaaacatgctatattatctataatttaaaatttattacattttagagcttttaaaatgaaagcatgttaaatcatcattccacataatttacataatatttcggaaaaagtacgaattaccccccccccgaactatcgcggtcgtccgcattacccccctaaaccacaaaaccggacattcttcacccccaactatgcaaaccggacgaattacccccctcgatccaatccgtggtggttttgatctacgtggcgtacgcgtggcagtccagtcagcattctatttataaaaaaatgtgggactcacctgttatatccttttccactcttcccctctgtaggatcgagatgtcgactggagggggggtgaataggcaatttaaaattaaatgacacctaatcaaaactaaactaagttgctaggctcggtgagggacaagactaactaagcaactaagttatgttttgcaatcctagggtgaaagtggctcaagtatatcactaggaaagtaaatcacactcatatgtcaatgtttagcaatcctagggtgatatgatctcaagtatgtctctagaaatgtaaattgcacaaatgtaaatgcgacaatcaaatgagacaatgagataagagatttttcaccgaggttcggaaacacgccggtttcctactccctgttgaggcgagcccaactctaccgctcaaccacgaagccaccgcacgcccccttcgtcaaggggtgggcaaggcgggagccggcccatggagaggactacccaagcctcgatcactcggggtagttcttccttcactccgaaggtagtgaactccaaaccactcacaaaccggcaccgggcctcctccacaatcttctcggagaggtcactaggcaactcctccacaagccgtctaggaggcggcaacctccaagagtaacaagcaatgacccggcgtggagatgatcaagtgccacactagctctacaatggaagcaaatgcacttgactcttggctaaaacaacctcaaccactacaatggatgaacactaagctcaaaggtgtgtgagagagatgcaagggattatgcaattgaattgggtgccaagaaagtccccttgctgctggagggggagtatttatactcccatcaaccaaaactagacgttgggggcggaatcccccaactcagtgctctgccgatctgaccggaggtatgtggccggtcagaccgtgctactgtgcaacggttagttttctagccgttgcagggctgacactaggccctactgccctggccggtcagaccggcctcggctcggtcagaccgccatcagctcggtctgaccgaatacggctccagcggctcgagatcggcacaccgagacggcaccatcgccatatggccggccggtcagactggcccgcacctgccggtcagaccagccttgaggcggcggtcagaccagctctgactctgcggtcagaccggctgccctggccggttagaccggcactaggtccacggtcagactggtccttgtcaggctgaactcaaacagagaaaaatgtttgtgtgtgtgtgatgaaatgagagcacaagtctaaatgcataatgacctaatgtggcaattaaaatcatctctttgctaggtcattaccccacttaatagtacggcaaggctttaaataaactagcacaattttgatcgcccaacgcctcgatcaatttaaaatgaaaacactagtttaccgtcttctcttccttttgctttgcgccgtcaattttaatccatcaatgatcatccatgtgcacacaaataagtgaacctaactcaaataaatagctcaaacacaacggttagtccacaattagtgcttgtcattaattaccaaaattaacaccgggggcctagatgcttcatcctttctctctctcttcccctctcttctctctctctgtctcactcttcccctctctctcgcgcacggtagcaggcgggggcggcggcggcggcgagcacgtacgcgaacgggtgccggaggtggcggcgaggacggcttcgtggccaagacgcacacggcagcgaggaccgcggcatgcacagcacaacggggcagggcgcgaggaggcgacgcgacggcggcgacacacaggcacgcgggcgcagagtgacagcgtgcggacggggctccaggtgacgacggcgatgggcgacgaacgatggcgcgcggcgtgggcggggctcgaggggagataacgacggcgcgcggcgcgagcgatgatgacaggcgaagcgacagcgcgtggcacgagcgacgacgataggtgtcacgcccagaaattcccgaatagaattccaagcagaatgtgcattaaaacccccgtccaggacaggccggggtacacaaacgacaaagttgacatatagatccacgtcttacaaacattataaaagtcttacataaatgcagcggaaaattaaaagataactggagctaacccttgacttggaccgcaacgggaacaccactccacaggcatcctcgacggcacgaacggagcctactcctcggagaaaccgccatctgacacgtactcaaactctggtgttttggggaaaatagagcaagcctgagtacaaccaccgtactcagcaagtcataccggaataggggtatgatgcagggtattaccaatggatagctagagaggttcttttgcataaagtgagcatttataaacagtagttgaaagcagtataaaaattgtattaattacccaatattatccatccactgtccaacgctacaccatgttgcaacaggcccaaccatccacctgaactaatcaattccattagactagactagggtgagactaatcacagtgaatctggttgaccgcccataaccgcgggcatagctattcgaatagttttactctgatcagatgtgtacaactgtacccacaagacacagccccacgacgcgttctcgtgcgccgacatgccaccacgacataccggatagaggccgtgacaggacccttcgcattaccccctctaaccaagcacaccacacctcaggtttcacccccactcctcgcaaggcagcgggcagtcccctttcgtgcctaggtgaatccggaagccgcataggccgtcgtagggcccatccaaactccatcacgcccacccttgcctggatgcgtcagctagaggaaagctacactacaagcccagccgttgcccacgctggcttgtggcaagtacgaggaattcttccagggtttcccacaaaccggtccttaagtgccatgggcgcgaccatcaaaaccatgcacccacagcccagcaattagtatattttaattgactaacaccaagacggtggctttactccaccaccaacactagaacctgaagtctaagcattaatgtgatttcccccattgtgtgctagttgaactaagcaaggctaagcaatccctagtccaatctctagtcatgttatatcccaagctaacaaaggagcatggtacaaaatagcatggctgtaacagtaggtaaacatcccgtagtaacattataaaacaatgcagtatttaagggaaaatagtagagcatttgcaatataggattaacatgttcaagtgacaagcatgacttaccttgctctgctgctggaggaacctcggcgactatttcaaagtacaccagagcgtcgggagagccggaatctaagcgacatacaaagcaaacaatacaaacaggctataagactactgaaacagaaaatgatgaactnctgtaccatcggttgtcgcacnngtgccac

SEQ ID NO: 34268 - DNA, 12188 bp, Oryza sativa
  unsure (1)..(12188): unsure at all n locations
cccacgcacgtgtcaattgccgnanactacgtgctcttctctctccccgccgaccctgttattgctgnttttctttncccctcccccccccccccccnnaaggagatgatgccatcgctggnacanancncatcaggcctcaccgacgacgattgacgacggcgagcgacggagggcgatggcgacggcgggacgagctccaggatcacctaaggaatcaaaaggggggagttagagagggagagggaaaccatggatggttagggcgccgaccgaaggcgccggccatggcgaagctcaccggcgcgcggtgcgaacggggttcccgcggcggaaaacagcggcggagaggcggacggcgtggccctcgggcttgtgaactcgacgacggcaacggcgcggctcggcgtggcggctagcggctaccagagcggcggcggcggcggcggtgaagaggagggcgacggcgctagggcgatagagggcacgagagagctcggcgaaatggagaaaaagagagagggggagagcggggatgcttaaataggggagagggggctcggacgtggctgggagcagcccgatttcaccggagtagtggggagggggagagagggcgtggccgatgggattcaaaattgaatcccggccgtttcggcgcgggcgcgggcgcgggcgggagagagagagggagtgggcgcggggtcgcggggaaagtgggcgcgggcggcgacgtgggcaacgtggcccgagaggcgcgggcgcaaggaggcggcgacggttgcgggatgcgcggcggcagctggaggttgggggaggacccgacaggtgggccccacttatcggcgaccccgggagagaggagggggctcgggcggccggcccagcggggagggggaggaggaagagaatgggccggcggcccattcggaaaaaaaaagggggaaaaagaaaaagaaaaagaaggaaatggattttcctgggattaaatattgcttgtgctcatttttaattggttgcaattagttctagagctctgaaaattgcactaaaaatcttgttagcatatttcgatatgtagaactcaagaaaaattccacatgccaattccgattattatttgcattaatttattagggtttctctcttgcttttacaccgatattttctctaggtgatttataaattcaatttaagcttgggaaagaactttagggtgtgacaaacgcgacgcgacggcacgcggtggcacggggtgcgaagaggcacgacggcggtgattgcgactgtccctcctcgagttcctccacgggatcgatgagctgccgagcaagctcgagctcctgcatgcgggatcgacgagccaccaccggcgatgccgccgccgccgtgtccttcctcgtcgacaagtcagcgaaggtcttcatcgccggccaccgcatcatggtcggctcggtggtgcaccgcaagctggactcgctggggttcaccaacatcgtggtccggactcgtgccgagctcgacctggcgtgtcttcttcgccgccgagctgccgcgctacgtgatcctggcggcggcgaacatcggcggcgtccacgccggctccgctgcaccagcggagtacctaacggagaacctccgcatcactgtcaacgtcgtggacgccgcccgccgctgcggctccgcacgcaatctgcttgtcctcgctagctcgaccatctaccccgcggatgcgccgcagccgacgcctgagtcggtgctgctcacggggccaccggcggacggaggtcgaggcctcgagcctgcggccggtgcgtgccgccgtcctcgccgccgcctgtggcccccgtccgcgtgcgtgcgcgtcagagagagaagagagagcctgctgccgtgcgcgtcaaagagagtgagatgggggaatagtggaagaggatatgacaggtgggtcccacattttttaataaatagaatgctgactgggttgccacgcgtacgtcacgtagaccaaaactaccgtggattgggtcgaggggtgtaattcgtccggtttacatagttggggggtgaagaatgtctggttttgtggttcaggggggtaattcggacgaccgtaatagtttggggtaattcgtactttttcctaataatatttcaatatatatcttcattattttttataatatcttatatacctttataatatcttatcacttggtttatgttatttctctcttctttaattaagccatatcacatcaactgattctagtgtttatgtaagtttatattgtttagctatcttatatattattttattattatcatactaaactcatgcagcaacacggggggtttcacctagtatctgtaagttttgcacaccacccacattaactccattcttaggtggtcaatgcgtatgtttcggtggtgtttggatcagcgactaagtccatgtcacatcagatatttaacactaattagaaatattaaacatagtataataataaaactaatggcataaatgagagctaattcacgagacaatttttttaagcctaattaatccataattagcacatgtttactatagcatcacataggctaattatggattaattaggctcaatagattcgtctcgcaaattagttcggagttatggaatgaattttatcaatatactacgtttaatatttttaattagtgtctaaacatatgatttgatggcaactaagggcttgttcactttgctaccattttcaaccttacgaagttttggcattgccaaatttttgttaagattgctaaaattttggcaaggttgacaaaatttggtaagatttcatatgtacttactaaaatttagcaacaaactaaatgtagctattttttttaattttttaaaaaatataaggttgaaaatggtagcaaagtgaaacagacatgcatccaaacagaccctagtggcgcgccgcctgccggtggtaggcgcgtacgtgtccctgtgcagcgcaccgcgcggcatcagaaatccactagtatcggatatttttcctctgtgcccatcagcaatttcttgaaaagaaaaaaaaactagtactcctagaaaacatcagctccactacttgctgtcttgctgccgccacgctgctcctccccgctccaccgatcggaggaactcaggcagccaccacttcctcccttccttccttgctcagctccgattttatccaacctatccatctatattttatccatccttcctccgtcaccatcagctccccgcgcgcgcgtgcatatccgcagggcgcaggcgatgctctgctcggcccgcatgctggcctgcagcggcctcggcggccccggggggcggctccggccgtcgccgcggccgggggcctacgctgaccggctgcggccgccgctgccggcgcgcaggtggcgggtcgcgtcctccgccgccgcgtcgggcggatcccccgacctgccgtcgtcgtcgtcgtcgtcctcgccgcctccgacgcctgcagcagcgtcgttcggctctggtgatgagcaggccgccggctccccggggtaaatgctttttctacgatcagtaggtgtttttttttggggggttggtcgtgggtcaatcacgctggatggctgagtgttcttgagcttgaccccccaatatacgctcagtactgtgttgaccagcatacaggggattgaggggagaaataattcgaatagatttagcatatgcttcatggttgggacgaattctctgttgatagagtttgtctgaatatggtggatcttgctgataaaaaaccgagtaccagggtagctatatatatatatgatatgcttgcctcagcttcgctgttgatggaggatgtctgaacatgccggatctagacgataaaaattcaagtagtttttgtagcctttgcttggctccttccgtgttggtgctggagtacgactgaacacgttaggtggatctagctgacaaaacgttggtcccgaactctgtcgttttggacctttagagatgataacattttggtttggtgttgtattgcacggagctcatgttgagtcatgcccggcttgttctcaggttttgtatcattgaagggcctgagacagtccaggattttgaaaagctggacttgcaggagattcaggataatattaggagccgccggaacaagatcttcttgcatatggaggaggtatgtcgactttgttttttctatgttactgtttttcattaaatggcaatagtgtaagcttggtatgatctgattatccctcacaaatagttaaaatacagaagataatgtgtagtccttgcttggtaatcagcatatgagttcaactaacgtggagatggcaatcctctgagctattacatagtacttttagattgtttacgcaatgatttcacagcttgcgccgttgttagttaatctttattctagatattgtgatattaaacaggtgtgttgcaaatcatcagagaactggaaacacccgttaatccttttgaataaatctggcacatcttctttctgcatgtactttagattgctttcagtttgttataccttctaaagttcttctgtgcagtgtcagatgtgttttgtgctgtatccttatttttctattttcgtgtacgtagattcgcaggttgagaatacaacaaagaataaagaatgttgaacttgggatctcagttgatgtgcctgaaggggaacttcctgattttccatcattcattccattcttgcctcccctggtaagtatatatacttctacatccagcaccatctcacatggttcatatttaaggagtgtatatatgctattgatattacttgttgaatttgaagttccaaatcagctcattactaatggttctcttgctttaaacagagtgcagctaatctcaaaatctactatgctacgtgtttcactttgattgctgggataatggttttcggtggatttcttgcaccaattgtaagttacactgtctagtccttgtcaccatttttatcattattgattccatcaatatccagtggatgtttaacaatttattgtacttttcttgcagctggaacttaaactcggtgtgggaggaacatcttatgcagacttcatccgcagtgtccatttgccgatgcaactgaggtattacaactattccatgttctattggtgtagtgaacatcttttaaccagttcttgataccagggaagttctgagataccgtgtgctgatccttttcatgatttttctatctgtacagtcaggtagatcctattgtggcatcgttctcaggtggagcagttggagttatctccgctctaatggttgttgagatcaacaatgtcaaacagcaggagcataagcggtgcaaatattgtttaggaactggtacttatttcttccaatgctgcttcaatcctcgtacccataaaatatgaataaatatctaagatttgcacttgctgttgtgttttggacttttggcagcgcagttcagtacttcaatgcagtacaatttgtgctttagtaaaatctctccattatgtaaagaaaaagtttagtacttcaatgtaagaatgctatactagtgttagctcagtccaaagatgctcacaagaatcaaaaaatctcagaatgaattcaaaggtctgatagcttgtaatgctgtataatgcgtctaatttgttagtgcctagttattaagcttgtttttatggacctgttaccaaaaaatctatcccctctaagaaaattttcttatagttgctcaattgctataggtttaattgtttaaactacagctttgctagggtactgacagttgtggcttgtaggatacctggcctgtgctcgctgttcaagtaccggaactctggtgcttactgaaccggtttcaacattcagcgatggtgatcagcctttatctacgccaagaacagagaggtgcccaaattgttcaggcgcaggaaaggtaaatcagccttttgcacaatgattcccaacaacaatgtcattcaaataatatacgcatatttccacttgctattttggattgaaaaacagccctgatttcaaacaaaatgtttgcaggtgatgtgtccaacatgtctctgcacggggatggcaatggcaagtgagcacgaccctcgaattgatccgtttgattaaaatgcacgtcatagttcagaaattcttgtaccactatataaactgtttgtagataatagtattgacaggcgcgcctggggttccaggcttacgaatagggcaacacttcacatcttagtgatgtgcggagcgaatcgcttgaattgaacagtggacaattcagaggtgtatgttgtcaaagctgtatcactgtatctgtatagtatgtttatggcacccaacactaacagttcaattccacgaattatttatctgcgttttgcttgcttttcaatggtcttttgtagaccttcgaatgtgttggcttggtgcacattttttatgatttagcctagctgcccatgatgctctaaatgtagttacagtttatgcgcgaccggagaaaacaagattataagccgctacttaaaaaatatgggtaaaacttttatatgctcttttcatcccgtttgagcatcacctaagattttttgtcttttcaaaatgatcagtgtctgtttatttggtgcaagtgccttcttatttatttgtgcaaagagtaaataaatgaatattattgaatacgatgcatgtaaccaattaaaattaatttatattggtgcaattccgtgcaatatttaaaatttgatgtatttcacgggacatgaagcgacgtagcactttgatcgcgagtattaatttaagaatgatgaatgttgcgttgttcacttgtatgctgtttgtttagtgatgatcaaactgggaatatttcttcagcgatctaacgatgaaaaataaactatgatttaaaagccaatgatgaaaaataagctatgatagaaaaactttaaaatcagctttaaatttcaaaattcaaattgcagtagcggctgataagccaagaagactaatcatgggagttcttcgttaacttctagttgggccgtcgaggcaacagtcgagtatccaataggaaaaagtacaccgaaggtccctgaacttgtcatcggcattaaaaaatgtcctcgaaccgcaaaatcagatatacaggttcctgaactgtacgaaaccggtcgcccgaggtctttttggtggtttttaccccggtttttgtctacgtggcagctgagtcaacatgggccccacatgtcagcgtgccacgtcaacttcccctttcccctcttctctctcccttcctcccctctctgctctctctctctctcgcaggctgggccgacgggtagggagcagacggccaggcggcgagcggggctgagcggcggcgcacacctcgcggatcctcgcttcgagcctcttgacctgcaggcaaacagtaaggagcagcagcagcaccatcagccggaactagcagggacggcgggatccgcgaggacgccggattggtggggacgcgatgccacaccgactccaccttgatggtgtcgatgccgcaggcaagctcccccacgacgcccatgaactgcgccgcccacggctcgttactcgcaatcgatctcgcctacacttcccatgttctctgcatcgatcaatctgaccttgtgactgcatgcatttctagctcccagctacctgtgtcaaacattccatttgcatgataatagcatgctagagccagataacaagaacaaattaaccgatacttgaagaactgagacaaatcatcgcgtgcaagttcaactgggcctctttaatctacccatgacaatactgtcagccagggtcaactagtgcttgggttctcctccgctcaggccccgtcgttcactgagctgctcatcactggggtggtggcgtcggcgggcggtgacgccattggcaaccgcgagcagagtccagtcttcccaatctctgctccgaaggatctgcatgctcgagctcttcagcgcacaccgcgtctagtcgctccaccacgtccgcgaggaagaggcggcgcgcctcgtccgcgtcgtcgccaacaagtgtgccatgggtggcgtcggcgtccttcttatactgccgctgcataatgtcaccgctggggccatcagttgcaggaggaggcggcgtcttctccagctccttcgcggccggggaacccatcgccttctctggctccgccatggtgttgcgtaccgtgaggccataggcgatttgggaggaggggttgtcgggggcggtggatgtgtcgagaacgaaggaggggtcgccggcggcggatgcggcttctccgccatcccgcccgccacctcaccgcaccgcggctgctactcccgcgcccgccgccgttcctgctccctcctcttctccacggccgacgacctcctcagcctcctcgacaacgacaacgatgccaacccgttccccgccgacgaccccggccgcacgcgccctagcgccggcatcccgatgccctgcgagagcagagagcgagagggagggaggaagcagagaaacagagaaagagaagaggggaaaggggaagttgacgcggcaagttgacatgtggggctcacgtggatctcatgctgactcagccgtataccaaaaccgaagtcaaaaccaataaaagatctcgggtgatcggttttgtatagttaagggacgcatatctagttttgtggttcggggacgtttttctatcccgataacaagttcagggacctttggtgtactttttccgtatccaataagaaccagcccaccaacgccaagtatccatgcccactcatcttcttcctccaggctcccgcagcctttcgcaccagcgcagcgcgcctcctcgccgcccccggccaccctgcgccgccggccgccgcccgccggcgccatactaagagggaagagtgggtaactgagttccgacggccggaggcggggccagcggtggatccgattggccccttctggcctctgactcgatccggttgagatagtggtgaggcgatggatgcgctcgtggcgaactacgcgtccgactccgactccgacggcgatgctccggcggctaccgcgggcgaagccgccccggtgcctccggaaccttccgcgttgctccctcccccgcccctcgacctcctccagcccccaaacttcgtaggcatgattgatacttctttaccgtactgagcctttcctcaattcttattctgaggccccccggtgatgtgttcttactgaagttttgcagattgctcgacaatggcgcaggggagtcgcgtccggagcttcccacatgtggaaggcaactatgcgctacatgtttacatccctggtctgttttctctctttcttttctcttgatctttctatatctgtttgtgcttaggtgaatgtaaattattggtcgtttatcgctggttgcatgttaccgcaaggttagttgcttttccatgtgaataggcatgcttatattgcttaacaccacgatcagatgtgtaggagtaggatctattgcctagccctacctatctggtttcatgggttttccttaggaaacaggatgcattctgaggacattactgcatgtttgcacagtacatatactgatataccgaaataagcatgcaccttgccaacattaagcgacgaagggcactttctatatgttgctgttgctgaactgatttttcagcatgttcatcatcctaagttgtagaattagtaacatagcaaaattttagtaacatcattttcccttattctgtcatttatatagtgtaagggggaaatgccgttgattcagttcagtatcatggtttctttttttattgtattgaattgaacagaaaacgggtagaaggattcactttctcactgttggacatgtaaaattttacgtcctgaaaggcccttgctcttacatatagatctctctcgtgcagttgtcataccttctgatgcaaagaaacacctggtccttgttatgagaagagccgcgtcttttgtgccggatctctatgccatcgatgcagattatgcactttccgagttgtgcaaggatgaacaaaagcttgagaaagtgcttctgagcagggagtttcatgtaagtttaggaagaactgttgcaattcaggtgcatcaaattgagtcccttgtcgcaatgcttcggcaaaagttccgctcacagcaacggttagtcatctcttatacctttattgctgagttcttactatttaactcctttcagtggacagactatgtgtacttgtctacagattatacttgctttatgtacctatttgggtataataattttttgcactgatagaattgactatatattaatcaggtattggatggacttcaacaaatgggagcattttgtcaatgatgattgtacacggtcatttctttcgctagaagttacaagtactgggttgccagaggtgcttaatactatctacctagtgtcctagcatctttaggcattgtatggatctttttactaagtctgataataaaaataccatataatatatgttcttatatgtcattaatgaaatgcactattaacttactgtttgttaaacttttgcagattagtaaacagataacgatggtagatgatgtatatcgattacatgggcttcctgaattctataaggtaatatattctttagcaatgtttgtgctggtgttctgcatattttacttgatgggtaccacatcacacatattttatggtttaatttcaaaacatgcgagcaacataattgcaacctaaaacagaaatctaatacactgctgcaatataaggggagggcggtagtgtactataattttgtttggtttggaacatctgtctgacagaatcagtcactggctgattagaatgattatagtgtcccacccagagtatcactaattcattatcatctgtagcatcaccacatttgtgcaaaattatttaactagtgtcttgaacttatggcagaatccacggccacatatatcactggcgtgggcattgggtgatgttagctgcaaactgaaacaagcaattaaggagatcgaaaaatctcagagcagtctgggcacatctcaaatatctaatctgagatgcaagtttagtcatgtagtgtgtaaaataggcaagaaggtgtatgatatctgtaaacttgcagactgagagataaatttcttgtgcacttgaccgttgagttctggggttgcaacagagatatacaaatgagcatgaaaacagagtggaagtaacttggaaaaactacaatattattcatttggttgagagttaaaacttcttgccagcatgcttctgatcaatggttgtatatcttttgatgtacagcaagatagtgtgcaggctttccattccaagaaaggaatgatggccaaaatgatcacaaattcacaatgattaaatgactgcatgaggtaaaacaaaatctagaacaaaaaggaagtctctctaagagcaactttaatagtatagcccactactagctccaattcatctatagccaatctaatagccagttcatacaatagtcgtcccccctgtactattaacacacggccccactctttcatatgcacatttcatcttgttctccgccctttctctccttccccactctatcgccgcacctcattctcatcactcttacccattctcacgtctttatcctacctacccctccccccctcgctactcactcgggcctcccatgtcttctacacaaccctccctcgaccccgctacccccattcattccccccttctccccccttcttcctacgacactcccatctaatccctccttctcgcgttatcgactacccttcctactactcgtactcccgactacctgcaattaatagtcactgcgtttatacttcaacggaagcccacactcccaaatctggggatcaacccaacactcctatctcccaagcctttttcttaccgcccctcattccaccccccccccaagcatttcctctatcacacctccctccactaactcg

SEQ ID NO: 34269 - DNA, 6060 bp, Oryza sativa
  unsure (1)..(6060): unsure at all n locations
aataacagcacttgtatacaaaggaagatatattgccgccagagtttctaagatgcattgtgggtatgcgaggtggggccatattctatgttgtatggnnnccacctattgaatgaattggttattagattggctatagatgaattgtagctagtagtgggctatactattaaacttgctctaaaaggtgcctttagttagaattccttgtaaatnctagtgacaaccaacactgtaccagattgtgccaatatattaccgaatgaagattttgaattacaaaattgaggtgattcctcaacagattctcatgcctcccatcccctcaacagagtagcctttgcaacccggttaacccccaaagtgaatgcccccatcctaaggttgcagttttgggatttgcacatgtccttgatgttctgaaaagcgttcttcatgtacttttggagctccctgttcaccttctcttcatcccacatgaagccctgaatgttctgcaccataggcgtagcacaaacatatgccattagattcatgggaaagatccaaagaaggcacaaaatcttctgttctattacctgaacccactcaaaatagctgacgaccacgccgcctgaatttgcatagatatctggcagcacaatgactcccttctttgcgagtatcttcaaggcagagagtaagctcaaaagattagaattataaataaattatcattcttgatgtcttgaggatattcatgttccttgaaggagagagagagagagagagagagagagagagagctcattgtggttttgagcttacctcatcagcttctgtatcagtgggatgattagccccctcaattatgaatctggccttcacttcagctgcattttctctgcagataactcatgtgaattagcaattctgcaacatgcagctagactaaggtagaaaactaaaacagaaaactccacaatacacagctaacaatttttggtatcatgacaccgcacacactaccaaataccaaggtgccaatatttatatgaatggaaacacaggaaaatataaagcaaatctcatttgcagtttacaaacctagaaactaccataggataaaaaaaaactgacgtctaagatttgtcctcatcaccccgagtaaaacttttactctcagatttaataataagtaaaaagttttattgggagtaaatgctttactcagaatatcttagacggtttatttttaattggatcctacgttagtttttaggtttgcgctacatatgaaatttgtactacatatttctttggaaacactacggcctaataatgagatattggaaaccaggtgaaaatgtagcaaaaacatcaatcaaattaccataatacgagattcttttatcaaatgcagcaatgcgccgttcttacatgttgagaacaccacccaaggcgcacgggacgagaacatcacattcatgcacaagcagctctgcagcgtccataacttctgcaccgtagaagtcctccaaagatccaccctcgctcctgtgcttcaagagagcaggtatgtctatcccggatttatttctgattgcacctgttacatctccaactgcaactatcttgccacctttctgatggatgagcttggctgcccaagaaccaacattccccaaaccctgcagaaaagattagtagttgatcaagtacaaagttatacaatttttggcatcctaatattaacatattgttaagtcaatcaataatgttgtcattgttacctggataacaaaggttgatcctgaaattgactcgctgtattcagtcaataaagcctcagtagcatacataacaccgcgaccagtcgcagcatctcttcctaaggatcctccaagatcctatatcaaataagacaataagttaagttaatgataaaatatgaagagtttgtctagatgaaataggtttttcatgactcatgtaaactcacaattggctttcccgtgacaacagctggggaggggccatggaactttgagtattcatctagtatccatgccatggtctgtgacagttgaaaataaaattttcagaaacatgtaaagaagaagcagagtatgaagacagcagatgataaattataaggcagatggaattggatgactcacctgtgcatttgttcccatgtcaggggctggaacatctgtattgatcccaatgaggtcatgaattttctgggtaaacacgcgcgttaaacgctcaagttcacttctactcagttcaccaggagtgcacccaatgcctccctttgctccaccataaggcacagcagcaacagcagtcttccatgtcatcagctgagcaagtgcattcacttcatctgggtcaacctgtccagggagaaaccttgatggttacaatactaatcgatccttctaaagacctactcttttggaacgcaagaaattttgtagtttctaaaggaattggcagaaaaacatcatctcctcacctcagggtgatacctgatgccgcctttcatcgggccacgggaattgtcatgctgcactctgaacccaacaaacgtcgccaaggtgccatcgtctttggggatggtgcattcaacctgaacacacaaatgccaatggttcagtgaagccgatgtgaaccactgaatcaagcatcaaattgcgagaaacagagaagcaggaaatcacacaaatcacacagagcatctatcaatcaatctatgcaatgcaagcagggaatcgggtaccttgatctcgcggagagggatcagaaggctcttctggagtttggagtcgaggccgagtagcctcgccgcctgccggaagttgcggctggtggcggctagcgcgttcatggcagcaccggagatcgccctctttttctcacagaattgcacgaggattcgacggaaaacaagcacaagaacgacgagaagctcacgagacggaaatttggcgaaccaaaggcgtgattttcatctctggaatccgaaggcattaatagctgagtgactttgaaagcgtgccgggaacaaacaggaactctttcgagaatacaaacaggaactctattaggctcggtgacacggcattgcaccgctggttagagcctaatagaattattcatcaagaaagttattctgcaagggaatcgttgaaagtagagagtttgtcgaagaagaaagggtgttttgatgctatctttctgcattattttcttcagttcagttggctggtggatcgaactgctcgagtcatatactagtacgagtcaagaattctcgacgttacacaagcaggacatctgtggaggcacaaagcacgtaacaagtcccggggatttccaattggatctgcagttctgcacgatatcgagaaggcactaaactgttttcggacacgtttttaatcaagtagccaaagtgttttttgctcagcgcagagcttagaggtcttggaccggcgtctcggttgaaaaaagaagcgttttgaaagcatggacctttgaacgtctgttctctcagttctcagttgtcacaaaatttccaggctttgcaccgtgcaaacacaagctaaaacgtgaagctcaccaacgtgtgattgcatggttgaacggtggtagctgcaaccagcgtttaccttaccgccggtaaccgcgcggttaccgggcttaccgcggggtacggtaatataaataccacggtaacctccttatattcaaataaattttaaaaataatttgattttttgataaattttgcacggtttttcgcggttaccgcggttaccgcgcggtaaccgtgcttaccgccggggcgcggtaaccccggcactggcggtttgggaaaccctggctgcaactagcctgagacgcgatctcccaaatacccaggacactgaaacgtcaatggatttcgcaaagcacagagctagttagtcaaatgaggactagtactgcaaccagaatgtagaagaagcagacaaaacaatcgccaactgggtatttgtaaaagcagtacaaccaaatgtcaaccatccattgtgccattgtgcagctcaagaacagatcatctcatggttcagtatacgagcttcagggtcatccattcgtgcatctggcctaggaactcaaggaagccctggaactctaagcaattaaaaaaaattcccctattctcaggccttgcaggtttttctacaatttctattcagtcctttgagcatctatagctgagcaaaattccaggcagcacagtatggcggtgcagacacattttcctctccacagataagaagcagcgctgcattccctaaattaagaaaacacataagtaacttgtatacgtaatttccagttaggatatagatgctgatcaactagtaacttatataccgatgtgcctttccatatacttaccaaggatatgcaacctccctacaaaaaccgtaaggctcagttacaagatcgtacatagtatgaagtatgaaccgagaatcttcggtcaggacatagggacataaaaaataaggcacatcttcatgcttccatcgctacagttctaacggtgcctagatcaccacaaaacatggtagcaattaatcccagtttcaacatttgagcaatcaacacttcaatatcagtcgcatagcctgacagtgaataatttattcacatcaacattcctgagcttaccatcctccaaaaattcaggtgattttcttcttgagaagccaaaaaaatcagatatggatgaaacttgagtccgcatgcctacttttccgcaaacaacataaaaaaggacaacaaagtttagtcttagatgaatcaaactgacattttaatctcaaaagaatcaaattgcattttagtctcataagaatcaaattaccagatttagctgtaagtttactgttagtgagaatggagaatcttcacaaacatgtctttgagctccctatgtgatgtcattgcttccaatatcttgtcattgaatatcacttcttgagacaagttgaatcctgcagcatggggttcttttgaaaatagcagtttggacatatgatccttcttagcttgcctatcatatttgtccttctcctttgtcccttctgtgattagattgtatgtatacacaatcttctcttgaccaattctataagctcggccaatcgcctgccttccaactgaagggttccatacaacatcaaggagaaccacacgtgatgccccgataagtgtaatgccttcacagcatgccttcgttgatgcaagcattaccttggcattgcttttcatgtcattgaaggcctccatcaaagcttctcgattttgaacaaggacatttccactcatcagtaggatctcctcaccttctgtccaattgaacattttactaagttggtccatgatcagagatagtggttcaagatattgactgaaaacaagtactcgctctttcatggcttcacacaaacggacaatttccaaaacaaattttgttttgactcctacgcacgggtttggccgtaagctcttcagcaaagagacatccacagaagatgtttctttttccgacagttttgcacatgtgacgaggaacgggtgtatagatgcaagggagatcttgtattctgcatcaagagtccccattgtcactgtgttctccattgctgtgatgatttccttttgatgaggaagaggattcagaatcacaactgattctctcaatcctggaagagacttttgaagaatgtcaccgttatggatgtgcacaattggatcgagtatttgccggatttcatctatctttttctctgttatgttattcagtgtcaaggatgtccagtaatcctcaaggcctattttcttgaaacttttagaagcgaagtgtcttgcaaactttggtctaatcaggtacaggacattagagagctcaagaaagcttttctgaaatggagtaccagatagaattattcgctttttggtgcgaacttcttcaagaaccttncatatgagactnttcttgntccttggtgtggn

SEQ ID NO: 34270 - DNA, 3534 bp, Oryza sativa
  unsure (1)..(3534): unsure at all n locations
gatgggcctttgaaatcagatctgcatgtagnncancatgaaaagcgtatagctcacaccaattatactgctccctttacgccatgatgccaacttcaactttcgcctaaatttgtgatccaatttgtttctagccaaactttgggccaaattttcatccatgatagccagctgtttgatggtcctgtcttctttccagttaatctccttggagttcaatacatgaaaagggaccttcaccttccattttctgaactcctgttcccatgtagcaagcatccctctgggagcaattatcactggacagcactcgggaaaaaacgcaaagtaggattgaacaaatgtgattgctagtctggtcttccctgtccctggtgcatgagaaatcacacagccaccttcaatagtgtttgcattgttcctcagctgttcaattgaagtcccccctgctagttttctccacatgaactcaaaaccttcttgctggtgcgggaacatgtcctcccggaccccaggaactagatcccaaaccaggccagtctttttaccaccaaaatcacgtggtccttcatatcccgctgatgttaggatatcatcaaaaaacaagtctaactcgtgatcttttctcatgtccctttcagtacaggactttacctattgaatgagaaaaaaaagaaaacatatataattttttgcaagataatagatgattaatcagaagaaaggcaaaagcatcagtcaggtgaagtataaggtctttgggaaacatgttggagtgtacggtagtagcttaccatggagggaagtacgaatctgatttcaagatcaacaaagttgcagtgcttgcatcgaagtcctatttgctcatcaataatgagctcatgcttcccttggatgcatgaagctgctttgtccgcagggatttcttgctcatcttccttttcaccctgaaaacaacgatatgagcatcacttttgtatttagatttttttactggagataaaaaaacacagaatttccaaaagaggtttacatttgaatgcatacaaaagttaatgtttgtcctaacatgctgagaggacaaacaaggcaactcagacctccctatagggaggctttacaaacttattctgacaaccacttcctgaggctgatggatatccacaaagaacattaagctaactcgtgtattagcaagggctattgatgatgcatttattttgcatacttatatgcatataaaattttactacaaattaaatgatactacagctatgaataatcttgtgaggcagcaagactaactttctttttaaatatatattctttcttttttctttttttttgaaaccgagcaagcaattgctggtgttatattaagaaaaggcagcaatatttacaatggtgcaagtaagcagttgcacttagaaagggaaacaaagcaagaaaaatgggactgcgactgcgccatacatatatattcttatgcaaacaaaccttttgtttcttaattactctttgttttgaatttttatgtacataaatatctattcatacacaaaagacaaaacagtttattgttctataaattaatgatcaatagtcaggtttggagcaggctgatttaatttcaataatagtttcagaatccaaaactagtcattagacacatttacttggcttatataagatatatatagaatccatcctagctattattcctgattaaataataaacctcacattaaagccattcaagaaacacaaaagtcagggctgatagcgcacttctattgacataattagaattatcattttagataataagtataattctaactatatttgcgtagcagagagcacgatgtacctcctcgcagttgtgagaacaaacatttatggattccaaagcaaaatcaaattctttccacagttcatcttcatcctgtaacttgtcatgtttggatttctcttccagcttatcgtcatccccaaatgcgaataccaggggcaatctcctgtcaatttgctcttcaggaacaggctcatattggttgctctctatttcattaaacatggggtcgagcaaatgaccatacttttcttggtctgccgttgcttgcctgcgcttcctcctctgagcaatctttacatttctcttgaaggatacaccaccctgtccattgagcccatttgtttgtctcccaacttttggtccattgtttctgacgcattgtggagtggagccatcctttttcttgttggaaccctccttcttaacctgcctacgaggtgctccttcttgtaccctcctagaacctgatccttccttgacatcacatacaaatgttgtatcctcctcgctatcactatgggcactttgcctcctgttcaatttcctcctcttcacagctctatgctcctcattgccatcgctgccgccatcgtcatccgcacaatccccaccgtacgccgactgctccggctgtggcacatcctcctccgaccccgagctagacacatcgatacaataaggcttcgcgaacgtcccacgcttgagcagtttcttgtccaggagtttcttgcgtttgaaatttgatcgtgtgcgagctctgatatccctgccagtcgaggtgtccacctgttgtagaaaactaaatccctcaaacatcctctttcccatcagcggcattgccatgattcttgatcggggaggagattcctcaccggcctcacccggttgatcaggtgcatcacccggttcctcctcctcctcgtcatcatcatcatcatcttcttcttcctcctcctcctcctcctcctccaattcctcttcatccccttcctcatcgctgaagttctcatcgctatcatcactggtttcatcttcatccgtacccaattcctcctcctctatctccgcaacatcgtccgtacctccaccttctcccctgattccaccattgccatgatcgttgtcatctgaacgaacctccacctccacctccatctccatctcctcctcaccttcttcttcgtcctcctcttgttcctccacttgttcttccttcacttgtgcaaaagctctcccctgctcttcttcttcctcctcctcctctcgttcctccacttgttcttcttcctcttgtgcaaaagctctcccctgctctgccaagcgtgaccgagttctcgaaccaacacccgtgctcacccggttcaccggagtagcgcgaccacgaacagcgcccttgcttctctggcgacctctcccaggccctctaccttttcccctgccgacggagggagcaccacttgaccgggcaccgggtgtggaaaatttccgaaaaacacccgccgccctttggctctggttgggggtttcttttcccgttccccctgtttcgtgttggggggcgggacgaacgcacgggcaccggccacattgcctgcggaatggtcccggaatacggctcctcttgatttgacgggcacaccgttcttctgggtctgttggggctttttttctcctccttg

SEQ ID NO: 34271 - DNA, 5639 bp, Oryza sativa
  unsure (1)..(5639): unsure at all n locations
cggttgaanngtgantcggcttcgtctgcaagtagctcatcatggttcgctccgccgctcgccgccgccgtccgccgtcctttcgcggccggatcgtcgtctaccttccgccggcccgcgtggcagccacgtaggcaccacgtcggcgccagctcagcccagaccgggtcgggccaaccccggtcggtctctccgtgtgcgcgcgttccaccgcgagccgtgaggctgcgcgtgggcccgccgcatccgcgtccaccgcaaaccgcgcgcgtgcaccgggtcccaaccccgcccgcgcgcgtgcaccgcgtgctccctccgcacggtgagccgagccgctgacaagcgggtcccacccgggaccgcgcgcggtgagtccggtccaccggtcccctctctcctccccttccgcgcgcgctctgggccgccttttgggccggccggcccattaagctcggccgagccgccccaaatcccttgggccgcaccctagccgcccgaggaaagtctaaatttcctctctcctttcttttcttttcttttccaaaaaggatttaattaaatccgtttcctttaggccaaaaattcaataatcttagaaattcaataccttcccaaccgtaaatccgttgactccgttcaacttccaaaattccctaaatctcgagatctatctaatggcacgcttagaggtcattaatagggccttatttttttcgccgtttgttgagttgtcccgtttcgcgtgtagtttcggaacccgaagacccgcagtgcgaggatttcgaggatcaagctccggatctcgagcaaggcaagccacctttgaacatcttgagcctatatttgaaatttaattatgttgcttgctaaatattatgcattgataggatcgcacttaatctgtttgtcccgtctgcaaggcagattggcggacctacctaatttgtcgcatttgatccttcctttgttaattgctataccatgtccccttgtaaccacccagttgcgcctcgatactcgtgcaccctgtgcaagtatcgacggtcgccttcaaacttaaaatctgagtaacaacttgggtaaaattggagttttacaaaaagacttggaaaacccgacacctgggtcggtgcttgcgaactaaatgaatttctaaaaccgcggaccgggaacgtacgggtgtacggttttcccgctcccgcacttaaggaccgattccttggaatttcatccgaacataagacaagtacgaccacataggtggaatgggacacccctggctgagtaactagcttatcaggggagccatgatgtcgagagacatgtggattcgccggggtggtgtcggagaggacccccctgggcttcctggcacagtatggtctgggacctaacctgttgttggtctagaacccctctcgtcggcatatggtaagcctgtgtcagctttggaaatgccttgtcatgaaagcttggaggtctcccgacgtggctgatccccacgggctgggtgatccgggttagtaatgtcgtgtgggtaaagtgtaccccctctgcagagattaacaaactgttcgaacagccgtgcccacggtcatgggcggatgtgaggtgattcctagcgtagttttgtttgactactgcttgtgaaattactgtgtgaaaaggggttcggtgtttgaaaaatctgcagctgatgggatcagctaggcccgggtggccgtttgaaaagttgttggcccgggtggccgttgaaaaagctgttggccgggtgccaaccttgtttaaattctaaagactgatacattgcacatactccgaccggacgagacgcactgtctcaaccgtgtcgtttgagaagcactcacctagatgtttttagaaaagagttcaaataaaatcaattacgaaaacaacagcctttccttgaagcctgcattaaacacttatttcccctggcttgctgagtactcccgtactcacccttgctctatataaatattccccccagttgctgatgaagatgaagcggatcctgctgatgaggagttcttccaggagcaagccggttacgatgagttttagggtttcggcctagttcccaagtcgcgcctgtgttgtttggtccaagtcccggcttccgtttcccttttgtaatgcagttgtgagctcgggatctgtccgcagcccaacatgactgtactcctactctataataaagagacctctgttgctgtgatattctatcttcctgtgataccagcactgtttcctgggactggtatcgattaacaggttaatttggagcgtcacgggctaattccagtcgggactagctcggggcgtgacaagagatggtattagagcacaggcttggccctagggcgaaacccgacgcttaggacgaccctaaggatactatgttcaaaaactacttgcgaaaagctaaggtgtcttttgttttctttatttttttcaatagtttgtttctaaaatggttactgatctttctccctctttcaaaattgtagatggcagtgaacgccagcttcagttcccacggttttggtgagggtcaccacgtcgctcagcttcgtgacctcgcccgtttccttggcttctcgtgtcccgagtacacggggtactccgtggaccgtgttccccctcactgtgagctctctgtgtacctttacccccgtggaggtatacacggagctggccttcgcccccaccacttcactgtggccaggcccactctccagatcgcgtaccaggacctctcctggactgcgctttgtcgcctggcccacgactacagccaccgtctcggaggttccgccttccggcagcttccacgccttccttctggccactcagacgccaggtacccttgtccgtacagcgagtctcagccagtgctgactcgcatggttgagctctcggaggctcaggccactcagcacgacctactccttgaggcttaccgctcccttgcccgccgctacgccgctttggaggcccgtttggccgaggagggtgtcacctcagttgacactatctcttgggactcagcccgcctctgccacgccagccacctgtcctcccacagctcccgcggctctgcccgcaccccagcggaccgcgctcccccagctcgcgtgcgccgtactcaccagtgtactccccctacccacacccagttagcccttcctacaccccgggacacaccccagttgcttcctcccgccgtggcccacgctttatccgcaccgcgcgcaagcgtgttgttggttcttccaccgtgttccgtttccgccacccagctcccccaccgccagcggcccgtgctgctgccggccctcgacaggttctgccggtcccttcgcgccagccgatcgacgtttcttcgactgaggagccgactacaggaggcagccaggccgacgaggagtagaggaggcagtcttcagcagccgtccgtgtgataggcccttttgttccgccgccaactcttttggagtcgtggcgaggtagtgcgtgcgtgtgtttgttgtgggtgttgtttggtagtctggttctcctaggtggtgtgcgcacagtcaagctcggtgtagctctgtgacttgtccacacccgttgtatcaggtgtttttatgatttgaaaaatccagtttatgcctagtgtgtgctatctgagttgctattactttgctccttgccctcctaagtgcttatctgactcttaccccgcccttttctgggagtttagatggctagccgcccccgccgtgcagctcgtgcaccagcccgctttggttttgaagatggtagagttgaagcagaagcaaatcatgaatcagctaatgagcagtctcaccacagcaaccgttcgcaccgtactatttcccgcaacgcagaggttgagcaaccccgccgcagcaaccgctcgcatcgcacagcttcccgtgatgcagagatggaacagtctcaccgctctcaccgcactgccagtcacaattctggagaagaacgcctcccttccccacctcatgtggaaaacaacatgcaacacttaatggcagttcagacacaaatcttgcaaggaatagccgcagccgtagccggttatcagcataatgcgcatggaaatggccaccctcacatgggcaacaatagatccaagctgacagattttctgaggtcacgtccgccagagttctctcagaccgtcgagcccgtcgaggctgacgattggttgaaagatgttaatagaaaactcaacttagtgcagtgtactccggtcgagaagacgctctacgcctctcaccagctaagaggacctgctgcagattggtgggagaattactgcaatgcacaccctgaacccactaacattgcttgggatgagtttgctacggctttctgtgcagctcatgtgcctgaaagcaccattgacatgaagaaagaggaattcaacagacttaagcaaggcaacagcagtgtcaatgagtacctaagtatgttcaacaagttggctcggtacgcccctgaggaagtggactcagataagaagaagatcaggaaattcttgaaaggaatcgcagttggaatgagactccagttgctagcgcatgacttccccacttttcaacatatgatcaacaaggcacttctacttgaggatgccagaaaagaggctaccgaagaatacaagaaacgcaaatctaaccaccaggggaattcctcccaaggcgcacctcgccctcgctacggtcaacccatgcaataccaccagtcggtcactcaggctaaccgccagccaggctacgcccctcgtcctcagatgaaccgcccggcaccccagccacagcagcgtgcccctagtggcaatattgcgccaaacagtgttacctctttcaagtcaccgcagggaccgtcagcagttcagtgtttccggtgcaaccagatgggtcactatgccagacaatgccctcagaatcctaccaacaccaactcagggcatgctaatggcagcactgccagaactcctactccagcggcagctcagtctcgtcctagcactcaagcaagtggacaaggttcacgtgcttccaaccactttggtcgaggccgtgtgaatcacattcaagctgaaaccgctcaggatgctccagacgttgtgatgggtatgttctctgtcaactccgtacccgcaatagttctgtttgattcgggagcttcccattctttcatatcacaagcttttgtgaaaagaaatggttggaaaacccaaaatttacgtgtaccaatgatagtacattcccctggaaggaatataagggcaactcaaatatgcccggaagttaaccttagaattgaggaaattgacttcctagccaaaccgatagtcctagactcgcaaagcttggacaacatcctaggaatggattggttggctaagcacaaaggacagatagattgtgccgaaaagtccatcaccttgcaaggacctggaggaaagcaagtcccctttacccctaacacttctaccgcaagttggtctatcttaacctgtttacaagtcacctccttggagtcggtgcccatagtttgtgaatatcccgacgtattttcgg

SEQ ID NO: 34272 - DNA, 3015 bp, Oryza sativa
  unsure (1)..(3015): unsure at all n locations
cgcgatgtggttcgttcttttttttaacattctactatacttccctccctcccgccacctttacttatatttcttcntttattgnccgnctggccncccnccnnnncggtggtgatgactcggtcgcctttaccaancagcctatgcatacaggcagcccacgccttatgaagtcaattatcccacccatgatctcaagttggcagccgtggttcatgctcttaagatctggaggcactatttaatcgggaacagatgtgaagtatacactgatcaccaaagtcttaagtatatcttcacacagactgagttaaatatgagacagagaagatggttggaactaatcaaggattacgatcttggaatccactatcaccctggtaaagccaaggtggtcgctgatgcgctaagtcgcaaggcctatcacaatgtagctcaaatacggcctgaccaagatcacctgtgcagagaattggagaagttaaggctgaccgtggtacagtcaggtgtccctgccagcttgacagtatagcctaccctagagtcgcaaatccgggaggctcagaaagacgacgaagggataaaagaattaataaaaggaatacaggagaagaaagacaccaatttctccatagacaaccaaggcacagtttggtgcggtccacgcatctgtgtaccggccaagaaggagttaagagatctcatcctcaaggaagctcatgagtccgcctattccattcatccaggaagtacgaagatgtaccaagatatcaaggcatacttctggtgggctggaatgaagcgagatgtcacagaatacgtagccctgtgtgacatttgccaaagagtcaaggcggaacatcagaggccagttggtctgctgcaacccctaccgactcccgagtggaaatgggaagagatcggaatggatttcatcaccggtttgccaagaacccccaacggatacgactccatttgggtaatcgtggaccgactcacgaaatcagctcatttcgtgccagtgaaaatcacctatgatggaaagaaactagcagaactctacatgacctatgtcgtatgtagatttggctgtcccaagaaaattgtgtcagaccgaggcactcagttcacctcaaggttctggaagcagttgcatgaagccctcggaattgatctgaattttagtacagcctaccatccgcagaccgatggtcagaccgaaagggttaaccaaatcctagaagacatgctacgtgcgtgtgccttggatttcgaaggcacttgggatcgttgtttgccgtatgccgagttctcatacaacaacagttatcaggccagcattcagatgtcgccgaatgaggcaatgttcggaagaaagtgccgcacccccttgtgctggaatgaggtgggcgaagcactggtattcggtccagacatactcaagtcagctgaagaacaagttaagctgatacgagaacgtttgaagacagcacaccgtcagaagaattacgcagacaatcgaaggtgtgaccttgagttcgaaaaaggagatcatgtgtacctgcgggtatcaccactccgcgcgctagcctccaaggggcggagggagagagcccctctccctctgccgagtcgccccgctccctcctccttttcccgaatcggcaaaggggcgagcccctttctctccctccttttcctctttttctcccctttttcccctctcgccggcgtcacctcctgtcgccgctttggacgctagccggagcgccagctcgccggcttgaccgcccatgtcagttcccctctctcaaaccgacattgccacccttttaaacccgtcttccccctcccttcctttcctctcccattcgcctcctcaccgttgtcgccgctcccgtgctctgcctcgcctccgccgtccatcgccaagcgtcgggagagccggtgcgttcgtggacgcggaaggggactccgggcgcgcccccttcttcctcttcctcggcccgaggccggagagatcactcccgcgccgtcggcctctcgtcactgcgccccgtcccgcacggtagtgcctctctccgttcttcctcctcgctccatctcctccccctagctttcggtagtagcttgagtagactccccgtagttagccggcgccgccccgaccgttgccgtcgctcgccgtgtgctcgccgccgtcgccgcccgagctccgtagcacccgctcgtcgccggcctcgctcggcatagttccgtccaatccgacgctagcgtcgagttcccgacgccgcgtagatgctctcaccgccgggaatcgacccctcgtagcttcgtcgccgttttccccttctcccgccgccggttgccgcccgcaatgccgtcgagcaacctccggcgaatccgagccgttggttcgtctcccctcgtcacgaacaaccgcccggtgtgctcgctttgcccgtatcaccgtggttcgctccgccgctcgccgcgccgccgcccgccgtcctttcgcggacggatcgtcgtctacctcccgccagcccacgtggcagccacgtaggcgccacgtcggtgccagctcagccagaccgggtcgggccgaccccggtcggtccctccgcgtgcgcgcgatccaccgcgagccgtgaggctgcgcgtgggcccgccgcacctgcgttcaccgcggaccgcgcgcatgcaccgcgttcctttcccgcccgcgcgcgtgcaccgtgtgctccctccgcgcggtgagccgagccgctgacaagcgggtcccacccgggaccgcgcgcggtgagcccggtccaccgggtcccttttttcttccctcccgcgcgcgctctgggccgccttttgggcggccgggccattagcttggccgagccgcccaaatcccttgggccgacctaaccgcccgaggaaatctaaatttctccctccttctttttttttttttgcaaaaggggttaattaatccttttctttaggccaaaaatcaaaatctta

SEQ ID NO: 34273 - DNA, 1419 bp, Oryza sativa
  unsure (1)..(1419): unsure at all n locations
nggagagatgagaagttagttatgataaatgagagtgaggggatgtatagaaaaggagtaaaatagtagatagaaagaaggattgataatgttaagaagaagaagaattagnggaaagaaggatagaaagtaaaaaaagataggaaagtaatgtataagaaagagaatagtagagaaaaaagggaaaggagagagaaggaggaggaagnaaagaagagaagggagaaagagagaagaagaagatagaaaagaaaggagaaaaaagagaaaagagaaggagaagaaagaaaggaaagaggnaaaaaaaaaagaaagagggaaggagaaagagaaaaaaagtaaanaaaagaaanaaagnaaaataaanananaannnnnnnnnnnnnnnnacatccccggtcacatctcctcctagcttgattctttttgggacggagagagtacctcataactatatccaacctaaaaaaattcttagtccagatacattgtaataggttgtgtctaaccatctcctaagttaccatatttcgggacagagggagtatactttggctgagtttagttccaaattttttcttcaaacttccaacttttccatcacatcaaaactttcttacacacataaatttccaacttttccgtcatatcgttccaatttcaatcaaacttccaattttagtgtgaactaaacacaccctttaagacaaatatagtagtaagtatcatgatcattaggtatttatggcaaaccatttccataactagcagaacggataactaaataagcagaaagggtaaaagcttacaggggatattccagtgatgttcaatgtagagtttgacttttaggacaaccttgctgcataagccaaaaactccaacaagcacatcctatgtatagtcatgtatagtcctggtcctgtttggagagttgagaacatcagttccttcgtaaatgaatccctctcatgagagatcaacatgatacagtactgactgatatataaaggtcaaggggaaaatgaagtcaaacatggttaggtcgcaaggtatgtcgaaagcgactaccgtgtcaacttgtcaacatttttatgtactcagcaacactagagctttctctcaagtgggggaaaaaaaactgctttgattcatttatgtactatatgtatgctagctatatgcaccatcccgtacattcctcctgtgcatcagcaacaaaaatttaccctgagcagcaatttcttcgtcataagtctcgagcactgttgcaacgaaaggggagaaaaaaagaaagagagagaaatntggtccatacttccatcgtctcaaaatataaaagggtttaagatagatgaaatacattctaatactacgaatctagacggataggaatatatttcttagcttaagctttgt

SEQ ID NO: 34274 - DNA, 29534 bp, Oryza sativa
  unsure (1)..(29534): unsure at all n locations
acggcttgtggatagactcgcgctctactgcaagtagttcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatataaaatccacatcagactcggtggtgatttggacgagagagagaggaggaaaaatggtgcaagcgggcgatagattagtcgccagctccgcactggctccaagacaccacttgtgatactttttttgaaacaggtgatactttgtcagtgttgcagcagaagagagagaaaagagcaccaaagcaccgcagagaaagtcattgatgtggttaaaaaaataataaagcttttggttgtttaacgtgactattatactctccaactattaggttgcttttagatgacatggtacacaattatcgctagcaatcgacgataatattaaacctgccctaatgccgacgtagtctgtcttcacggaacaaaggtcgcagccatgtccccgaggtcagtttttggctcaaatttcggaatcatgataaacatgctgtccttcctgttgttttttttcgcgaactgtccttcctgttgtttccaaggagatgatgataagatactctttttacatgagctgagacataagcgtgctctttgtgttggcgcttagatggttgcagatgatttcaacttatatatacagaagaactttgtgttggccattagataatagcagggtatttcaacttatactagaattgtatcgagcggcgacacgccgcgcaccgcatgcaaatagtgattaaacaaaagatttactccattggcctaaaagagtacccagacgtagcatacctatacaagtgacattcattaaaaattagattacataggtcagtacttcagttgcaaactgtactatatgactaattttaagtttgttattgagtggcgtcaaacttcaaaagaacacatttcgtgtaactaataccatgatctcacaaacattgtacacataattcaaagtttggcaatagagtggctctttagataaattgaacaaacttcaaacaaacaaatctcgtggaagcattcgctaatggaaacttgcaaacatatctggactggtcaatacccaaaacatcactcttaaaactatccttgcatttgttcattacattacattgtaagaaataagcatggtcaagatctcaagatgtgaaaggcaatgaacctctgtagaaaaatggccaaaggaagcaacaaggggaaaactgacataacccaaaaatccacatgaataatcgcccatgagtcaataacttacaacagcctctcatggccacatcatcacagtgctccatttgacataaagaaatttgaagaattcatcccatattttcccaattctacggacaaagaaccatgcgggcatgctcaggcgcgggggacggcgatggcgccaaggggtgtagcggcggcacacggtggggaggaggtgggaggcggcagggtatggtttggaggtgggatatatgtggttgttttccgaaaaaccccgtctttttaggtttacagtgctaccctagaagcagaattttcacttcttctggttgtacttctatggaacacgaggggttttctggataaaatacaacggggtaaccatcggttcgaggacgtgtgtgcaattctgtgcaaatgcgaggagtttttttacaaaataacaaaacacgcataatctttccgaggagccaaaaaatatctgatggaactggaaaatacccgtataaggaaaccgacacacagacagatggcacgcagtgaaaaatcggttttaccggcgcaccgcgtaacaatggttacagcgcgaaatcgagacgctgaaggaagcatgtggatacgggtaaatcagcgagatagccaaaaaaaaaattctaaaacatgagaaaaacgaagcggcatcaagttttattatatgatgatatacactagcactataccttctttcgtggttcagagacttcacaggagaaaagaacttagttcgtcctgtagtcacaagatttgccgcggcctactaaatattgaagtcacttcatgaaaaccaaggtactttaataaactcgttctgctcagaaaaatggtggtgcagcaggtaatagttttagtctttaaccactttgtatttagcattcttgctgtaaactaaagactacttgtttacttctattcatgaagatttccaaaaactgaagagggaagacagtaggacaaatcgtgctagatactaatggattttggcctaatcgtctaacatatgcctttggtcaaagttctgcgcttagttgattcagatgaaaagcctgccatgccatacatttatgagcatatggtccatgcaaagaaagaattaaataaaattttaacaataatgtgaagagaaactacatgcctatattgaaaatcattgatgaaagatgggaatcacagctttctataggcctttacacactgctgcatatcttttgaatccagccttcagtataagcattgagaccatgcctcctaatattaagtttggtttgtattcctgtattgacaagatgacacccgacaaatctgagttagtgaaggttcacctgtagcttgatagatctaagagtgcaaaaggacattttggagactaagtggcagtcttaaccagatcaagaaaactccaggtaactaatatttccatctggaagtgttgggctcccctttaatgcaagtttttcatttggttggccgtataataggtgttggacagccgattgattggcgaagtgaggcctgcagcacctgtggtctaccctctttgtgatcaaaatgaggaatccatccaacacattataatttcttgtgtcagtctcgccaagtgtggacaatattcttcctacggttggggttacccgatgcggcgcctcaaccttccacggatcgttttttgagatggtggagccaagctactaaataccggccgaaggaggtacaataagggattaattctttggtcactttagtggcttgggagatttggaagcatcacaacgactgtgttttcaatggtgtcaatcctagagttgcgtctgtcttgcaagtggtagaaaacgagagtaatctttggtgttctgcaggtgctttggcacttcaaaagctccttagtgggacagctaacctaggcagttagcgctccccggtgtggtcttgggtgtgtgggtctcagtggaagtggaagggctcgggtcctcatactttgtaaatattttgtactttgttttttccccttaataaaatgaaacgcagtactcatgtgtttctaagagaaaaataatatttccatctgtacatattatatacattctctaattcattcataagctaatttatttttatattaactgattggtgggatttgtacggggataacttgttagcgccttttccggccaacacggagtcgccaaccacctcaatctataaagctctaaattaagatgggtttagaaaagaaataaaaccggctagtgaagccaatttagaaatcaaaccaacttctagaccgatttagatccatttaaagataaccacccatctcgtgggcgaatcaaaaggtttatgggacaaacctacaaagagtatcacactctcgcaacaaaggcaggcgatttacaactgcaaatcgacacagatggacgaatctaggttaaagtagaaaaaaatggctgaaaagtaaaggtaaaagagcgattcgattgattgtgtaggagttgaggtcgggggctggaatcgaatcggccatagcccttaaggggttggtctggcctccacggggccttatccacatcctattaggcttagagatcaattaagacacaacaaaccttaggcccaaacaaggaaacacgatatttgccttaattgaattcggacttggcctctgccagtctgaccggccactagccatcggtttgactggccctagaccgtcggttagactggcctcgcatggtaagctaggactcttccaaatctagcccgagttttcctattttccatttaggtgtcaaattttggtgttaaatgtccactgccttttagacaaacttatgtgccgaaaagtctagaacgcatagtcttagggcgataatctgtatcggccttacaggctcccaagttcttagcaaatctttctctttctaatatttcaacaaagcaagagctcctaagaatgatttgcacaactcgattaggcattcccgactaaatgattacccagcgagctctttacaggcttctaacagtaaaatcgtcttttcatgccaagtctttaatcccgagacgattccactccagttctgttgttatgggttttggctataacttcgtattatctctttagcttgttctaaagtcttcaaacatttatcggtcactttatcactattaacgtcttataaccactgactgataaatcatctcactcaaacaaggagaatcaacaggctaaataatttatcccctaagctgattgataaattcgataatgcctcatagcactttatccatagcaattttggattggccagcatctaaacatcttgaaagtactagctctatggtttgcaatgaaattctatattaaacaaaatgtatttagatgctccaatcaaccgtcttgtttagatctttgaaatattaaactagtggaatccttcgattggtaatcttaaattcataacacatcaatagctatgtactacgggctgcaatccttggtcagacgggcattatcctcacggtcataccgttcctgtgctcaatcagacaggacaagaagccacagtcaaactgacattgaatcatcggttagaccggccatgtaattgaggttagaccgacctgatctagaattatcatacacaatttgtaatcaagcactggctttgtagtacaaaatttggctctcctatcttaataaccaaatgcttgttgtgtcaaactattggtcaacatgatttctgaagtagctatttgaaataattatcaaagagaaaatccattctatacccctaagtttactctagttcaatgatttgccatcgactttatctccctctataatatgccaccgactttgtcaatttttctataatatgtcatcgagatggatactttttaaaaaatgtctaaaatgcccttcaagccatataagggttatcgattgattgtctcattataagcttcaaaaaatatgaaagttttggtgtagccttcatatacgacataaaagtttgtgtacatattttaagattttcttcattttttttgaaaaattatttttatgtggtatatgaaagatgaatcgcgtacacaaaacatagctagattaaaaaaataattttgtgtatcatatgaaagatgatttacataaaagaaatcaatgctaaggtattttttttacttaaatgctagggtattctattagcatgtgaaacataaattatatttttttaaaaaaataataaatgaaaattaaaaatcttaatatgtaaagagactatgcaaaaaaaattaatatttttttgatacttctagaaggtaaattaattgtcaaccctctatgtcttgaagggtattttaggcattttttaaaaagtagctactccaagggcatattgttgaaaaaattgacaaagtcggtggcatattatagagagagacaaagttgatggtaaaccgttgaactgtagtaaactcaggggcatataatagattctctccattatagatgatgcatccgaaactcacagccacttgatgcatcatctataatgaatcacccaaaagattgacatgttttgcacccatggattctaataaactacaatgtatgtaactggctcaagcatagatgaacaaaactctaatagggccaatgtagcaaaatagcatctctaggtactattagaaatcaacatactggccatttgtataagacaaattattaagaagtaaaactctcatagtgcaatattaacaaaatcaatatttaatatggtgatccataaaatcatatatagtttggcttttaatagatataaaaaaaatcaagagccaaatcatactcaaacaaagtgtatgccaacttgttaattctatcactaagaactggcctttgcagcatgtatgtacaatatcgatttaacaagcaaagacacatgtgctagatagcaagcaatgttctaacatggtataggcataatataacgatgaacatgatacacatacattgtcttagcattcaacaaattttggctcaaagatgtgatgttgtacccgttgccgttcatctctctcgatttcttcaaaagaacattaatgtcttaccccccgagcaaaatcagcttttcttagtgcttgattttgagggcaagataaacaccatattaatgtcaacaacatcatgtggatcgaggaagcttatgactaatgaccgatggttcttctctcaacgaattggatttatcactactttgggaaatcaccgttctctcatcttttaccgccttgggtctccacactctcttaggagcttgaggctctaaattgttgcacgtttggttcttcacatcttcggcctttgtctcctttcgatccttggccccaagacattgtagcctcctcttttgagagcgcgataagccagaaggtatccactgcggttgtgattgtgttccaggaggcaaatgatgatttttgatactcttgtttgaattggaagctcatgtactactctcagatcgcctagctatctctgatgccccccggttagaccggccttggggctctgttgacggtccttaagtaccaaatccgaccatcaattcctgcataaaagtaaatgaaagaatacaaaatggagtagcaaacttagaggtagtggttattagtaaccattttcataagtcttgtgaatatttgtatgtaggtgaattacgaacggatgcgagtacatggattggagggcccacatatcaatcaaaacaaattacaattgagcccaaccaaggtacaacatgtagatggcccaccagatagcttcccaaccaaaggagtaatcggaaggtgggacaaaggggtcatccgaacccaaggttggccgaacctcctttgtctcccctcgccatcagcttccacgtgtaggttcctgatgactcccaaaaggcggttatgagtgattcccatgagttactaactttataatcgtcataggatggctataaaatgaggagaagctcttactctcaaacaacaaaacaagtggagtacaactcacttacacatttaagctactctctagtagagttagaatataggaggagagagagagggaaagctccggaatgagtgccccaaatatcagagttccggaggagtgccatagatgtcggcattcttccaggggagttccggaggagtgccggagatgttggcactctctccgatcttatacttcgacggatgtttcttttataagtaagcattcatgattcttttggtatttacttttttttatttaagatatataatcatcgttgcggtttcatcgctctgcttaagtagagtgttgacagtcgttaagtaccgatttcggccatcaactatctgttaacgaccaaatttggtaacccaacgatcggatgtgaaggaggaatcgagacggagttcgaggtagagattgttccggaaacagagtgaggatcggctgaagtctgaatcggctgcgactaggatcgccagagttcgagtcggacagggttagccgattgagccgaatccgacaatatgatgcggcatacgttgtcgggttaggttgacgtgcttcatgatggttgccacgcatggatagagtcctgagaaggcaattgtatctattaattaggatattttatgtaatttccttagagatatgtttgggcaaaagtctgccgcaaagacttatgatatcttagagtttgttaaagataagagtcatgtccgatatggacatattttgtaattctcgggtataaatagaccccgagccccatgtaatcaaactaacacacgttcaatacaatctcggcgcatcgccacccttttactttcgttttatttcgacgagttcttactttcgggttgagctgcatcggtttcgatcttcaacaaaaggtaaaacttgttatggcggcttgcgttctcggcattagtgcttccatctctatgatactctaatcttgtttatgtaattcgtcgagttatcatatatcttatataatctccggcaatatcgctatctaacctacaatcggctaacatctgtcagtagaaggtagccgattaggttaaatatcgatgctggcttagattatacaagatatccaccactctatgaaacatccaacggcttgattgtctagatattgttcttcttttcatacttatagctgcatcagttgagtttgatcttatgagtcgtgattagaatctcaatctctagcctgcctttgattgccgattagggtagtatcggggtttcagccgatcttacctgatttaagtactttttatcttatatgcttgattgacatgttaaatccaccctttatgttaagatcttgttgcatttaagtatattaggcttttgtttagtatattctacttgccttaatatcttaatatagagtggtatcggagtattagccgatacatgctagatctatctgatcggctatgctatgaacatatataatcttgctgttagtatatatttcgatctaggtgatttatactgtcttggcatggcgaccgatctatcccaatcacttgagttaagtatatatcgacataaggattacgtattgtgaatatctacagccgatcgagtagatttagttctttcttacttattcatgactgccgatcgattcacatatgacatcggctcaaggataaatgatatgtcatcggcaactaaccgatcggctatcgtttatagatttaaccgcggtttctttgtctttgtttcttgttgattgcaggatcaaatcaactggcatgctcacacacctaaaggcaagcttttggacctgcactggagttaagcagatctcccaggcctcgtgtttttacatcaacactatctcaatgaataaagagagaaataatatttcttacacttatattagtattaaataatgtagttccacttgtcattagagaaatactatagattcagggttatgagacaaattaaggagaaaatgcactgacatgcgaagaaatacacttccggtgaatcatgtgagagcacacggattgatgggccacaagtctagtccaaaccgacttaaagtggggccaaccaaccatgcaccgaccaaggagtccacatgtcagcctcaggacaaggtcggtcaagaatggtggtttccctggttcggccgaaccaggggtggcgccccttggtcctagcttccatgtgtcactctcttagccactctcaatgatagttatgccttattcccggaccaaaaccgacttaagcaactgtcattggaagctatgaaaagaggaggccttcatactctcaaagcacacacttcaaggagcaattctttgattccatattgtattctctctaatagtagtggagttaggtttagagtagtcttcggtcctatagcctttatggagattccaatatgtctttagtactttatcattttgttagactatagttgcaataaagaaagtagcttctttatttaattgtgttcatagtccataaactactttgctagttatgtgttctatgaatagattatacttcatttatatgcttcacttgattaggctagtctatctaaactatggtaacgacccaatgatcttaacgggttgcactagttctaacttgtccatcctctggatggtaatccggggaaattagtggtattatttgttaacataagcatggtgcttagattaaataaataccattagatgcaggaatgccccacagaaagtgaggtaggcggcatgtggtgatagctctatccatcctttgtattcctccatgtccgggtatgacgtaagagttcgtaaaatgccctccttgaccactcgagttccttaaccatgcacacactcaaccatagtgcacatcttcaccttctagttttcttcgcgtacatcagtcattgcacaattgatcttgtgaagtttgttatgaacacctcctgatatgatatcaccatgttttttattgaatagtttcattttcaattttccgatattgttttcaattccggttaccattttcgactgtgtttccggttaaaaaaatacgaatgtcgaaatggtttaggtgtttttccgacagtctcaggctgttttcatccttctctatccaaactctaaagtggttatatcgtggccgtaccgaatcgattagtttagtgattaattttgacaaattgacccttctataaaacttattgccaaaataaaccgtgtcaaaaactaatttcaaaaatagaccgtcaagggccaactaaggtggcgctgagacattttagctcagcgctgtcggggttggtgctgaggccacggtctatttttgaaatttgtttttggcatgatttatttttgaaactagatgatgcccccgcgctttgctgcgggatatatgttagatattggagaaatgataaaatgatttgtattgaaatattatgaaaatgatttgagaatgatgatttagtatgtgtatgtttagttttagaataaaactagttatcgtgcacgtgcaaggcacgttttggtttatatacataaaaaatagaataataaatataacttttttatgtactgcactccatacaaattatacaaattctaaaggtaggtctatagtaggatgacaatttgcagatggaaaacaaaaccaatagttcaataggtccctgtcaaacactttcaatttggcagtaaccaaataaagcactcttactatcacccctgtcagcccataggacaaaaaagtacaggaaacataactgtaaaaatttcaaaataaggttgtgtttagttccacgccaaaattgaaagtttgactaaaattgaaagtttgaagaaaaaagttggaagtttataggaaagttttgatgtgatggaaaatttgggaactaaacaaggcctaagatacgatgctatataattaatttaggaaatctgctgattttttttgcaatgattgatgtatactcaatatcatttctcatgaaacttgctgagttgatcataccttcgttgttccaaatataacccaaaatcaccaacaaaacaaccttgattctctttatattcactacaggagattcaaattgtctttcggcttgataacaggtatttcagataattacctatccgtcaatttggaaccattaggttgtaaataaactattagagaagagatgaactgcacaggaactaaaggaggttaaaatgtttctcctcttcaccttgaccatgcagtccgctctcctgccccaagaactgtagccaagaacatctgttcactgcaaaagttgtacttcctccatttcacaatgtaagtcattctagtatttttccacatttattttgatgttaataaatctagatagatatatatgtagatagatatatatgtctagattcattaacatcaatatgaatgtggaaaatgctagaataacttacattgtgaaacggagggagtaactttgagttgttgaactattgctcttccactcaggtcacaccatcttttacaggattgtgtatagcttgtactacaaagacaacgatggagtattttagcctccctacaacataaatatgcaaataggaagaagaaaaagtaacttttcaatagtgcaacaagatttaaaacataacaggtaattaggactgctagcaactgcgagcagttgtgattccttctattcgagcgttctatacatcaccaagaatgattccttctattcgaatcaaatcaaataacacagttgtgaaactattcgtttgttctgagagcactggatttgatctcggtttggtagatcaaaaagaaatcaagaaccaggtggtgattcaaaaagagaagagaaagataggagcgaaagcaatagagcagtaccttggggcggcggctgcagcgttacccgcgagaaggagtgactgcgggggcagcagtggagtgcggcggcggcagcggtacacgcgaggaggagcgacagtaggggcaatggtggagtgcagtggtggcaacggtgcacgcgaggaggcgaggagacttttcaggggtccggtgtgaaactaaatgtagaggtgtgaaactatacaatgataatatatgaattattgtcataaacatttaaattgcatttagaaataatatttatataaaaaaattgtatatgctacctcaaaatttttttccgagaacacactaatgtagctagggccttcgttggttcatccaattctgagaacaactgaattaactagtatgtaccccgcgtgttgccgcgggacataatgaaaattggttattataagcatggagtgaagcacggaaacaaaaggtattcatgtagattttgaaatataaatccaacgtcaaagctgatatgattagaaactgcagtgtcgttaatataaatgtgaatacatatatttttaatatttcacatgacaacaaaaatattactggaagtttacttactaaagcatataatatatgtaagatatgttatttcatcggacaaaagaactgatgacggtagtcagttggcaattaaaatagttatattatttacatggcaggcatacaggtgagtgagacaaataatttatctcgtagaacactcttgcaagccaaaaggtacatactagggcatagaggtgcattgatatgttttctagcagaacacctgctgatggaaaaatgaaatttatgatgatcattgagatggctggatgcttggttcttcgtatgatggcagcctgcattatagtaagattatgagcatcagccataatcaagactggtagcatagtgaataacagattaatttttaagtaaaataggtatgtgtgtgaaacatccatatacagttgttaaagtagctgatcacattgaaacagggaaaataatatcatgtgacagttgatgagatgacaaatgaagtggtaagacatgttatgaaacatatatatggatggaaaacttaatgaattatagcatactatgaacttgtatcaagactaaattaataggagtaggtgtgtgaccaaatatgatagactacttaaaagcattagctgtgagagaatctagatttggtgtggaagatttttttttttggcaatgcaggaatgcaaggatcttcaaatttatataggtaacctgtaaaatgctgtaaacttcttttcacattgaacttgtttagtggtcagaatgcaaaatataaaaagaggaaaacaaacttacgaagaaaccatggataccagaaggcatatattagaggaaagttgagtgtgaagatcacataaaatagacaggaaagaactgaactattgtaacaataccaactgcgtgctgctttgacaaggcagaggtttcggataaagaatcctacaaacaatgaacataggtaaatttgacattaagtatcaaaacacaaagaatataatcaggtcaagttagtaggtctgagaaaaaagaacctaggactcacattgggggcaaggcaacaaaacacagcaaattaccaataggtagaacacgtatgcttgacttacctgtaatcatgtatgcattccttgttgatccagatcgttaaatatttctttgtaaacaacattgtgagtgctggtcacatgctcagttggactattctcaattagaatacgaagaccatcaggcgatgttagacgtgagaatgcgacataaagttgtccatgtgagaagacatggctaggtaagtagacaccaactctactaagtgtttgcccttgacttttatttatagtcattgcatatgacacacgtacaggaaattgtcggcgctttaatttaaaaggccacttcttatcaattgaagtggttactatccttggtatatatgccttggatccttggtatatatgccttggatcctttagccttccctgtaattatctccccttctatcacacgacgagtcaattgagtcactataagtctggttccattgcagagacctttagatgggttcagattgcgcagcagcataattggcactcctatttttagttgaaggtgatggtctggcaaaccgctgatttttatagtgttcaggaactcagttgggtaaagagcatcaagagtggcacgattacttgtagtatcttcaattgtatctgaactgtagtatgacatttcttgagtagtcagctgagcaatcatttgggaatttatacttgcagcgatttcatttgttggggctagaattgctcgctcacagagataattggctgtgtgagaattgattgaggcatcatatacaaaagagataaggcctgaaaggtttcttgtgtcatctggcaaaagcaaacactctggtatttttacccaagaaacatcctctccatcagtaggtgaagaatctgctactgctccctcccctattgctaacaaccattctgcaaattcttgaaggtgttggcgatgagtattagacaatgttggggattgaagtctcatattttccgtaagatgcatgagaatgcagtgttgccataaatgagaacgtgtgatggatgaagataagatttcctgttttttttttttgcatagggtagaaccgggagagtttgcctaaaatctcctccaagaacaactgtaatgcgtccaaactgtttgttagcaagtgatggatcattggatgcaagaatatctctcaatgttcggtcaagagcttcaaagcaatgtttgtgattaacaggtgcctcatcccatatgactaaggaggtttgttgaattaattgagccaagtgagtgttcttcttaatagaacaaactgaatgctcttgtatgtccaatggtattctaaagcaagaatgaggcgtgcggccaccaggaagtagaagtgatgctataccagaagaagcaactgccaaagcaattttcctttcagcccttacactatttagtaaggtattccaaaggaatgttttccctgtccctccatagccatagataaagaaggtatgcccaatgtcactatttaaagaattgagaatagcatcatatatatgtctctggttcagatttaacttgcctaactgatcagccgcttcaatcgatatcttctctagatcatatgcttgttcatctattagcagcctattgccaaggatggatgtgctttgaatagtaggctcaggtaaatggaaatatgccaaagtacgaccaacatttctaagtatgctatcgatctcggaaagaacataggacttgacatattgtatgactgaaggtgcagaagaatttatacctagtgtggcatggttaaggtggtaggctgcatcttgacccattgaagacagatgctcttcaaataaactcagtgggtgtgtaacatcacagaaaagaagcaatgttacaaataactcacggagttggtagggaagtgcccaatgagtcgcatcagtcattgcgaaggaccattcacggtcatcaccaagaaggcctagggcttgacatgcagcttggaatgtaggatatacatgtccttcaatggtccggagatcagaataggattttgctcctttgacaatgtgcagcaacattctaaggtagtagacatctccttgggcaggacaaacatgtgctatccttccaattttcttgcggcaatttttctgtggagcccaatatttgccattaccatgccaggtaaagtattctgggaactctgcatatgtatatgcagcagcctgagagtattctctatttgcagcaaaccatgctgtaagtttcgtaacacgattgcgtgggttatccaagatctgttccagattatcatcctctgtgaatgtaacattattctctaatggcatatgtacatggagacgctcaatagcaggatcagtataatgaatctcaaactgaagtaaacgccatgccgcctcattcggcgctatacatctacatttaaacgccatgccgcctcattcggcgctatacatctacattctaaatagtcatgaatctcattagttccagcacatgcccgcttgcgcttgagactaaccctcgaacaatcaaaacccttagcaacatatttgaatagatacttttccattccatcacgattaactctttccacgttgatatgcgcctcatatttgactaataaatcgatgttgtgggggacaacatgccgattatcaagagaaattctatttttggcaacaattatatcattttttggccgagcataccttacatggccatttggcaggattgttgttttctcagaatattccttcgggtaattctttgagcatttaccgtcaaccatgcatgaacaatgcggatttgcatcaccacaaggtccatgcatcatgaatgccgcaacagcatcataaccaactcgatcaatggatggatctggaagctgtgccgatattagtctgtcaatatcagcaggtgtcaacggaccactcttatctaaccacaatatgatgtgaacatgtggaagtccacgcttctgaaattcaattgtgtacacaactacataaaaggaaaaattatgtgagaatgacacatgcaaaatatttgaatatatgaagtgtgcagtatgttgtgtcatgcatgattcatgaacaattaaattactacctgcagtgacagggccaaaaaatttcttctttacgatgtcgtccatgaagaggtgtagcttaacatggaatacacgattaataatatcaggcctatctgctgagtgttgcccagggatgatagccaaagcttgtgttacctctgaccataaggaatttgatgtgaaagtgataaacaaatcagggcaaccatattttctacatagagcaactgaatctaagtaattttgatataaatatcttggccccccaatataagaagaaggcaatataactcgctgcccggcatctgatgcttctgtgatgcctgaatggaccatagtggatacctcactgaatgaagctgttctatacttaagctgaaatgtcttggatctgtagtgactcaggcgagattcttccatacaacaataggcatctatgacataggcctaggttcctctcttgcagcgcataggagtattgaagtcatcagctctgtcatgaagcctatatgcaaagtattcaaccatagtagccttctttcttttgatagcttgtgatcgagcacaacgtcggtatgtgatattttcatgatagccatcctccccatatggaaatagaattggatattgcattgacataaatttacaatgcttttcttcaactttttgtaaatgacccgcttggtcctgcacaataaggtcatggccaacatcacttatacctacatcaccaacaactaacccaacaacctctgatgcaactggagcactaaatatatcaccatgcttgtcgggatcaccaaataatcttatgatgtatcgatcatcaccattttcagccaatctatcacgagctgtcctaaataggtggacaataggattgtgggtgttgaacatgtctataagtccagccacaatatcctcattaggacaaaaactcctatttgcataggttccaacattcatcctattcctaatctcattttctgtgtcaaagatatataactgagcatactctggtcgtcttccttcttttggtatgagtgacccaatgcagtggcagagctggccactaatcttgaaaacatatgggcctcgtccatcattgatagaatcaatgacatttacacccatcgatgtgaaggcaaacatcgaattgtagaacctaatgttctcaaaaaaatgggctgacaatgatctgttaactcctgtgagtagactatgcaaaggttctgggggtggcctatatggaggtaagatgacactcccacctttacagcatgtattgtatattggtgatgagctgtgctgttctcggcggacacgctcctcaaaccaaaagaaagccccacaatatggacaagtgtgacatgggggcccaagccttgatggagagaaaatagtgcctagtaattaaaagaaaaggacataagtgtgtgtaataggtgggaattttttttcgtgctattgattgacatacatcaggtcgagcatcagaattacattagtgagtcgaacagcaggtcgagcatcatactgtatgagtgatctgatttgacatgtcgagcatcaggttcacatcagcaaaaccacgataattgatgagcaaatggtctgtacattattagcattgtagttgtcatgatttgtaaagggtgaaatgaaatgatagttgtagagaactaatatatgactaaacttatgttggtgtgtgggagatggagacaataaggcaagaggtcgacgatgaacatgctgtcattggttacatttgttgaagaattaggagagaaacacagtaaaataagtggaaataggaataggacagacctccatcgacagttgcaaaaggttgtgtatggccacaattgataggaaccaaggtggatgactgagatagactggttcgttgtcgaacattccgttgtagcacatggatatgcgtccgatgctctatcatttcagtggtactattaatttctagagaaaacaacacgtgttagggaaaaaaaaattttgtataaggcatgaaagtgcacatgtagataaacatgtgagtggataaagaatataatcaaacctctagatgatttggcagccatagagagcttacgctttcgacatgattgagcagctgttataggatccgggtggggaaatcctgatttagaatatgagcaacaattttcggtcaaaaaagaattaggttaataacatgggaaattgatatgtaaatgtggactgcggtaggttgaactggtagtgatgattatgcataataaatggaaagaaatgccatacatttggaaaacaacagggtagacaattagaacgaaaaaaaaataatcaaaacaacaaatattataccagcagactgagcaagtagtcttcgacgtatagagcgccttgatggcaaatgaaaacttgtagggaaatcaccaacatgggagagggcgtcatcagccagcagaacaacgccatcgctaggaatattccccaggaaatagatatggcacaacagaatcatttgttgacaaataggagagctcaataggaaaatggtttcaaatgtagaaataaaaatttatatggcttggagctaacctgaaggtataaaagctctctcgggttgcctgcgcttgcgagctggtttaggtgttgatggcccagaagaggctgacatcattcaaactgatttatgaaagtaattagtggtttactggaactataataatgaaagtgatatatttattatagcagccaaaacatcattatatgtgtagcaatcaagtagtatacatataaagagaaatttatgcatccataaagtggcacattaggtactggccagtttgctatatcttttttttttttgcgataggaagctcatttcattcgtcagggaacagcaggattacaatcttcagtcacaaggtgctcgatacaagctggggctgactgccactcacccagcctgtcatcagccgtgacttgcttcgctaatacatgagctacatgattgcaagatcggggggtgtacagtaaagtaaaaccatgaaaactggagctaagctctatagcatcactgataatcgacgcaacatgcgatctttgagagccaccctgcttccacagtttggttagctcttggcagtccgtctccacctggattcttaagactcctttctcccgggcaagttgtatcccatcccggcaggcaagggcctccatcatcaaagcatccaggccatgaggatgccatctagcccggccgcctttgaacctcccatcaacatctcgtaggactgcccctgttgctccctggctatcgttcctagagaaagctccctggccagtttgctatatcaggtaatactaattaaactatatgggaagagccataaaaggaagcagataaaatgcactacacatctagtcataattaatctttttgaccaattgatatggagttctttaaatgtgagtgtacttgcaaattgtaatgaagaggctataatgcattttgtttatgaaagaaagcaccaaactggaaagaaggttaaaaaaaagatatgcacatagggaaattgataggcagtaacagagaaagttcaaaatcaaaccaccaagaccaaatgccatgctgaagcgtacatatattctaaatcgacccaatatggcaagccaaaataaatagcaaaattagcactgcaataatccaaatgccaagctgcaagttgacggcctacaaatatttaataagctgacaggcaaaatgagaacatatcaaggaaaagcgcatatctatctttcgttcattagcatattgtcatatagtgtttaatctgaaaaaatcgcaaccttggtagtattcactcagcctaactatcgcaaggaagcatagggaaatagattcatgttttggttgttaacaacagcaaagattgatcagcctgggcattgtctcggtgactcaaaactgaaagaaagcaagattggtatccaacagcaacaaagagcagtatagagaaaaatgacttactgaagaaaaccgaggatggaggcagccgtccagagcagacgggctggcagatggcagccgctcgaccagggcaacaatcgggagccttgttgggtacggccagcgcgctgacagcctgaccgatggagatagctggacgacgactataatcagcggcaaccaccacggggcaaccctacaatcacaggtggtgggtggggaagaacgcaggtcggggaagaggaaggcagccgccggcgaactggtgatcgatggggcagaggggatgacgtcgatttctccgatggattagagaattctcttcatgaattggggattgatgggtgtgtggtggagagggcaagcagatggattagggatttattttcatgaattggggattgatgggtgtgtgctgtgtggagggcaagcatatcgggttggcaagcggacggacagatcacagccacgacagagcatcgcacggcaacgcagccggaaggaagctgttgcactgtagcaaaatactggcctctggtggagcaagttactgttggtagtggcttaggaaaaggacgcgactacacagctagtgctagctaatttgtctaaacaagctactactccatctatgaaagacactatccacctatacttcaaatacaattttctcttaaactacttatctgatctacgctccgattgcaccgttgtgtttgtaacaattaaatctttataacaagatctcacacgattatactttgatgaaaaatcacaaattacttttataatatatctaaattacttttagatttcactaagttacttcttagacatatgaaagtaaattcaataaaacctaaaagtaatttacatatattatagaagtaacttagatcaaaacgaaggtaactttaattaatgccttttttcattgaacaaattatcatatatataagttacttttagattttattaaaaatacttcctatacattcataatgctctgagttgattacttttattattgtttttagttaattctataatttgtgctgattaatttaatttctagatagagtcatatttttatctttacaacgaacttacttcaaatgacatgccaaagttacattcgttttgttttaagttacttctataatatatgtaaattacttttagactttacttaatttacttttatatgtttaagaagtaacttagtgaaatctaaaagtaatttagacatttcataaaaataatttgtgatttttcatcaaaatataatcatgtgagatcttgttgtaaagatttaattgttacgaacataacagtgtaatcggattgtaaatcggatgagtaatttaagagaaaattttatttgaagcatgaatgataggaatattttccctacttacttaatggattaatactataaaaggcacgcatgttgacataataggttggtacaaatcctttcaccctagcattaaactctagcttagatttctctcatacttggcaactggaccgtcgctgctttgtactaaaccgagagtgctcttggtttagattttacgttaggaaaactaaagatttaatatgattaacctagcattactcgtatgtgaacaacaagcaagttagaaacagcaactatgggaacaacaactactgaatcaatttttcacatgggcttgacgcgatggcaaattggcaattgcgaaattgactcacctgatcagaaaacctacgatcgttgtcctcgttcaaaggtccagtcggtgcgcaagcaaaaagcagcggacagccgggcttgcgtcggcgcggcggcaggggtgctcggcgcgccgctcccttgaggattgcgcaatctaccgatctcgtcgcatgaggagtgaggatgagggtggcgccgcggcggtaatctcgctcgctcgtgaggagtgaggtctctctcgcgtctctcgcaattgtcaccgcgcctgttgggttccgttttctcgcatgcgcctgttcggttcctggatcagggcgatgtggatgcagatagatggacggtatggattcacctgttgatttggctggtagggttggaggggtgcaactcctcatttttatattagtatagatatagataaattgtagatataattactatatgattgcatgttgaactttttgtgcttaatgggttgatgtgacatgcttgcatgtgatatttaattaacattagctttatagaaagaagggataagttatactccctccatactcataaaggaagtcatttatgacaatgtttaagtcaaaccttgggaatataaatcatgaataactctcaagttattgagattgaaaatgtaaaaattatacgtatagatttgtcttgaaaaatattttcataaaagtatacatatatcacttttcaataaatatttttatagaaataagaagtcaaagttgtgttttaaagaccgtgccgctgtcctaaacgactttctttacgagtatggagggagtatagaagtgtcaatttgtcaaaataacggtagtgttgagaaatttaacaatatgccactccataaaaatggttttaacagaatgccaccctctaggatgttcttataaaagttccactcaatagagggtactccttaatagaatgccactttcggctgttttgaagcttttaacgtgagaaatgacaaaaatatccctgatttgtatgagcggcggtggtgcagtgggggcggcttggtgggggaggagggtggggttggtggctgtcgcggcgagcgcggcaacgccgttgtcagtgacgaggtggagggagtggagcttgagtcagtggaggcctgggccaaggcggtcagtgactcgcgcgaacgtggggttgacgcgacgtggagccgcgcccgcgcgtagaggatgaggcggcgcacgaggcggcgttgacggagagccagcggcgcagacgaggaagcaacgcttgcggtcgccagagccgaggaggccaaagacaacggccaggagctcggcaaggaggtcggcggtgtgatcctcctccgcgggggcgtcgtcctcaaggtaggctgtgccgccacatgcttggcgggggtggagagggaggaggccgaggtggcttgcaggggtacctagcgatgatggtggtggtagtggtagtggagtgagtgtaggggcctcatggcctagggccaacgacggcagcggcgagaaagaaggaaatacatctggtggtgcaggggtattttagtcatttcacgagtgaagtctgataaaaatatccaaagtggcattcttttaaagagtacctcctattaggtggtatttttataaggacattttagatagtgacattttgctaaagtcaccgctacgaagtggcgccccgtgcgtcagttccccactcaaaccctcgcttccgccgaccacacggccgcaccatggcgccgccgccggagctcatagacaacgtcaccgcctccctcccgccggatctcatctccgagattctcctccgcctcccgccggatgagcccgagcacctcttccgcgccgccctcgtctgcaagtcatggctccgcgccatctgcgagcacggcttcctccgccggtaccgcgccttctcggccttcttcacaggctcaaagtcatgcagggagaccccgccgcccgcctcgcccgcaccacagcggtgcccctctcccccgatcccacctttcgccgggccctcgattgccgccatggccgcgccctcctccacgcttcggacgatgattggtatctcattgtctgggatcccgtcacgggcgaacggcaccgcgtgccagagcctggcatcccgtggctgatctactccgcagcagtgttctgtgccgcgagtggctgtgaccacctcgattgccacggcggtcccttcagagtggtttttatagccacggacgatgacgacgaactcgttaaggcgagcgtctactcgtcggagacgtgtgcgtggaacaagacagtgattcttgctgatggttatcaaacctggcaagagcgtttgcaagccatcactagaggtgaatcataccgtacaccttatgtccagcccaggcgaggtgcccttgttggagatgaaatctacttcacgcttcggaatgagaatgcaatcatcaagtacaactgggccgcgaactgcttatctaagattgacccgccgatacgagatgtgtatgacatttccctcatggagatggagaacggttcactgggttatgcctgcattcagggttccagcctttatgtgtggtcgaggaatgccagttcagaaggggctgcagaatgggtacagtgctgggtgattgagctggagcaaatggtacctgttgccaatcgcggtgatgaagcatttgttgttggctctgcagagggtgtgggtgtcatattcatgagcacaggtgttggattattcacgatcgagctcaagtcaaggcgggtgaagaaggttgaagagcctggggtctactctagcgtcttaccctacatgagcttctacactcctggtattgtactaaaaattgcttatctcctgtccttcatttcctttacagcttctatatatttgctttgtcataatgtaactgcaatattgtaatttcaattgacaaaaacagttttgtgtatgctagagaatactgaatagaggcattgcaaatcagagccttaatttttgtgatgagagtttgcttgctaagaaccatgaccttgcattggtctaatatattcgggatacaaacttgttgatctggtatatttgttactctgttactttcaagcatatctgttactcaggcccagttgattcatggaatagttcatgcagcagtaagtagctaataggctaaactggctattgctaaagatttatagaagccttcttgttatgatatttatagaaacattagattttccttaaatggtattggtaccttctggcatagatgaagctcatatctcagacccaaccttgtaacctttggaactggttctctgtacatagttcgtcaaactgtaaagtttgagctggacagttggttatgagttgtgtgcttgactgtttggtgtgtttctttttttcagatcgtggcacattgttatcgctagcgaggactcactgatactcaaaacatgttgcaattgacttcttccagaactaccactatgaaatcatttattttctgttcggcagtataagtatgaacaatgcaagtaatcatgtttcgaatgtggttctagtgtcgaattcatcctaccaaccatgaactgtatttaatttatcatgtctggcatatttcagttgagcctcaggtacaggaaactaaaatctaaaattatgttgacttttgttgcttccattcagagatctgcaagtcatgcgaagctgaatagctggatcatgtttacttcgattacaaccttacagggccggggtagtgaggtgggtttgatcagtcttgcaattttttggtggtcagttcaacccgaatatgagtggaatattcttttttttaccaactaaacccacctaatcctcaaaccaaacagctgcaaaaaaaaaaaaaaaaaaaaaaaaaaaggatggccccgacccgacgttcaacttgcagctacatactggtattcaagtagtagctcctgccccatcttaactgccatcttagtgaaccttttgcatcatgtcttattggcaggaaaatgttttggacaaggacgggaaatatggattatagcatcatcgatcctcttgcaccaaacaatgctgccgtttttgtttccgtttcatgaataaatgaatgtcaagtggtacagctcgatcgaaacttgtgctctcaacattttatctgcttgtttccgttcctacaatacttgtggactacgattactttttcagttgtagactactgagtaccgactacggagtactaggcttttgtctgatcactactgtgctcaacttattcaggagttctttatattgtttgggacagggagtcgtatgtttataaagttttcccaggttttactagttttatatatcccacgaaaattctattggctgttctgttttcaaatagccctattggtttgcaaacatgtaattatatatttgttagccatttatttattttaaagcttcataatatcttaaacttctatggtggcttcatatatgcattaatagttacatctctatttcaggtgaactatttgttcaagtttaggttcaaaattacagctaatatctccaatgaggaacaaaacataatatccacactaatttctttaatcaaggattaaatttctgggatgttaaagtcccttaaaaacttgatgtgcataaaaggcaacatcaagttgtggataatgaaatggaaaaagttacccccctacactattctggaagtacgaattacccgctcaattaaaaaaccaaatattcttcaccctcaatttttcatacgggacagatttaccctgatagattttggagcggttttgtttctatgtgacagtccagttagtataaaaaattataaaaaatataggacccacatatggtaaccaagagaagaggccgaacgaataagtgggcctattatttttaacttttttatgttcactggtcacgtgtgcaccatgtaggaccaaaaccgctccggaatcgtcagggggtaattcgaccgatatgaaaagttgagggcgaaaaatgtctaattttttaattgatgggggtaattcctaccgccacaatagtttgagggataatttggatttgtttcctaacgaaatatggataacgaatgggcggacaattaatcggaatttgttggaaatttaacatttttcaaatatacgttagttgataataatttgacctcttttagagagaaatatatttaaatgtattcctaccatccttgtctcatggtcgtcatcagaagcaaagaagaggaagtcagttccttcattccttgttactttcatagtgttgcgctgtgagaattttgggaaggcaaacgtctaggtctagccagccaatagcagtaaagaacacactaatgggttggaatgctagattattgtgggatgggcctatgtcatcgcacaattatattgttactagcaaaagtgtccgtgcgttgcaccgagtgattacggagtgtgtacagtgatcaaaaaagtgttgcttagggacctaaatcagactttttcccgccctagccggtcggcccatggcctcttatgcgcacatgcaggcgctccccacctcctcgggccgcaacctgggcctaggccgggaagcctccccacgcgcgcctccacttgggttgaattcggtctagccagtgccggccgtccgatcttagggtttcgatcagacggttgggcgccgacgtcggagggacaaaaccccttccctcccggcgccggcgaaaaccctagcctcctcggcccttcaccggtgtgcgcactcgtcgcagggtgagtgcgccgccgtcgagcggccttgccccaacggccctccccatcgtctttcaagcggcgcccctccccatcgtcttctgcggggcaccctcccctccactagatccagtgggaggggaggcggcggtggcccggcggcctagatccgatgtctcggatctaacactagtagagaaaccatctttggtcggtcgacccaaatccataatagtcccggttctattaaaaaccgggactaaaaatgatttttagtcccggtttataagagaaagatctttaggaccggttgttgttaccaaccgggactaaaaatcatctttagtcccggttggtaactccaaccgggatctttagtcccggttgattccatgtcagaccgtatcagggtactaggatctttagtcccggttagtaacaccaaccgggactaaaaacctatttttagtccctaaaaataaaaataaaaaacacactatataatccctattaccgatcctcttttcctgtccacacaacaaactcctccctctatctctttctccctctccaacttctttatctcttccttatctctaactcccaccttgtctttcttttttttccttccattagtcacagcaaagcagacggcggccggaaaaagggaacagggggccggtgcgtcgtcggccggcgcggaggcgcggggagcctgcgtcggcaaccaagagaacgcgggngttgaaagtcgcaatcgaagttcacacgt

SEQ ID NO: 34275 - DNA, 39645 bp, Oryza sativa
  unsure (1)..(39645): unsure at all n locations
tgtgttcagatantgccgtctctccaagtagcncatcatttacgatttatcctgtgatgtatttgatttgtgtgtggtggggatctgtgatgtatttttcagaacttgtgatgtaattttttaaaagtttgtgatgtatttggagatgatctatttgaggatttagagatgttctgtgatatgtgagaatttggatttgggatttcttgacatgattaggggatggtgtgaaatcaatattcaatactaaaacaatgaaaaagagaaaagaaagaaaaaatatctttagtcccggttgttgttaccaaccgggactaaagatcgatttttaatcccggttatttgaaccgggactaaagatagcgatctttagtcccggattcgtagtcccggttgaaaaaccggaactataggggggttacgaaccgggactaaaaagcatttctccaccagtgtaacgggagggaaggggaggtgatggcggcccggcctcccctccgtcggatccagcgggaggggagccagcggcggaccgttgtcccctcgacggcggtggcagttcggtagcgacggtggcaccctctccttccggtatcctttttcttcttgtgttcttgtatccaattcatatgcttcagttttatttgtgcgatggaattccgactgggacttggattgggggatgtgcgatggaattccgactggcgattttttttggggggggggggggcggacgaaagaccactgcacggatgaggtgataaaaggaaaaacacgaatcttttaattagttttaattagttaagagatggagacggatgattatcggtaatgacagatttattcgttcattacacacttaatgatgaccgtatcggcatgacggttagggaataaccgaaaattttggttttgttatttggtctttagtcttaagaccaattggacttcgacaaacctcaagaccaagcactttggccttaggtctgtttggttcggtctcggtcatagaccgaactaattgtaccagaagtttgatttgcaaaaaaaaagccaagtaatcagtacaagatcgatgagtcaaagcaattagacatatctgcagtttgatgccactagcaaatcgagcacaattcagaacaaaagaggcaaatcgagcacgattcaggaaaaaaaaaaaaagaagccaatcgatacttgcatgacttggatcccatcaatctccaccaaaccactagaagctccagggaccagatctcattcatcccaccgtctcctgtcattgttgttcctgttgctcctttcactttgctcatggccaacctcctcggcacagcctcttccgcatccacagtgctcatagccagcctcctcggccacgtaggcctccagagcacagcctcttccgcctccacggtgcagccaaccagcaaacaccagagggcgtcgagttgggacagtggtgttggttttggtgagaggtgagatgcggcggtggaaagggacagcacaacgcaggtcgtcgatgacagtgccacaccatgggaagttgtgatctccattttttctccaaaaactgggagatggggattggcgaggataagatcatgcctagtgatggtgcggtaaggtgttagagcatcaccaattctcctatttcattcccaaaactaatttttcagggattttaaggggtctggctagccatcacacgacaaatttctgacccacaaatcacacagatttctcagccattggattagcatccaacgagcaacagaatcaaatacaaatagacttttttttcttttcacagacataatgggccagatctgtagagaaaaaaaaaattaaaaaacccatccaaacaacaatagatccaaacataagcccaaataaaaaaatagatcaaatagataatttctcagcccaaacaatgatcacgtggtccccatgaacaaagatcaacttacaccacaaggaaacaaactcagaaaccacgtgactctaccaaaccacatcgatcgaacagaaaaaatcgcaaagatggagaacgagaagggggaagctaagaagaaaaagaagatctgctccaaatctgaaagtcaactccaaagaaaatttaaagaaggtgagtaaactgcatacctcaatttctaacagcatcttcaaacacaaaattgattgaagttcaccttctttgaatcttgaaaagaaatctggtcaattcccttcaaatcttggtagaaattctgagaataactacatcttgagatgaaaaacacaaatcagtttaaacagtagaccaaatcagtttagattgagatgcaggaacttgcaaaaataaacaactaacaacaaatctgacataaggacatgtcaactcagaactaaaatacagttgacaagatgaaacacagtacatgacctgaacttgtatattcctatacaacattctccttcaaacaaaattttcttccacttcttaacaaaacagatcatacaaattcaagattctccctgaataacaaaatttattaaaaaaaacaatgcataacaaaaacctaagtactatgcagagttttgtttctcacaaagagaactctactgcccgcgccgcgacgacagaaaccaatgcccattgcaaaacacctgacagcaacatagttaaatagccctaatctcccaggtaataggagctaggaatcgtgggcgaggtcctaatggtcctaccaatacaaaaatatgcaacactatagccaatatataatccacatcagtataaaaactaaagtatagcaaattacatacacagatttctaaagttacagttataacaatagcacaattgccatgtaagttttcaaaaattacactatgcagagttttgtttctcactgaactagtgctctatatggactacaaaaaaaaaagggaaaagaaccaaataattaacaagtcataaaaattacatgatgaaagatctaaagttacagttgtaactttagtacaaaggtcatgtaagttttcagatttagatttaggcatttaggcatgaaacattaaaatcaaatataatatagcagattacatacaacaaatatacaaagatcatgtaagttttaaatccagctaactaattattttattttatttcataattaaattacatacacagatttctgaagtaacagtagtaactatagtacaatgatcatgtaagtttacatctgattcctatacacttgttaaattttgcaggaaaaaatgtatttggagagtctactcaactgagcaacatgctgggcacaggagcagaacaagtcatcaaagaaaaagaactaataggtatttatttgtgtgatatatgattaaaatcaatcttcccaaaatgcataaactcaaaattacataggcacacatctaatattacatatgtaatttcagtggaattggactgtaactacctatattttcagattttcttttctaaaagactatataatcctatacacttgttaaattttgcaggaaaaaatgtatttggagagtctactcaactgagcgacatgtaggacaaaaaagctaaacaagtcatcaaagaaaaagaactaataggtatttatttgtgtgatatatgattaaaatcagtcttcccaaaatgcataaactcaaaattacataggcacacaactaatattacatatgtaatttcagtggaataggactgtaactacctatattttcagattttcttttctaaaagacaatatattcctatacacttgttaaattttgcaggaaaaaatgtatttggagagtctactcaactgagcaacatgcaggacaaaaaagctgaacaaatcatcaaagaaaaagaactaataggtatttatttgtgtgctatatgattaaaatcagttttcccaaaatgcataaactcaaaattacataggcacacaactaatattacatatgtaatttcagtggaataggactgtaactacctatattttcagattttcttttctaaaagactatatattcctgtacacttgttaaattttgcaggaacaaaaaagtttggagagtgttcagtgttctcaactgagcaacatgcaggacagagcagctgaacaagttatcaaagaaaaagaactaataggtatttatttgtgtaatatatgattaaaatcagtcttcccaaaatgcataaactcaaaattacataggcacagatctaatattacatatgtaatttcagtggaattggactgtaactaactatattttcagatttgttaaataaaaaacttgcataaactgaaaattttatgaatattttcaggtttgtttacaccaagagttacctacagcccacaagcactacatgatgagttaacaatgctcaactcacaaacgacacaggttggtttttataaaagcattacaaaaatctatgcaattcatattaatttctattatactaacattgaaaaaattgcagccgggaaacatgtcctatactgaatctaatgcaacatgtcattaatagtccacgcgttacactacaaccttcccaggtaagaatatttctagttatattaaagtacatataatatggatcagtaataacaaatattgcaggaagggcaacaaaacttcacaaggttgtttcagacaccaacagcatatcatgtaagcaaaaaaaaaaggagcattgcctatattttgatgacatagaaagaaaaaaaaattatacaatcatgcacctataaaaaagtatacatgtactaattttgtttattactaacaatgattaattattttaatcatgcagaactcaatgatctttaacaacaagcagattttccccaaacttgggaacaaatcatgcactgccaagcattgaatggaactaccaggaatttgatgaaatttacaacaacagcagtcacaatacttatgaggtaatattaacaacaaatttttccaaacttattaataaaaaactcattgctgtgaactaacatttgtttgaaaaaaatgcagatctcagaatggacaacaattgaagatttgtatgaattgaagaacacacatttcaaatcacaggtatatatatatatggttcaaaaataaacagttatattgacaagcatagaaaaaaaatagttaaaattaattttgctactaataaacatgcagggaaaatcaagcagtttcacaaatggagatgaacaaccagcaatatacacaaacaatgaacaggtgaaattgaaaacttgacagtgtaattagtagatatcatgcattattcataatagagcttacataatagtactatttaacttttgacaggaaattagtctatgcatacaagatcaacatatggacaaggagaatggaactgctcaagaaacagttgaagaaattcaaatacagcaaacagagcaacatgagacaatgccagaaagcaatgaaacatcaaattcagaacctaacagcagagaagaactaaatgaagaggatattgataatttcttgagaaatgatgaggatggcaatacacaaattgacaaaaagcacatacctgagcttggaatgaaattcaaaacagacaaagaagctcatggcttcttcaacttttacgcttatttagctggtttttctactgtgataactcatcactacaagtcaacaagtaaaaagagaaatggtgagattacaaagtatacatatagatgcaacttgcaaggaaaaaatgaaccagaggacaaaaatgcagaacaagaagaagaagaacaagaagaagaagaagaagaagaagaagaagtggaagaagaagaacaaatagaagaagcaacagaacaagaaaggcaaactaatgttcttaaaaagactggctgcaaatgtatgatgatggtggaaaaaatgtttgccctaggagatgtatggcaaatagcaacactagatttgaagcataaccatgcactttgcccaaggagagaggcaaaatttctgaaatcgcacaagaatatgacaataaaggagaaaaggctaataaggacattgaaggagtgcaacatacccactaggagcatgattgttatcctctcatttctgcgtggtggcttgccagcactaccctacaccaagaaggatgttagtaatgttggaacagcaataaattcagaaacaagaaacaacgacatgaagcaagtgctggcttatctcagaaaaaaagaaatagaagacccaggaatatcctacaaattcaaactagatgaaaacaacaaagtgactagcatgttttggactgacgggagatcaactcagctatatgaggaatatggtgactgcataagttttgacacaacttacagaacaaacagatataacatgccatttgcaccatttgtaggagttataggccatgggacaacctgtttatttggatgtgcattcctaggtgatgaaacagcagaaactttcaaatgggtttttgaaacatttgcaacagctatgggagggaaacatccaaagactataatcactgatcaagacaatgcaatgagatcagccatagctcaagtgtttcaaaacacaaagcacagaaattgtctatttcacattaagaaaaactgtagagaaaagacagggagcatgttttctcagaaatcaaacaaaaacctatacgatgaatatgatgacattttgagcaactgcctgacagaagctgagtttgaatcactctggcctcaaatgattgagaagttcaatttgcagaatgtgaattatttgaagataatgtggaaaaatagagctcagtttgtaccagtctatttcaagtatgatttctgcccttttatacagagcacaacactaagtgaggggacaaacagcagatttaaaagaggagttggcccacaacatagtgtaatgagtttcatgaaggaatatgagaatataaatgatactatctttgacactttgtacagcaaagatttccaatcaagaccaaagaagccaaagaccttgtggttcaactatctcattgaagagcaagcatcagaactatacaaccttgaaatattcaagaaattccaactagaactaaaggaaacattgagtttgcaagtatcagtgctacaacaaggtaaagtttatgaagtgtttgtgtcaccaaccagcatacagaaagaatatagaccaaggaagcatatagtcattgttgacttaccaaatgaaaactatagttgcatctgtggaaagttctcaaaggatggaatgttatgctcacatgtcctgaaagtaatgttggacctgaatgtcagaaaaattccagaaaaatacataattgaaagatggagaaagaaggaaaggaaagaaacaaaaaagcacatcatgcagaaagaaaatggagataattcagtcctaatgtttaatgtgctgtctaggaaaggagctgacatagcttcaaaagcatcaaaaagaaaaagaacatatgattaccttgtagatgaacttgacaagttggagaagaacattgacttaatgattcaacaggaagatcaaactcaattctcacaacatcaagacagtggtatagaaattgcaaatgcagagcaacaagagcaagaaaaagatgttcaagaagagcacatagaagatcctgatacagcaaatacaaaggggagaaaaccaaaaaggtatagaagaatagtggagaagataatagaaagttcaaagaagaaaattgaagaacaagaagatgcagaagaaaatcagaataaagcaaggccaaaaaggaataccaatgaagaaaaacaaacagcgaattcagcaaccaaaggtaatgctgaaaactaaagaaatgtcatgtacaatgaaaaaaagataaaataatactaaatatttaattgcaggaaaaagaaaggcaacagaagacaagggaacaaacaagaagcagaaatcaaaacaaggctgaggaagcaaaagcattgaagacagaaaaaaaagaatacatatatgacttttatagttcatgtaataggactgaatgagttttatatgtgctacataagtttctgtatgcatatcatatactatgtcaaatagaaaactataactttatgatgaaatatattctatatacacatttgactagacataaagctaaaaatgctgatgtgtgacactattcaagcatcaatagcacggtgattgcttggaaaccttgcctgcaaagaaaattaataatataaaacatatcaaaatttgataaataaaacaagtgtataaagcattatttgcaaaaaaaaatttgtggtgaaaaaaagaaacttactgaatcaaaccaattgacaccaacattttcaacttcggtttgcaacatcttgttgtttggatgaaaaaacatctgattcgcatactgtacgcggatattgttgatattttgtccagtgaattgattagaaagaataattcttggagaccaaatttccatgaacttcattgagaatatgcctgaatcaaaactacaaaacataacaaaacaataactaaacttattttgaattttttattacatctgagcaacaaaaactgaatatcatttgagcaaacaaaaaactgaatatcatctgagcaacaaagaatctactggcataattataaaattatgtcactaaactaaatgcagattttggtggtcaaaaaccaatcaaaatatcatcttccaaaaacaatacaacctacaaaaatgccaaaaaaaatttgatttctcaaaaatcagtttgaatttttttttgaaatgacataaacatgcagcatctaatatatttcaattcaattaccaagggataatttatcatacaaatatcaataaaatattgacagatttaaaaactaacctgtattcttggcgtggaacaggtgggaacttaattttaaaagtgctgaagttcattggagtgcgttcatatttatcccacacaatctgcaaattttttaactgcaattcatacataacaataaaaataattaccagcaaattcattcatatcaatatagttgttaaaaagggaaaaaagaacatggaaataaaagtacaggaaaaacacattaccagcaaaggcagaattggttcaaaaaactcatcatctggttgatgcaatgaatctaaaaacaccagcatcctatcttttatatcaacaacgagaacaaaccagtgctgaccatgtagtatagggaaaaaaagctgcaaaaaaacaaaaacagaaacaacccatacagtaaaaataatgaattacaacaaaacaaaataaacataattagaatagtaaaaatcaataccatgtcacaaaggtgtagtggccgagcactagcagctccaaggaaagattttttcactttttcttgatcaacaaaatcagggtcaagaataagttgtgcctagaaaagatatattgtacaatcagtttggggaaacaaaagacataattttaaatttttttacaaaaagatgtaatgtacaaatcagttagctcacttacaccaatggatgggaagaaataatgcttcttagattttgatggatgattgttttgaaacaaaaagcggcagaaaactgacatgacaaatggcaaaacaacaccagtctttttgagagaatggccaaagctagaaaacttggctctgacattgtcgatatcaacagcatcataactacataataaaaaaatgaataaatagtaaattaataatagatataaatgaacaacacatttttaagaaaaaaatcaaaaaaaaaatacagatggcaaattaatctaaaaaaatggctgtggcaatgtttctgatgcttctgctacttaacttgtaaacaaagggttcagctgtaaaaatgctattaactgagttcagtggatgaaatctagaatcagacaaaaaacatcgcaaatactctaataatgaattatgcttagcaaaggacaaatcagaacatatcatgacagagacatagaagcaaactgattgataaataacagaatagaaagtgcaaacagattaacaaaaaatggaacatcctgaaaatttaaaacttgtattgtctaataacaaaattgatgaaatgctaaaaatctataccaaaataacaacaaaaaggaaatattacctcaaaacatcaagataatattacctctgccacttggaactatctgctaagcgacagagagcaatgtaatatctgttctcttgatcggacactagaaaacgacgtttcattgcaggaacaaatggatcagaagcatgcctgctaggaacaattattcttctaggaccatgagcaggtaattttccgcctgaagagctcatcccatgtgtataccgtgatagattattggttgcattgtatatctcttcggttttaacacaagattctttaacagtttgtggaaatttattttcacccaagaaaacaacatctggagagttctacagaaaacaacaaaataaaaacacaactaaatttaatttgaaaaataaaatggcaaaataaattaaaaaaacacatttctatacttacagtcacatcttgaaataccctgttggaaaaaattgaagaaatttgattaatcccagctgagttctcattacttcttatattgttgtgatcaatgacatcaatagaatcagggacagatcgaaaagatttgcacagctacaacagaaaaatgaatataaatatatagaaacatcttctaaaagaactataaaatacagtattaaaaaacaaaactagtaccaatgatgaaggaggagtaatatctccatgagcttgattatcctcttcatttaactgattattggcatcatcattagaactactaacatcatcttcagaatcaagcaatttgaatgaaggccttgaaaaatcaataatattgtctctggcattttgatttagtaattctggaaatcttgtcttaaacttctttgcaacattatgaatagaagcagcaatggttgcactagcagaacctacagaaacatagtataaccaaaaaattataaaaatttacactatttagcaaacttataaaagaaatgaaataaaatatcaatgaaaaaaacataccagccaaattatgatcagcacaatatttgaacttcttcacaaaagcactcttaggagtcaacaactcataatctaaaaaaaagcactaagtgaagagaaaagaaaacataactaaaataacatcttctgaattgaaaaatgtattaacaaataccaaaatctctgttacttgatgagataagtgcagcagcatgaccagatgcaataacatcatcaccattagcctaacaaagaacaaatgaaaacaaatcaaacttaaaacttaaaaatgggaaaaataaatataaatgatatagaacaaaaaaatacttacaacaaaagagttgacacatggatcattttcaatgggtgtacagacaacaacatcatctggtattgaagcatcaacatctacatataaaaaaataaatttaaaaaacatgcatatagaaaataaaaacagaaactaaatttctaatcagaaaatactaacttgtattcattggggtagaaataccagcattatcatcaaatctagaaggaacagcattacaaccttcagtattagtatcatcaacatcattttgaactttatctgagggtgtaacactatcttcagcaaccagaactagagcatcaataagaacatcttcacaagtatgactcccagcagcatgaacttcagaacaatgatgttccatcagagaacataatttctctttcatactaagaggcaacacagaacctagagcagaatcaagtttctctttaaatgaaattcttctctcagcagtaggatgaggctaaaaaaaatgaaatctataagaagactaataccaaagttacctagtaataaatcaaaaaaggggaccaaaaatatacctgataataacacccagatttaaaatctctaagaggcctaagaccaaaattatcatcatcaactttgtcaagatcagagtaagtttgtatcatgttcttagtccaaacagcaatgcgaggagtgctatttccaggattcttcttgccaaaatcaacatggtcaagataaagcgcctaacaaatttacatttaagtcatatattactaaatagaaaaataccaatatcataataagaaataaaggaaaaaaatactcacagcccaatagaataagcaccctccaaggttgttagacttgaagacctttttcagaagagtcatagtccaataataaatgaactttgaccaatcataatttctcagattttcaatatcctcaaaaactgtcagatacttggtgctaggcgtcaaagatgaatttgggcaaagaaagcaagctagcgcaacaatcagaaatgatgtgatcactttatcatcagaaatctattcccttttaataaactaatcaccaaagaaccgaaacgaaggtagatcactgagaccatactttgatagaatgaacttctttccactttcaaaatccctactgaattgcaaaccaccttgaggcaaaccaaaaatagtactgacagaatcttttgaaacagaaatcactttgttgctcaaaataatttcagaagacttgtaatcaacatgctttgcaatccaagtggcaaattttattagaacataactgctatcaaacaacagtagagatccaaaatcatagcttcgaatgacattcttttgatgctcagacagtgcagctataacatcagagaaatatttgcaagaaaacctcgagaaagatacttcattcttcttataaatccttgctctcttataattcataaaatgaaaattaaattaataaatcatacataactcaaacatcaatgcaatgtaaaaattataaatacaagtaggaaacttaggcttaatgatcagggtacactaatatttcacacataacaaaacatttaattatcaattatacaaaaaagtgatgaacaatgaaagacatgaaacttgcattggctgaaaacaaaaaataataataataattcatcatcaagcacattgtcaaattacatgaaaggtcaaaattggattaaaatgattaagataaagtagatacataaattcaacaaacaaaaccaaaaaattaccaagttcaatactaaatatttataaactgcagaacatgccatacaacacttaaatacaactataatttacacttgaaaaacatgacaaatgtactaaatcaagaaggatacacataatgcatatataaaagatttaaatgcaagcatataaaaaaatgagacaaaatatcagaaaataaaacacataattgcaatatcagacaaaaataccttggatgtatggaaatcataagattttttcaaatgccttttaatctcatgaacaacctagaaaacaagaaacttatcataagaatgaaaggaacaaataatacaaaaataaatttataacatacctctttcctgtgcattcttaagattaaatcatccaattcagaatcactactggattcactatcaacattacagtcttctaaagcatcaacttcaattcgatccatctaaataacaaaatagacaatgcaacaaaacaacatgagtaaaaaaaaagtggagtttcatcagctaataaacaaagtatatatagagaatacttttataaactattagtataacattttaacagagataaactagtactataacatgcatcaaaagaatgaatatcaaatcaaaaataaaacattactactaaaaaacctagtcaacagatctagttaaaaactagatgtcaaacataaaagctcctaaacagatcatacataaaactaactaagttcatatttaaataggaataaacagatcagattcaagtatacatatacatgagtacttcaaattgaaatgtctgccatatatacctcaagtatacatatacatgagtacttcaaactagaaaactaagtcagaaacatataattaaaatgttcataaattgaaatgtacctacattcatacactgatagtaaaaattacattgctttcaacctaaaattacatttgtaaaaacagtagatttggcatgtaagtacattgtaattttagtataaatgcactgtaaattttggtaacttaaatatgttaactcatcaaaatttcataaagtctccatcaacagtaaagcataaacagaaattatataaaacaagacagggcacagataaagcacaaatcaatcagtcaagctatgaggctatatatcaagcacagattaaaaattttgaaacaactataaaaattgcataaatcatgaatttaaatactgaatcatcttaaaaataaccagagctaaaaataaatcatgcatttagatacaccaatagctaaaacctactcagatccaaaaccaataaccaaaaaaaaacatgcaacaaattacactacaaaaccaatcatcacgagtactgtcttagtgattcttaaactagttcaagcaaatcatgtagagctttagttataaatatttcagaaatgttggcatcatcaaatgtaattttacagatctggagtatactaatcactaatacaacaataacataagccatcttatgattttgaaataaaaatcaacagatcaatcacactgcatcccgagcataaaaggacacaaaaaaaccagagaaactgaaacaaccataactaaacctccagtttgaaccctagccagattcaaatcgaacctagcctgattcaaatcgaacaaaacaactaaacctactcagatccagaaactaccactacaaagataactaaaaaaaacttgcaagtttgaacacaaacacaaatcacggcgaaatcaaatccaaactcctatgggattccaaaaactacaacgatttaaaacaaaaacaaccataaatcacaaaaaaaacaaaccccctttcaaaaacatcaaactcgaatcctagcatgattgaaatagaaaaaaccacaaaaaaaaactgggagcaagcagcgcagcacacaccaaactgtcgaatcaacaaattttgcccccacgccgaccacgcaatcagactaccaaacgaactagaactcaaatcaacaaacctaccaaaccaactacatggaaaactaccagatctaccatacgaactacacaaaaaacaacaataaacaactcctcgtggacatcatcaacctcaacctcaaatcatccatttcatacatccggaaaaatgccgagcacacacacactctctctctctctctctctctcaaaaagcaaaacactccacacataaaggctggaaccctgaatgcaggcataacccagtgagccgttctccatctccatgagggcaatgtcatacacttctcgtatcggcgggtcaatcttagaaaagcagttcatgccccagttgtacttgatgattgcattctcgttccgaagtgtgaagtagatttcatctccgacaagggctcctcgcctgggctggacataaggtgtacggtatgattcacctctagtgatggcttgcaaacgctcttgccaggtttgataaccataatcaagaattgctggcttgctccatgcacccgtctccgacgagtacacgctcgccttaacgagttcgtcctcatcgtccgtggccacaaagaccactctgaagggacagccactcacggcacagaacactgcggcagtgtacatcagccacgggatgccaggctctggcacgcggtgctgttcgcctgtgacggggtcccagacaatgagataccaaccgtcgtccgacgcgtggaggagggcgcggccatggtggcaatcgagggcccggcgaaaggtgggatcggggaagaggggcactgcggtggtgcgggcgaggtggcggacgggatcaccctgtaggacttggcgcctgtgaaggaggccgagcaggggaggggatccgtggaaggcgcggtagcggcggagaaagccggggtcgcagatggcgcggagccactccttgcagacgagggcggcgcgaaagaggtgccctggctcgtccggagggaggcggaggaggatctcggagaggagctccggcgcgagcgaagcggtgatgtcgtccatgaactccgggcggtggcagcggcgccatggtggtcggcggaagcgagggtttgggtggggaattataaggattggagaatagaggcacggggcacactgccttctttgtactacaaatttgctaacccgttagaccaactttgacacctgcgttggatggtgtccatgatggacagtccatctgtgcatcatgtgcttcctccgttttatattataaaactttttagcattgttcgcattcacatagatatgtctaaatccattaacatctatatgaatatgtatgaatatagtcaatgttaaaagtcttataatataaaacggatgaagtatttattatggacacacacctattatcgtcagtactcggtagctgctatcaaaatttgaatttaaaacttaaaattcttgattatagtcagttttctagtttttcatcctaatcattttaatataatcttttacatgcgtttgtaatacatgaaaattttcttcatctttggtcagtcatgaccataccttggagtggtaatgggccaaggtttatacgcatttcgtatcccatctcaatctttaaatattctttaatcttaaaaatctactaaatttcagtctaaccctttttatccggtccttatattttgtaggtcaaaaaattgggctcgttaccacttctatccatactacgctaggacccatgtatccttaattgatttttttatacgtgcacccaaacacaccacactcgctgattcgcacctccacaaatgcatcctctaacacatgctcaaagaaatgaaaatctaaacggcacatccctggtctaactaaatcatattgaaagtccaactgcatatgcgagtaatattgaatcccgtagaaagatcatcaacatgtgcataatattcatgaacataagatttaaaccctcaaggtatcatgcatccacgatttcaccgcccatgattccaccaccacaccactagtacttacccatccattattgatttctatttgcacacatatacaaatggttaaaaccacaaaggatatctctactaccttaaaagtggagttgttattctttggtcacctcctcccattttgcaccgcccacgcatgcttagtgtactacgtaggtaaccaccggatcaatgttttatcactaatattcttacaacatatggacatgttaatagtctacaaataataggcagtcatacgatcttggatcgacagactagattaaactctagtacggggtaaatgtttgcaaccaattggggtagagctaacttgacatacgatattttacacaattttcattgtctaactaagatagcgtttaattataacagcatcatcatatttttacaactactggcgttgtaatctatacttaattaaaaaatacatgaggctttcgtaacctttgtcgtctttcatcgtctctcagttggccccgctccgtttctcccccctcccccaagcctccatctctctccctcttggatcttattccgtatttttttacaaggattccgttttcttagaagtccaatccattgcacgcatgctgtgcacacctccagctgccgcccgggccaaaccctacaccgctgacacatcaatctgcctccccgtgagtttcctccaattgattgcggattcgcatcgattatgggtgaaacaaaaagaggagatcgagtggatcaaaaacccttaactggttttgggagatcgagaaagattcgtccgaatttgatggggaggatcgactttggcattgtacgggcacaaggctgtcgtccggaggttaaagacgctactaaagatagttgatgtatcactggaagaaaaaaacacctttacccattgcaatgcacgaacattttttctagtaggaagagaagatagaggaagttaccgaaagaaagtatgatcagaggacagttcagatgttagtgtacaaggagagagtgttgttcgacggccgcgggaggcggtggtatcacaagttctagtagagagaggagaagaggattgtgataggaagatattagtttaagacccaaaattaataatttcatcgtaatttagctacgtacaacaaactacgtgcctgtaacacctcacacttttaccactatagataaaagcgcaaggttgtggaatattatttaacaaagtattgttttttctaaataatacctcacaatcagagaccacaatagacaaaataattataaccacctttactttgttccagagttttgaggccatctctaatccatcttatacttgcaaagaatgggacctattgttgacaacttttttttggacgagtcacaaaagacaatcgacacacctaaatgtcttgcggtaatatgggatttccaaccaccgcgatctagaaaagccaaataaagatgggttaccggctagcagagcggatttaaagaccaaaattagcctcaaggccagtttagatcaatatgagggtaaacacccatctcatgggtgaattggaaggtttacgggacaaacttacaaaggaatttcgaactcttgcaacgatggcgaacgatttatggtgcaaatcaacaaagatggacgaaccaggcttgaactaggaaaaaaaagtagacgcgatattgaaaaaagattcaattggctaattacgttgaaaatagattatgttggttgtttttccaattgaactggccttggcccttataaaggggttcgtcttgcctcctataggtcttcctccacctcaatttcagggtagaaatcaattagaactcgaaaaatacctccccatgcaaggaaactcaagactcggtgaaatttgacccggacttggactctgccaatctgatcggccacacgccgccagtcagactagctccacacaccggtcagaccggcctataagcggtggtcagaccggccccgtgaaggaaaccgggcgccttccaaaatttggtaatgttttcctatttcgaatctaggtgccaaatttgggggttaacatatgccccctgcctttttgtctatatttgagagccaaaaagcgtagaacacgtggttttagggcgataacctaattacctgccatatcacctcctaagcatcttgccagacgcttgggaagtatttcttcaaatatttcccattgattgctctttaaaatcattctccttgcaaagtttcaagaaaatacgcattccctcgaacgattccacatatccgataaggaccttcccatctaggcaaccacttaccgaagtccttacatctagaacccaaaggaaaaatcgtcttccaaaccaagtttcctacttgaaatgatttttctctcactctttttatataggctttggctactctctttttttccttttctatctcctctaaagcctttagacgtttatcggtcacatcatcaagattgtctcccatcaacgtcctatattcttcggccgataaatcatcttgcttgatatatctaacagagccaagatttacctctactagtaaaacggcttcttgcaaatagattaactcaaaaggagtaactttagtaccaccatgcttagatattctatgagctcataacgcttcaaagagtacctcatgccatctctttggatgtccctcattatttttcttgactaatttcaacaaaatcttattacttgactcaacttgtccattagcctgagcatagtaaggagaagaacttaacaatttaatatcataagattctgcaaagcttttcagttccttagacataaaagaatctctttgatccgtagttaaagtttgaggaatgccaaacctatgaataatatgcttattattcttcaaaataaagtcaattacctccgtgtgagtcatattcttgagttgcacggctttggcccacttggtgaagtaatctgttggaactagcacgaaccgatgcccatttggtgatgaatgatgaatttgacctatgaaatccaaagaccaatctcggaacagccatggcttgatgataggattcaacactacagcgggtgctaattggacattgccgaattgttgacaagcttcacatcctctattgtacttaaaacaatcatcaaccatctttggccaatagaatcccgctctattaagtaaccatttcatcttgttgtaggatcaaggaagttaactagaggggggatgaatagcggttttaaaattttttgtctgaaaccgagttttgtatgcggaagcataaatcaaaacggttttgcacaattcaaaacctaaacaactagtctaaactaagtgcacaaagaagcctatgttgaggtttgcaagcctaggatgattttagcacaaataaactctagtatgtaaacttgctcaaagtaaattggcacaaatataaattgcacaaaataaagaagacaagagacaaagtatttttccacctgatgtttggaagtttgccaaagccaacttcaccactcaaatcaccaaacatccaaacctctcgtcaacagatgagcaaggtgggagccggtctcgaaatggtctcccaagtctctatcactatggttgttcttcctccactctggagatggcaaacaccgagccactcacaaccaattccaggccttctccacaaccttctcggaaaggtcactgggcaactcatttgttgggtaaaacctatcgatgacgggttttatttttggcccaattgagataactgttatccgtgatggctaaatgcttgatacaaatgacttctcacatctatgacctttggttcgtgatgggagcccttcctgatacaaatgagggtttccgcccgattgagatgacctatcccgtgctagtggttcgtcaccaagattttttagaaaaaaaatactgaattttagaaaatgcatgtactagctaattgtaggagttagggatgaaaacggagcggatagtttccgtccgctccggacaaaaacggatatggatacctttcggatcagataattctcggatagttcggatacggatacgaatacggatattttctcccgaatacgaatacgaatatggtaccagggtttccatcggatacggataataattcggatatccggtgaacagtgctattcggatatccgcaggaaccatgagacataccccatttctttctaactctataaccttcaatatacctttatagattttaataatagtttatctcttaacactagtccatactattaatattatttaaattttaaaaaatatttataaattatacctcattttatataaaatgagctaattatatatgttgatatttgtttctattagaagttgagttggttttcgtgttccgagaaaaatttgtttccgtattcgtgtccgatcatattcgattcttattcgtattcgagataatccgtatttgtttccgtattcgagctatccgtatttgttttcgtatccggtaaaaaatatgaaaacaaatatggtatgagcattatccgtccgtatccgctccattttcatccctagtaggagtgatatgtagtagcatggttgctacatactctaatccctagcatggttgttatttagaactcgacagccgcaattttgattcatcacatagcaacaacggagtgagtgacgatgaccgcgaagggaggggtggagacagtggaatataatgaagggattgctacatatcttggcctttttggcttagttcgtttcccctttttccaaactcatcactctctttttccgcgcgcacgtttttcaaactgctaaacggtgcgttttttataaaaagtttctatacgaaagttgcttaaaaaaatcatattgattcatttttgaaaaaaatagctaatacttaattaaccatacactaatggactgctccgtttttcgtgcagagaagtttgttcccaaccatccaaaactaacacagccttagtctgtttggttatcagctcttaaagccaagtaaaacactgaacgctaaatcccagagtagggggaaaataaaaccaaaggctgaaaataaaaacggcctttgtgtctttctgatttggtgcaacatttggattgcacttaatttgtgcccacccctacccataaggttgtgaataaatataggagttaacttatcaatacacgatgctcttttccgatgcaaatgaatatcactgtgaatatgcatgtcactcaactatgaccctgtttggagaactagccagagttattttgaaagcttatttttagcacaaggaaatagtcctccaataaaatagccctaagttgtttggatccaagagttattttgagagctatttggtctttaaggtaccttcccatggagagagatagagagaagacatgttttcagtgggccccatccaaaatagccccaattagcaccccttgagtgggatattttttttggatgggttatttccaaatagctctcaaatagctcactcttttagatttttttggactatttgagctatttaagggagggttaaaaatatcccttcaatcaaaacagagtccatgtggcaaacaagtaatttccctaatatttttatcagatggaggttgtaccgaaatgagtatgaaggcctggaactaaaaaataagagcagcaattttggaaaggtgggaattcaacgacggaaacatggctatggcacataggaggcaggcccagatctcactaacaatattacacctactagaaatatctcatttgttgcaaatctctgatgttaacaaaaacatatagcaaaagcatattctctccgtccaaaaaaaaaaaaacccacttctgggtttaaatctggacataaccagaagtggatttttttggaacggaaggagtagcaaatatctcattaattggaaatatgatcaaagcagttatctgcataaaagttccagttatatttatctggatggcatgtttaaaaaatatgcaaaagcatagcaacttgttgatctaatgaataaaggctgaacacatggtaacatgtcctagttatatttatctggatggcatgttgcccttgatacaaatggacggtgcattagaaacaggagactagttttgggtaatagaggcggtacattatagaagaatagtgccttcacattccatcagtaaagtagttgacatggaactcttcaagcagttcagaagtagagttatgctcaaagagacggtgcgatactctgcccatcaagcatgaactgcaaggttgatgccacgctcatctgagtctggggctcagctgtttgcttggcattcttaaccacatcatttgaatcgacaatgtcatctattacattgaggttactgtcgaatgcctccaactcatgcagccccaatgcatttacatcactagctagcctcacatcctgaccacgctggtttttcttcttctccacttcattctcttgttgcaacttctggtacttcagattgagctcatgcactatgtcagtctcatcaccattgcccccatcacccatggtagggttactaggacccacaccaagtaagcgacgagtgacagcttgaacagtagggcagccaaagaaaaagggcttaccagcaggtgagagcacagcaacagcaacattgacaccacataatatgctgagttcgttagccttcttgattacaacctggcggcgcttggagaagcatacatcacgagcctttctatttgcaatgggcttgatcttaacttttccccttctcatggctgcttacccttcactatcacctaaacaaaaatgtgttctctgtattttgtcaagggatggtacaagaacctttatatagacctctatggagatgaaaaaggaagtgataagtctatattttgtaagaaatttattttgttagtcataagtatatacaaattaatagttgccaatgaatctagccaattttaacaattcgacttccaaaattgacgtttgtactgataaaaggataggctagaattgtgctaactctaattttagtcgaacgactatattgatcatattggtagggagtaatggacgtcatgacatattgctggctagtaacgcccctgattttacgaggcgttaaaactcttgtttagtaaaagattaattactttttttttgcttttccactgtcatctcataagctgtgtcaaataatctcatgttatgcagttcatccctccaaaaaagcaaactccataaactcgagtccaatccatgtttcaaaaacccaaatattcaaatcccttctaaattaatttaaatattacctccctctaatccaagttacaaaatacaaaaataaacccaaatcccaaaatcaagttccagaccaaacaccataataaaaagtacagttcacattttatgttgaaagttcatttaaattttccatggaattccctcattgtatccgtcttaattcaatatctcgtatccctttccatgacttctaatctcaatatttgaattaaagtgcaggtataaatgccgcaccacaaagttactctaaaatttcaccctttaatttcattccttaaaattggaagaatcatcaagagcctactacaatttaaaaaatcaccaagtagtaactcctaccccatcttaactgccatcttagcaaaccttttgcatcatgtcctattggcaggaaaatgtttttgataaggacggaatatatggattattggagcatcatcgatctcttgcaccaaaaaatgctcaaggcttgctgttttcgtttccatttcatgaataaatgaaagtcatgcagtccttcaaacctacttgttctgtcgaatttttttctgcttgtttccatttctaaaatacttgtggactatgatacctgtttcggttgtagactagtactgagtactgactacggagtactaaggcttttgtctgatcactaccatgctctattatatcccacaaaaattctatgtgctgatctgttttcaaatagccctattggtttgcaaaaatatggttatataattgttagctatttattttaaagcttcatactttcataaacttttattgtagcttcatatctacatttatagttagatctttatttcaggttaactatttgtttaagtttagattcaaaattacagctaatgtctccaatggcgaaaaaacataatatccacactattttcttgtaactattaatcaaggattaaatttctgggatgttaaaatcccttaaaaacttgatgtacataaaaggcactgacaaggtagtcaccttctgacaggttgaaactacggagtttaagaatcaagattttgtttgtcgaaacttgtgcaatgaagaaaggttatatcttccatcaaataaaaaaagaagggttatatctctctggactatacatgccatttattgatccaattcagaatttgggaggaatatataaatccatcctaaaagaaggccacacagcaggaaaaactgaagccgtcccatactcagagttggattcaaaaactgataacttgtaatacatccatgctgttcagaaatttccatagacatcacttacgttattatccaactatgttaactgattaagcaaaagcatacacaactctgtccagaaagaagcagcccagtagcagcacgggccgaacgaaacactcagccagccaaaacgaagaaaccacgtcagaggtaaatagcatatacaagggcaagaccactaagttcagagaacactaataaagttaggagaaattgataaaatagaattcagagaaagaaattctgatacctgagccttcatggcctcatcagcgtgttgatgcttattccgatagttggcccattcctgtaaggctggaatcaaagcaaacatcaccggagccatcatgggcgtcttgatgctcaatataatcacagaaaccatattacccaaagcgcaaaccatgctctcaaaacgaacaataaagaatagggagccagctattcagcttagcacgacttgctgatctctgaatggaagcaacataagtcaacataattttagtttcatgtacctgagctcaacataaaacaaacagtaactgaaatgtgccagacatgttagactgcttacagttcatggtcggtaggatgaatttgacacaacaaccacatttgaacatcagacttggcattgttcgtacttgtactgcccaacaaaaaataaacagcttagtagtagtagtagttctggaagaagtcagtggcagcagattcaagagtcaagacaatggatttgtccattttgcaacaagttactcttgagcatgacatcaaagatcagtgagtccttgctagcgataacaatgtgccacgatctgaaaagacaccaaacaggcaagtgaacaactcataaccaactgtttccagctcaaagtatacaatttaacgagctatgcacttagaactaactagtttcaaaggttgtaaaattgggtttgagttgtgagcttcagctatgctagagagcaacataatactttgtaaagaaaacccgaaacaatacgataggataatattatatcaagaaggttctttaaatatttagcaatatccattttagcgtagtagccacttcatgttttatcaattacatcaactattccatgaatcaactgagcctgagaagttagcttcagctatgccagataattaacagaaacctttgtagcagctaacagataccagatgcatggtcatggttatttcacaagtcgaatctcaataataaaatttaggttcttatttccaatgccatatattcagtattctctagcatacacaaaacagcctttgtcaatccatataacaaatgttgcagttatattatgactaataagatatatagaagctgtaaagaaaatgcatacagcagataagcaaagtcttagtacaataccaggagtgtagaagctcatgtagggtaagatgctaaagtagacctcaggctctgcaaccttcttcaccctccttgacttgagctcgatcgtgaacaagccaacacctgtgctcacgaatatggcacccataccctccccagagccaaccacaaatgcttcatcactgagattggcaacaggtatcattttgtccagcttgatcaccctgcattgtacccattctgctgccccttctgaattcaccttccgtgaccacacataaaggctggaatcctcaatgcaggcaaaacccagtgaaccgttctccatctccatgagggcaatgccatacacgtctggcgacggcgagtcaatttcagataagcagtgcatgccccagttgtacttgatgatggcattatcctcccgaagtgtgaagtagatttcatctccgacaagggcaactcgcctaggcatgacataaggtacgcggtagaattcacctctactctgtgcatctcgccatcgctgttcccaggaatcaagaccatcatcaagaactaccggggtgctccacgccccggtctccgatgagtacatgctcgccttaacgagatctttgtactcatcacgggtggatcagaaacaaaaaattagggaggctcaattacacagttttttcaacctccagccatttagggacttttagttcattcatagtgaaaaaatcgaagggggtgctccggggtatccatgagttttgtgggtgtaggtgttggatccgccccgtcatcggtggccacaaagaccactcggaagggaccgccgtggcagtcgaggtggtcacagccgctcacggcacagaacacagcgctggagtagatcagccacgggatgccgggctctggcacgcggtgctgttcgccggtgacggggtcccagacaatgagataccaatcatcgtccgaagcgtggaggagggcacggccatggcggcaatcgagggcccggcgaaaggtgggatcgggcgagaggggcactgcggtggtgcgggcgaggtggggggcgggggctccctgtagaacttggcggcgtaaaggaggccgagcaggggaggggatcggtggaaggcgcggtagcggcggaggaagccggggtcgcagatggcgcggagccattccttgcagactagggcagcgcggaagagttgctcgggctcgtccggcgggaggcggaggaggatctcggagaggagctccggcgcgagcgaggcggtgaggtcgtccatgacctccggcgtcggtggcggcagcgccatggtgcgcccgtggtcggcggagcgggggcaggcgagccgcgcgacacgagagggtttgggtggggattgggaaagagagagtgagagaccaagaatgggcaaggggggaccgaccgcacgcccgcacccgcgctgccttctacccggtccggttcgaccctatcctatactacaaatttgggtttgcgaaccttcgattttgagtaaacaaggcaatattcgtttctgttgaattttgatctgctttaagatctgcattggatggtgggcctgcatcatggactgtaacgtgatactcccttcatccacaaaagttacacatattatttttgacaccaagacgtaatctttcacattccgccaaagaagaaattagaaaaaaactataggctgacgccaaagattccatccaaaaaaaaccatattttgactgtgcttcaactatatcaactgtacttgaactgttggataatcatagtcgacgataacatcacagttcccaccgctattccaaaaccgtacatgaaaccttagtttcatacggctcctctatgatcagaaaaaaggaaagtactttttcatttcattattatcttcttgggcgtagttagaattatctaagataaaatcgatttcaacgtcctaaattagaccaaaggaattctgtctgctagaataataaaaaacgcttcggaattcatctcatcctttataatataatggtatttttttctttgttcagcaataacttaatcttgaaatgaaacactcgttataacaattaataaacgaagaaattaaatcatcttagatgttacaaaatcaagtagtaaatgtaaacatgcaaccaatgagtatttcgaggactccttaggatctaataaaaacatttaatttatctcttcatttaagtcctgaatgtataaagactacaaataggaacaacttatttggaaaaactcaaatatgaaataggtgtaactgttgtggatggagggagtagttttattctcaaaataagtagtctgcaaaacaatgtgaagatgatatttatcatggaatttgacgatgtgtttggcacgacaagaaacattttagcatagcaacccatgagatggcccactacctagtaccacagtgagaaaggtgtaagactgtctccaacagagaaggcaaaacgcaaaatagctcgtgcacagttttttttgcatgtcagaaacagcctccaacagacgacgcaaacagaggaggcattttgcgtatgaggagagagagaacgcaaaattgcgtcgtctctctccaagacgcaatcgtctgcacggcgtggtggtgggcctgaagattcgcgtaggggcgcggtggccagcggacgatgacatcgaggcgagcccgcggccggcgtttccaggcatgtccgcgacggggcgaggagggccgatgacggatcctcgtcggggggcggcggcgcggcgcggtgagcctgcgggcggtgcttgcacggcggatccatgtcggcgaggcgtccacgtcgacgaggcgaggaggatccgcgtcggtgcgaggcgcggcggcgaggcgaggcggatctacgtcggtgcgaggcgcggcggatgcgcgtcgacgtgcgtcagggcgaggcggcttgtcgggcacggcgggtgcgaggaggaagacggaggatttgcgttcgtttgttggagttggctttgttttgggtgcccaccttttcctttcaacgcgaggcataccaggtataggtctcctattttgcatcgtattgttggagacagtctaatagtcggtgaggcaccttgctactagttccattgagaaagaagacgtgataggcgctagccgatgaggcaacaaaatgttttgtacggtgtcaacgatatcaagtggattgtgttaagacgaccacttaatctaaagcggggtgtggcaatatagccatagcttctcgcagtgttagtggtagggattctttttttttttttacttgatgtagggtgactaggagcacctaatttgtgggcatcgtttttattttgttgcacgtacaaatcaaaatgatgttttataatgattgattaaaaattgagtggatataagttgataggcaaaaaaaaaatatgttagggtttagctagttccgtgatcagtgtcggatggttaactggttatatcgtttgtaaatattacggttccttaaaactcctctctattttctgttgttcctttgttacaatgttttggtatatgttcgcaaattctacacatgcatcattatgttaattgtcatcaatgaattatatagtaagttgctcattaatattgcagcaaaacaaaggacaattatacacttattagaccctcttttatattaatatattagcatataggctaggccatctaacaaacctccaataagaggttactcaactgtctatttttttcagccaacaggtaaatactattatccggttatttggaaaaaaataaaagataagtaataaggtctttaaaaaacagaaataagttacgaaaagaaaagactgggaacaccagctcaatataaatgttctccaattccatcagaggttgtaaacgatgagacgctcatcctttaaccctaccacgattcaaagaaacaaacatagacaaattggagcagcaaaactagtcacatcctcatatcctctggcagtacataaccgctccaacttcttcaccagcttctcgtggacaatgtctagacaggcgcggtctttttgttttataagcactttccaactcatatgaaaaactatcaagacaatttctgtctatttagaactatatatataaatttcaaatttcaatactctcatgaaacaacattatacaatcgctaagttataagatagaatatggtgccaaacaatctagtatcaatacgattgacaaggagtgaaaaagaaaaactatgcagatggtccagttagccacgtaactatactgtagttgtacaaaagatgaagatgttctatcaggacatatttagctatgggaggggatgatttgtcactcgtagtcagtcactctcaccacaacttcatcttcatatcagcagcaggccagttagacaacatcttcagttcatctgttcttattgcatttacacatttggacaaacgaacaaatccaattcagtatgtacaagttcttcagcaagcggaccaaccttccgaggcaaagcatgtttgcagagcatagcatagtacatcctgtaaccttgatggtttttcatatgctgtatgagaacgatgaggtcagggagtaagggatccgcgtcaccgtggcaggctgctgctggagcttgtggatgtccttcacgatgtcgaacacggcttctggctgcgctagcttcagcgcgttgagggagtatctccggagctcgtttgtgtgtgtggtgaaccatctggcaacctgtctcgcggcttccctcgggtccttggagaacacaccggcaccattgtccacgacgtaaggcacattcccgacttcctgtgcgacgacaagagggacgatatttgtttagcctcaatatcttggccatcccttctttcaaaaaatattttggcccactcacgtgtatatataaccatggcccatatacatgcattccggtccatctaaacaagggctccatttgattttttttttctgagagcgatgtaattgccagactccacttaactaaaacagggactggatgactctttttttccaaaataaagtggagagcgctacggctcggacgtccgatatctcaccaaatattggacgcccagccgcagcgagcgtatgtgtgtgtatattgctgcacttcattcttcactcctcaatcatgaggaatcttcccatctaacgtcctatgtcccaaagaaaattggttggtcaaatgttctagttgaccaatgagtgaaacatcaaattatatatggtgaaacaaaaaatcagcaactgaaacatttaaaaattttatgaaacatgaaaaagatacatgttgaaacatatcgctatcacatataaaacaactagtgttaacggattgaaacatatgtttttctttcatcaaaatataatcatatgatatcttgttgtaaagatttaattacaacgaatataccgatgtgttcggatcatagattggataattagtttacgagaaaagttgttttgaagctcgctaaaatgcatgcatgtatgtatgaggtggagagaggagagagagtagtgagatgtagttccacgaaatttgtgaaacatgctgaagagacatattgaaacatattactattgcgtatgaaacaaagagtgttaatggattgaaacatatgattatttttaatcagaatataatcatgtgacatcttgttgtaaagatttaattacaacgaatacaacggtgtgatcagattgtagattggataagtaatttaagagaaaaattgttttgaatatcgttaaaggtatatgtgtataggcttgataggatgtgtgtcagactcagtccatccgatttttctccttcagtcggacgtccgaggagaagcattttcgaaataaagtacgcacgcatgttgtcatattgggcctgttcggtcggcattactgtgaatgcagttgcagttgctgcaacaacagtgtacacacgttttgactactttaaatttgactatgtttatgcacaaatatagtaatatttataataccaaattagttttattaaattaataattgaaatatattttcataataaatttgtgttgagtatagtcttaaaatcagaaaaacaattttgttactctaacgaattcagtatagttgcatccgcacacacctgtccaggtatgaagtcgttgagaataattgggagtcctcttatcagggcctctgcaattgtaccaggaccagcctgcaaacaggacacaaacattcctaagtaaaaacagtaaaaaaaaaaaaaccatcaactcctccatcagtccaagaaccaacctttgtgatgatgcaatcgcaagcgcccatccacttctccatctgcttttcgaaccctctaatctgagatcaaaacaaaaagagaaaagaaaatgtaaaaatgtcagccagtggtcactaccaaacgcagtaagagcagaaatgcgcatctagcacggcatcatcctccccagattcggcatatacatggtaccttgacagggacattccaccgtgacgactgcagcgtggaccgcagcacctggttcctgccacagatgacaacgatctgcccgacaggccggcgtctccggcgatcgtagagctcgtcgctgagtgctctcgccgtctcctccaccggacccatcccctcgccgccgcccatcagtagcactgcaggcaggtcgggatccatgtccagctctttcctcagctcatcctgtcaccccaaaccccgagcagagttcagttcagctctgcgtcagtgcaatgcagcaatgtgcggctcatgaagattatctgaaaatgcgcggcaaccggatcgaccgaccttgtcgagcacggcgcggcagaaggacggcctgatcggcaacccgtacacacggatttgggacggctcgagcccccggagcagtgccctcttggccacctccgccgacgggcagtagcacctcgtcacgccatggtggaacctgcacaaataagctctatcgatcaatctgagatcgcgccgcgccgtggcgaggccggcgagagtgcgtggctccggtgaactgaactggttaccatgtcgggtggcaggtgttgaggtcggtgatgacggtgacgaatggcaccttggggtggaggctctgccacttgagcacccacagcgggatgtgctgcatcagcgggtgcacgctgatgataatgtcggggttgtacctcatgatcccggccaccacctcgctgaaatcaaccatgtcagttttcgcgaatcgatcggatgaacagagacggaaacagaacgtgatttggattggacgatcaagttgtgatggctgcgtgcgtgcgtacttggcgtagaaataggccagcgcggcgaggtacatgccgtgcacccagcgcggcgaagtgccgtggaacgccaccttccagagccggacatggcggatcatgaacttgtacgaccgctccatgtcgttcagtggccacccgccgtactccttccccaaatctctcacgaacacctgcgcgaaagcaattcagttgtgattggagttcaattttttttcgcgagaaatcaagagattcatcaaaccagtttacaaacaattcatgtgattgtgagttcaaatgttttggcgagcaaattgaatttgggggcggctgtaatttcggagcggggaggagaggaccgaggcttggagcgcaaggaacagcgggcattgagcggacggaccgaccgacctggtaggcgtcgccgaactcgaggcggaaggcgtcgcggagggcctcggcggatgcgcggtggccgccgccggtgtcgctcatgaggatgagcacgttcttcgccgccgccgtcttcctcccgcacgggagggggacgccgccctcggctccatcctccgagagcgcggcggtgaggccgcccccggcggcgccgtcgtagaaggcgcagcggaggggctggtagagctggcggcctccggcgccgagcacgccacccagcacggcgtcgcggatggagcggcggggggtggcgaccgagatcaccatggcggcggcggcgggggcggcggcttctcctcctcgtctcgtggatcgagcctacgaaaggtttgccggcgaagagagagagacagagagagaaggcagggaggcgagaaggtggcgaggaagggaagggcggatacgccatttatcagtgctctcatatggattacttcaaattgccccttatcctttacatatttcttgttccaggccatttcaagttttgttccaaaatattcctctggctagattattaataagtatatagtcgagaaaattttcatgataacatttactcatctctactctatccaaatttcaaattcttaactagtcgtcattcgtagttacagagaaatataggcatttatgcgacaaagctgggttacacggtgcccaggcaaagtacaagcgggcaaggcaactcgggcaggcagtgcaaaaccacgaaaaagccccagagcgtccggtccacgtggcgaaatgctagtggccgaacgaattgcttttggggggttgggcacgcgcggctagcgggcgaaaggggatgattccgtcggagatgctgggattatgcttggaggattgcttcgttagcctcatgtctgttgctcaatgagtcgatcgagtagtcttttaccacacgcttaaaaaggataagagacagaaactggtgacaaatttctgatgttactaaacctatttgcacttgcatgtgctttacatttgtgggaatcagaatttaaaccttgatggggtggagtcatacacgtttaacgtctttaccaccacagaatcagtgcttctttgtctttggcttattttatttgactagtacatgataattatgagtatatgagttaaaggccctgtttagatcctccaaaatggtaaaagttttgccattttgaagcactttttgctattttggatctaaacactagtaacaaaacttagcaatttggcatttggcatttgctagtccatagtagcaaattgtgccaaaaagtgctttgggaccactccctctctctttctctctctcactttagtgctagaatggtaaaagtttaggatgcatctaaacaccaactaatacttttgcaataccaaaacttttgccaccaaaacttttgccatttaccatttgctattccaaatggacctaaacagagcctaagtattatgtggaaataatatagtaattctaaagaacccgtttaacaataattgatgaaaccatttgaattttcaatacttcaaaatctatagaatagctattacatgttacaacatgctcccttactccacaaataaaagaacttaagtttttttattttcaaaattaggatggaactatgatgcactccctccatttcattataagtcacttctcttttttttctaatcaaacttgttaagtttgaccaattttatagaaaaatttagcaacatctaaattatctaattaattttattaaatttaatattaaatatattttgataatatgtatgttttgtgttgaaaatactattatatttttatataatcttgatcaaaattaaagaaatttgactaagaaaaaagtcagacaacttataatatgaagcgaagggagtacccattaaattaggggtgtgtgggaggataatattggctaaatattacatgaggataatgaaaggtggttgggtgataaagtaatactctaagtacttatatttgtgaacagatggagtggtaaatatcagtaacaaggttagtacaacactacacaaatttcagattaacaaataagttttagactaacacactcttgtagtcttgtgttccttcctcctgcatctagaactcctagaccctaaaccctcatcatataatcaaataaaaatgacatttttcatatttctatgtttacaattgaagttggctattatactttttatgtaactgtatatgcatgactttagctaccagtattttagttatgatatttataattagatggatatgtgcattcacttttttttaataatggaatataacatccctgtctttgctcaagagagttacaaccaattattacagagaatgtgcattcacttattataatacaagttttctcaatatttacgaattagaacataaagaaaatatattctcattcgttgcagcccaagtgatgaggacatcctacaattgatacaaacatacctagtgcataacaaagaccaatgcatgacttgagcttgaacacaactaaaattgttccctgttattcaaacaaattctttttcgaatgatgattttattatgcttaggaacttgggacacgaaccatgtgggtgaaggaacagccacgacaatgaacaagtggaggccggcatgagcaaaggaaggattagaccaaatgattgtactacaagttcggatagcacgtttggacctccaagcaatggtaactttaattggacatagctctttactctggagggtgttgaggtccatgagtacttgttgaaaatgtcttgatgtcttctttgtagatggatcaagaaacactactacaaaaataatttttttacgagaacctctttatctgccaccgtaactggttgcatctgcaaaaatcatcctctatttttacgtgaggctacttaagaagactgcacggaaaaatcgattttcgcagacgggccttttaagtagaccgtacacgaaaatgagcctattttcgtagacgggcctcataaatggaccacgcacaaaaatatcactatcctttacagatttttttatcccatcatttctctcttttccctctcactcacgtcaaaattttcacctcctctctctcactttcccttttattttcactcttctctctctcttgctctcctctcctctcctctcctcttctccgagcgcgcggctagccctaccgcatgcgaaaacccctttcgggttgtccgcaaaaatctcttttataatagtgaaacaccaataaattccatcaatgttgcctagaaactacagaagagatgttcaagactctaacccgcgagttgggcctcttgtatctagaagagcccatcaagggagtgtcttagctagggtttcccatacctcctactattccccccatatataagatagcagcaaccaccaagaacacttccttaccttttatttagatgcaagtttcgcttcagctacttccttttactcacgtgtattggctagaccacccggatgcttgatttagaaccccaactttgtgtgtttgttttatcatctggcaagtgatgtaaatcgtttccttgtcaattggttcttgatgcctattcttttattgcttgcaggttcaaggttgtcggggcccaccctgtcttgataggtaaggaaactccggcgatcgaattctatactattacatttagcattccaccttctatttccagccagatagctgcgatttttagcaacaactatttggattttcaacagtgctgtcatggaatgtagaaaggctacccaacagccctctcaagcaccttactgctgacaatactatcacaattgacccatatatgccaacaaccttgtcacagttagtaccatgatgccatttccacttcaatggatgataggcttgttgggaatgtaccatgacaactagacactagcaatctgtcggagatatgggcccgggggtatgtggagtagaggggaattactttccctccggccacgtgactacgcaggctggccccactcgcgtgccacgcgagtcgtataagcgcgcgggggggggggggggaatatttcttttctcaatcttgtcataatgatacctgtttccaatctcaacgatgaatcatttgtggttgtctctggggagggtattggtgccatattcttgatcacaggggttggcttgttcacgatcgaccttatatcaaggagggtgaaaaaggttgcaaatcctgaggtctaatttagtatcttaccctacatgagcttttacactccttggtattgtactaagaactttgcttatcctgttgtattgcattttctttaacccctcctctatgtcctaattatgccataagataaactgctacctttgtgattnattgtattctacacaaagcctgattttctcgttttgttaaaaaaaaactcgtgtcttcttggtattttgaaatttaacaccttaatttttttttttttgtgaattattaattgtttacataccaccatatacatttctgtcttcgtttttatgtaataacttctgtccttgagactactacgttatataccttccgatacattcaaccg

SEQ ID NO: 34276 - DNA, 15109 bp, Oryza sativa
  unsure (1)..(15109): unsure at all n locations
gcatgtgtttgatgagtagactcgcttcttctgcaagnacttcattaggggaggggggggggccctcgagatatgacgtcaccctctcgggctctgccgcagcttcgccccgaggccctcacccgactgccgtgtggcagagggagagagcaagaggggagcgcaggctgagcaagccataaatgtgcgacgccccaactgtccctcaccgcatttaatgcggtcagggcagatgtgcggcgtgcctagctaacccctgtccatcggatgtgaccggtctgtgaccagcccgtctccgtcacatccgatggataaggcaaacatgtccccacgtcgccctttgtccccggcggagtgggggtgagtatgacccatcacatccgggcgccactcgaggaaggactgttgcatgtcaccgttcatttatgagggaatgatagggctgtcccccgtgtcaggcgggggacggcaccgggttccgcgcaagaatcggttattgcttagcttccggaagaaggcacagttggaagccaaaaaaggtggagtggggtttttcctccccccccccccccgcgatggaggggaggtagaggcggcatatgtggtatccccttaagctataaaaggaggaccctgcccaccgaaaaaagggggaggcccagaaaagcctgaactccagaagagaggaagcgagcgcgctctctggagtaaagaaacccttgtaaaacttgtccataatcccaaacacaggagtagggtgttacactctatagcggcccgaacctgtataatccgacggtgtgcattcactcctaatagtcatagggacgagcaagcgactaacgagagacgagcctccgcccccggccgaactcatgaaaagggggtctcacgactccctgctattgagggtcttccctcaacacaatcaatgtatgatagtgctgttgcagatatattttgtatatattttttaacatataagttaaaaggcatgaatttgccttaattttccaagagccaaatatattccctttattattcctctaacatattacttgtgtgaatttgacactcaccattcacgatgttgctttaaaacttttgaaaaagatacacaaaacttaattagagtatttattatattcctcataatacattttgttacgataaaaggcttttattttcttaaaacatgtactaaaaaagatatcatgatcaaaatattgaaatgtgaggcgagaaaaacaagaagaaatgtgaggggggaggaaaaaagagagaaaaataggcataattaggaagaataggaaatacatgagaaaatggaaaaaaaagaagaaaataggaaaaaaatatgtgaaattttaaaaaaaatatagggggaaatagggaaacagatgggtcggttgggcaatgctcatgcttgggtcgtaccttgtcggaatatcggcaaccatgccgtggtgtgccaagaatttatataagatactttgtgtatgtgtgaacttttttgcttgtaaatatataagaagaaagtaattagtttttgcaataatttcaaaatctgaatttagtagttacaaagttatatatagaagcaactgcgtattcgtaccgttaccttttatgttattagcttaatagttcttagatttgaaattcataaatacaaagttttactccttttcaaaattaataagttccatccttttcatcaaaactaataatgagtaagtcctatatgggaacaaatttataaatagaatgttgtatttgttgtggagtgataactattttgattttattcttcaaatttcgaaaataatatatacaatcctgtcaaaaaaatgttatatacaacgttgtatttttcttgtagtctaaatatcagttttcgtgataaagaactaaaatttggaattgatatacatatataaatatatatgtaaaattgtagtcagccaaaaaactagtattatctaaatctctaaaaatctagtatttccatccacttattacaattttttttgaatattttctagaaaatttgaaccagctttggtctaaaggaaataatgccttcgaaaaatacatctaaaaatctagtatttccatccacttattacaaatttttttttgaatattttctagaaaatttgaaccaactttggtctaaaggatttttttttgaatattttctagaaaatttgaaccagctttggtctaaaggaaataatgccttcgaaaaatacttcaaaaaaattgtggcaggaatcgaacaagggaccttgtgtttctcatcaggcatgcatgccaattttattctatgtgcgcgcgaaaataattcacttccctcggtttttccgcaggaaattttcatttccccctaatcccgctacacgatggcgattctcctataaccccgcgaactagatctcgcttctctctccaaagaagtgctcgctcccaagatttaggatcctaactgtcgtttccaaattagtttacttgagctacctatttcgtcggactttccagacagccatctccaaaaaaaaatcaccacgcagttctttcgattctacttggcgacgacatccatgtgttgaaccatgttcatcttcaacaacggtgattcaagggagagccggtgtcatattgcctgatgcaagcatcttgtagaccacaatcacaggtgcattttcttttgactagaagctgttcgatctatttccccttccgtaacttgagcgtacacgcatctgtgagttggtgtggggaacggggcgggggttgaagagcagtgctgcaatgatgccgccgccggtggtagtgaggtgtggtgaatggaggctgcggtcggctgggcacgtggttgtcgtaggggtgaccggtggccggtagaaaggcgccgggccaaggcgtgattgcacggggtggagatggccagccggctaggaagctggtgcctgcatctagaaagctagagactagagtcctagagctaaggttgtggttagtgtttcttgattactgaaaatggatagatgtaggaggagaaaagcattggagttctacaaccgacaggtgcatgtttctctgtactagttctattctctgcttttgtagtagggaggcactggatagatatctttgtttatctggaatcttgttggatgttgtggcaatgcacctgctatggattgcttcacatggatctgcagctttacattctgtaattggaactcagtagatacattgctcttttacatcagtctagattcaggatcactaaattgtattatcagattatatctaacagctaattgaatttattgtgtcatgatgtttcttggatggtaaaaatattaatattgtttcacagttggaccaaatgttatatgggtaagggcacctttggatgcacaggttatgtacgaatgcactggacgcaaggcacatgggaagtttgcaatggcggatggtgcaattgatagctcagaagtgcaattatccacaaatgctcatccttctcacacttacacagttagacctagccaaatagaggttgaactgcgtcaagagcttgctaatttcaagcatcagcgacaagaggattgccaatcaatacaaaatgctctatctgagttcaataatcagacaaaggaggttattcctcttttcatgatgctatattactgttctttgtttttactgcaatgtgaacgtgtctaactattgcctaatgaattcttattagtatatgattaatggatctgcaagtacacctccacctcagatcaatttggctgcattatttcctagccattcatctccaactactcagcaggtaagaatattctgaaaaaagttttctactacagatctgtactactttggagcattcatccatctttgtttaaaatatatatgtttgactaatggcatcatattttcttttattgtagaatactacaaataatagctccagaaatgtgttcaaccaaatagatggaaataatagtggaaactgcagccaacaagatgctggtttgagcaacaatgaacaggtattaacaaatctactcttttggtagttcctttttcagaatgattgataaagtaaaaaacttgtaatcatttgtcaattaaattgtggaacttagtcaatagcaatttctctgtcttctcaagtgtagatcaatatgaccatggaacattatattagcctagctatttttttgtacccacactataccagattatgcatatatgttacatacataattaaagataatgtgttgattagatatagtatgacatatcattccacatatttaacattattctagctttttcacttggagcttttattgagggccggaattgcttgatgtgatgtatcctaaaaaactgaagtcatcaatctctagcaaaatttacaattttcttactagctagaagtaacttttaccaagcagctttactatgttttgtcaaaaactagtttgatcataatcttgcgtagtcattgatgatcaccacatgagagtataaactagcttgtacaactaaaccattgtttcatatgctgaaccatatagacattaacctatccatagaacactttccaagtagactatatctgtttcaaacatctttagaagatatttttgtactgttagctaaattggagattggagggatacattgtcacctgatcctttttccttttagggtgacatgggaaacaactctgaaaatgtggtgttacaacgcatggatggaagcacatttggttattctagccaacaaactgctcctgctactaatcaaggcaacagtaagcgagggagagatggagactatgttgatagtgaagatgattatgctgatgatggaaactatgatgatgctgatgaaactcctgaaccgttcgttgctgcagttatagttgattatccttgtacaaagtagtgctcactgttttatgttggttaggaacttcaatttacttatccttagtgcaagacaattacttttatttaggaacgatgatttatgtttttattgtgaaacctaatgtcagtacaatttctgattatatgtgatattattaattaagtcatgagatcactggttcaagttacctttgcagtctgtaatagtattgaaaagtgtagtgctatgaaaatggttggaaatggcagtggttcatttataataaacataattctaaagtatatccactgatttgatttttgacagtgctatcgtggaagcatctgtatccatgacatgcctattgtggttactgctataatacccttgttttattttgctacttgtgactgtgttgtcactatgtatgttgaattttctgacattgcagtcatagaagggggctagctggacaccatgttgagatagcttgacaccaagttaccccaacaatgtgggcagtcagtaaacaagaaccacaacatggctgtcaacgatgagaccatatccccgacatagcaaccccaacaggaaatacccaagagctggctgttgacaaatggcatccgcgacagtttcgtacctttcaccaacagttctaggctgttgcggttgctatagtatggtgttcatatcctccacatgaacctataatagtttctacatataaaacaccacatattcaacacgcactgcaacgcaactaagttaggcaaatcacccgtttttacatcacatagttatccaaatgggaatataaatgaggatatttttagcatattaccatttgctatccagggtgagatccaacacggcatattgtacccccaggctccattcgaatgagatgcagatattaaaccttctctttcgcgtaaaacaagacgagtcattagcacataataaattcagtattaactagtacaaacttaaaatggtttaattgatttaaagaaagttaaaccagaccatttaacagtttgggaaatatgctcatgaaaaatgatgaagtagcatatcccaattgagccaaatcaaagatatagtcttagtcggctgtaggtataacagtaaccctgagtatcattagttcattaatcattacaagaatgcattagcatggcagcatgctaccgtaacgtaggttaattatgcggaaatacttaaaagtttgtaagaggatgtgcgtgatagtgatattatccactcatggaatcatctcgcttgtgtacttgaccaaagagggaatatgccacggaaggcagtcgctagtcacaaatgtgttgttcagggctactgatttggaattcctttttttggaaggcagttccgtttaagtttgatggagacgagcatcaagtaaaggtaaattgagaaaaccattagtgtttgattaattgagttttatttatttttaacttgaaaaataaatttatttggtattttatagcaacttatatattgaaagttttcgtacgaaacatatcatttaacattttaaaaaacgtgctaacgataccaaggtctaatatgcatcttaatcataaaacaacgggcagaaaataggatgtgctcgtatcattggagaggatctattgagcacaatccgcagcaacgaaaaagattcggacaatgatatatatattgcagaataaaatagtaaacactagtggccaggaaggcaggaaggagcccatgcaccaaattgtaagtggcagaggataaaaataataataataattgtacgaggcataatcctcggggtggtatacaggcctcagatttagaaaatgtgctcaacttttcatccaagtagaattgaattcagtgaacttttcccctgtcgctgctagaacaggctgtgacaggtacatgctatgttttccctaggatggtgaaatacggttatttgatgtcatggtccttgtaaacctttagtatgagaatgccatttcattgaattcgtgggtggtatatacctccacatcccttaaagaggcaaaaaaaaaaagagaattaattagctaaacggatgaaaaaaagactggacgattggcaaggtacaagatggaatttttgacataacatttgatcattggtcaaattaaaaatacaaatatatattgatcaggtttaaagtacatttggtaaaaaaaaaatcaaagcaataatacatatcacgataaatgaccaaatatcatgtctaaaagttaatgttgccatacattgaaaaaggagatagtatatatatataccttaactcatattgttacacactaagtacatatagaccttgcaactgtttttttctctctctaaaaataagttttgcaaaagaaatcaagtcagcccaactgattcttgatttgttttgtgaaacaacgccacaacaatgattccacgtaagctctatagactcaaaagatgtacagcagaaaaccaaataggtggccgcatgcttaaagctgattgagtactctttagctcgttcgaaaacaccctctgctttcttgtcccgcacttgtatgttcagacacagtgttcgttatgtgcaccgttggtaggcaagtggattttcataattttatggaacatgcttgaaatacagcagctatacacgaagcaagtacactttcagtaaaataaaaaaaatcaactcctgagaataaatgtggataagcattcatccttagaagttgagttttctaaaacagagagtagtattcagcaagcatagtagtgaattacttaaccctagttggaagcccaatttcaagcccaataagatggtaaattgtggtacctgaaactttttaaccttgctcatttgccatgagaaagaagtaaaaaattgtaaattttacaaaactatagatattttaacaaaattactgtaaaactacatatttaatatatagtatcgcaaaaatacatattcaaaaatgattttatagtttcttagaaaaagaaggaatggttttatcataaaactacatatataatctatgctatcttcaaagtataaatttagtgttgtttttttccacaaaactatagattttagatgctcccttcacctattatcatggtaaatttctaaaatgtgtagttttgcgaggaaatcaatgctctatctgtagttttatgggaaaaaaaagatgacactaaatccgtagttatgaaatataatagcttaaatctagagttttatgataaatttattactagatctatacttttatgatactatggtttaaatatattattttgtgatagttttataaaagtatttgtaataaaactatgttgacttttgatataaacattatacatagagaatattaatagaaatcaaaaaaaattttagttataaacttcgtttcaaagaaagcagtgacatcctgacaaaaaggtggggagcattcgcgcaacgcctgcagggcacccacccaggtagctttgatccctgcatcagaaggggccccctaatgggcgatcgctcgcttggagatgggggcagcgatcaattcgcccccccccctccagcctccctccctccacttggttttcttttttggcaccgcattactttcctattttagtaaatttatgcacctaaagtttatacacctcaagtttacacatctaaagtttagagaccaaaagtttataagtcaaaagtttatatatccgattcaaatttgaatttgaattcaaatatttttttatatatagtatttctatacatctaaagtttatacacgtaaagtttatagacctaaattttatatatccgattcaaatttgaatttgaattatatccgattcaaatttgaatttgaattcaaatatttttcatatatagtaattctatacatctaaagtttacacacctaaagtttatagacctaaagtttatagacccgattcaaatttaaattatatccgattcaaatttgaatttgaattcaaatattttctatatatagtatttctatacatctaaagtttatacacctaaagtttatagacccaaagtttataagtcaaaagtttacatacccgattcaaatttgaatttgaattcaagttttttatacataaatttttttaactttttgtttttttaaaaattttttgtggtgtactgtaataggaagagaagaaggggaggaggaagggggagaagagagagaggagcacagggggaggcgaggggtgatcgccagggcagcgcgggggcgatcacccgcgcgttaggatttccgcatcagaagaccatatcaattccataatgcgagccatgcagccattatatccgaccatacttaacattctctaatccacgtatccacagttcgttaccctaggtgtgaaaacgaagtagatagatcaaaacaaatacggataccatttggagcaaaatcttcaatagtctacaggggcaaagggagctagatagaagagggtgtgcccagaaacccggtcaagcaaatttatagttatagtttatttattttcaccatatgtgctcaatccaaattcaggcgctcaatcaacctaaacttggtctaaagtagactaaggcccctttgaatcacatgaataaaaaaatggaggaataggaaaaacataggattctcacaggaatacaagtgtaaaacagagaattacaaaacacaggaaaaacataggaatgactgtttgattgagccgtaggaaaaacacaggattttgaggagagataaagactcaatggattcttaatatgaggttctacctcatgctaaatttcctccaaaacttacatgggaagaggcattccataggactttcataggatccatatgattcattcttttgattcaaagggctatataggaaaaattcctataggaatgaaatcctttaaaatttctatgaatttcctttgaatcaaagggggcctaagggtgagtttgaggaggaggagattgggaagatacacaaaacgaggtgagccattagcgcatgattaattgaatattaactattttaaattttaaaaatgaattaatatgattttttaaagcaacttttccatagaaattttttgcaaaatacgcaccgtttagtagtttgagaatcgtgcgcgcggaaaacgaggtgtttactcaccctatctcacacgaatgaacgcagcctaaggccctgtttggttggagagatgtcccttaactttggtcccttccgagcataggactaaagtttttagttagggattaattttagtctcgggactaaatgatccaaacagggcctaaacggtgtgtccggcaccctttttctcaactcctctcattcgttttccacgcgcacgcttttcaaactgctaaacggtgtatttttttgcaaaaaatttctatagaaaagttgctttaaaaatcaaattaacccatttttgaaagaaattagctaatacttaattaatcacacgctaatagattgttccgttttccgtgcgggagagattagttcccatcccttcaaactgaacacaccctaaagtaagcgaatgttacccctctctatttcgttccggcttcatccgtgatagtccatatacaaatacaaacacacaacaaatacagatgatttcatgacctttcttccctacagccagccaacccttatccaaccttattgtccggcacggacaagcaaacagtacgaggaacagaagcagcatggcgcaccagcgattctatcgagatatgcacagcggagacatgtaaaaacattaagcactatgtgtagattaatgttagctaacaaactttcagtgtgtactacggttgaaatgtcaaatttatgcatcctaaaaccagaagcatcatcatgtttttaaatagaatgacaagtctgaactctgaactgaatgtctgcataagagtacgtacaaaggcgcatattatacctactcatatttaccagaagacggctgtatggagttccttttttcacaataaggcgatctttaataagcaacaagagaaacaaactgtaaaaggaaacacctttttcagaaaaatcattacattcaattcacaatccgatttcgcaacacagcacaagcaagtacactagaagagtgaaatcttcagtggacaggcaacaagatatggctgtgttcggcattgccggttcccatcctctccctagcttttcacgcgcacgcttttcaaactgctaaacggttgtatttttttgcaaaaagtattttacgaaagttgctgaaaatcatattaatccatttctaaaaaaaattagcaaatacttaattaatcacgtgctaatggaccgctccgttttccgtgtgtacatcctgtgttgggaagactggcttccgaacgcagccttagggcccatattatgtggagggatgaattggggtgctcgatgggaaggcgaggctgttgcagcctcgccgccccggagcctaggtgaggccgaacatagaagaggggagactagagatatgtttaacttcttttttgattgattccaaatgactgcggtgaggtcctctaacaaacatcctaacaaccttatctaataaagcctaacaaatctcctaacaaccttatagggaggctgagttctgcccataacacgtgattaattaagtatttattaagtatttgctatttttttttgctaaaatggatcaatatgattttttaagcaactttcgtatataaacttttgcaaaaaacgcaccgtttagcagtttgaaaagcatgcgcgcagaaaacagagagtagggagttgggactagctcttgcaaacagagcccgagtctttgtgctaccaagatctatataagtgttaacttcatgataaaaaatgaaacatgagattctaatcaggtggtaccgtggtagtaccttccttgaatgtttttttctaagtaagagaagggattcaattgaaatttgcaaccaacataatgaaatcacaagacagagaaacatctaagctatgtgggtggacactaagttagagtacataagcaacttgaagaattcatgtagcccatcacacatcagaaccgttttgataaatcaggtgcattgctgaagtgcagtatcatcttgattaactgctccttttcaaatcatatacatatatagctacaaatttcaagaatcaagttaagaagtgatgcagcatgtcctgccagcataacatgtaatgccaagagtgacgattgccgacctccacaagaatgaacacagaaaatgaggatgaaggggatcccctaataatttacagggttatacagattaaaattgcaatttgccgccacgaggaagttataagcataaggaactataccaaaaggaggaggattgcgatagtggcatagtgccatcaagaacactgtttttttgggacatgagaaccagttgcccaagtcaacaaccatagacaagtagaagagaacgaagttgatgaagtgatatatgcatagcaattaggccatgtacttttgcttgatcaatctgcctaagggattagattatgcaatatctgataatcttgacatcacctaaaaagatcaggaggagagcagagtagaatgtaatccgcaattgacatgccatgtgcattgcagttagttacatatgaaaccaaagcaggaaacatatgtagtttgttggttaggcatgtaacaagtgtagcaaagatacctaaatattgctagctgtaagctatcagaaaaacgcaattgaacataacagaatcttattttcctcacaattggaatagcgaaattgcaagagacaacgatattttgcttaacacattgttattgcctcagaaacaataatcatgtcttaaaatcaccaagagtacagcaatggagtatcacctagttaaggaagaagctttccagccataaagcaggcaaacttattgctccgggaatactcatacggcacgccggccacggtgagcaaccgctcgaggacctgcttggcctgctcgggctccgccgtttcacactccagctcgtagttcgtaccaaagtcgaagcgcgtctcgtcgagctccacgacgagcccgagggtgtcgccctcctccagctggtacacggcgcgggtgttccggaacccgccgaggcagacgaacggcgcggcgtccccgccgacgccgtactcttcggagacgagccgaatgatcggggactcgaccccgccgaggcttgccgggtcgtcgacgcaggcgagggcgatggcggggtcgagaggctcctcgacctcctcgacgcggctgacgcccgcgtcgatgcgcgggcggcgcttgagcgcgaggacggcgcgggagggggcgcggtcgtcgagcccgtagaggcggacgcggagcgcggcggtggcggcggcaagggggcgcgcggcggcgtcgaaaaagaggttgcgctgggcgtcggtgcggcgaaggcggggcgcgaggaagaagaaaagccggcggtgcgcgccggcgtcggggaggcggagcttgatctcgacctccatcaaggcgggcgaaggggggagaggagaggctagggtttggggttgggattgggattggtagggaggccgatgcggtgggacttggagggcgcggcgccaggcggcgggtggagaaggtgaagaagggggttggagttggaggccggcggggtcgtggtcggagtggatgaggcggtgggggtgctggccgctgcggcggcggcggcgcggaggtggtcttcgagctcgtcgcggtcggaggagcggagctcgatgcgggtgggcttgcggcgcagcatcgatgtgaaaggaatgggttggcccggtgcactgtggtgaccgggtgggctcgggatgagattataatggagctggaaaataaactgcgatgaaaaaaatcttaaaattaaaaatttaaattttagcttgtcggtgacatgggaccgggggtatcttgactagaggtttggggcagccgcggtcacccacgtggcctgaccccctcgggggggtcgggcccgaagggtaaagtggccgcccctccctctgtctccccgaggggtcgggccgctcccgtttcggccccgagggctggggcgccccgaccccctgtgggtttggcgccacgtgtgtgggtgagcacagcggcgctaacctaaccgcgtttattgcgggttggacgagcgccccacgccgcatttaaaaaagcgtagcacgctcgttcggtctgtgacaggtcacagtgtgtgaccggtcacagaccggtcagatcgcgggttaggtggcaacagacggccttttacacgcctcgccctgtcccgtcggaatgatgagagcctctaggcactcgtccctagccggagccggcgtgctaactcctggagttagcacgtcagtcccggctagattcataccaggtttcatcgcaaccattacaaggaagtcattttatgaagaagggctgacgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtgcaatncagtncagcagtcagtcaaccatg

SEQ ID NO: 34277 - DNA, 866 bp, Oryza sativa
  unsure (1)..(866): unsure at all n locations
cgtcacttcatacaatcattatataacttatcaatttcncgctcttcttacctactcttcactttcttactttttaaatatgtttactcctattctctcccccccccccccccccgtgggaattgctnatacatcgtagaacccnnccncaacacggcaggnaanaggaaggcgcgccacacccaacgnggctagcaanncaaggcgaagcaccgcaggncccgactattactccaacaanngngcaagaacgccgagggggccaagccatgaccaatactggttgctttcagccaaagcgctttaactagaattggatcaagttgagttggggcggtcatcaaggcgggagttttcagtcaatactaacaggtgtgttatgctcggaggcggttgacaaccatattgtcttaccatactgcttctgatgaaacttcacttgacatgtttgttacccttgccatgtgtgtgatgtgatgggtgtttttgcagccggtctagggagagataccgtgaaagggataacggtaggggacagcaagaaggaaggagcctaggtggaggaggaggggtggaggccggtgggtctgcgacaagatcattttcaagcaaccttcccacaatactgcagcaaccttgagagcgtactacgagtgacgagcgtactagcacaggaggaaattattattaggagaatgctgagggaagtggtgacgcccagaggtccgagatccaaatcagcggtgggtttgtgagcttgcaccaagcatactccttttggtgcaacaagtcttcggcgtaaccttaacctcaacctctaagcagggtgtaatacaacgcagggagcgttaaaaaggaaatggacg

SEQ ID NO: 34278 - DNA, 1263 bp, Oryza sativa
  unsure (1)..(1263): unsure at all n locations
ccgccctttgatgactgtcctttanacanaacattaccccccaagaggtaacttgctcagtgttattacctttcattgcatctagatgtctaccagtctatgtgacgatgcaatgttgccaacgctgtcaaacccgggtttcgaacctatgacgtcaacaacgataactacgtgtcttttattatcgaatttcatgcactaaccagttcaacccaattacccaaaagcttaaaccggtgagaaaaatgaggtttttgaacttaaaagctctggcttttataccatacttagttacaaccaaccagttcaacctaaaagcataagacgatgaggaagcgcgcacaatttaccttttttagataatggaagctttttggtgcagcgtatcaaggtcttcgacctgttgtagagttcatgacattcaatttctcaatgcaggttggtaatgcacgaattatcaatatgctactatgatagtggaatcagtttatattgttgcttgcagcaacggattgctgttgaattttatattagtttttgtctatgtaaagcaatgtaacacttaggtaagtatgttgtacaactaggttgttaatttgctagtatagattatctttcctgcattttagttaaaccatactctaatccatattgtacacatgcttgataaagtgttcgtcactcaggatctagtgttcggaggtccaccttctttgataagaaaccctcttttttttttctgaagcttaataattgacatatatttatcaggtgtacctcattagtgtttacttctgcattatttgtaccaatgacatatttcagtttttgtatgctgtgatttcgttttaattatttatattacacattcaggcaattgatcatatcatcaattcagctgccaagtcaaactacatgtcagcgggtcagatatctgtccctattgttttcagaggacctaatggagctgctgctggagttggcgctcaacactcgcaaggtttgtgatcagggaaatgggctttatgaaattagttatcatccttagggaccccatttgaactttgtaaaaatttcattggttccttttggtgtgttggtctacccagaacctgtcctggatgatctgccaaccttttgctaatgctgaaaacttaatatccccctctccccaaaatgctggtctttaagtggtagaaaagaaacccaaagatttattatgagaagttttttacagcatgtgaaacttgactgagctgagca

SEQ ID NO: 34279 - DNA, 64808 bp, Oryza sativa
  unsure (1)..(64808): unsure at all n locations
gccctgttgtgattgcantcctgtagnaccccatcaaaattttgggtgggatataaacagggccaaagccaaagtctgaactttcgaaatcttctctcctgcatctgcacaaatgtgacagtttttaattatacatgctttgactatgactggtactagccgggagaagaaaggagaagagaagatgagagcaagaactgaactgttccaatccaaggccacttggaccctgccttctccagtcgtatctggcgcaggtggcgatccttgatgatgatgaatcggtgacaaccttgtggagatttgcagtttgcagatttgcagatttgtgatgatgatgatgatgaatgtgagcttgagtaagttgagtttgcagagcagcatagcatacggccatggcagctgcatactccactatgcacaagttcaatgcatgcatttacaaactcctcgtaccccctgtgagtgtgacagaagaagagagaaaaaaaggatgccatcttgcattcttgcctcttgtcctggtccaggtccaggtgcagtgttccatcagatttaagacaatttgttaccattatcatactagatgacatatcattaatttcatgaaattactccaagcagatgcaactcgtagtatggccttgtttagttggagaaaatttttggctttgattatcatatcggatatacggacacacatttgaagtattaaacatagtgtaataacaaaacaaattatagattccaccaggaaactacgaaacgaatttattaagcctaattaatatgtcattagcaaatatttacggtagcaccacattgtcaaatcatggtgcaattagacttaaacgattcgtctcacaatttacacattcgatgtgatggttgaaaagtttttgtcttgggacctaaagcagtcctatgtatactaagtgatgttcacttgtttgttagccatcaccaaaagaacatttacggcagttgaaccagcttcagaatctctgcagttaaatatttaattttataaatatttcttcaaactaaatattttaaacattattaatagtcaaggttgtactccctccatttttaataattgatagctataatttgtttccatttaaacttggaccactagatacaatttaacaacgaaatgagcaaaaaatatttttatatttagggtaataacatggctttatatctagtttttgtaaatattagaagaagaagacaagtggtcttagtttgaaagtgaatattccaaaaaaaacaattttataaaaatggatcttttaaccttaatcttattcaaaacaacaatagttattgtcgattctagaaatcgacaccgagaaaaagggtagcatatgagatctaaagtggatgagtacaaagacaaagatttcgacatattcagaccttctcgatgagaaataatacattatttttattttggggattgtatccaccggatgttgtattggtctgataatcttggtgttcctatgccctcaggggactccctccctaggttcgggggcaaggttacaaaggggaaaacctagtcagacacgatatggattttcttattcagttattcaattgcataagactaatactacggactatgccttaaaacaacttttaacactcaagacttatcctaaaatataataacttctccaccaacattctgttccaaccaatcaccactatccatcattcgctttttccacctacctccatttcttaaccaatcacgacctctccctatttaattctacctactttcttaaaaatcatgtctaactctaaaacttcttatattctgggacggatgtagtaatatacaaatctggtccacctcctaccttcagtcggataagctgtccgtgtagatatatattacccaaaatctccacagctatgtaacccgagggagaactagcatacagctgcgtgtgttgtctcgtcatctaggtggtgtttggttgcaaggatgggatgggacgaacccactttgaggagtatttggtttatgagttagtgggttgggttggtccctaaagaggaatattcctctcaaaatctaggaccaacccatccggtaaaatcaaccggacgagctcgtcctacctagacggagtacacgacgtcagcttgtctctacatccgctggcgctcatccgtgatgtctgccacctccgcaactgccgacgcctctctgcaagcggctgccacctctcctccacgaccctccgccacctctcctccacgagcggtcgacgaccctccgcgacccactgctgccgaccctccgcgacatgttgccgcttctcctctgcgagaggccaacgctcctccgcgacccgtcgtcaccttgtctccgccgcctctcctccgcgagcggccgcctcgcctctcctccacgactggtcatctgccttctcgctcgtccgcccgtctgcctgttggtcgccaccactcctccttccgcctgctcgctcgtgcgctcgtcgagtcatcggccacgccgtccctcctccgcttgctcgctcgccgagttgctggccgcaccgctcccaccagcttgccgccgggatcgaacgtgggttgacggtagccacaaatggcgtccatcccatacctccctcatcctttctaccaaacaaagaactgggatggtctcatcctatgaaccaaacatgcgagtagaatcatcccatcctaaaaatcagggatggtttcatcccaccccatctaatcccagaaccaaacaagtgttgttcttggctttgatgatgtgccgattaattttccaacgactttcggtactccaaatactccatcaatgcactggcacgccatatcgggggtgtttagatccaggggtgtaaagttttggcgtgtcacatcgggtattatatagggtgtcgtatggggtgctcggacactaataaaaaaactaattacagaatccattagtaaaccgcgagacgaatttattaagcctaattaatccgtcattagcatatgtttactgtagcaccacattgtcaaatcatgaagcaattaggcttaaaatattcgtctcgcaaattaatcgcaatctatgcaattagttatttttttagcctatatttaatacttcatgcaggtattaaaatgttcgatgtgtcagggtaaaaaattttgggtgggatataaacagggccaaagccaaagtctgaactttcgaaatcttctctcctgcatctgcacaaatgtgacagtttttaattatacatgctttgactatgactggtactagccgggagaagaaaggagaagagaagatgagagcaagaactgaactgttccaatccaaggccacttggaccctgccttctccagtcgtatctggcgcaggtggcgatccttgatgatgatgaatcggtgacaaccttgtggagatttgcagtttgcagatttgcagatttgtgatgatgatgatgatgaatgtgagcttgagtaagttgagtttgcagagcagcatagcatacggccatggcagctgcatactccactatgcacaagttcaatgcatgcatttacaaactcctcgtaccccctgtgagtgtgacagaagaagagggaaaaaacaaggatgcaatcttgcattcttgcttcttgtccttgtccaggtccaggtccaggtgcagtgatccatcagatttaagacattttgttaccattatcatactagatgccataccattgttttcatgaaattactccaagcagatgcaactagtactagactactagtatgtataccaagtgatgttcacttgttcgtcagccatctccaacaacatttacggcagttgaaccagcttcagaatcactactcctacctgcagtagatgccatttcagatagattggcaatcaattaagatggccttttggccgctcaagaaactgtgtactaccaatgaattgaatgcagatggaatttctcgcaagatcttcagggatatgttcagtctgcatcggaggggagctgatcctgcacagtttctcaattcttggcatattagtagaagtagattactagcagcggcatcgacgatcaatgcctttgttggcttttttttttaatacgcaaggagcgcatctttgtattaagaaggaataaatatatgtacaaagcgggaaaaaaaacaaagcgaaggggacagggtacaggaggagaaccaagaaataaaagcctaatctccaactaaattttgcgacccttctccactaacatgagctaccaaaacggggattgcagctctagctagccgccacagctccgcttcacccgtcataacccttgcaacctccgcccaagttctgctcttctggttgaagactcgattgtttctttccttccagatcgtccatgcaaccaacgtcacgatggtgtcgaaaccccggcaatgttccttgaccatcttcttgcgacagtcgcacaaccatgagaggaaagagtgttcattgagcggtaagcactctgaatgcccgatagctctgagcgcaacccaccacagttgccacgactccgggcatgcgaccaagagatgatcaattgtctcttcgcattgatcacacaaaacacatcgatccgggtgcgacaaaccacgactccggagacggtctgctgtccagcaacggttaagagctacttcctccgtttcataatgtaagtcattctagcatttctcacattcatattgatgttaatgaatatatatatatatatatatatatatatatatatatatatgtctagattcattaacatcaatatgaatgtggaaaatgctagaatgacttacattgtgaaacggagggagtaccaaccaaaggaagtagcgacagcgagggggtgccaaagattgccaaattagcttgtgctggagacgagttcttccaaaaaagagaacacgagaagccgagcgggaagagtattctcctgaggtctcccaccgccaagatagagagtccggctcttcggaaagccgcactgaccgaaggcaatcccaaagcttgaaatactccaggatcgcttgaatacccaacgccgaactgatgtcctggatccatcttctgttagtcattgcctcggccaccgtgcgtcgattccggagatgggcagggattgcagcatagacagccggcgctagcaaccgaatggaggaaccctgcagccagcaatcctcccagaacagcaccgaattcccatcccctaccaagcataccatagaaatcgatactagattgcgctccttctgcgagaccagaatactaagcccttgccacggcttttccggtgaagttctctgctgccagagccatcgcgacctcaaggcgattcccaacctctctagatcaggaatccccaaaccaccatactccttgggcgagcaaactcgagcccatgcgacccgacagacgccgccgtttgcataagctttgccagcccaaagaaagctgtggcggatcttgtcagcctttgttggcttttcaccatctgctcatgaactggtcaagaagcgagcactggttggcacatcatctctgaactctctgaatcttctctcccgcataatcgaaacatcaaataattgagttcaccctaacctcaaaaggcttaaaaaggtggtctgaccgtaaaactgaagactgcttcgataacgtttctgtagaaactcgttttgtccaaaaccaaccgttagatcaagtttactttattagaataaattagataaactaagaagcaacttcaccagatgaatttgttcataatgtgcaaccacaacacccctcatgagtttcttataagaccataatacaaagagatccaaactctcgaatttctcgattgtggcttaccctcaggggttaacctctctcgctatttatatccatggatgtgatgtccaaagtcacgaatttaactagtactactaggaatcctaatcacaaagttgggagtgcaccagcaggaagagaagcataagcaatgagtcatctgtattctgtcttgtaaaagaaaatgataagtgtgatatctgagaaactggtttcataatcgaacctgcccacatatttcacctacgctactgcagtttttggcaatcttgcacttttctccttctgtcactgaattgtgggtccttagcctcacgtgtcaatgagacagacaagaagtgcaaataaaggattaagggtgtgtttgagaagaaggggattgaggagattgagaagatacgcaaaacgaggtgagccattagctcatgattaattgagtattaattattttaaattttaaaaatggattaatatgatttttttaaagcaactttcctatagaaaatttttacaaaaaatacaccgtttagtagtttggaaagcgtgcgtgcggaaaacgaggtgctctccctcaatgtcctccaaacgaacgctgcctaaattgttgtagtgtaaaacaaggaaattcttcagcatgttgaaattttggttgatgtttgtgctattggctgttaatgtttctttttgaagatggaaagtacaacgcaccatcaagaagagaagcattagtatttggagacattttgggtttcctatcttgtaaataatcgatatatagtctcgaagaggtcgttgcaaattgtttcgatatatataaactgcctatcgtttcttagagctaggaccgagcacagtcctactcctagcaattaacataactacgaattttaccaactcttcttttaccataaaaagaactgaggcggcaaagacgctctgtacaatcttcgtacccattcctttgtaaaacccgtgcaatccttcataccggatcatctttatgatcgcgtcaatcgtacctggagaaaacaggcagtcagcattatattacttgcacaatgagtagcaaatattccctccgtcccaaaatatctatatccgtagctaaaagtagctacattttataacggaagaggtatagctaaatgtctgacacacaagacataggagcagcgcggaaaaacaatgatcccaacaaatatggaaatgaaacagtgttttctgctagtaagttaaaatggtaggaaatgatttacctgtgtatctggacatcacattcctgccaatttcttgttttgcttgcaacctagactgcattagttcaatacaacaatcaggatagcacaaacaaacatgacactattttgataatgtaaaccattcatacactcaacccagatagactggcattgcctgcaactacttgcacccgtggcaggtctagatattgtcgttgttgagtaaagtctcacaagattaaattatattctgaaggagagcaaaaatgtggtgcagcatattcatggggttgttgtatgcaacaatgcaggacagctattagtactgtagttgttttgctgaaagcatttgttttaacaacatcagagaaacagagtagagaaatggaaaagaaatctctagcatcgatgtggacttccgggtttctattcaggcctattttggcaatcctgagtggcccatcactggctgatctgacaagccagtaattcctcatttcttaaaaaaaattgagcttaaacagatgtacaagtgagaaatgcatcagttttaacactttgcacaagataagatgatttacatgtatataatattaagtttaccttaaccactagcaatgggtatgtcacaacagtagctccgagctttgctattgcacctaataagaatacctgctcaaagagaaaatggtaaggataggacatataaatgcatcaaaggaaatttcaaagagcttaagatgttatttagctctggatctgaagaataaagaaacaaatatatggtctgtgctatggacataattaaacaaagggaagtaataatgatgaatattctttagtgcattcatagaatcataaattgactgcatagctaattgtagtatgaaattactctgtcctggcgctttatgtggccaaattatctggtttgctcaaataaccgtagcatgcatctttaaatataataatttatggagtacaagaattatagacgaatgatttgaaggtaattatagcaatcccaacgatgattctttttacattgaaccaaatattattgatcatgatcaatgtagctttatttgcatcaaagcggataaacggtgaacaggtttataggattgaaagatacaatacaaatttctagaaataaaaaagaaacatgaagttcctaggaaggcagcacatgcaaatagctgatgccatctaactgttaaaaactcatatatccacagacacagatacatgcaaatttctaatgcagagctaaatcgaaaaaacaaatccatacctccatagcagtaaggttcttttttgggagttcctttccagatctctttgaccggagacgctttgccaatgtttcatagatcataaattgaattgatggattacatacctaacaatttaaatggttcattctctatagtcactcttacataaccactaatttcagctcaaatgttttgagaaacataaactaaccataattagtgttggaataagtcctttccagaatcctcttatgcctgattcacggtagacctcccggacctacatactactgataaaagtaagaaaaatcatgtctgaccagtgacaaatacatttgattagttaaaagcaagtttgtagagcccaaaacttgaaatgcaattgcagctactattcattgtagttttttgcaaacagaattttaaaatctgtaagtgcagcaattagttctagaaggaagaaagcaattcgataaaaaaatcaagaattcttgtactatctaaatagtacaagtgagaaatctatctaaatatctagatgtggtcacaactctcaacaaaaaatagagaggagcagggttgggtgtgggggattcacgtactatcttattttatgtgctgcataattgttaagaaatggattatatatacaaaataatgtatagcaacttaaggaatgtgagtgtgctcaattactcaccgcttgaattgtcccatatggacgaggcttttcagaatcaagtttatacaacctgtccttaagaattgagacctctattgaattggccctagcaacatccttcagcaaaagctcctttttagactccatgatcttcttttctgcttgtgtatgtgtctgaaaaatggaataaagttaatttccaaactgatgataaaaaaacttacagatattttgaataatattagaatgttccaatttaatagtagttgcatagttaatacaagcttggttacaaccgaccatggtcttccaactaatttcacaaaggatgtcatggaccaataatccttgtgattcggcgcctcctgaagtttcatggatcattgtcatcataaaaacaaagctaatgcttggagtcaggcaggtacaaagaaggtaagtatgctaccagaaagtgggggcaaaagcaacagtaattaaattcaatgggtgcaataccaatgttaatattctaacatattagaagatttcttctctttttttgaattttgacaggacatacagtatagtaactcattaaccccatcatcgacgatcttttttggtgttatatgtcattttaaaatatagactgttaaacaaaatttacctgcatacgagtcacgagaacccatattggattggtaagaagaacattgattgacctgcagcagagaaaagtgtccatcagaatgcctgaggatcaatgttgcaatattacattcaaagtgcaatcttcgccatactggtgactctatttcacagcgctatggttttccagaacaaaaaccatcttaactggaaaggattacacgcttcaaattcaaagttaatcaccgccttcagtcagttctaaggaggcaaggccatacgaacaatcatggcaaccatacattaccatgaattacattttcttatctccctttccgaaacaatttaaggtttcaacgctctgttagcctttgcaagctcagtcaaattcatcagaactctattacaattcgtttgacaggatactatggagatgccctattggaccactaccaactgataatgtcccggttgtccagactgaattgttcattccagcattaaatggagacaagcattcgatttgttttgggtgaatgttggggctccaggttgacttgacatataaatgatgtttagcaatttcagtgcgagagtagatggcttacccagcaacagctgcaataccaagccaggagaacatcccaacagtaccatcccctagacccttcttaccgcgagcaactgctagatcttccaccttgtttttgagaatctggtaaaagtagtaatagattccctacaaccacaaacaggatgaaccataaatcctgaataccaccgtacagactcatccaagtatcatcacattgacaaacagggaaatacaattgttacagaaaaaaatgatgtgagtagcaccaaattactaaaccagtggaatttacctgtgaagcagcggtgccaataagagagggtttaaggccgctatacaaccctccccatccttctgtttggaacagctgcagtaactcgattccacacttggccattataacattagaggaggcaattccaaataaactaaaagtccaggaggaactacctggagcatctggaagagggtggaagtattggcgatggctgcgccattggccttcttcttttttgctgacctctctgtctgctgccgggtgttcacctgctcaggccatcatcatgatgaggaaggattgagcagactataaaggaacagcagagctacataagatggtagggggagaatgattgtacagtctggagggggtaggtgatgatctgggcgatgatgccaccaccggcaccagccaatccattcaccgccgcactcgacatgcgccaacctgaaaaacccatgcgcaatcagaaagcaacgcaatgaattcctataagctacttgtttggtggagcagcatgaggaagacggacgtgtgcgttgatgcagaggcaatggacacatggtgccgaggcaaggtccgcacgcgccatgcagaggccactaggtattgccactaagaagctactaaaatacatttcataatgtaaaagcctttcctttcgcattcatctaatgatgtcaatttgaatcaaattagcaactaacaattcaattggactattttgatcaacgaaataacccaatatcgttatttgctttgtttcagccactggtagttgatcatgaagaccggcctagagaaagccatacttggcctatgaggttgtgagttgtgactccttacgtcgttgcgagagatacataggtagtgtttggtttgaaagcaagcttggatgggttttaggcatccatgtttttgggggatgatccaagttgcctgtctggttggatggattggatgaaccgattttttgtttgggatacatgttggatgggattggacgacaactaaaaagtttacaaatgcgaaaggaggaggctctattaagtaggggtgaaaacggtacggaaactttccggattccgggcctgttttcggaaacggaatcagccggtcggaatttctcggaaacagaatcgaaaacggaaacattttctcggaaacggaatcgaatatgataatagcagtttctgtcggaactcggaatcggtcggaaaaattccggaaaaaatatcggaatttccgaagttaaaaaggcccatagaatcaatagtctataactcgtccccaagttttaagcccaacccaaatcgcggcatctacccaaatagtggctaaccctagaggagagagacagccacacggcatcgcaactttgcgagaccgcgagccggcggcggagcatcgcgctccgcccaccgctagcgcccaccgcccggcgcccgcgccaccgctggtccgccatcctcggctcctcgcaacctcacccccaccgtcttcgccgtctcgtaccgccgccatctcgcgacgctgtcccgccgtttcgcagcgccgtctcgcggccgcggcgccgtcccgccgtttcaccgccgctaccaccactgacgacgacgccacagccacaccaaggagccgacgacgcctcgcctcgcagtcgcagcagccagcagcccagcggcagtagccaacagcccagcggcagcagccagcagcccagctacgagccgacgagcctaaaccattgatttgatttcttttgtgctgtagatttatgatggaatcatcaaatgcaagtagctgttttgtgattgatccaagtactgtactgatggattgatgtgtgctgctgttgtgtgatgaccgaaacaattgatgaactatgtactgatgatggagtgatagctcatagcagattagcagtagctcatagcagattagcactatagcactgaataatagtgtatactatatatcttatacaagggtgttttgctgtaattttttttaaatatttgttatgcaaattatatgaagttatagaagaatatattttgctgttgagacgatttcatataattgtgttttatgatgaattgttgactgttgagacttgagaattggacttgacaaaagtttgaagctcagtttgaggggttgttgtattccgataaattttcgttaccgtatccgcgccggttcgtttttgctccgttttcggtttcgataatattcgtttccgttttcgtttccggggtttccgattccgaaaaaaatatgaaaacgaaaacgataaaggttgtttccgtccgtttccgtaccgttttcacccctactattaagtccaagcatgtttacacaagttcaatcattcttacatattttagtgtttagataattcccatcctatccctttcattcattgacctatttctaatggcttgcctcatcgcatccttttcctttttctagacgcatatgccctgcagccctataatacaaaaaagcttggtcctcttgtccatctataacatagcgaggcaaacaagaacacactacagtgtcatacaacatagcgggccatcgacaccgtctccaatgcacatgtttcatccttattttttttcaaactacatatttaaaggaaatattaaaagtataaccatatgaacgtgttttttcacgacaaatctatcaataattcaatatcgttttcctgtcaaatcctaatattttttagtttgtttaattagttaattaaccagttattaatatcttcgcatttccattccaggaacgaacgacaacttcacaagtaaataaataagcagttcagatttatgtaagggcacaaataccaaatagatcatgtacaaattcacgagcatgaaaaatcatcactaataaacaacatcgctccatgaagactcgatcctcacctgcccgaggttgcggtgcgtggaaggaggagggacgacgcggccgcccgccgcccgccgccggctgtgagcgccgccctcgccgcgcctcctgatttcgtggataaggaggagggaagtgagtgaagggatgaacgggagatgtggagtggaaattttcgacagattaaaaatgtttttctgactttcggtttatttaatctgttacgtgaagcctcggttttcagaaaatatcagttctgtaagaaaaagccgaattaaccggaccggtttttcagacctgttttttttttcttcacatcaaaattgaaagtttgattgaaattggaacgatatgataggaaagttagaagtttatatgtgtaaaaaaaagttttaatggaacggaaaagtcggatgtttggtgaaaaattttgcaactgaacagggccagaagcggagcacctgcacgaggcgaggacagaggaatggccggaggtgcgcctgcttgcaccgccgatgtggtcgccgccgcagttcgctgggcattgggttgggttgggacacgtaaaagtcacttcggtgtctcctccacaagccctaatgtaggtgagaaatttgggattataccatcccacagttcgtccaaatgcgtttccctccggtttcataattatttattttatggtttgaacatcaatacggtcttcgaaatatatatatatatagttttcgcactaaacgcaccgtttagcagtttaaaaagcgtgtcacgaaaattttaatcttcatcaaactcttattggagaaaagaacgggacctagatactacacgtcagagtgcttaataactaggataaaatacaatttgtgcttgcttgcgccgagctcatggaggagggagggcgatcaagctcgaggcgacataggtgaatggtgagcaactgagcacagggcaggcagcagggttcacaattatggtctaactcgatttgcaaaatctttctgaaccggggcaaaaacacaaaccacacggttattgggtcaagctaaaaaaaacaaactgaatttaaaaatttggacaaaatttatcaggatcttatcggtttttgtggtttatcaatgtattccataaaatccgatgatattgctcgtgagcggattatagttgagttgggtaattcgtatgttttataaatatagtagcatagataagtaagagagaaattagactaaacataaactcaatcgtataaaaagaactactccctatatctagatatagatgtatttaacattgaaatattgtgaatattcctcaccttagccaatcaaactatccgtgtatttaacattgaaatattgtcaatattcctcaccttagccaatcaaactatccttgtatttaacattgaaatattgtcaatattcctcaccttagccaatcaaactatcctttatttaaattgtatctgaaccttaatccctccaaaaaaaaacctattatttaaattgtatctgaaccttaatccctccaaaaaaaacctattatattttggggtatatgtatcattcactcctccagccatgaatatagccaaaaccagccatgaacatagccaaaccaatctcaacgaacagtactgcacaacggcgtggctgcatatgcaattgtttggttccacttccactcagacgtaatcaagcaacatcagacaggagacgaggacgttgccgcatatacaattgaaccattgcgcacagatggcagaacaatagaaatggaattaacagagcagcttccgagctccgtacaagaacacagttagcagtgtatttatttggacaaaatgcactagttgaccaaacatttataatgttttaagtgcttcaaacaaccgctagttccagacacattgaagtgattgctcgacacatacgaaaccgagttcacaaagcagcataagagtatacatgcgataacaacaggaaacaaatgaagttacgctcgtactagattctacatatcgtttattctagcagtgttctactggtaattcctcccttgtccgtccctctcataagccggcacaccggcattgtagttatcgccgccttgctggtagctagggttgcctccttggccatggtagcctggtgcatagccagggttgccaccttggtaaggaggcgggttgccgccctggtaacctggccctcctccctggtatccagggttgttgccttggtaagcagatggtgggggtgggggtggaccttggtagccctggttgctaccttgatagccagggggtccaccttggtagccaggcgcaccgccctgctgatagtttgtatagccttgcggatttggtgcatggggctggtagtttggaggacctgcatttggtggtggaggtggaggaacattaccctgagcatggtgcatcggaggagcatcacgaggcgggactgggccctgacctggtgggggagggctgttgaatccctggccaggaggcacatctctgttctggaagttctgcatgttctcccttctcctctcaaaattccttgacctgtcaaagtttctaggcctatcattgcgccggcttctttcattggcacgcgcattgtttctcacccactcctcgtggtacttagggtcataaggaacggcttccccatttataaaaggttctcctgcaataaaagacaaggtgtcaaatacacaccaaatgctcatagatcacatctctatgattccatcacatggataaagacattacaaaacagataaaaataactatgaactcataaaactctgctagatataattatgaactaagcaacaaacagcacactaaaaataacatatgtattcaaattctcaaccacagaagatggtaactgccacggacagtccgcaatcactaccactaccatgacatatatacaactacaaacagaaggtccaagttaccatttactccctcaaaactagataactaaatagatattactgactcaagtttataaagtttgcttgaactagttgatttcactgcgatgactactgataatcaagcaatccaacttatcagatggtctagggaagaaatagcaaactaaatttcaagatatcctagtactaggagatttcacaggatacagactccaaataaaaagttcagtggtatgctagaatacaaggtgacaccagagcaatcagcagaagagttccatggtaaaacatatacttgacgcagaaaaaacataacctctataaaacaagagccagaaattatcagttcaaagcattgcacagggacattagaattaatcagtttgatcataatatggcatcatacacatagagagcaattatcacagaggatctatataactaacacggaaatgatataaaaacagttcagaaaagaaagtgatgatatgtaattcaataggaagagaatgaacatttacctccgtagtccttatttctgacatccaggtatgagtctggaagaacccagcggaccttgggcaactctggcaaaataatttaatagcacagcgttaaagcaagaacacaagtgacccccataaaacatcccctacaaagaatttcatacaaccataaatacctttgagtttgtaggagagttcctcagatacaagagctccaaaagcaaagtaatgccgagttgacactgagtagatcttatgccttgcttcttcctcactggaagaaaggacacatttggttaaaaagaattatgagcaatttatataatggccaatacccagggcatatatcaagaaaataaatgaataaactaagcaaataaattgttatacagtaggacttacatgatgcgataattaaagagaaaccagaaaaactagcacatgctaccatgaagatggacgcctaaatatgtcagtggttgacagaattaatagaacacaatcaattttcaaaacagggcatgaagcatgattaaaaaacatcgtgttgataacaggagggcatgacctcccttctaatttacaaatcatccccatagaaataccaatttattcccccataataactaactacatgcaacaccatgagaccagattaatatggaaaccgtagcgaatcaaaagaaaatgacaaatacatgtggaatctataaataaaatcccagtcacatttgtgaaaataaaataaaatatgcatcaacagtacagaatacactatcactgaaacaggtatttatcagccaatccaccacagatgaagttaacaaataataccatggaaaaacttcacatatcacctaactataaatatccccaaatccactttctccgtcccatttcctcacccccaatcacgacccaatcacgaactaacagattaaatcgagtgtttccacgaaatcccacggatgcgagatgcgcgtgagagggagaagggggggaggatcgttcaagacggccatatatacctcccaaccacctgtgcgagggttttgatgtagccgtcgataatctcgtcgcgggtgggctccgggttggagggatcgccggggggcggctccacgacgaccagccagtgctcgaagtcgcacccgtcgaggaggatcgtctccttggggggccggttgctccagttcggcgacgagtcccgcagcgaggaggtcgcgggctgcgtggcgaagcacctcgccgccgccgccgccgcgcgcggggcggagggggcgagcgccgccgggaggaggctccccgcggcggagagcgggcggaggaggcgggaggtggaggaggcggcggcggcggggagcctggagaggaggaggaagcgcgacgccgacgccatgggggaaaaccctagattgggaatgaggggggctgagggtttaagcctaatccgggcaatcggctcccatttttatagccgcatattatatattcctcgggttgataatatttttagttttggattagggataatttccaaaacatttgctttacacacttttcggttaattaatcactctactatttagagaatgagagatgttcgaaaaggatttattaaagatgttcaaaaagaatttattaagtgaattatgtatgatgatgatttaatatgtttgtatttaaatctcttaaatttacaatctaataaattatagaatcatagataatataacatgctttgcctctagaccgcctccggcagcatgccccgccggaccttgtcggtggcggcgtggaggtaggtgatcccatcagcgtcggcggggcggagcccgatgttctcccagatcgagatctagccgcgcggccggaagcgggggtcggccagcgtggggtcccgcgggtcggcggtggatgcgctccagcgggagcacacggcgtggaacgctttgtactccctcacgccggcggcgagcagccgctccgcgatgtggttagcgacctcgtcgtggagcgacgtccagtcccgctcctccacctccacgacggccgccgcttcccgccgccaccgaggcaacacgcacccgccttgcgcttgccttgtacgttcatcccccctcttcctccgctgtcatcgcctcccgccccgccggaacaaaacaagggtttatatagcaactccggggaacccgcctccgatccaacactcgatgcaactcaatcgatctccgaatccgattcataatacaacagtgagcttggaggacaagggtgtgtaggaggagggaaaggcggtggtcgccaatctcgccgctcgccggggtctaccacaaccggcggccatggatgacggcgtggtagggaatgaagtggagacgagagagtgctggactggtgtattatatgtttttagttttggactatgaataattttcaaaatatttgctttattacaccttgttcagttaatccctctcacaaaagaattaagagatatttcaaaatgatttattccacacctattatagtgtggaattatgctcctcaatcttcttcaatccctctagtttgattgttaactgaacaagactttagaaatatgaaccataggatataggcatagattaatcttaaaaagtaatataataaaattatatatttttgataattctatatagaaaattatataatggttaaagttgctttttaaaaacatgttattgtctgaaataacgagtattattaagagagtaatctttttttatggaaatatctctaccaaataatagtccttttagcgaaaataagtgctcctaattttagggatagagtacccacagatgttggtcaccttactaatcttgagaaaattgcaaaattttcaaatgaatattttgctgataataatccatatttgatgctttggtttatatttaactccaagagacaaattattctgttcagaataagcatcacacaaaaatcggccccttacaccattaagtcaagtcaggcatgggctttggcccagacaagtcaagaaaacggtccactagtctctggcccaaatgaagaaaataccgcagctcgtttcagtaggaataagttcatctgaggcccttaacttgttaacggatccgattttcatccttcaaccgaaaaaccaaatccaacgagtccttctactgttaaaatcggtgcaaaataagtctcaaagcggtttggacggcggtttcagatgacgtggcacctacatgactaaactcagtcttcatttgacgtgacacatgaatcaaaatttaacaattagaaaaagaaaacaaaataaagtctcacccgcttctgtaacagtagccatcatgttgctgatgctgtgttgcaagatcaaagggatttatgacttgtgaggaagaaaagagtaagttcgtcgtctctctcaagggcatgataatgagatggtgttcacctatgatcctcagtttaaaattatgagtactagcttattctgaatttgcatcgtatgaatatagtaattcacaagaattttcttaaaatatcttgcatttagcagatgatctagagtattgtcttgtcttgcagaagaaatattactactactacttatggctagtgcagatgaggaacttgtgatccaagttagcaatggtcgggagtgaagctaatcattctgttttatacttcctactctctcttaagacccaagggattactgtgctccagatctgcatttgcgtgctgcaatacaatgtgcagccagcagcagcagcagccttcagcacatggagttcagtagtactgtacttcatgctcatggccctcagctgctgccaaacaaacagctgaaggagcaagcaacttagaatgaaagctaaccctggtttaccatcatcataatcatcatcatcaagagcttgcacgcatgcattgcatggacatgtgccatgcatgtgaccaagcaaagaccttaatcttctcctggaaacaagtccctccaaaagtgagacacatcacatcaatgttatcaagcaatgcaacaatgttttgttaccctgatcaaacaatgcaacaattaaagctaacatctctgcatttaggacaggaatcacaggcaggatgtttcagtgctaatctctgaaaacttctgaaactttagaccagtgggagacctgctggattgaaaggagaatcactgaataggtcagcagctttctgaccagtaaaaggagtgagaatgttcaggctttggccaaaactaagatgagaaagaaagctaatttaaggccacttgcacacaaatcaacttatcaaggcaaaagaaaccctgcctaacctgccaaacatactgtcaaagttgagtaatttatactcaatacatgttcagaaaataacctactactaattgaaaaataattacctctagctttgagaagtttacatgtcctgatcactaaaagtgactaggtcctaactcctaattaaccaagccgagcttgaggcggccaaagcggatgaaatcattgggcatgcagtttccggggtcctagctgcttatctggggacagaaggcatcaacccaagcaagatcatttccttttcttcaataatatttgcctactagatgctatgaccctagccatcttttcaggccaagatagtactagtaatcaactcaaagatcagtattaattaaggttggcaattgcagtgtttgcttcagttcatgggcaagggtctcaccacgcacaagtcagaggcacccgcactccaaaggcattgacaatctgccacacaaggagaaagcaacccccaagtacccaaccacaatatgatttagagatcgttcagtagcagtagcagtagtgtattaattagtcttaagctttcagaaataactccagaaaacgagcgatgaacacaccactgttcacacctgcacacacacgacatgatcgatcatgatcatggcgacatggatcgatcgatcgatcggttcatcgatatgccggtttccgggttcctaagttaacaccgggagaaatggaaatggcttgtgttagaggaaatgtaggacactctagctgattgatctgtctctgcttactgctactactcatatgattggtctgtacctactgctgatagatagctttttctggcttgctctctgcagctatctaactctaagcctcagtttaaaacaaattattgagtggattgttactacgaattatctacttgataaataaacttggtctaaacaatacagcaacacaaggttttttaagaaaatttatttttcggagcagaacaaataatccgtttcaatgttccggtaaaaaatctgaaaagataagcctaaactagcagtacctgaaactgcacttgctgtttgtttaaggaaatgggagcaatgacatcaggtgagacagacaattgtgtgagttgcaaattgcattgctctctctctcccctgagccacactgatccagctagataggtctgaaccctgaaagaaccctcaggacacactcaatgtttcatggaattcggtcgggattcgctcgaggacgatgccgactcgcgacagcaagtcgacgaatgagggtcgtggagagaaatgagattggtggggggtgttctcatcaggattcctatttctggtccagcatcacctgctctcctggtgcccagccatgtgttgtttgtggccattctgtcaacaatttgcattattgaaagatatagtgcttggaggagttgaaggggacctgttgcttgggcacttcaacttgagcctaatttctgtccccatttctcctcaagtgtaatcctgaataataaagattcgtactagtctccctctcatgcacttggtttggtttcatgtgctacttagttacatgcaccgaaacatcgtcgataattcatgaatggtggaacataggtaaattgtgcacgagagaaggtgattccacgccactaacttagagccagtaaggtccctgcgccaagaaaagcttagatgactggtttggaaaatttctgaaatagttgcatgtttatgcctaacaacgttatagagacaaggatattgttctcttaaacaggcattccccaaccatttatcttcccaaaaccgaacttgagagccatctttgatgttggaggagccaaacctgagaaaatcaggcttggacttcattagactagcccaaaagtgtgagtctcctgctttccactgagcttgagacaaaggttgtgacctcaaatatttgttccttagcatttgttgtcacacaccatctgtagtgagtagtttatgcaaccactttctaaggagagccttgttcttaattttaagatcttgaattcccaaccccccttggtctttaggacgacatatgatgtcccaccttgctagtctatatttccttttgtgtccatccccttgccaaaagaaccttgatcagaaataatcaatcttcttgatcactcctttaggtatttccaaaaaggacatcatatatattggtaggctggtaagcactgaattgattagtgttagtcgccctccaagtgataaaagtttgtctttccaacttgccaaccgtttttcaagccgttcaatcacttccttccactccaaattacgaagtctcctatgatgtataggaatgccaaggtaacggaatggaaaagaaccaacctcacattgaaaaaggttagtatattgatcatgagctgtttgggcttcaccaaagcagtaaagctcgctcttatgaaaattaatctttaagccagataattcttcgaaaacgttcaacaacattttcagattacaagctttctctagatcatgttccataaagagtacagtatcatcagcatattggaggatggacaatccaccatcaatgagatgaggcaccactccaacaagctgtcatgcattatttgctctctggatcataaccactagcatgtccagattatattatctcacgaccaagatgagtttaaatggaatctaaccactgatggcagattctcggttaaatctctttatcttgcgttggtgcagaccgatgttcccaatataaacaaaagaatctggaagatcaaagccctcctaaagattaagatcttcttatggtacttacgtcgtggagtagtcttaacaaaagataatcttattaaaaggaattggagaggaaacaagtcttgttctttctgccacaaagatgaaactattaatcatttgttctttgattgtcgttttgcccatgcagtttggtctttaatccagtttgcttcgaatattagtttacctaatagtacaactcatatgtttgggcattggataagaagacaaccacgcaatttgagatctttggtcttattaggggcaacaaccactatttggtctatttggctttgcaaaaatgatgtggtttttgaaagaaaaaacatatcttctcctttgcaggttatctttttgattacacattggctccgctcatgggctatccttcagaaggtcaatttgcggggaactatcgttgtggcttgtcaacaattggagctagtggccatggagttttctaccccggcgcatgggtggcgttctaggctacggttagagggctcctgaagttctttttgtccctgctatttggatgatgagtttatcttttgtttctttcttgttggctgtgtgcactctttgagtgcagaagccggaggtgctctcagaataattgtatcacttgatagaattttactgagattaataaagcttccattatctaaaaaaggtaaattgtgcgcgcttcctcatcgtcttatgcttttaggttgaactggttggttgtaactaagtatggtataaaagccagagcttttaagttcaaaaacctcatttttctcaccggtttaagcttttgggtaattgggttgaactggttagtgcatgaaattcgataataaaagacacgtagttatcgttgttgacgtcataggttcgaaacccgggtttgacagcgttggcaacattgcatcgtcacatagactggtagacatctagatgcaatgaaaggtaataacactgagcaagttacctcttggggggtaaaaatgatccccttttggcacaccaaaaagtcgccgaatttgattggagcaaggcaagcaattccattccacaagcctctcctcccgctggagttattccaatccaagcctgctgtatttgtcacggtaatggcgacaggggagcccggagtttttcaccctgttgcttgcacggagttgctctgtgagctatgcttggacgtcatcttccccggcatggtgcgatgctgtgacgtcaccaactcaccattctgtttaacctgctgttgttaaatactccatccgtttcaggttataagatggtttaactttggtcaaaatcaaactactttaaatttgactaagtttataaacaaatataataatatttataataccaaattagtttcattagatcaataattaaatatattcttataataaatttatcttggttgaaaatgttattattttttctataaacttagtcaaacttaaaacagtttgactttgaccaaagtcaagatatcttataacctaaaacggatgtagtatttaaatgtggctttgcggttaatattctcacttttttttgaagagaaaaatagcatgagagtgtgtctttttcattaaatatagcggaagaacaatacaatcctaagagcgaagaaatataaaaggccaagaaattatgacactatacgaggtgcgattaatattctcactcgtttcgtgtagattatgccctgctaatgctgatgaattgagaggagaaaaaagagtgtgtctgaaccaatgggcattggatgagacttcatgagacagttatttcttcctgtgcataatcacacaaagaaaaaaaatatccatttcttcagaaaattcaaagagaaaccagtacaagttacttcctctgtcccagtttactagtcgttctaggaaagagatgacaaaatatggtgttggaaaaatgaccaacgtgcccctacattaatcatttcaatgcttaaaaattaacacaaaactagtactgcgtctgttattccgatatatctgcaaccagcatggggaagaaaattaatagaagtactcataatagtggctagcctgctagctgccctacgcctaaacgaccttctttctgggacaataactctacaccccaatgacaactaaaccggaacggagggagtagttatactaggaagtcagatgctgatgcagatgaatcttaagtcagataaaatgttttttttacagtgcccttgaaatatctgccaggtgtgtgggcccaggaggccctaagattcagacattggagatgcttggttgcttggaaggagggggcaggaagcaactcggcatattaagcaacggccaaaagagtgacatgattacaattagaagcaagaaaaggcgctaatgattcctcctaatccacacgaagtaccacggaagcacgcacaacacatggcgataatcagctctgccaattaagccagttgattagctcacaaggcaatcactgacaagaacatctgcacctgtgtgcgtgtgttcctcctgtcagtcacttgcaagctgcagtttgcatagggcacatcagggtcgaatccgatgtgcaaaaacgagcaaagtgccaatcctgaagtttgcttcatgatttttatcagaaaaaatgtttttaaaatgaataaccagacaaaaatgtccctaaaaacatggaatcatatagcaatcatagaaacaatagtactcaattttttttgtgcaatggccaatgggcatataaatccaagccatcgagtcaagtgaattgcttacatggcatgattaacaattgaccataaaccctctagtctatcttaaaaccaaaataaacaattaattaaatctctgtcaagcgctacttggattttttttctccactttctgaaaaaagagggaggagaagaaaaagtttttgtatcaatcagaatttaggagacatgtttagggtgaaacaagattggatcatgtcaaatcggagaaggaatcatactatttaagcaacaatggtggcaggattggagtctgctccacgccacatggatcctataaattccccgcccttttcttctccactccactcatcatcaaactctctctctctctctctctctctctgaatctctggatctctgaaaactctgaacattccaagaactcataagttacctgtgatctgtgaagcttgagctgaagctgtgacagtgtctcactgatcgttgatcactcagcttggctgctactgtgcattcactgcgtggttagctagctaactgagcagaagagctttagcaatggcgacgccggggcagcagctgccgccggggttcaggttccacccgacggacgaggagctggtggtgcagtacctccggcggagggcgctgtgccggccgctccccgccgccgtcatcccggacgtccacgacgccaccgtgctcgacccctgggacctccccggtgcggttttcttgatccgttttggtttcgaggaggtgcggcgccattgccaagctcgaccgagcgggagactgatcgtgaactctctccttctgtgcaggcgccggcgatggtgaggcctacttcttcagcttccggcagctcgcggcggcaagcggcggccgccggtggccgaagaagagggccgggagtgggtactggaaggcgacgggggcggagaagccggtgttcctgcgtggcttcgggtacgacgacgtcgacgacgacgacggccagcacctcgtcggcgtcaagacgacgctgctcttcctccgcgcgaagccgccgtcgcgcacccactgggtcatgcacgagtaccgcctcgccgccgccggcgctgtcgccgtcgccgccgccggacagacaaagcgcgggaaccatgtgagtctgaattctccaattcttcagtaataacactaatagtactgatacatgtgattaagtctaatgtcattctgaatcatcattaggttttgcttcaaaggttcaaattaattaaccccagttttagttcaaacttttattagaacaaacttagcatatgtatgtgaaatttttgggtaaattaactgaagagaagtttgcagcttttgcaaaaggctttccacagcgcacggcagcatctcaatcatgcagacatgagagaatctttgcctcctttcaaagtaacttaacctgcttggctacgtggattaggacacttcactgtgtgcggccacttgtcttgcattgtgttccatcaaaaaatttaattgaacctctttgtcactcacatctcatctactagcatgcacccgtcgctgtaaatttaaacacgaattcagttcagttcagacttgagagctcaatttgatcatctggaatctgatgaatggtatcattatgtttttctttgcagagttgcatggctcagccaggagaatgggtggtgtgccggatttttctgaagaacaacaggtcatcaagaaggcgagccggcgacgccgacggcgaaacgccggtcaccggtgtccacggtcaccgtcggcggcagccgtcgccgtcgccgtcgtcgtcgagctgtgtcacggctgaggtttcagacggagaaggagaagaagaagtcagcagtggcagcatcaatggtgctccatctgcctctcaaagagaggcctagacatgctgaaaatctccttaattaattactagtactagtgattttttttcttcttcttcttgttctcttttgtccctccattgcttttcctgtacttctccttgtaccataatgattagtaggagtttaagtttaagcagcaggttgaagagagaagccccagcttaagaaagctcctaagtaaagattactgagcagcagctgtgacatctgtatcaattgtaacttgtaagtttctcttgatcatttattaagataaggaacctcaattaagcaggaacatcagatcgatcaccagttgctagctaccaccagctaccattattcagctgtcatttctgcagcagtcagattaactttagtccaaaatttttctctgcctcctctagctcccaacaaaagcctgtcaactctctgtttgaagaaaaaacgcatgtatacactgttttagatcagctgaaaattaacttctctacagaaatgaaatcatatatctgtgtaccaaaaggtgtgtttagttcacgctaaaattgaaagtttaattgaaattggaacgatgtgacggaaaagttggaagtatatgtagaaattttttttttgatgtgatggaaaagttggaagtttgaagaaaaagttgggaactaaaccaaaccaaaatggtcaaatgcctcctccacgatatgagcccgatcggttgaccaatgatggattatatgctagaatggctttagtagcgatacaaaataatttatgagtaaaacttttatatgtgtctctagcgacttaaagatcaatgctgaaaagaaaacaaagtccaaaataccttaaaatcaactccacaatcaagctttaaattttaaattttggccgcgactgattcgttgtaagataaacgatgatgcttgagacaaatggcctccctgaactggagagagagaaaaaaaacttttgcagctttcaagaggcgaaatgagaagtttgatcagcggaaggaaggaagggaggaaagaaggacgggtccccctggctcgagcgagtcaagtgagagtgagtgacagacacctgcgaatccaccgcgagatcctggcgttgaatcgcggggcgctctgccgatcacgtcgccaacagtgtgacagttcagcaaagatggcgatctttcttttgctctcgagtggcctcggtactctgaactcttctgaagtctgaagtctgaactccttcaagtggcgatctgcatatagatactagaggttgtctcattatttatttgctcccgattactgtgaatagtaacaagaagtagtattatagtagtatgaatatatttttctgaagaattgtgacatctagtatagaaaagaacgcagtaaaagttgagaaaccagaagtttgcaggcattattttttatccagaggcaaatgcatataaggaagtgagggagaaggtttggtctgtacagttaaactgattccgctccctttgtcgtgaaaatacaatctcaaagacatgtttatgttcttacattaaaaaaaacctcaaaaacttgtttatgttcttaagacaaaaattactcgtccctacacaaaagtcaatccacgaattactcctttaaatattccttatggtggttttctaaatgtatagttgtagcggtagagtcacgagtgcatgattctactcaccagagtttaattccttgtgtccataaatatggttatgttcatcctcgttgatgtagagatgggagttatacatttttcccctttttttttgggatatacagttcccctcgcaaaattcaggtcgttaattggaaaaacatttatgctaaacaggccgtcattacggtgatagcaatacgaaagcccatcacagcagtctcccctttgacgggccggcccaattactcccacaaaccaggctgggcctttgggccaatatgtaattacagtaattattccttatactaataataaatgcgcattaagctggggggctttcctgcaaaagagcgcggaaaataaaaatctcgcacagaggcgtatccacgctttccttctcccctcccaccaactaatcgatctcctctctctctctctctctccctctctatcccattcgcgaggcggcgtctcctcctcctccccgtctctctcgcttcccccccaaatccggcggcgaatccagggccccgcgccgcgccgacgaccaccgccgatcgcgaccaggagggaggatgctgggcgccgcgaggaggcagctcggatccggccccgtgagtgccgacgacctcctcggttttttttcctcgctcgctcgcccgcccgccatccctcggatttcccggggtttggtgcggttgggtttcgatctgtgatttggggggtcgctgacgggtaatggatggcgtgtgtgggggttgcagatgctggggcaggtgctgcggaggctccggccggcgacggcggctgcagcggatgcggcgagggcgtactccgcggcggcgaaggaggtgagggcctgggtgaaccctagtttttttttaattattttcattcgtgctcgctgcattggtgtggaatgaataatgatctggtctggcccgcggaattgcgttgttctgtttgttgacgggaaattgggttttggtggttggttgtatcattgatgtcgtgtattttgttgtttcggtagtattaacggagcgaattgtttctagtttggtgttgaggtggttggggatggttattggaagtggctgacggttcatggagataatgtgatgttttaatgtgtacctatttttttggttgagatcaacttaggattggttttgatgtcagttcttatgtatagcacaatggaattaggttatcccgattgaagaatagaatgttgtcatgttttgatgactgctgatttgtagccacatgtagactcgatgtcggagtgaactgatatctaaactgcctatagatgtgggtcgcgtgtccaaatttcccacagacagtcaggctacagggttaacagtttgtattgattcatttggcagtcactatactagacgtggagatacagtctcttcggatggtattgtgcggtttttctttagatgtatcgttgtggagatgtagacagttgacttcaaaactggtgactactatatctgcatagttcgattacttcctttggggcgtactgtactgtacttgtgttggtggtttgtggtgatttaatttgtatatgctggaaggtcctatttatattcctaattattttgttggtaagccggtaatgatttttctttgtttgataaagatgtattgttgtctggtaatcatgtctaacatgtttgatctacattgcttgctcaccttggttgttatggcgcactaggcggccatggcccatggcacttgctaaatgaagcaatttctatcgcatcatatatctacatgcttattcctttgcattgttcttgcccttctcattggcgtttattttttcctcaattacttatcaagttagtagcacagtgaatgaatgcaataagtgaagtatctgctggcttgctctttgcactgaaaggatcttcatagtttgttgagtgggcaaaggggaaaaatgacatttctatattaaaatttgtttttctttgttgggcaccttgatatggcaattggcaagttatctgcaacatattttacttattcagatgactgtccgtgaagcgctgaactctgcactcgatgaagaaatgtctgctgatccttctgtttttctgatgggtgaagaggtacacttggaactcactcactttctctccctgatttgtgtgtttttctaaggccttctctttcgtggcaggtgggagagtatcaaggtgcatacaaggtgtgtgaagttaaaaaatattagtagttgtgcctttcctcaggtccgctgtaaacgtattagctcttatcgttgttcatgaagtgtattctgttgcagatttcaaagggcttgcttgacaagtatggtcctgagagggttctggatacaccaatcacagaggtgattctaaaaaccttcttacctacctttcttttctgcccattcacatttttttcacactaaggtatcatgcgttcatgttctagtacttatctgcttcagttctgcttttccaggctgggtttactggcattgctgttggtgcagcgtatcaaggtcttcgacctgttgtagagttcatgacattcaatttctcaatgcaggttggtaatgcacgaattatcaatatgctactatgatagtggaatcagtttatattgttgcttgcagcaacggattgctgttgaattttatattagtttttgtctatgtaaagcaatgtaacacttaggtaagtatgttgtacaactagtttgttaatttgctagtatagattatctttcctgcattttagttaaaccatactctaatccatattgtacacatgcttgataaagtgttcgtcactcaggatctagtgttcggaggtccaccttctttgataagaaaccctcttttttttttctgaagcttaataattgacatatatttatcaggtgtacctcattagtgtttacttctgcattatttgtaccaatgacatatttcagtttttgtatgctgtgatttcgttttaattatttatattacacattcaggcaattgatcatatcatcaattcagctgccaagtcaaactacatgtcagcgggtcagatatctgtccctattgttttcagaggacctaatggagctgctgctggagttggcgctcaacactcgcaggtttgtgatcagggaatggcttatgaattagtttatcatcctaggaccccattgaactttgtaaaagttcattgtttccttttgttgtgttgttctacccagaaactgtcctggatgatctggcaacctctttgctaatgctgaaatacttaatatccccctctccccaaaatgctggtctttaggtgtagaaaagaaaccaaagattaattatgagagttctttacagcatgtgaagctgcagtgagctgagcaggaagtttgactgtttaagatcagtttgccactagcttttatattctggctttttaggcatcacttgtttttgataaatcatggtagaattattttgccacttaaatatgtcattataattgcaattattcatttacaaactgaattggtttgcagtgttatgcggcttggtatgcacatgttccgggtcttaaggttctggttccatattctgcagaagatgctcgtggcttgctcaaagctgcgattagggatccggaccctgttgttttcttggaaaatgaactgctgtatggaacatgatcttgttatgctatactgactagccgtcatttccccaagatgctgatatactattttctgcagctatggagaatcattccctatttctgctgaagtgcttgattctagtttcgctctgccaattggcaaagcaaaggtatgttgtactagctgtgtacacatgtttgggaaagaaacatacttgcatagaattaccttgattatttcacaggagtcccttttaatgaacaccttgttttctagataagtgtataccagatacatgctgatatatatttctgttatacagtcagtgaagtttgatgtacttacctgtgggtcttctctctgtagatagagcgtgagggtaaagatgttacaattactgcatactccaagatggttggatatgctcttcaggtgcgtcattttgtaattggtaaacaatatggatgatgagtatgttacgtcgataactttatatgttttggctcatcatttgcgcagttttctatggtgtggcatatcatatctctgtaaattctgattactgtatgtctgtagcggcacttgtgagctatgccttttgggaatagcaatttatttttcattttgtgcggatagagggatcgtttatcaaacagatggttggtacgtccataagtctgatagttaaattgatctgccatattgttcctcagaaagtgtatgtttctttcagtttatgctatttgaggttttaagtagtaccagcggtacttaaaatctttcacatttatgattgcaatattacttttctatgttcttatgctcaatttttttcaggccgcagatatattgtccaaagaaggaatcagtgctgaggtgatcacttgttaaacaatttatgttcagtataataatctataatgcatcaatcttttcaaccacatactgcaaaagtttccttattttttactgctatttgccaataggtgataaaccttcgttcaattagaccacttgatagagctactatcaatgcatctgttagaaaaacaaatagattggtgaccattgaggaaagcttcccacagcatgggattggtgctgagatatggtacgctctctctccacatgcattggcacacctgtgtgtggataaggacttttagttctgacactcgttttctttgcagcatgtctgttgttgaggaaagctttgaatatcttgatgcaccagttgagagaattgctggagctgatgtacccatgccctatgctgccaatcttgagaggatggctgtcccacaggtccttttctgtttctatccaaaattttatgttgtgtcttgtacacatgttttgtttatgattcttttctccaccgatgcattttgtgccaaggacttgcacagagtagcactgtttgggtggaattcctagttttattggttgcatatatttatttctgttgacataattgagtagtagttacttccattcaacctttacattgtggggtggacatgtgctcctatttcgtgaagttgtgctgaatttaatgggagtgatgatttgttttcttcaagttgctctgtttttatttatgcctaaagccatttgattggtgcttctgaagggaatgaatatagtgaatctgatattagcagggaataaagaaatatcagttctatttcgtagttgtagtggcggtgttgaacaggatagtgtgcatatagtgttgattactggctgaccttgagggtcattccgatccaggagactctgaattatgaagatggaacctttttttaataaacagttaccatcattgtcataaccttatttgttaaaacaaatcgatttgtgtgggccatcctatgtgtctggattacaaaaatatttgcaggagcaatgtttcagtagagtaaggaaaaaagtgtggggctattgacctattgtagtttttatagtgtataatgtagaggttgctatacgtgcatacacactcataaatagaagtatttccttgattgccctttccactcaacaacttgagcaatagatatttgatcataagctggaaagcatatggcacacttgtcatgggatattacctaactgtactatggcttttagttaagactttctggtggatgttgtctgccacccagttatccctggaggtgctcactattaagaagttggtaattctgtcctattgtcggtttgtgtgttccgggtgaccactgtgatcagggtggtcatcagcatttcttcgactctttatggtttgcagaatggtggaagtacttgcggtactctttagacactggttcagaatcacatttgatttctgcactagcaatattattaaatatacctttaatgtaaatgaaatgtgaagtctaaactccgcttgcatgtttttttgtttttagctgtacctacagttttaaactggatctacgaggctatgcaattgtgaaatgcatggacctgcatcatttattatcccttatatggatcaactatgctgatcatttctttatcttcatttatattaacgacgttattgttgtgcttgcaggttgacgatattgtccgtgcagcgaagcgtgcgtgctacagagcggtgcccatggcagcaactgcctgataggagagacctcttttacatcatctttcttttcccgtccggccaacatatgattcataatggtgtccaacaattgcccaaactcaaagcgagctaattttgcaagatatttccatgacccccacctattcttttagctgcagttgcatcactgcgttcgttggtggtgacccaaatttccctctttttttttggtgtgtatgcgagaattatgcagcttatggtgattggttcacagtacacactggcgctagttacataaatgaaagaaaaatctgagctcttgatggacacatttgttgcaaaagacaacgagggcaatgaataatcccaacttaagacaacgattgcgcatgtcgcatgttgctattcgcccaaaatccggggtctaaactctcacgatagtcaacattttgaactgtctaaaacctctcgctgttgatgtcgatgcctctctctgatcaattagttttcaagtttttttttaatcttttcccaaaatcgacttaattagccgttatctccaatccaatcttgtatcgccgcaattactaacgatgtgatccccaccgaattgctggtataatagtgacaaccttttctttttagtacaacggtacagctaactaggaagacctaaatgattttttggtcaaacggtccgtgctaattgatcacggatctggtgcacgtaaccatcaatcgctataacaattattgtaacatctctcatcacctaacagaaaatcacgttccattacattatactccctccgtttttaaatatttggcaatgttgatttttagcacatgtttgactgttcgtcttatctgtgaaatatgtaaaactatatgtatacatataagtatatttaacaatgaatcaaatgataagaaaataattaataattacttatttttttaataagacgaacggtcaaacatattttaaaaagtcaacggcgtcgaatatttagaaacggagggagtattaaataagaaaacagcaataaaattcagctggaaaaaggtacttggttgatccacgcacacttgcggtcgtgcagaaaatgtatttttcttagtagtactatctcatcttttttgcccttttttccaaatctctccctttgactggaccatggactgcaacaagcaacaactaaagaaagaaaagacattaataaagcagcaaagaaaagaacagtccaattagaaaaaagattaaagtgcaaataccaaagccaaatcatccctattattatatataaaaaggattagaaatattattatttgtactaccaaaccgagcaggaatgtgtgcaagcaaggcataaccaaaaccaaccgctttccttttgtccaccgattgctctctctttgaccaaacaaagaccggggcagcttaaataaacagacaaagcaatcgaaaatactaaaataaaaaaaaacgaggcactaattaatgtcctgttcacatctaagaatttccaaagctagatattcctcgcttcacaaattcatgaatataaaatttgcaatcacttgataacatttgtatcaatcattttatttctactttaaataaaatacatatttaaatcactataattaaacaaacaaacttcaaattcaaattcagcgtgaatctaaaatctaaagctgtgccaagcatggtttggcagtcttgcctacaattactccttaattaagtcaccataaacacggcgcgccattaggggattaaagaaagcgcaacagtacgccactcgcactcgagcccggaaagaaagaggcaaaaaaaaaaaaaagaattccccatttccttctctctctctctctcatctctctcagtgaggagtggtggtgtagctaagctagggtttcgctcggaatcagggttcggtttcctccaccggaattggcggcgatctggagctcggcacggcggcgcgcggcgtgatccggacgctcgggtaggtgagggagggagggaggagatgaagtcgtcgctgcggaagctgcggggcttcgcgctgcagcgccacgagcagcgggtggaccgccgcgggggccactccccggccgccgccgccgccgcgaacgagctcctcgccgcctcgcaggtgagggggcacctgctccgtacctcccgttctccgtgtgggcgcgtgggtgagcgtgcgtgtgagtgagtgagacttggcgtgtggagatctctctctgcgggagcggttctccgcttctctgtgcgtgtggttggctggctcttgggagtccgcgaaatcggttcccgaatcccgattggttgtttgtttgtgcaaattgtttttgggaattttcgttgccgatggagtactatgggatgatgtgttcggatctgtgctccatgttctgtagggagattgttgaggaggcagacgtatggagtaagttccatggcgcggtgtgcttgaactgtttgtttcctgggtggacactgggaacactcgaatttcgcagtcttatctgctcacatttgccttaacgagcagagtttcatgtaatttgagagaaacattcctttgatcttctactcttgagtatggagttagcaaaaaaaaagaaagatcaaaacaatttagaagtttagttgcactaccatcgtagccgccgacataattcacggctaagctgaatgccttgtagtaatgatggccttgtcaattctagttggatctgacaaggtagtgccccattacctagtggcgattgcttcattagtgtttgatactagttgaaaaccaaaatgctgaatgagggaggttgtctgaataggtggaaacattgatgacatatgagaaagcatgtggtacatttttttttactacagtttagtcttatcaaatctaattggatatgacaagggagtcgctgctcaccattacctagtgtccttttctaattgttgaaaatcaaaatgctggaggagggtggtttttggaataggtgcaaacagtggtgacatatgagaagcatgctttttttttaaccaacagtagagcttaatccagattccaccaagtttcctctgttaaaactttcccttgttaggttcttactaaatttgttttaaactgcaatttcactttcaacaggatatggcagatatgaggagctgttatgacaatctgctttctgttgcagcagcgattgcaaatagtgcatatggtatgtttattccccaatagtacattttgtcttttgagatcagttaagtatgtgttcaatcctgtaaaaatatttttttgtgtattgttgccatttcattttacacatgccctgcaatagaactaacaactgcccattttcaaatggataaaaaacctcaatgtttcttggttaatcgagaaagcatttaagacgaatatttcatagttttaatctaaagtacagactacagagggtgcagaaacttaggtgttttatgagttgttcaccaattcttctcgtgtatagcctcagttcatttgctcttttttcatatgctagcagctttattagttcttatgctaattgtttataaggttatagcagctagaaatataggtgtcttgactcttttttgcatatcaatgatcattttatcctttcatgcatgcagagttctcagaagcactgcaggaaatggggacttgtttacttaaaagagtcacaccaaacaaggacgggattaatggtaattatgttctgttgtgattaatggttctcactcccttgcataaacacatatcttgcaaattaagctcttcatgaaaacgacaaattgagccaagggaagttgtttgtgcccattctcatctgctagttgatagtcactatctcaaattgtgaggaaaatgaataaaaataggataatgaggccatcttaatgttattgatcattccatgtaacttttgcctattatacactttgctgcttaatgcttacattgaacagtatcccccagataaagttttgctgttgcttggaaaggcccagtttgaactgcggaagcttgtagatagttatgtaagttttaagttgtttatcggtggagtcacttatttaccataatcttctactgctaatcaagtcactatatttttcccagcgtgtgcatgttcttaataccatcaccactccatcacagtcccttctcaatgaacttcaaactgtagaggtatgttctcccattctaataattttagccattatgtacaattttttgtgcatattccctcttatgctcatgctcttttctctggggcctattccttccttgttctatgtcgttttactatttccccccctgccctttttaccctgctgatcatatgtacaatacatgaactcgctaaaaacaaaagtttggctagtaaacactggtctgtggcatgaaggaactcaaatcaactctgtagtccacttcattaatttgggttacattttattataaagtgtattgctgatcattcaaatgtggttttacataaactcattgcaactccaatggatatacatgataatctgaaattgtgtgtgtgcgtgtgtgtttttttccttttgccattcagtacaatccctgtttaaagggagcattcatttacttaaaatatagtatacatattttttttgttttgtctactcctatgcagattaacacttcacagctttgttttgtcatgttcttcttgttgcatttgttcttattttttgagtatttattatgtatttgatgcttgattacctaatcgtagtgaactgttcaatagataactatgatttattccactcagaactgcaattaagcaatagtgtttttttattacaggaaatgaagcaccagtgtgatgaaaaaaggtatgctgactgtacagaatgtggcttatatttttccctgttgacacaatttttgagtttccaaatgcttctttcagagagttgttcgaatttctgctgaatgcacagaaagaaaagggaagatctaagaatgccaaaagtgacattggtgcgtcagagcaattgaaacaagctcaggacgattatcaagaagaagcaactctttttctattccggttaaagtcattgaagcaaggacagttcagaagtcttttcacacaagctgctcggcaccatgctgctcaggtgcacattctgtcatttggaaataccccacttccttttttttttctgtggcaatctgtacaaaagctaattttgtgtaaatttgtttatattttactccaaccagctaaatttattcagaaaggggctcaaatctcttgaggctgtagagccacatgttaggcttgctgctgagcagcaacacattgaccatcagttcagtgcacttgacgaggaggattactctgtggatgaagaaaatgaggatgattacaatgacagtcatgaagatttatcctttgattatggagaaaataaggaaggcacagaagctggtcatgcttccaggagccctacagaggtaacaatgtggattttaatttgagcataattaactatcctacagaaggatactctagaattttgcatggtctcttactattagcaatcatagttcaccgcgcaggtgtaaagttgcattgctttaatgagtttaatgcatgactttgtatttctcacctttttaagaaatgatgttacattttcaaaattccatagctactacaaagtacaaactgaataattatgatgacataaccagtaagaatggtatatcgttattccatctgttaggaaagaaagatctaagcagataaatggcattccatatgttcaattacaagacattgtgcttccatgtacttaatttgttaagttgaatttgtatacggctacgcatttcttttccttttttagttggcttccttttcttgtcccaaaatatacctgtttctttacaatcatgtttttcttttcatgtctttggaggccttaattttctggatttgcaggaacttcttgacagaagcaaagcagagtattcctcttttcctggtgaaaggcagagatctggaagtcagtcagccccactttttcctgaaaaaaaacttgaggcagcagagagaataaaagagttgcggcgttctgctacgaggaagctatatacttatgttttgcctactccaaatgatgttagagacacctctcagacagttacagcaaatcctactagtggatctcctcttggaaacaaaggtgcattctattcatctccactccagccaagtacaaatgtgggagatttgagagacaataagctaccaagtcctaccagattatctaatgcacattcagttttgaaagagagcaataccaatactacagacaccaggacaatgcttgtgctccctttgggtgatctctctttacctggttatcatgactcgaaggcttctgacaacaaaaaggtgaagagaggatccttttctggtcctattgttcccaggtcaaggtcaacagagaatattgatgttgtttctgtaccacctaggcacagctcttcacatcagccgtcaatacatgtcagagtttctcccaatacctcgccaccactgttgtcctcacctaaaatcaaggagcttcatgagcttcctcggccacctgctaatgcatcaaaacatacaacatttcccagtttagtcgcccactctgcaccgttggtgccaaattctgctcctttggcacccagaggccaggatcattttaggccgaggcaaacaccaccaagtgctccccaaactgcatcacctttaccgacaccacctgggcctatatcccgcagtttttcgataccttctaggggcatgagaacatcaggtatttcagatggtaaagagacagaagatcttcaggataaagggcctgccagaatgagcctttctagtcttccttcagcacaaacatcgttggaggatcatcggccattgtcaggagctaccgagtcagttagcaaaacatagggtgagtctagttttctgtaatacaacgccaattttggtagaaacttccttataagcaatttattgtttttagtccatccttagtagttcatgtaagaacatcaagtttgggttaccccttgaagattttttttttctgtgttagttcggagcttactatcatacatgagggcgaaaacatcagtgatgctgtttggactatagaagttttttcatttgcatttatttggttgccatcactactggccgcataacacaatatggatgtatatgcacacatacattaatagatgtggatacaaatgtattatggcattatttcaagtgattttagttccttttgagagttaagatgaactagaacaggtccaagtagaaggtagtttgtcaagcaccttcattttattgttgtgacatgtaatacaatggctctatatcagactaatcctttttctcaattaccttcccttggcagaatatttggtgttgaggtgaaagtttatttatcaaggggctcagctatctcgccatggaagaatattgtacatattagtatgtgaactcggccaatattgcaaattagttggtgtttcgtttgtatcccccatggttaagatgtaattgtgcaaataacgagttgtggaataaaatctccatttttctctccgattaattgatgtaagatttgtttgttgtgcccttgagatgacttgaatgccacctgttttccactgctcatgtaagcatcctccatcttaatttttaacatgagggagtcaattttgccaaaaaagaaaaacactagtgctgttattcatggaatctgcatgtatcatttatcaccttatgacaatctttaccatctgtgtgaactgctgggcaataattggctgtggcaagagaatgaagatgtttcatgagagttaatctacttctgtccaaatatacaggcagtttgttatacttttgagtgtattctgcaccaacatttctggttgcaaaatcaatagcgtagaacctgaacaaaatcaacatttaccatgtgcagtactttttctaagctgaagttaactccataattctgtactgtcagttagattgatcacattacgacatgggacgtaccaggttgtaccgatgaatagcttcagaagtacgaaaggtgtagtttcttcaactgggtcgtatttgaagaaacgatcaattaattgtaaagtctaacaggtgcggtcagtacatggaccagcaagcaattgtgtagctgtcacatgcctcaatcatgaacgccaaggacaatgctagatcagaagctggaactacctgacaatcttggatctgtatttgatggttttaattcaatctgtttgcttctcagacagggttatttccagctatttgtttttattctagttgttacaaatggcaggaggagtggactgactgaattgatcaaaaagattattattcagagcaaaactgaattacatgaagctgtccaagaccaagcttggcagcttgggttgttcgttttaggagaatggaatggcatcacgcttcctgatctgttaaacacttaaacggtatgatttagaaatatattatatatgaaattcttataatattggtttaaattcatttttaactttataatagttaattcattcatttgtacacttgcataattatattcagtattgcattccattcaacccaaatgaacactcaattataaatagacgattataaggataaaatgcatatcatgatgttaacaaatagctttgaaaaaaagttacccaaacaataccaataataaaagtttttttgagaaatattaccacccttttatataagtagttcaaaattgaactaatcaacgttaaacaaagaaaattgagaggggaggaaagaagaagattgtgaagatacgtaaaatcagacgaaccattagtacataattaatttagtactaattattttaaatttgggaaaatggatttgtatgatttttaaactgacttttatatataaagtttttttaaaaacgaactgtttagtagtttgagaatcgtacacgtggaaaataagttaaatcttctctcaatctctaaccaaaccaaagaacacagtcttaacagggttggtgatattaatgtgaactgaattgaagatgttcaactggtcactgcaatctcatcaattgatgatgtctttgatgccgagtaaaaaaaaaagagtgaagcatatctttgccttcttttgccaatctggacaaagaaccgacggcgtcagcggcagggagagaccggagagacgtagctgccgaggcacgcaacgaaaaacacaaaaagaaaagcctttggttttcacgtgcctggtcggtggccttgcattggctgcgcctgcacatctttgacgttccttttccattggttttccctgtgcagccagtacggctgctctccctttttctttcatgccaaaagttgggttggggaggaccagaagcattgagcagccacccaacaacgtactgtatgaatgatgcggcagcggcagcagcgacgtaatccctccgtcttaaaaaataattcgttaatccacctaaaataacgaattggataatcttttattcagatttgttgttttaaatgaagtcacatttttatctatgttagattttttttagactagggagattagccgtgcttctttcttttttttttttatgtatgtatgcttctaaagaactgtacgggattccatcctgcttgattttctcttataagtttggtactacattgcatactgagacttgtgcatcaggttaggctgcctagcatgtccatttgaaatcgggacagagctagaatgaaacagcaaagtgggactcacgtattttactctagtttgaactgagtttaggttgatacgtgtgtttgaatttgaacccaattggatgcacatatacgatgaaaatagataaactataagttgtaaaaaaaattagaccgaattcatgagcacctcctaacctaatgtagctcttccacagtttggaatactccctccgtactcgtaaataaagtcgtttaggacaaggttgaaaacaaacattgggaatataaatcatgaataactctcaagttgttgagtttgaaaatgtaaaaaatatatgaatagatttgtcttgaaaaatactttcataaaagtatacatatatcacttttcaataaatatttttatagaaataataagtcaaagttgtgttttgaagaccgtgtcgctatccaaaacgacttcctttacgagtacggagggagtatatttttctttatataataataaattaaaaaacccagcatctatgtatagtataccaaatccacttgaaatacacggttgttctctgttcgtccaaaaacaaagagaatatgaacacttccttgggatgtttattgaaaaaactgtaaaattcatgcgtcgcaaactagctccaatttgaactctgcttcaattttttgtgattcaaggatgatgatgcttggttgtctagttgtaattagacaagcaaataagtttagtagatactaatatacctttccaaaaaaatgtactagctatctaggagtggatttgacaccatctagaactaccaatgtggattactgatagctatatttcaggaggtagtatatattaccagtattgctacattgctatgtctcaaatcgtcggtctaatatctcaatttcacacgatccgatctaaatcctcttaataactcaatccaacagtgagatatctatcgctcattggttcaacttctacatcaaaaaattaccattaggtgccccctatatctataaattcatgataacttcaatcagacctaaccttcacaaatatcaaaaatcagggccctccatctctctttatctacggtcaggatcgcaaaaaaaaaaaaaaaacaaaaacaaaaatactgcttcaaaaggagaccttcagttaaaaaaaaaaagaaaaattgccggaggggagagaaaatccatggaatccgcctatttaaccatgagaagggagaagcgaagataggagagagaagaacaccaccaccaatccaccatcacgaggaggaggagaagagaagacgcgcaagcgaaatccaggggaggagggcgagcgagagagagagagattctcgcggcaggaaatggcccattccgcttgctgctggtaattttgcctctctaggcagatgagatgagatgagacccccgcgtgattttttttttgtggagatgatcggatcgagctcgcccccctcagattgtagagatggcaaaccgcgcgatttggcggttattgggagccacgattgttgtttttttgcgcccgatttcgtgattttggttcgcgatggccattcgtttgcgcttttctgttttgttttgagatggttggggggtgggggatctcggggggggggggggggggtagatgcgattctgtttcttcgtgtgttctgatcatcgacgccgcgatcgctctgggattgcggttgatttgtccgatttggggcgcgtcgggtgatagctgccaagggattttgtatgaacagcggtagatttcagacaatgtagttctgtagcacttcttaggagcttgggataactttatggttagcgcattgatgcctcatttatcaaatcttcattgcgccacaactcaatgttgatgtgaaatggatgtcttattttttgctctgcattgcatcatgttgatatgctgatagcctgtttgctcttttgtggttgatagttaatgctgtcatgttcattgtgctagagaaattattgaaaagcttatttaacagtgtgcggtgacatcctccgatttgtgcttgcaggactctgatctgatctattggaatggttcatcccaggttccttgttgcttgttcaggctccaaattgtgcttcatctccaattgttgcagtaactattggaacatgattggtggtgggatggtgaaatcattagtgctgatggggttcgattcagaagccacattgtagttttagccttcttgtgtcatcatagtttagctgattattactggaacaattgctagagactttgttgctgaaaataagaggctgaaatggatcatggtaaaatctgaataggaacaaagtgtgggcaagaggaaaattggtttccttttgctggagtaactctagtgagatgggtttgcctcaggttcctgcaatcaaggaggaagtgcttcctacaatgagtgcatctcttattgttcgtcctcattttgcggggaatagcacctgtcatttgggtaagcttcctgcagaaagctcaagtaacagggcatctccatgctcatacatcagtgatttcaagagaaatgatgttttagattctttgaatggatttgatggcaattttagagccagccatgctgcttatgggcctgcaggcttccaaggtctaaaacctgatacaggggatgtaggttccagatcaggccctaaattgggatcaaatgttcagatgcctgcaatgaggattgttggctttgaatcaggttttgctaattccactggaggtcctgatacgatggtagctgacaatacggattcacctttagttattgataattgccattcattgattgaacagcatgggcctcatgcgaggaaaagggtgttgtcgcctttgaacaatgcgctccctggacatttccgaggtgatgccctgaatattggttctggtgatgccaaaattcagcattctgattgtgctaggagactttatacttctggctttcaagatcgtaaaaaggcaaatactgcaattcttgattcttttgaggcacctacatggccagcttcgagatactccaactggagtacagagcagggtgtcgataaatttagtggtagtacattcactgatggtcctttgcttgagagcagggagtcatttccttgttcagatcacctggaagctcttgaaagtgttgctgttccacttgcaaaattggcacatcctcctctgcttaatctgtctcctcttggcccaacatggatgcatggaacaaatactgtaggatctcatggagaatcattgagagaaactgaaggttcaacctgtgaagggtattcagaaggtcatggtaggtcaaggataagagatgcgtttgaaaaaactaatatcttacatgatgactttgatatgaggatccctaagaagagttcagatagaaaatctcaaaactggggcccggaatctgcctctgtatccccacgcattggatgtattcggagtattggtctccttcctgtacgaaggtcgttaattggctcttttgaggaatctcttttatctggtcgctattcctgtggaaaagacaatcaggtccgtagaatttatacgctcctaatttagcttttagtggtgtaccataagttgatatttttcgagtgatgccagttgatatttctcctaaagtgcagaatattgacggtttccttgctgtcctgaatgtgactggtggtaacttctctcccccaactcagaagcttccattttcagctaccagcattgatgagaacagctccttactctactattcatcgatcgatcttgtggggaggctgcctatgagcagtagcaaaagcccaaagctcaaaagaagcctgagtaatcatgattcacgatcagcgaagagtcggttacgtatcccagttaaagggcgtgtgcagctggtaccatattcttgactttgagatttgcattaattcactgtattttgctcgattgttcatgatgcattggtgtgtatatatgttagtgcatatgcatgtgggcgacatgcatatgcatgtaccaattatgcaccacaagtctagttatttatcatgggatatttactctcataccattatgggtactggggaagctatatttgtaatgatacttttactactctgcatcatgtctcattttatgccctcctgtcatggatagctttctttggacttaattgcttattctcaaatggttcttccattatttagtcttttaaaagatttgttgaattgtcatatgcttcgatgatgtgtctatttcaccagaagcataactcttgactttgacaggttgtcagtaacccagagaagacaccgctacataccttcttctgcaactatgatttgagtgacatgcctgctggaaccaaggtatgagaaattgagaattgttatattacttttctttttgcctcatagacttatacgctggtggtaactgcaaatgtttctgcattgtcttggagttcctatgatggcatatttataattgcctatatggacaatgctgccagccatctaattcatgctggacacatagatgtgctttacaccatccatgaacttcttatttctggttgtaaaggtctgaccatttcatgccattggtcttacctggaggtgataatagaagtggaaaaatagaagtcatctattagtttgtactgaagcaacactaagcatttagtaattaatgatcctgtttgtagccacaccaccgggtacatgtgatttttctagccgcacaattttgctattcgcaatatattttttgactggtttgcaaagtttggagggatttctggtgttcttaagcagttaccagcaaaaaaaaaaaagggagaacgggcagtggaatggttcttattgttggatagtataggagaggggaatactgcgtaacatgggacgatagtattgagcctcagggggccggtatatataggagtacatggggaggagataaggaaggattacagatatggaaggagtctacacaaatcaatcctatcataatatgactctaactagtaactaccatatactctaacacttatttgtcctaaatggtttcttgaaccctgcttggaacagtactgcttcacttggcaggataagaactatctcatcgtgcatgaaagatgccattcaaaagtaatgccagatgcacgtacggtattgtctgtttagaaggaacaaacataagatgtctacgtttacggttcagattttatcgttttatttctttattttttttctcctgaggtcatcttatttctgttattgtaaaatgggacagactttcatgcggcaaaaggtcactctgttccctgtttctccctctaatcaaaagaaagaaggaagcaaggccaatgaaacaaaggtcgagtcagtccagtttgggagtgaacttagagaatgcggcactctattttctgaatgtaatgtagccattacctgtgatagctaaatccaaattttagagtttataaatactgacaaattgttgttgactatgcaggctgtagaccagggcagaactgcaacttgatcgatgactcggaaaagggcggccgcaagaacatgacatgttgctctatggagtgtgacattagagaatcaaatgactctagctctctagaaacttcagaaaatggcagtagtaccaatgtttgctgttgtcaatcagacacatttcccttaggtgaaaagaaatactgctgtagatcgtccaagatcaatgatccagctggaggtgctcttcgttatgctttgcacctacgatttctgagcccatttgccaagaaaccgtcaagatctatgcagcgtagcaaatctgatgtatcatcagaaccatacaaccatagttcagggcctgaggaacacagacgattctatctctacaatgatgttagagttgtctttcctcaaagacactcagatgcagatgaaggcgaggtatgcagccctacagcagctaccctgttcttgtttctttctacatcagtaggcttaagtaattctgaccaatagcattgctagcatgtaggtttcagtaattctgaccaataacatagatagcatgtaggtttcagtatttcatatagataaagtttctcagaactgttttccttatcctaatactatgatgcataactctttcgcatgttcccaagaaaaaaaagactttcttgtgccctttctagaggagagttagtttatttgtttatttatttatatatttattttccctcaactctgttttctctaaaggacattttttttccctgcagctgcgggtcgagcacgacttccctgctgatcccaagtacttcgacataagcaactgatatttactcgcgcacttcacatgaaatctgtatatatcataccctcattaacccgtccatcaatcccttgtgttcataaacattcacccatttgtataggactaaaatcttccaatgaaatacctcatttcgttcagaatcttgtgcatagtctctaaataatgttttcaccatacatggtgatgttgtcatctctgtcatgaatgtatagtttttttttggtaattttaccatccttgagaaggtaccaagaggtaaatttgatacctctaggtattaagtacctcgaggtaccaaaaattttaatgtaaaatttaggtatctcaaggtactttctcaaggattgtaaaattcctcatagttttttccccagcaaaaactcacaaaatggaacaaagattgtaaactgaattttattaacctctatggtctgaatattgccgtcaaattgacaagcagaattgctgagagaaaaaaactgataactatgtgaaacaaaaatgcatgaaacaatataaacaattgacttgaatgtactcctatctaattctgcaagtgaccatcttagttctcacggatcaaatgtgggaacttctgcatcaagaccatgaaccatctgatagagaagcctggcgagtatattcctgtaagggtccttctctcttttctcctttagatacttcatgcagctctcaacttcggacttaacattcaggtagaggtgttgggcgttctctttgtctcttagttccttttctctccctatgaaaacaagcaaaaatcaggtctcggaaaaacatcttcatcacttcatgtgttctagcctagtagcttatcttcagattgccaaaagaaagtaagcgtgtttaacttgtcatgagacagtgcgtgcgacaggtatattaattggagatttacttgcgtagttctttagagatgtacctcttgtttcaattggcttcccaaagatgaaataaaacctccctggtatctttggggcagccactactggatggattctttgatattttaattctccggtagaatcagtcctatgaaaccaagaggtaaactgagatcagatcattttttcttccaaagaattctggagacatcataaaaacaaacactataattaaattaaatccaaactcttttgacttttgtgtatgggcgtatgggcagcatatataccttagtttcacaccatcttcatttagcatcctgtcaaggatgtcatagaatggaatcttcataagatcgtcgtagtctaacaacatctgaggtggtacatctgtcattagacaatagaataaccagaaaacaaggcaaaaaggtgccaacttttttactctgagcacctataggaactaaattcccatggaagggaaaatttcctgccaaatcttgtcaatcctagtgattacagttagaatatatagtgtaaagcataattatctatccttagaccaaacatgtagacagcaaaggttcctcgcaaaaaaaaatgtagacagcaaaggagatttgcatctattaataattggtagttaatagtaagaatgcactcacatcacatatatcatcttctccaactactccaaatggtattattgttgctccaaaccttgatgccatcctcacaaattcagactgctctggccaaaacaacttatactcctctccctgaagaacagccaatcctctagtcagtagattgatttcatgatctcacaggttctatatgccaaattcagattgatttcatggtatcactgactctatgatctatctgccaaattcaaactgatttcatgataacactggctctatgatccatctgccaaaactgttgctacctttctatgaagcgcttctcgcgcgcctcccgggtacagcaacacgaagtgcttctccgcgagaagcttgtaaaaattgcctgcggtgacaggcacggcgcccatgatccgatgcatatcgtagtaggacggatccggcatgatcttctccttcttcttgtcaaacatgaagggatgagccaagcctctgatgtggatcccagagcttctcagcactccggtcaccagaggtccgagctcaaaccccaacagcatgtggtacccaacaatcactgcaggaccttgcttgggtaggcctgacaaacccctcacaatctttccatcaggcagtgttgatagcatcactgggtttgctatgtactgcaacatcctgaaagtttcagaaatccagtagaaaatgttcagtttcatgtgacaatttgttagttattactccaacagtaggaaatttgctccctgtaaaggggaattgcatggattctgaattgaccaagcttaagttgttttgagagatggtacctgatgtgatcagttgccttctgaaattcatcaggagtcagtggcagatagtccgaaacaaagtccgtctccaacgagcggcgatagtacccagctcctttgatggccgttgccagatcaaattcagcttcctatccaatattttaaggagttaacatggacatgccaaagatgaaaatagtgtcaaagtaggcttaagcttaacatggacatggcaaggatggacatagttatctaagcaatttggactacggatggaatttgctcgatgtgtaggacaagaacagacttgaaaattgaattgacaaataaaaaacactttttctcttccttggaccagtgagatcttaacatcaatacattttctaagacgcctggaatatgtaatgcagagaaacatgagctttcataccagcaatattttgtgaccgttgtctttgaaattacggattctgcatttctctagagcgtcacgtagcctttcagcttcttctcggcttggtagcagttcatcattccaactggaaaagaaaaggagaatagaatcttcagatccagtccgaaggaggaccataagtttcagtattacttaatatcatataatccatggaaagacagcatcaagagcaatgtgcacattgctaattgcaaggacatgataaaagttatcaggagctaaacatacctagcaagcaccaaagtctgcgctttaactgcatgcaaacgggaattgacaaatgatgacgctgttctcagcattttcaacttccaaacaatagattcctttggcagaacatcaagcaaagactgcataaacaagggcataaaattagtattatgatgattcagacatgaactgacaaagaaattggagcaatggttagattcgagtctcaccataagagaaggcaatagactagtggtgatctctgatagtgcttgaccagcttcttgaaatgaaaaaccacgcccaacaatagtcgacggtatcttcatgaagttgcctaaaaacattttttggtcactaataagcattacatcttataatcagctataggcgaagcgatgggtgagcttggcttcaaatgagtctactcattaatttcataaaggctcaaagtgcagaaaagtgagctaaacatgcaattatacttcttccccagttgagtaaaataaaatcatttatccatcaaacaagtcataaatattctcatagagaagttaaccgaacctgtcaggaaattcagcaactgcggtgtggttaaatggaacggttcagggaccaaatccaagaagactgagagagactgcagctgagacttatggaaagatgttcctgcaagaaaaccatacaacagaagataagtcagtaatcacttgtcactgaaagaagataaacagagaaagaacagaaaactatggctaatggcagcaagacctgggttgactaggatcaataccaaatcgatatctggatttcgcgccgccacggcaagagcaatgcatgctccaacggattctccgactagatagactggtctgtctcttgctctctggccctctgatttcactgcactctccacatactcaactagtcctgtattcattactacagtttcagagtttttacaaactatataagtttagtccaaaaaatgagctaaaaacatggtttcttatgcatcatattcttacaggaaattacgataagttcaagatcattaaggtttatatacttatacttcttaaactacaagcacatgagcatttctgtccattctttgaattataattaggagcatatgggaagtagacactacttcatttatgagaagtagacatcaagaaagtgtaccttcaaaggacgtacaatcttcaacaggtatatgtaagcaccacatatcaaacatcctgcaaagcagaattaattaccagcggtagtgaagataaaacagccatacattatacataaaattgtcattactttgctaatctctcatgatgccggatcagtcttaagccaactccatcaattcctgcaagaccaaagaccgaaaacggttacccatttttaatttttcttgtgtttctcaaatggttggaaccaaagtaatgaaaggtatgaacatatattctgacaatccaacccataatgcagtaggttgcatttccactgggataagactttcagtactataccttttttaaaacacaaattttcagtactatacttgaatactttaaaaaccaaatctctaacccaatgatcctaagcctgaatccagactttgcaagcatgtctgctgcatcaaacagtcagattaacagtgagtctctgattatctgtccatccatctaatccagccacttccaatggccatcaaccaccagtaaacaactgagctggtcaagaaagccagtccctttccccattctactaatattggcctactgggagttttcgtagtggcttgtcaaactgcttttattgtttatggtttcagcattgcagatcttcatgcgagcaattagaaaattttgtttggcatgatctgggtgagtcaccgaatcgccgacatgttgtctaaattagtgctgctgcactgatcttgatgagcttaaatattgccaattgccaaaggtggttggtcctgctttcaggcctaccctacaaccctctggtttcagactagaaaatcttgcatgattaaatggtgtcaaaattgaaataaaaattcagggaaaaaaaagggggtactgttcaaacaaattttcattttcaacacacccacttggtactattcaatatcatgctttgtcagagtttcacaagataaacagtattcaaacacatgttttacttatttatttgacaaaaaaaaaaggaatatgcagacacacatgattaaaaaaaggaaattatttttcttttttttttcagagagaggctcataccgggcaagtagagcatcgtgggcgcgccgggcagccgccctccgccgccgccgcactccagcggcgagaaccacctcgccgggccgccgtccggccgccgcaccatctcccgcgccgcctccacgtactccctcacccctctcctcgccgccttcgcggccacgccccgcgacgccgccgacgccgcggacgcgctccaccgcccccgcggcggcgccgtcccgcggcgtggcaggccgggcaagaggggccgcggcgctgtctccaccgtcgccggcatcggcatgggtggttgcgcggctggctcgacgtacggtgacggcggcgcctctggtcttctccttgatcactcgcgcgcgcgcgcactcgcttgcaacgtacgtgtcgtgtcgccgtgtggctggagaagaggaagaagattagagaaaagtaaaccggcctagtgcactgacagcactgtgctgtactagtactcccgccatactcgtaaatactcgtaatggaaatcatttagaacagcgacacggtattcaaaacacaactttgacttcttattcctataaaaatatttattaaaaagtaatatatgtatacttttatgaaagtatttttcaagacaaatctatacatataatttttacattttcaaacttaacaacttgagagttattcataatttatattcctaagatttaatttaaatattgtcctaaatgacttcctttattagtatggagggagtatatgccgtatatatataactaggtgaatatctcgtcacgttgctacgaaaaaattaagttacacggtatatacagataagacataatatgtttattgaaaccaaaaggatgcttcgtatgttttacataatttgtatatggttgcaaatatagtgcgagatgaatatattttatgtctaattaacacttatcaattttgatctaaaaataattaagaaagaagaaataagagacaatttaaagcataaatctattatcaaaaactataaataattgagatgatgtgaattaatgagagaagagataaatagtattatatatgaaactatatttagtgggataataactatatactaagtatatagaatatggacgcacgctagcaatgaagtcaaatgagagaacgatgaatcaatcaaacagttaagagtatatagaaatactgacttgaacatctcaactagaactagactgtattaggtgcaaaatgtctgcatatacagaaatgggggctgctaccccacggaataccgtggaaatagtgtactcacgggataattaaaaaagcaatgacagcataaaggagcaccccacagaacacgtgatttgtctcaatacctagccactgtctgctcggtatcgtcgccggagcagtggctaccttacctcgccggcgtcatcgccgaagtagcagctacctcaccgccaaatattctccttgttatcgcgcgctcgggtgatacctcgccggcgtcgtcgcccctgagcacccagagtagcagctacctcaccgccaaatcctcctggtaccttgagtaaggtaccgaggtggtacctggtacactggtattggctggtacctggtaccctgggtatcgagctggtacctagatatcagaccttggtacctgggtatcagcatgatacttcaagagggaggaggaggaggagtcgtggggtcgggaggtcctggtaccctggtatcgactgatacctggtaccctgggtatcgagctggtacctaggtatcagaccttggtatctgggtatcagcgtgataccctaagagagaggaggaggaggaggagggggaggagtcgcggggtcaaggagttcaaacagcgggccgggccgtcggcgaagaaaaagaagccgacagatctggtgcctaccttgtaccatgcctccccagcctcctcagccggctgtggacgacgatgtgctcggcgcacccctgccgccggccatggaggtcttcatcaccaacgatgtagcagatccgcttgctgccggccatggaggatgccgccgcaaccgcaccccgttccggctccaccgcaccccgctcccactctccctcttgctcaccgcgctcgctgctgagctcctcgccgttgcggcctccctcgcggcggcggccgccggctctggtgagcagtgggcgacggcgacagggagggttgcagtgccgtctaatttaggggagaagagtgaagtaagaggaggcgacggggaggcctgcaacgccgtgtgatttgggagaggagagtgaggtaggaggagaggagtgaggtaggaagaggggatcccgtctccacaggatgccgtgttgtaggttttctgtacagaaattcattgaaaatcaaagggaaaaaaatatcaaataattgctcccaaaaaaattgtgaaagtgagcaagtacgtgcatcactgtttgcaggatgcacgcaagccacataaaccgatctctctctttctttttttggattttggtggcagagtcaacgtagagagatgggtaatcaagcagttgccgattgagtgaagtaatgaagttgagttaacctgacagatgaattggcatcttcttctcccaaaattgttttttatttttattttcaaacagaacaatattactattgatcaacacacatagtcgttttacagcaaaagcgtataacccatgaactgatcacaatcaacaaagctggagacgtcagaaacactttgtgattgcgatgggagtctgaaccaaactctgaagaagatgtcaccctctctgcaatttctatccgttcgatgagttggccgaacgacctgagccggatatcttgttgggcctgaacagtaacattacgtgcgtgaggcccattacgattgggccggaacgagattgccacgtacgttctagttgggtcggaacgtcgcaatttcttatttgggctggtacttgcctacaagcatagtccagctacgctcgcatctcaatcctgggccgatcagttggatccaacggtcagcagcatcgctgaagggcgttaggagcctaggacccacctgtcagaactcaaaacgacgaggggggttcaagtgcattacccgcgaacctacttataggtaaaaataagtaagttcataggttagttttgcttataagtggattttcacgggtagccgcttgcacacttagggaggcccatactacgggctgcttcgctttgtcgccaattctaactgacataaacaatttgtgagagaaaagttccgtaactaccaaatattaatacaattgtatttataagataatgtttagtttgctaccctactaaagtttagtggggttgaaagtggcaacaaaattacaaacaggtcctacataacttgccacattttcaggggctgcaaaaacttctgagtggaataataaccatacaacaatccctcaaaaagtcattcaaaaaaaacttgtcattaaaaaaaaacaatccctcaaaaaaaaaaatacaacaatacaagatcatggatgtgatatcgtatgtattctactactccaggaaacaagtttcagttcaggctattcacaaaaagtgttggtgatgcagcatctccattcccccagcaataatccccactgaactgacgttgttgaggatgtcgctggatttcagacatcgcaagcacattttcagccgccgtcgccgccaccgacgttgaagatgtcagtggccctgacgaagcgccctttcacccgcgtcctcgtgtcggctctcatcttcctcgactcgtaccggatgtgcttgtcatacctgcatcaacaaataaccaaattcaccacgaaacagtgagaaaggagatgatcaatggcaggttaagcagcttctgtccaaacatggtcagaaaaaaaggctagtgaaaaccatgcctgcgagtctttctcttttctctataccgttgcatcgcgttgtccctgttcatggcgatcgttttgctgtcgatcttcagggaattcctctgatcagctccagttacagtttgatcagtgatacagttctccccggcaagaactgctgcaacttcttcaggagaagagttcagagttctatcgacgtcaacgatcctcgaagatgatggcccgtcatttgtcaatccgtgttgctcgttcttgtgtcgcctgttgccggatgtggcagtgctcagctgaaaataggtgcaagaatagtgacttgagtaactcaattgccactgtcaacaacaggatcaatcgatgggtttctcaacggtgtaaacttttcacagattaagttggctgtcagtgtcacattgaagagcatgaggtttacattgctaaacggaccaagagcaaaggatatgatgagtatgtgcatgatggcccatagtggtgacagcatccagataatatcttagatcagatcggagcacatggtctactctgtcaatatcaatcctttagacgataaggttgattgataaaaaagtctgaaacatttatggactgtgccttaacatcaatgagcagctatatataatcagaccgcaaaggtgtatatatattattatatatctaagatcaagagcacgaacctctaaacatatgaacaagagcactgcacatgaatgggacagtgatacatccctatgcgcacagtacttcacttatatttcagtataattttagagttcgtaaatatcacacaagcatgaaaatatacagaaatttcatctgtgaatagcaaaaagattgaaatgtggattacctgttttggagtcaactggtagatattggccgacacaatatcttccgtggcaaaagagtatgtcgagtcataaatatattgaagatctttccttgagctagaggaaacttcctcaatcatgtcattataacttttgatcataaagcctccatcttttgggccgaaatgaagttcaagtgcagagtgctcatcatggtcccttgattttcctagattaaaatcccatatctgtcatgccaataacaaactctgatttcaagttgtctaactcctcttttttcccatgaaaataagcacatagtgattgacacaagaagaatctgctttctctggctgtctggtaattagacccatgactataacataatagtcatataaaataaaatttccaggctagaagtgatcttaccaaaaaaaaaaagaatctctcttaggtaatactaatgcagctaatatcaacaggcaacaggcacatttgggcttgagaaaatggtcggagcacaaactgtggatcagcatgaacacattattttgcttccatgccaagttttcagttcatcctctgatcacatatcccatttttattttgtgggttacaagtttactactactaatgctaacttattacagagaaaaatcagaaaacacagctttttgacaccataccacagaacaatcagagaaaaaaatttgatgataatcaaggaggaacttggttatcaaataattagaagaaattgtaagcatgttgagaatttgacaatcagagtatgagaatgagaccatgctatcacttgtaataaactgttgaaataatggaagcaaaaaaacacagtctctttgtcactacctggcatggcggatcggagggcgcggtgcgctgccacacgagttcgttgtcgtcggtgaactgctcgccgttgccgacatcgccgcagcccgccgcctccgtcaccggcgtggacttgtacggcaatgtggccctttgcgccgccgccgctgccgcagcctcatggcggattgcagcggcagagccccggcgagctgatggggagatcgatcccgagttcgcctgcgccggcgcggattccatctcacgccgcgccagctcggcgagctggtggcagagcgagtcccctttgagccgccgtccgcgtccgccggcggcgacctccggcggcgggtcgcagggcacgtacatgtcccgcagcacgcgatccgccgccagcattgggtaaccggcctcggggaagaacggatcctcctcgaattcatctcttccgccgccgccgccgaggtcgagcccccacgacgcggcgagctcggcggccccggggcatccggagaaccccaccacgggcaccctcgccgcctccgcaccgtcgtcgtcggcgcacccggcgcaaagaaacctggcttcccggccgccgccgcatcctccagttccagggacggcggcgacacgcgccgccgcggggcgcgcctcgcaccgggcgcagagcggcgcccgcacgtggccccgcgacagcgcgttcgcgccgtgcacgtggcggtcgcacgcctgatgnnctctgtgccagtggcnttagtngtcatntccct

SEQ ID NO: 34280 - DNA, 16281 bp, Oryza sativa
  unsure (1)..(16281): unsure at all n locations
agtgtggatgaatagttgcaacaattttaagcatagctattttgctgttagggacaggtatctaccgggagggtagttacaagtgttaatttttgaaaatgttttgaaagttagggcgcagtgaagaatttgttgattttaaanaataattcattaaatagataaanaancttttntnacaataaaaagnatnnaaatcgcccccggtggcgcaaaatatctcgcgcttttttttcttccgccgagctggctgaggcggggcccagtaggttctcttggcccatatcagttttttttgggcctgacggattgacggcccaggagcccagttaagaagatcactaacggcccaagtcttcataataagaagagaaattataaaaagtataaagaaaataaagaaaaagaaaaacacaaacggcccagcgaaaagtctgcacggaaatgctttgggaaaagaaagaaaatattagattccaatgattgaacaagatctagcagtggcagcgacaagggattatgggcttgactaaaggatgagggaatgatcaattgaggtcactggtgacatccaaatcccatttttgaaaaaaattcccctgtttttgccaaagcaaaataatgggaagaaatttcgtttataaaagtttgggactgtgtagcttccagtctcctcaaaatacctacaaatttcactcactcttagaaagccaagatctcggcttctattttgattacttttacgaaatataaggaaaattaagtatacttttttgggtgaatagctaatttaatctctcaagtttcaccgaaggctcaatttggttcttcaggttttattttgtccacatatatcctctaagtatttgttttggcttaaaatcatccttaggctcacttaatagttaatatgccatatggctatttctagtcaacaattctgttagaaaatgtctcttttgcctgtaatttgtatgcaactataaactagaaaagtgaaaaccaagataaataaacaacatttttacttcccattatttcaacatgtgcatatgaaacttagtctaatggctatcgtatacacttgcaagtacataatttatttttgttttacataaattgctatccattatctataaaaagaattcattgcacgcaattttttctcttatatatgtgaatgagggagtataattgtcatttatcaatagagttgttggttatgtgagtttaaggataagtttaaattaaaataaaaacttgaaggactaatatggacagattagaacatcaagaactaaaccgagcctcgcatgaaacttggaggaccactttgactattcaccctacttttttcaaaaatgtcgacacataatcaccacttccttgccacttgaaatttgaaaacacaactatccacatacgttgctcctgttatggaatattatctcccaatgagataatatcctttcttgtattataatctaaaccgaagtatagataagatctatttcctcctaagacctccctatatatacagggacagagtgagatatctaaggttgatttgtactccagataagatttataatgaaaagagagctccaccctacatatgtgttcattgtctatttctacaatgttttctgagggcaaagggaagggcacggatgttctatatcatctcacacgtctactgttatgggagctgagggacaggaaacggatccgtgatccgctaatgaacgcgttgatttacaacaactccaacatttcgaatcaaaggtgggggtagcttagcaatggtagcatgatgggccgcaggaaatggcgggaaagataacgaggaacatatcctgcgccctttccgataatggaaaaaaagagaccaaaatgggctcgcaggatcggatcggatagcagatcggtcggtggtcagctcatccaatccaatttctctttaattctgcaactgcgatcgctttcagtgtcaacttttgcagggtataaatcgggcaacggacggagatcttgccagcccaaatcaggaaagtttctcagcgagctagcagctatagcttagctggagatcgatcgagaggtagaagaagaagaagaagaagaagaagaagaagaagaagaagaagaagaagaagaagaagaagaagaagagaggcctcgcatggcgatgagagctcgcatctggtagccaaggatgacttgcctgtgtctctgctcatgtgcagtagaagaagatgcatttctagctgctttctgcatatgtgatctcacaggcagtctccttggctagcctgagcggctctcatccttcatgcctggctcatctcttcttaatgatctcttattagtcacagatcctgtagagattagttgatgtttgatgcttgtccacttcagtgccacacataaacatagcggccgtgatcaactgatcagtccagcctgacagagaattcagagagcatgacaagatcagcttctgacaaaccgcgcgagattaaccaacaaatgtattcagggagaatatctgaattgcattgcactttgcatgatcgggacattctcgttaatttcataattaaaattcagatgctctctctgtacgtaactacgtataatactaatatactttgctgaattgctttggttcttatttgatgtgtgcaggcaggcaagatcaagactacagcggtgcgtgcttcctgaactgcctgtggacgaagacgaacagacaaagctagtgatcgatcgatgctctgacgacagccactcctgcaggctgcagcttatgcactggtgcatctgctagatagagcctaggagagtaggaggatgcacttacagagagacagaatgtgttgttctctgcttaatttgttagttaccacactgtttaattcctctgttcaatgggaaacttcgtttagggtgtgtttagttaacgctaaaattaaaagtttgattgaaattggaacgatgtgatggaaaagttggaagtttaaagaaaaaagttgaggactaaaccaggccttagtttgttcctagtactgcatcaaattttgaaacttttagggcctgtttagttcccgagagtgtcacatcggaagtttgaccagatgtcggaagaggttttcgaacacgaatgaaaaaactaatttcataactcgcctggaaaccgcgagacgaatcttttgagcctaattaatccgtcattagcacatgtaggttattgtagcacttatgactaatcatggactaattaggctcaaaagattcatttcgtgatttccatgcaaactgtacaattagtttttgtttttatctttatttaatgctccatgcatacatgtgtctaaatgttcaatgtgatgtttctgggaaaaaattttgggaactaaatcgggccttagtcagttagtcctcctgtgtcatctcatagacactgaaacttgtgttacgccaaagcaaaactatcaaaagatttataaagaacaccttagtacgcctcgatcatggagaagtcaatttagggcagttggtgaaatgaaaattttatgatgtcacatcgaatgtttgaccagatgttggaaggggtttttggacacgaaggaaaaaactaatttcataactcgcctggaaactgcgagacgaatcttttgagcctaattaatccaccattagctcatatgggttactgtaacacttatggctaatcatggactaattagactcaaaagattcgtctcgcgattttcatcataaatgtacaattagtttttttcatctacatttaatgctccatacatatctctaaagattcgatgtgatgtttttggaaaaaaaaaattggaaactaaataggcccttacaatgtaaatgcatgtacgcctatacccctattgtcttgtttgctttgagatttgtgtatgtagcatagatttcaacaaatcacaatattatattcctccttttagtacatcacgaatttcaataattcatcaaatgcatccaaatatagggcacatacacacttgcgttgtaaaaggtatgttccctcgacaattaattccacgcacaagagaaatctctaaccatgaagtagtgagaatcaactatgggggctccctcgacaattaattcgaagcacaaaagaagatctctaaccatgaagtagtgagaatcaactatgggggctccctcgacaattaattcgaagcacaaaagaagatctctaaccatgaagtagtgagaatcaactatgggggcgtttagatccatggtgtaaagttttgacgtgtcacatcaggtattatatagggtatcgtatgtggtgtttgggcactaatgaaaaaactaattacagaatctgtcagtaaaccgcaatatgaatatattaaacctagttaatccatctttagcaaatatttactgtagcaccatattgtcaaaacatggagcaattaggctaaagattggtctcgcaaattagtcacaatatgtgcaactagttatttttttagtcaaaaacttttaactcaaacttaaaactttcagcccaattgtcaaaactttcatctcaaatttaaacaacttttaactcaaaactcaaaactttcatctcgatgtctttgcgtttccttcacataccaagaaatggtccctgaacattggattgaacattgacagcgggcaattcaaggaggtcggatacggatcactctcatggttggagagattttacagtcattgagagatatcacgaggtgtcgaggtaccaaaattgttagttaaaaaaaattctgcatcacagcagaaatgactactgttttttttttgtctgagctctgaagcagcagtttactgcaagaaacagcagctaaagtacggcatcacttgaacacaaccattggatttcaatcaaacggttcgaaagaacctcttgaatgctcatcctctgcacttagaccaccaaaagtcagaacatagagaatctgttctcaataacaaccatccccactacttctacaagcatgtcaacaaaacctgatcttattcagatcttgaagggcatttcgagtgccaatcctgaacattatattcgttgcaaaatgtcaacgagtgatccttgccaggatatgcacggaccgtgcatatattccccgctttccaaattgggcaagattgaaaaggcgccttcagggcttgaaccgaatccaatccttgtaatttgtaaaggagatcaggagagtggatcaaattattcgatgctgcatggacccttctctccctgtcgagatagatagatagatagctccgttagcttcttccattcatggctgtctctcctgcttcagattgctataaattggccatgaacttgcagtgtttttttcacacaaacagagcccaaacacacacaagaggagagagatgaaatatgataagagtctgtctagatagccaaggatgacttgcctgtggcctcttggagagagaggtgtagcttaattagcagcatggtttgagcattgcttgatcggttgatcgcttcgcttgctctgcatgagatcttacaggcagtctccttggctagtctgggcggctcttatccgttctagtacaacataggcattaggcagcattgcagccttgcaaagtgcgaacagcagtcacctttgcagtgttgaagcaatgccacatataaatttagaaattttctcatggtttatatggttaattatagtcgttaaattatttgggagacgaaactgtcacatatcacaagttatatttattagtagtagtgattttcttatggtccgaggttatattaccatattttcgcaaaaaagaaaatgttcctctcaaggaccgtaaaatttccttgcatttatgttttttgaacttctgttgatgatatgcaaacatataccaagcaattctagagatttatgtgttatataattgactcaaaacaagggtttgttcagcatttaggaaagaggttactcggcggtatggcacttgctgtgaaaaccaagaggttaaggttacctataaaatcgagagggttacacaaacacccgtgatatcacaaaccctagggttgtagggcaataattatgggggtatgggtattacgacgtcaatctgtgttatctgaactctaggtgaagatataatttagagcatccttagtggttcatccaaatctgatcctccatatacttatttggatggtcatctaaaaaagattctcactctgtatcccttttcactccaaccgatcatccatactacatccttcatatcacactctcttatattaacatctttcaactacccatacatttgtactatttttttcgtaatagctaaattttgaatgactaaaatttaacagtgttatttgtagtggattgttttaaataaatgactctatttgaatggatatatttttgataggtaattttttaattgctatatttccaacggattggtattttttcaaagactaagttgtaacggcatattgcatatagccgaggaggagaggcgagtggctaggcgttggcaggtgcagacggccgacgacgggagccacatggcgcattgggcaagggtgggagcaggcggtagatctcggagcaggcaggcgtaggtggctgacggcaggagttggcacgagcacggaatcagggccaacacataatctatccccacctctaacgtagtcttcataaaaaaaacgttggaaaggaaggtgggagcgggagcttgcaagatggtgcacatgctatttttggaccatcgggtggagtatttgctggagcctggttttcttctcaagtaagctattttcatgatggaggatgggatgaagtatcttctaggaatgatcttaagtgtagcacgtagtattttcctttacattttcatgctttatgtgcatataggcacacatttttactatcgcacaaacatgatagagtagagaagatagaggaaccatctataaataaagtagagaaactacactagtttaaattaacacgggtttttactatcgcacaaacatgatagagtagagaagacagaggaaccatctataaataaagtagagaaactacactagtttaaattaacacgggtaaaaacttacagatacaagaatctttgaatttttttcaagcattgcactacagataaaaaaagctttgaatttaaattctggcactgcagataaaaaacacatgctacatatacaagaatctttgaattttattcaagcattgcactgtagataaaaaaagctttgaatttaaatgcaatcactacagataaaaaaaactttgaatttaaattcaagcactgcagataaataaagaaataaatctttgcatttaaattcaagcactgcagttaaaaaaaactttgaattttattcaagcattgcactgcagataaaaaaaagctttgaatttaaatgcaatcactacagataaaaaaacctttgaatttaaattcaagcactgcagataaataaagaaataaatctttgaatttaaattcaagcactgcagttaaaaaaaactttgagtttaaattcaagcagtggatataaacttcagatacaagaatctttgaattttattcaagcattgcactacaagcactgcagttaaaaaaaaatttgagtttaaattcaagcagtggatataaactacagatacaagaatctttgaattttattcaagcattgcactacaagcactgcagttaaaaaaaaactttgagtttaaattcaagcagcggatataaacttcagatacaaggatctttgattttattcaagcattgcactacagatttttaaaaaaatctaatttaaattcaagcataaagcataaattaaaagcactgcagtttaaaaaaactttgagtttaaattcaagcagcggatataaacttcagatacaagaatctttgattttattcaagcattgcactaagattttttaaaaaagctaatttaaattcaagcataaagcataatttttttaaaaaactaatttaaattcaagcataaagcataattttttttaaaaaaaatctaatttacattcaagcatgaatttgattttattcaaacattgcactacagattttttttaaaaaaaaataatttaaattcaagcataaattaaaaaaaatataatatctgatttaaattcaagcataaatttgattttattcaagcattgcactacagatttttttaaaaaaaataatttaaagtcaagcataaattaaaaaataaatgcgttagaaggagggcttgaacctccgaccttgtggttaacagccacacnnnnnnnnnnnnnnnnnnnntccagcttttgtctcttaaaccacatccaccattttctcctttgatttcttcatattgggccagacatgggcgcacgcgtacgcatgggctcctttctcgctggaaataagttcgctttatatccctcatcttgacgtcgagtttgtattacttccttaaccataatgccagatataatgtatccgttaacttacaaaaccgtattaaccaaggtcttagggtaatattatatctagtttggctgacatggtgagctgaattagtgtgggaccacacgggtctaacatgccagcgaccggttctttcttcctcctctcttcctctctctctccccatctctagagcgacgaccaacggagagaagggcggtgcgtggtgagcatcggcataatccgacagtgcgatgtggccagcgacacacttgccgagcagcaacgcgtcctcccactcccgcgcaagcaatcactccagcccgacgtaggtggaggtgttaacctggttttccttggcggagtgtcgcttcctcaagtagaaggcgttctcggtgaagcaacggctacggatgtgaacgtaggacttggcctcgcgtcgcacgtcgctgttgccctcgatgcagccacccgacaccttattgtgtttcttctcgtagccaacacaagatttttgatgggttacatgtggtccctccgtttcacaatgtaagactttctagcattgcccacattcatatatattagacatatatatatttagattcattaatatctatatgaatatggataatgctagaaagtcttgcattgtgaaacggaggaagtattgtccacattcatatatattagacatatatatatatatatatatatatagattcattaatatctatattaatatggataatgttagaaagtcttatattatgaaacggaagaagtattgtactattgtggttcaaggatggtttttaaactcgcactcaagtgattgagggatctttggtgaacttattcctttctcgctgccccgagcggagcagcccacttgttgggcctccaccaccgccggtccggcccaaccatcccggaatactcgttgacatcgcgatgcgtcgtcgtcgtataataccacagatacgaatccgctcgccggagtccacggggagatcggagcctgcaaggcaagcaaccaccgccgccgacgacgacgacgttgacggcgacgaggagacgatgagctaccagaaagtgccgcctcctcaggacggctaccctcctccaggcaattccccccttccctcctcccccggatccatccctcgccggaccgggataatcacactgcggcggcggcaggggctttcttgatctcagcctccccctgttcaggatccccattctgttctgggttgatttggatgcgtgtccgaaatctgaatctgtgacggcgcagcatcgggtgtcgccgaattcgtgcccgattatctgatcgatttttagggtcgttcttccgtgatttctctgatcgattcttgggctgtttgtttctgtggatgcagggtactcgcagccatacccgccgccaccgtccggcgggcagtacccacctacgcagtactacccgccgccgaaccagcctcctccggggtaccagggctacttcagcgaggggcagcagccgccatactactacccgcccccgcatgatccccaccaccaccatggtcaccaccaccaccacgaggaccatcaccaccacggccaccaccaccatggccaccacgacgatgactgctgccttggcttcctcagaggatggtaattcaaagctttactccttttcatttcttgccaatttcgtgtgaatactttatactttcggtgctcgtatgcgttgttaatcatggatgctctattgctctgtgaactacaagttcattgtgtgttgctgtctttggtaaatttgtttcacagaatgaaatttctaaaaaaaaaaatgtttcaaagaatgaagatctggaacaaatgtaaaacatagacttagctcagcaatctgattatgaatagacttatattaaaaaaaaacttaaatgaatgactgattttacgatatcggctggtacctccttgatgaccatgtaaaatctccaaacaacaacatctctaccatggtatatccattatagaattatatattgcttgtgcatctttggatagttaatactttaaacatcggaatcaattaaaatttctcctcaaagataacttttcgatgaaaactgtgcaatataaataaaatcatgctagctcagctgtactgtactttgatgaagtgttaattataggccaaaagaatattcagtatatggtgtcatgggcaggatcacaagattaataaattgctttcttgagtactgaggttctgcaccataaaaaatgtattgctgaatgctgagctgattggatcacatatgatctgaaatacttcttgtatgtccttcgaagttgtacatactccttcatgatgcagacaatagttgaccttggactgtgacaatttcatgaagctggtttatttttatcttccgtctctatctctatttttttaagagggatattcatccatctaaccctccaactagataaaaaccgccttccaaaacccacctcagaagaatcaccgtgacttcccactgaacaggataactcttctccatgtcctctcttgcattggtggagcttgcaggttgttgcaaagggctatctaataaacatgcttagataacttgagaagagaaggccaattagtatttacattgattccattgattaatctacatggtaaaactaatcacttatttagcaacttgccatggccaagcttggccctaaaaaggctctgccctgctctcccggtatggtgaatatttttgtatgattataggaataataatgtatacatgaaacatacaattagctaatactccctccgtcccaaaacgtagtgaattttagagttcaaacattgtcccaaatctagaaacatatgacatgtaaaaggtagcttttgccactaaactatatggactaccactactatcccttagccctattatagtctgggcctacacctcacccatcccaagaagacaaacaagtcatacatgttccgtcatatattctgcgacggtgggagtattcattttgtatcaatcacttccgcgcaccaaaagatgccatttgtaaggttccagaattcgtttttgatatacctgtgtagttttcttttaaccaaatgtacctgtttaagttgatacttttttatgtttgataaagggttttaacagaatgataattaatagatgaggcattttatattgagaagactgctgtgagtagggttcctagcttaaaattgcttaatctctgttttctttttattaggttggccattctttgctgctgctgcgtgctggaggaatgttgctgctgctgctgctgatggcctgaatgctttgaagctccttgttatcaactattcttgaatggaaaattttaagtgtgaatttgattttctgtgattgatggacagtacgtagtgtgcatcttgttattatttgtcaataagtggactctgttatctgtatatgccccgctcaaatatgaaaggtgttcagtttgtttcagagtcaataagctgattgtgctattctgtctgtccatgtcccgaactagaacgtaaccccccatcccaaaaggaaaaaaaaaaggctatcggaagttttctcagtagtagtggattgctgagatagtgtacagtttgtctaaagaatttggggatggttgtagttctaaacttttgtgctattcgagaatcaaaataaacccatgatcagattaaggatgttcattacaaattgacaaacactgattttaaaacgaaaaaatttagaaaaaaatatatttttgtaggaagttttttgacaaaactcagcatatgacaaaatttatgttgtttaattcacaatcagcaatggtttcgtggtgtagttggttatcacgtcagtctaacacactgaaggtctccggttcgagtccgggcgaagccatatttttattttttactctcatggaccgtccattttaagcccagtagcttttaaaaaaatcatgggccggccggccgtcctactgaaagcccagtatcgtatgttgcgtggttcaccggtgacctactcggcccacgggttgatataagccggcccaacccaaaaaactcttacttctgttgcctcccgaagcatctggagaattggaagactggaaggccgacctgccgctgccggaaaaccccgccccccgcgccgccgcttcgatctccggctcccctccgccacttcccttgcctcccccacctcgggtcggccagttcctcctcgcagttgacgagctacctccggatcgagggtgcgatcctctactctcttttttttgttctactttcgcgagctgatgaaactcgagatgaatccgcgtatacggcactcttttacgtttttggagaaaatttcacccgatttgattgggttagcgattctccgtggggttttgagcgcaactagggcttggggttgggaggacagttcagggatgatgcacagcccctagaattttaagttaggtgcaatggttaggtcatgttttctgaatttagattttcgtgacgtttttaatgtgagccgatgatagttgtatgtttgagagcttttctgattgtttgatggggaattagaggagagatgctaaatagaagaggggctgcgattatattgttttattcaaaatttggattgtttgatgcaatgaattgcctgcctgttaatttatgaaagatagaaaatgctaggggatgagcagaacgaaagtgctccactgtactgctgcgatttatagtgttcatgcatttggatgttcctagctgacacagacaaactttgaattgcagagaggtgttctcatttgtttggacttggaaactctgggaaaatgttcaagaatacatttcagtctgggtttctatcaattctttacagccttgggtatgcagtgcggtgatctactcgcattttttatatcatacattttctgaactgttggatatctcattctttactgttgtcatttggtcaggaccaagcctttgcagatatgggataaggaaggtgcattattgtttatacttggattctccttaacttcagtcttttactcatgctatactgtagacagagcattgtctgatattcaggacttatctgtcacgatctaaagatatctgcttctgattgttgccagagccagatctgcacatgggcaattcccttgactctatatttggtttgtgacatatgcattgaatatgtgttgtataatctacagagccagcttaactgtttaactaaatctgagttgcttgcccccccccctcctcttttattgaaccttgttcagaaacgaaaatgtgtttccattatcacatttgggactactgttgaccctttctcaaaaccattcacgtgcatagcttaacttcacatggtctctgtgggaattttagtaggggtagttattgatacactgtttatttatccaagtaagggtggaaaacataaactaagtgtgcttcagctgtagtctatgccaccaaaattgattattaaaagctttactataatcttgtttgtcaaacatgctgatctggttatttacctttcagtgaagaattctattctatgtttacttgtttaacgccttgtctattatgcagttgtagatgggcacatcaaaaggcctcaggatgaggatatccagtctaatgtacttgaaattattggaacaaatgtgcaatcgacttacattacctgcccggctgatcctgctgctactcttggaattaaacttccatttcttgctttaatcgtgaagaatcttaagaagtacttcacatttgagatccaagttttggacgataagaatgtccgccgccgatttagagcatcaaattttcaagtatgtataatctggaattcatttttctctctgtaggcattgcgtatctacaagcactgaaagtctaaaactttcatcatgttgttctgcttcataacttgaaagtatgaaatgcttttgttcaaatttgttaattgtcctctcatggtatttaaaagggcttagtgagacgtaggttgactagaagtgatactttacctgcaacattctagttcagacttgaagttaatgttttatactctgtttattcatttgaacagtggaattcatattagaagagttgtttatttaaccactcggaaataagaaaaataatacattttctagatttgaatttgtcaggctcatactgagatagatatcagtttcttgcttcgcccagtcagcaatcagcacatgagtctcatgaacatgtgtcatgcttgcattgtttttcactagtcttatgatgtggttgtagtcttgtacgcaatttgccatgtttcagttcccatttttatatttttgtaccgcatcaggtgcaatagcatatgtaatgtttgacatggccttcttattaaaggtagttttatggcatcttttgtttctgctcttcttggaatttgaaaggtctaaagttgggtttctacttttttgtttctacatgtaatgcatattgacttgtaaccgttactattttccagtctgtcactagagtgaagccatatatatgcacaatgccattgaagctagaagacggctggaacaacattcagttgaatctctctgatctgacaaaaagagcctatggcacaaattatgttgagacactccgagtgcaagttcacgcgaattgcagacttcgtagaatttactttgctgaccgcctctactcagaggaggagctgccacctgagttcaagctctaccttcctattcaggtgagaacaccataccttctctactctgttatgaaacatttgcttgtttctgatccatctgttctaagttgtaaccttttatttgaacttcagaaggcatagaccttggagcaatcatggagacgggttcttgatcacgaaagtagccagccccaggagataccactgcgcgccctcgtgatgactcgtttaacgcgaagctattcacgcgcaagcctgcacgaaacctcagggatcttcctggttgtttgataattgtaggagagtagttagtcgtagcctgaatgagttgccggggtacccactgaccctcatctaatgcactgttactcggtgttgcatcctcccctacaactgtaccggatggtccaactcccatgtttgcaaacccagtagcacctaccgttgtgtttggccattcaatttgcagcgcttttgccatagtatgtgaccacttgtgcgggctcgttttggatgggcatatgtcattgtcaggccggcgcgggcgccataaaatcttactccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34281 - DNA, 755 bp, Oryza sativa
  unsure (1)..(755): unsure at all n locations
gcgggtttgcctttgccctcnagtggtacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagcttctacatttaattaacaagagaactattgtatttatctaacacctggattatctccacctttcatttgatccctatttatagattacgctgcg

SEQ ID NO: 34282 - DNA, 775 bp, Oryza sativa
  unsure (1)..(775): unsure at all n locations
cgcaaaccctctgcgnagatcaatgtcttgaagctgtcgtcgcccatttccatacagaatcttcgactgatgtcgcgtggcaaactcctgctgaccgtggagtccaagaagtacccacatctgcgcatccagggacacatcgtgacccgagccagctgcgaaatcttccagaccctgctggcgccgcacagtgccgaatcctcgaccaagagcagcggtttggcgtgggtctacttgaacaccgatggatctctggcctacaacatcgaaacggagcacgtgaacacccgggataggcccaacatcagtttgattgaggagcagggcaagcggaaggccaagctggaggatctgacgccgagcttcaacttcaaccaggccattggtagtgtggagaagttgggtcccaaggtcctcgagtcgctgtatgccggcgaactgggcgttaatgtggccaccgagcatgagacgagcctgatccgtggccgcctagtgccccgtccagtggccgatgctcgggactcggcggaacccattctgctgaagcgacaggagcacacggatgcacagaatccacatgccgtcggcatggcctggatgtccattgacaacgagtgcaatctgcactacgaggtgacgctcaacggtgtgcccgcccaggatctgcagctgtatctggaggagaagcccatcgaggcgattggagcgccagtgacgaggaaattgctcgaggaattcctctgcagtcgaacgcgaatctactnaacaaacacgg

SEQ ID NO: 34283 - DNA, 31063 bp, Oryza sativa
  unsure (1)..(31063): unsure at all n locations
cgtgggtagacgtcactgcagnagnncatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagttggattggtagatcaagccgtcgacgtcatcccggagtgaagcgctgtcgccaagccattttcgtgtctgctgccatcgtccggacctcatcaactccggccaacaccatggtatatacccatgaacctcaaatactcacatgcatgcacccccttaaccaattcatgactgtagatgcacatgcaccatcacctgaaaacaccttccgctcacactcgccatcggcgctactccgatgtcccctaaccaagaaaactagaggaatggaatcgcgagagctttctcttcattttatcttttgacctcaacctcaaacgagccaccgtttgccgccggcgagctcgagctagctctactctgtctagagcagagggatgtctcccgtgaattagattatatcggtatttgaaattgggttaaggtgttacgacctatttgctgcattccctaccttgaataattgatcctcttgctgtttgaacccctagaaatggttagagcacactctttgtgctcaaatgggtttatatatgctctatgtgcaactacttgcttagccatatttagaaatatgcaaatgctcattccatctatatttaaaatgtgattttcatatgtgaacctttgctggaataaaatgaatatgatgggtatttacgaactaaaatgtgtaaaatgtgattttagacttgggcggcaagtggtgtgcatatggtgttagttacatgccgatagggggagtgtttgcccaagtccgtaaggaccgtaaggaccgaacttgtgtcaccaacttaaagttattcgtacatccacatgtactagtatgggatggcctaagctgattaatctatttagaactagcattgcattctggtaggccggtgtgtatgagttagtcgataattctgaggaattagtcgatgattcagaggaacttcctatttgccccgacgtggtagtttaggtgactaagtctgtccaatacaacggtattgtgccacgtgggtgggtttaaggcgtgggcccaccacttaacggttctagacatatttctaagtatgcataggatggaggaaaacgtatcgtgatggtgcaaggctaggctctaagtagtgtaaaggcttcgttgtgacctctagtccgcactcataatgtagagtgtggggtgcttgggccggcaccgaaccatctagagtgtagcctccgggcttctatcacatcatgtgggtaaaggtgtacaaattctgcagagttctttaaactaatcgattagccgtgctcacggtcaagagcgctttggtgaagtgtcatgagtatagactatgtttgaaaatgtgaacatgtgaccttggtttgaaattgataaatgtgttgagttgtgtgtgtggtgatatattattacttgttgtcaaaagatgacaacaagatattgattatgatggaattatgatggatttaatgttgaaacttaaaatttgttttgttaattgaagcatcaacttctttacaaaagaattgcgaaataaaacttgctttatgctgaaattgaactacatattgccttcattttaatatatgtcttacaagtagtatattaggattgtattgtgcttgctagtacattaacttgtttaatgtactgactcttgctgttgatataaccctttgtttgcaggtttagacttagtctttgagtgatgcgggttccgattgcttcttctaggatgagaacttaatggggtaaacccctagtcggtgtgcttgtgtttgggtagtcaagcttccggcgttctctaataagtttatttggccggtcggcctatgtatctattaagctgttgtaagtcttaagtttctttcatcttagttgtgtttactatgtataatcatgcttaagatgaaagtgtgaatctagtgcacatcctgggaactagattcacatgagtatgagttaagaatatttgagatgttgtagatctttagccatttttgtcaagtctcctgaatgtataacacatctggtcgctaccttcgagtggtttgaggggcacatctcaggctgaagttgactggcaggctaaaggactagcaatgtctccaatattcctctctcgaggcgtcggatgtttcattatgcttgtttgatgacttgaattattcatttcatctctcaagtataatggaaggtccggagagcctacgacaattcccgttgctgcgcactatggtaccatgaaaattttggattgggcgacattgggagatagctagttgctcggtcgtcgtggacatcaaacaaaaacacaaaggatatcaggtcattcttctccacttgcaacacttgggtttctagagaactcactgttatcagcttatgaatattggaacacaactctgatatgaactgtaattattctcttcgtgttcacatcatcggttacactttagccatgtgggataattgaccgacatacacagtatcgagtattgtcacatagtgagtttaaattactcatgcgccactgaaaattaactctgtttttgcgtcaggaaaataagtatgctgaaattggtatccttttgactgctgttaatatcatgaacgattggtttagttttttttgaatgcttatacttagtgttatcgatcttgttagatgttatctttttcttttaaaaataaaagtataatttccatcctctagacaaactaagaatacatggtaacaccatatctgtagacacaatgatttcatttttacaagaagagaccaggattaaccatggttaggagtatctgttaggctatttcttatggatacatcttaagaccatgcataaatatatggtgtagctgtaaggtgtaacaatgcacgaccaaaacaaccgatccctttcattcacttgtatcgtctcttatggtcttctctcctgcctcgccaaagctttcctctttagccttccatctgctagcttctactgtctatcttcgaaccctatcttaactatcagtaagaaaagacagtgataacacattgataaaacaattacaactttactttgcactcttgctctgtcctaattctcgcttaggtcatctctgatgctgctacatactaaaaacagctgatcaataagacacccaattttgaagagacaaacaattttggcttggaaagcatgaggaaagtgtgggcgatgttctgcagagagggatgaagtgtctcgtactttctgagatcacaataatgtttactccttgatcatcaacatcacctcatattacctaaaacctacgttatcagctatacacaaatatttggtgcagatgtgtataacaattcattggttcacatattaatctatctatctatctatcaatccaaagccggccgttctgccagcatttcattggtccacacggcaactctggactagttttttacttcctccgtctcaaaatgtagtcatttttaagattggcacgggtattaaaaaagtaggtgagaatgattagagaaagtgggtgatttgttaaaaagaggaagtaggtgagaagaatggttgtgattggttgacaggacaaggtaggtgtaaaaatagcttcattttatgataaaacattatgctagaaatagctatatctcggaacggaggtagtagctatttgggaatgtgttatggctttgccgtttcaccgtgaaagaaaaaaaggctattgcctattggcgtgtgcaccggctcacaccatgctggcctgcacagcccagtcagctctaggcctggttgtccggaggccaacatttgcattgttgtcttgtcaggttaattgtgcagttaggaccaagcagaaatagtataaaacaaggtaaaaatagaaaaaaagtataaataattttgtcaaaaccatctgaataaataaaatttattatggtgaaaactcgaaactgagtcgcgtacctaaccatacatattgatattatatatttctacaaataaataataatcagaaataaaaactaaataacagaaataagttgaaagattggatgaaaactttccaatactatattacaattgatactatatgcataatattttggttaatgaaatcgcaacaattttgaggaaacataactttaattttttagttagcaaatctaatcacaagtaaagttattggcaatcactaattacaatcgtactttggtttttctcattcttacaggataaacacaaaattaaatttctttcttctgggacaaacacaaaattaaattccattaatttgtcttttgaatgatattttatggtgtgaaacttactcatgtaaaaatatattactccgtccgtatcaaattacatatcgttctgacatttcaacttttagattgtgatcctctatctgcacctttcattaatgccacatataactggtaatcaaagttaacattgcttttaatactattaaaatatagttaatgagcataacaaggtaatttgcagtaagttcttgtgtgatgtgaaatttgctagagtaacaaataattaaaaaaaggtaggtaaattttctatattgtagatgagtcctaaaataagatatacatgctatgaatttatcggcgtgccactaggcgcgcagattttttctagtatatttactctttctgggttgataatacttgtggtttgaacaactattttttattataatatataaaaatatcaaaacatatatgattttattaaagtattttttaacactactctacgcatatggttttcatatttttaagataaatattttggaaattatttatagtcaaagatttcaaagtttgactttacccttgttcaaagcgactaatattgtcagcccgaagggagtattactccggatttgagctattacttaatcatcaccttgtacgataaaatttgaattcatggctagaaattatgttgttcccaattgcattatgttgatgagctataatgctatcattctctgttgttctcaacatatctcttccaagactttcatcaaaagttggttattaaatttgtagaatcaaacagaaagaactaaacctatggtgggaatatgtttagtaggatatatcggggcttttaggtcctagaagagagcaaatgctaattgccaagacaattcaattcaattatatgataaaaaggctaaagtgttgaaagaggaaagagggaggaattgatacgaaaagcgtaggatttaaccactatctagtcaaatatacgtaaacatagctaagttctatgatgtttacgggttcacatcctctaccataatgtcactaccattataggtactgacattcctaaaaaaaatatagacaatgatatgtggggcaataggagggtgagatctacataccagtaactgtaatgataatgatattatgttagaggatcctcacccgacgtttacacatatcttggctggccctttattgactttaatgatgctctcacattctccaagtatagttttacaaatctcaaagcacttgtaatttttagagataattaagtagcagtcagccaccactaagtcaagctatattaatcaaaaacactgttaaatgaaaggttcatttaagtaactctacaagtagtataaaaaatgagcactttagaaggtaacaagtgatgatattgatattgattttcctttgcacaaaaaataaagccggactaaacttttcagctatataaatcattgtcccaagagtcgagcaagagtggtacaatggtgaagaatgagtactacggtttccaaaactaagatcaataaacatgtgctctagatgcatgccacaaaaaattaagatctaggactgggcggacctaggaaatacaaggcgatggggccaaaatggtcatgcatcggcagcgacggacagagaaggctttgagaatattgtggcatagggtcgtacaatgtacttgtgttcatgatattgtgttgtgcatttactatatatttcgattattttagttagcatgattattagcaatgtcattacatcatttatatatttcatctaattcaatatcacattcacacccaaagaaccatagaaaaacatcgtattttcgtagtccgatatctaaagctcgtaggctggttgcatttgataaattagaaacatttcctcggaaacctcaaagtacaactcctttacagagaaatttgttggaatgtgtgctaccatatacatattgataggactccggcgtttcgcttatcgacgaaataagcgaaacggcatatttacaaacggataatgatttataaataaaacttttatatacgtgttcttagcgatctaaaagcaaaggctgacaaataaactacgataaaaaagccctaaaatcaactctaaatttaaggttaaaaatttaaattttggcttataagcgtaagcataagcataagccaaaagatgaggctgataatgtttgctagaattcatgcccacacgactcatgaaactagcaaaagtatgtcactaatcgatctacacctcagtcacttgggccaaaaccacaccactaatacaggggctttaaatgaattgggctggtacaatgaccccttccttaagagtccactactagagaactcagatgtgtgtagtatgtgcgatggtaacgctcttaagggctgagatgagagatcgtgagttggaatcccacattccacatatttttgacttgtatatatcttagtatcagttccttcaaccggtactaaaaattaacaactttagtctccatttccttgtttgtctcggttttcttctctcaattgctacaatcagaattaacaggggttgacaaccagtattaaaaatcatatatctcctagtggtcgatgcaccgacagctcacaacttacatggcggaggcccacaacttcaccttggtgtagactacgcacgagttatacagcaagggtacatatcagaacatcagctagctaggaaggggaggcacagtgaaccagggatccatgatgccatgtcctcggagatgtttgaccttgccataatgggacagtctaatgctatacgttcgagttgatcgtcctctgtatgggtgagaacaaaggaaaatagaagcacaaaccaaatgataacttctctctcgccgtgtatatatatatatatatatatatatgtaatgcatcggcccaactgcaaaacaagagttgcgtacaccttctgaaaatatttactgaagcagtagaatcatggtaaagaagatcgcatcaagtctgttgaaggagtagtatagctgtatcaaaatttggatggaatgactctgcgtatattctgcactttgtccggcatcaagaaagatggttggcagtaattgtgccacatttttactgtcctctgaagatgctataactcattgtctcatgcacttcacaagaaccagataaacacatcatatatttgtaaaagtttccaataatgacaaatcagataatatagtttttattggattatttttttagtctgcaaattaagtggaaaagacttcgataaatctgataaaaatgttgcaatgtgttgcacattgcttgtttgttaagaacgattactttacacgaaagtaccctaaccgaaaattttgactgcactataattattattgtaccgcaacattttggaccaattacttgctcctgaatacacttaatccatatcaacctgtgctatatatgctcatatatatcatttttcctgttcacttgtgtagttacctacacagtagacatggtccatccttccaacccaactagatgtaattaactttcaagctacagaatacaacccaagtattctttgttctgaagaaaatgctgaagctatatcttcctagctccccaacaatttttcttcctagtcccctatctcttttctcctccatccttctcttccttttttttccccctctcattcttaaacatctagaatctctctaacataaacatgctagacaaatattgaaatcacacatttattactgtcgaggcatatagccatatacctatttctagctagctagttgcataccagtcaactttttagtttcttgttcttaagaaccacacatctattaatctcttacatacaaaatggtaacccgaacatgaacttagtttgtttacataatacatacatatctgcaatgttggcatgggaggcattgggaaagatgtggatatcgagtaaaaagaaacatgacctctaaaccatcgaagggtctcaagaaggtactagaaatctttgaaccgattcaatccaactcaatcttgaactactcaggaacaatgtgaacgttgacgatcgataatctctcgatgttcatcatgaacaaagctttgatgtggaagttgatgagatcaatgactcgatctaactgaaagtctaggttgaatagcttggggcgagcagcaatgactgatatcaaagactagtcaagtaagacatttcacttagaattgattaatttcatgttatttgactagattagcattaaccggaacatagatctgcacattgctctatttatcttcataagtttattttcctcggatgcttaattcaatgctgaatgaaccatcatcacagtaaaaagaaaaaacactgtttctaaagcgtttggtgtttgataaatctattaatgtaatttttgttgtattgctaaagtttgatagtctgaaagtggaagacttcgaaagttgcatcctaaaaattgttggaatatgtcgcgcattgctagctagttcagaacgagtactttacatgacaacagtgcaggatgaagagcctgcccgaaaatcctcttgagtggtctataattaccttaggtggacatatggatggaccagaccaactacttcgtttccttctcgatgaattttatctatatcaagcagcatcctccatgtccatttgtccagtagccatgcatgaacattacagtttagatataccaaaactgcatgtagctagctaggcctgggaggcagagggaactactgagccataacatcatgtgtacatgagcagagttgcaccttgtcatgcagagaaacaacactaacatggttgagtagattatcggattgcagaatgacaagccaactatgagatcaaggcctgggttgaacgacctgattagtccgtgcgtcttcttaacacaagcgtttgatcaaaggacctggcctgataaaggatcagcagagcacctcatattaagataaaatagatcatttgagtagaattaatagaaaggggaaacatgaggcgctctgctgatcctttatatgtcattttttttgttctgcacatgtgtagttacctattgtacttagtactcaagaaccttataattctctgttctgaattcctagctaggcttctcaagctgactagatgcagttaataaccggtatcataacagagatggtatacgatcgaaattgagtacattaaaatgcaaaaaaaaaataaaataatgaacgacatatatgtttatttcccttctcctttgctcaaacatgatgccaatgacaagttatttcccttctcctttgctcaaatatgatgccaatgacaagttctcaccgtgtatatatataatgcatcgtcccaacggccaaacaagtaagtaaaatcaattcaactatggcagcaacattaattatctctcattcgtacattctacctagctagcagatacgtatatatagatcaatttcgctagtatgcacgcctacatgtctcatcaaactatagcaggagtatcgatcgttgatcgatctaggactgggaggtgctaggaaatacaagctaacagcatcaaaagtatcacaaatgggtgacgactgatttagaagacatccaagaaacagtaacaccttgtagtgtcttgaatcatggtagagatcgaaggcgttgctgacagacttgttggagtaatatcgaaatgaaatggctcctatactgtatgatgctaccagtgattttacaacatttctgtggtcctttcactactggagaagtgatctttgccgggtaggggaaaaaccacaattgtcccggttcaccaaaaaaccgagactaaaaacaatttttagtcccggtttataggttcaacgggaagatttcatcctggttcgccagttgtcagggtgtgttaggcccccggtgatctttagtcctggtttgtgttactaaccgggactaaagatcatggcgatttttaagcccggttggtaacacaaaccgggactaaaagtccatccatataaagtcttcttcttcctccagctagcccgagaaggcttcaaaaatttgttgagtttgagggaaggtgctgccaaaatttttggtgattttgttttggtgaaaatataaaatttgaaggagttaaaggttagcaacttcatcctcctctactttgtgataagcatttgtacttagagatatgttttgtatactattttgcctctagaaatttgggaatgggagatgatgaaagagaaagtttgtgtagggatgaaataatatagaaattttgtttatgtagaatttgggaaaaaaaaacttgtgataaaagagatgagaaagagaaagatagaaaattatatgaaaaagattagaaaacttagttaatttaaattaaattaagtaaaacaaattaaatatttgtttacaactttaaaatgatggggaatgaaaacatgaataatttgtggtattattttataatcaaattttattatttagaatttggaaaaaaacttgtgataaaagaaatgaaaaagaaaaagatagaaaattatatgaaaaacatagttaatttaaattaaattaagtaaaacaaattaaatatttgtttacaactttaaaatgatggggaatgaaaacatgaataatttgaggtattattttataatcaaattttattatttagaatttggaaaaaaacttgtgataaaagaaatgaaaaagaaaaagatagaaaattatatgaaaaacttagttaatttaaattaaattaagtaaaacaaattaaatatttgtttacaactttaaaatgatggggaatgaaaacatgaataatttgtggtattattttataatcaaatatgattatttagaatttggaaaaaaaaacttgtgataaaagagatgagaaagaaaaagatagaaaattatatgaaaaagaatggaaaacttagttaatttaaattaaattaagtaaaacaaatttaatatttgtttacaactttaaaatgatggggaatgaaaacatgaataatttgttgtattattttataataattatatattgctatttttaatattgtttaattggtttgaatttcgtggattaatttttcatgatttttgtgcttttcatgtagatggatcggcaatggatgcgcgcggactgacggtcaaaagagttttttgatggcttgcataattttctgaaagtggcagaagctaacaagcagaataatggttttatccgttgtccaagcactaagtgcaaaaaccagagagagtattctacagttagaactattcatattcacttgtttgagacgggcttcatgccgagctataatgtttggacctcgcacggggagcaaggggttcgaatggaagaagatgaagtagaagacgagaacattccggactgggcccagtacgttggatttgaaggaaatacaacgtgcgaggtggaaggggctgacgttgaagatgatcttggtcagatgttacaggacatcaaggaggattgtgaaagtgaaaaggaggctcagaaattagagcgtatgttagcggatcacaagacgccattgtaccccggctatgaacaggggcacaaaaaattgggtacaactctggaattgttgcaatggaaggccaaaaatggtgtcagtgacaaggcatttggcgagctattgaaactagtgaagaacattctttcggaggaaaacaagttgcccaaaacaacatacgaagcaaagaatatagtctgccctctaggacttgaggataccaaacgattgtatcctctatcgcggtgaggagtacgagaacctagaagcatgcccggtctgtaatgcactatgatacaacattagaagagacgatccaggtgatgttgacggacagccttcgaggaagagaattcctgctaaggtgatgtggtatttccctataataccacggctcagacgtttgttcaggaacaaagagcatgcaagattgatgcgatggcacgcagaagaacgtcaacaagacgggatgctaagacaccccgccgatgggttgcagtggtgaaacatcgatagaaagtttaaagactttggaaaggatccacgaaacgtaaggttcagtttaagtacggatggcatggatccatttggagagatgagcagcggccatagcacttggcttgttacgatgtgtatctacgacccccctggctatgcatgaagaggaagtacatcatgatgttgattgttattcaaggcccaaagcaacctggtaacgatattgatgtgtatctaagaccactggttgaagatctcaaactgctgtggaagaaataaggcgtccctgtgtgggatgaggacaaacaggtggaatttaacctacgagcgctgctgctcgtaaccatcaacgattggcctgcccttagcaacctatccggacagtcaaacaaggggtacaaggcttgcatccactgtttggatgaaactgaaagtacgtatctgaaacattgtaaaaaagttgtgtacatggggcatcgtcgatttcttgttacgaaccacactgtccggaagaaaggcaagcaccgtaagaagcctatatttcgaaacggtaaaaccttgttcgaaatggtgaaagatctgaaagtagtgtttggaaagggacctggaagccaacccatagccagcgaagatggtcacgcagcaatgtggaagaaaaagtctattttttgggagttaccctattgggaagtcttggacgtccggcatgcaatagacgtgatgcacctcactaagaacctctgcgtcaacttgctgggcttcctaggtgtatacgggaagtcgaaagatacacttgaagcacgcaatgatctaaaagatacgaaccaacgtgaggacctccacccggaaccaaaggagaaaggaagccaatgcttgagcccatccagctacactcttagcaaggtaaagaaggaaagtatgtttgaatgcttggagagcatcaaggtaccgtctgggtactcctttaatataaagagaataataaggacgaaggataagaagttcacaaacctaaagtctcatgactgtcacgtgttgatgacacagctgcttcctgttataattagtggtattctccctgacaatgttcgagcaacaataacaaagctatgtgctttcatgaacgcaatttcacagaagatcatcgatccagaaagattagaagcccttcaaaatgatgtggtgcaatgccttgtcagctttgagttgatctttccaccttccttcttcaacataataacgcatcttctaagtcaccttgtgaaagatatcagtattctcgggcctgtgtacctgcacaatatgtttcctttcgagaggtacatgggcgttctaaagaagtacgttcgtaaccgtgctcgtccagaagtaagcatagccaaggggtatggaacagaggaggtcatagaattttgcttagaatttattgaagaccttcgtccaatcggggtggccgaatcacggcatgaagggatgctacggggaaaggggactcttggaaggaaagcaattatgactgtagacatcgatttataccgtaaagcacatttcacggttttgcaacaatcttttttggttgctccttacatcgaggagcacatggcgattgtaaggagcgaaaacatcggtaagtccgatggctggataacacgatgtcacattgatactttccccgcttggctatgacaacatctcatgggtaacgcgacgattaaccaacagctagcctttttcgcgaggggaccatctgggtccatcacgacatggcaaggatatgagatcaatggaaaggggaaatatgaggcgctctgctgatcctttatatgtcatttttttgttctgcacgtgtgtagttacctattgtacttagtactcaagaaccttataattctctattctgaattcctagctaagcttctcaagctgactagatgcagttaataaccggtatcataacagagatggtatacgatcgaaattgagtacattaaaatgcaaaaacaaaataatgaatgacatatatgttgatttcccttctcttttgctcaaatatgatgccaatgacaagttctcacggtgtatatatatatatatatatatataatgcatcgtcccaacagccaaacaattaagtaaaatcaattcaactatggcagcaacattaattatctctcattcgtacattctacctagctagcagatacatatatatagatcaatttcgctagtatgcatgcctacatgtctcatcaaactatagcaggagtatcgttgatcgatttaggactgggaggtgctagaaaacacaagctgacagcatcaaaagtgtcccaaatgggtgacgactgttttagaagacatccaaggaatagtagcaccttgtatgtggtgcattttgaatcatggtagagaaggcgttgctaacacacttgttggagtaatatcgaaatgaaatggctcctatatttgtatgatgctacaagctattttacaacatttctatagtcctttagaggtactaactgttgagaaaattgatctctcggttcaaaaaacagggaggagaacgggctagacagttttttccacctgttgtaactcgaaatcacagcaattcaatttgttttaatccctgattaactgtgtgcagtgatcggtggcgcccaatttattttcttttgagtcaccaccgattccctacaatgctaaatgtaaaaggggagcccgacccaagagcggatgacgatctctctcgatctcaatctccccgataaccagaccctaaacccaatcaacataggcgctggaggggaaacgtgtggcggttccgggacagtgtaggtggcaaccggaaagctatcactaccctcacgagtgatcgccggcgacccctttgggatcaagccagcgttctcactgctaccactatttcccctacaccaacaatacgcgaggtggttcgagtttctgcatcctctacattcactctggttcgagctagaacaattacaatgtcttagaacaatttcgaagacagcagcacagttgtcctgatcaaattgaacgaataatccatgtggtcatgctgctgcgcaggttcgtgaggatgaatcaataaaggcgggaggtcttcatcaccaggatggatgtcggcaaaatcagtgttaagaacaaaaacaccaaaagtccaggactgacctaagccacctcgcaaggggagttctttgagcacgattactcttggcactgcatcaatgtcatcaaagacagctctgagcaaaactctacctggaatgggatccctctcctgctaatccaccaggcgaccaaataggggaacagcagggggagaataacccacaaaatagaggcaattcgggaatcagtgctggtccaaaccagaatctggcaatgtctgttctagaaaatgaaacttctcctgtgttctttgtgccggattctgttcagggcaaaatccaggaagtgcttctcaagaatcagttgttaagacagttagcagaaagagttcaggggcctccagcagtccctttggcgcttgctcccttcactgctttgctgctcccaagaaggaatgcaatttatgattctttgccgccagtcttccactcttcacagctgcccgtggtagtggttcaacatgaggatcatgaggatgatatggaccatgacatgggccctctgggccaagatgagatccttgatgttcagcttttggcaatttcagagccactggaccaggctcagcccaagagcccgccaagaacaggaccagtgcctctcctgttagaaccaccaagagctccaatcaagaagaaagatggcaagactgtcttgtttgatcctaacagaaggcagagtgctcggatgcgttcttctagtcaggagctcacccagcctgaccccagaatgggcataggaaagccgagaggaaaatctgccaaaaaattgaaatagttggcaggtatttcaaaccttctagctggcaatatttctttatcagcttctgattttcattctgatttagatgaagattgtctctctacatctgattcctctccttctgactgttcaatatctttgctgcaaaagttgggagtggaaatatgcggtctatctcctgaggaggtggaagaggcgactttgggtggtgctaggaagaagaagcttccaaggccatctgaagaagacaactaggcagcctccctggactcttttgtttatctcagttttaaatggatagcagctatatctcttatcttttggttgtatgtttgtggaaccttgatcacctggttgtgatgtgtggctgtcagactatttatgttactacttcaagcactgagtatgatatgcttgacatgtattcagggtattttgttcaatcaaggttgtttgttataaccttgtgtttctcctgctatatttatgtcctcgatgaatagtcaagctagaagtatgaacattctctgttggaatattcgggggatgaactccccaggaaaatccttagccttatatcagcagattgatatcagtgcctgccacatcttatgtttgcaagagacaaaaaagcagaattttgttttagccgacatcaaaaattttgctccaaaacgctttgattcttttgccttctccccttcacgcggtgcttcaggtggaattcttgtggcttgggtctctcgtttgcttcaagggagtacggtccagattaatgattatgctgtgacagtcaaattcagctcgaatctcaacaatgctacgtggtttttatgttgtgtttatggcccttgtgctaggccgcaatgtgatctttttgttcaatggttgcgagaccttcatatcagtccagtggaaaattggctcatccttggtgatttcaatttttatagatcagttgataaccgaaacaagcctggggcaaatatgaatgatatccttattttcaatgatattattagtcacttgggacttttggagttgccattaaaagggacgagtttcacctggagtaatatgcaggataacccactgctgcagcaattggactggttctttacttccccaagctggactctagctttctcaaacactgatgttcaagccctgacaagaagtacttctgatcatgtaccatgtgtggtaaaaatcagcactaagattcctaaaagctccatctttagatttgagaattattgggtgcaactggaaggtttctttgaggttgttcagtcagtctgggcccttgaccctgggtttgaggatcctgcaaagtgcatctcctttaaattaaagcacttgaggaaaaaactactcaattggagcagaaattactcccaactatctaaattactagtcaactcaaacagggttctagatttcttggatttgatagaggagcttaggccactatccatcttagaatggaattttgaatatgaaaagatgtaccaataggtggatgctcctaggtgaggaaaataccaaatttttccaggccatggcaacagaaagatttaggataaactctattccccaagtgataaatgatgagggtacctctatttctgctcatgaggaaaaagctgatttgttttaccagaattttatgcaaagaatggggatcacaacttctccttcaatggcttttgacttgccttccctgtttgccccccagaatctggatagcttgattgaccctttttacacacaggagattgatagtctaatttctttactcccggttcataaggcacctggaccagatggtttcaatggtcagtttgtcaaaaaatgctagccaataattgcacaagatttctatagacttgcagcgcatttccatgctgaatgcactgatctacagtgcatcaatacatcttatattactctgatccccaaaaagcatctgcctgaaaaagtaaatgattatagacccatatccttgatgagcatcagtctgaagttcctaatcaagttgttggccgataggttacaaggggtcattctcaagattatccatgtaaatcagtatgggttcatcaagggcagaacaattcaagattgtttggcttggtcttttgaacatatatcatcagtgtcaacaattaaagagggaaataattctgcttaaacatgactttgaaaaggcctttgacactatagaacactcagcaataattcagataatgaaacatatgggctttcctctgaaatggctaaattgggtctccttgattttttccacagctagctcatctgttcttctaaatggtgtgccaggtgcctacttcaaatgcaaaagaggagtgaggcaaggtgatcctctttcacccctgttgtttgtccttggagcagacctcctacatgctgtagtaaacagagctttctctttaggactgttgtccaagcctatcaatgagcaagacaataagggtttcccaattgtgcaatatgcagatgataccctcattctgcttaagtctgaccaaagagaactcttctgctttaaagcaattctgaatacttttgctcaatccacaggacttaaggtgaattatcataagtcacagctttaccccctgaatgttcccccagaaaaagtacacttgttagctggtctgttgggttgctctgtgggacaaatgcctttcacctatcttggtttaccaatggggacaacaagacctagactgattgactttgcccctctggttgacagaattgagagaagactaacctccagctctatgttcctgccctatggagggaggctaacccttgtgaactctgtgttgtctgccatccctacatattacatgtgctcccttcagcttccagtcactgtaattgaagcaattgacaaggctaggaaaaactgcttatggagagggaatgatactagctcgaaaagaaagtccttagcggcctagcataaagtttgtagaccaaaggaaaaaggaggcatgggtgtcattaatctgaccttgcataacattgctctttttctcaagcacttggcaaaattctatcaaggggctgacctcccttgggtaaagttaatctggaattcatattatcagaccaaggttcctcacggagtttttaacaagggttctttttggtggagggacattatcaatctttcagattacttcaggggaattgcaaagtgtgaggctatctcaggtaacacagttttgttttgggacgacatgtggaatgaccaaattaggagcatcacttacccacatctctgtggccatgccattgccagaaatattcgttggctgtcacctgtgctaaaccctttgaggattgttttaagtttccactgacccaggaagcttacacagaatttctgcagctaaagggagagttggatgctctgtccttagcaagtcagcagggggataattggagttttatatggggcaggaacaattacacctcaaaagctttttacaagttgaattttgcagccatgcaacatcccagacctttccgatggatctggaagaccaagtgtgtgatgaagataaaagtttttatatggcttcttttctctgataggctgaacacgagagacatgttggacaggagaaaatgcgcccccctaaatgctgatcttacttgtgtcttatgccctttgcatcacagagaaactttgtctcacctgttctttcaatgcccttttagtagaaagtgttggcagaagctgggaatatcttggaacacttctctagaagtctttcagatgctggtgctagcaagattgagatttcagaaaaaaggattcttagagatttgtttcattgcgtgttggcacatttggaagcaaaggaatggaaagattttccagaatatagatccttcatttgaccgctggtggaattcttttaagcataaaattcttctacatatgtgtaggatgaatgatgatcttagacaattagtttctggggttgtagccttttgtagtttttcttttttcctgtaaatactttgttggcttctataaaatacactactgggccattgcctggtagtattcctttcaaaaaaaaaattgaacaaataaagttaaactacatggtctaagatttctgttgcaaagcaccatgcacgactagctgatctgttcaacgagcatgctggtttttacatcaaagaaaagaaaacgagaatgctgctggatcatgtgtctgcatatacatttctccggaattgaattgagtgctctgatcattccttgtgattattcttctgatttcatcaaattgtgtcctagtcccggcatacagaccatcctattaacaaccccgaatgatgtttctccctattgataatgcatgttgttttgttttggataaggatacagtctccaaaaaataactatgaacattaatatatatgaaagtatcaactaatatatgattttattgaagtattttttaaactaatctatacatatgatctccataatttcaagacaaatatttcagaaactattcatagtcaaacattttaaaatttaactttactcttgtccaaaatgacaagtattatcaatctagaggggtagcaagtgtgcaagttttaaaaaggaaatgttgtttattggtctagaaaatttgaaatgcagcaagcagatatgcaaattaaaacagacttaaggcgttttaattccagacgacatggaatttgtttacctctgtaaaaaaatttggcatcaatttagtatagggtgtgatgccttgagagactagttaatcaaagtaaggaatgctaatacttactgactgcgcccatcaaatttatctaaaaagatactcttctagagcacttcatgtctcaaaatatataacttcaatattatctaaaaaaatatactcttctagagtactttatgtcccatacttccattaatatccttcctttcaaatttcttaattttcatctttaaccccagccatcctcccactcctgagtaagatttgtcaagcactaacaatttttacaggtagtaattccctttaacaatcacccatatatgcctttattgcagttgatatctgaacactgccaaattctatatattcgtcactctcttctaattaacctccatatatcctcacccatatatttcaactgcagtctgcagccatctctcatccgcatgtcttcatttttttctcctctgaaatttaatttctctcgcgttcttaaacttccagaatttctgtagcgtaaatatgacagacaaaaaactgtttatattcctagactcctagttgcatatcattgtgccatatatgttgacctgaagcacatgaacttgaccattatttttctacaaaataccacatgcatatatatacaacaatgttggcttgggaggcatcgggaaagaagtggacatatagcagaaagatacatggccaatgaaccatgggtacatctccaaaagagtgcgcgagtgtgaaatcattcgaatggattcattccgtctctgtaatgaagtgtgcagggccaatgtgcagtttggcgatcgatgatctccttggtttgatcacgaatgaagctttgatgtgaaagtttgggggtgttgtggacaaagagatgaaagagatttgggggtgcaaagttcctattgctcttgaagagcaattttacggtccttgaggaggtaccatgaggtaccattttttctattgtaaatttggtatctcttggtacctaggtactatgaggtaccatgaggtaccaaattttacactaaaaatttagtacctcatggtatctcctcaaggatcgtagaattgctctcctttgaaagtcaagcatttcctgtttttggctgggagagggagaataccttgtgctgaactcttagttcagagaaattggaaggggggactaaattctgtaaattatgcttgggaactgaatctactaaccatgttctttttacttgtcctattgcttgctttgtttggtgctctgtaatggaggtaattggagggggttcaattccaaccaatttttgggatggtataaaagctgttaaggataaactcagggtgaatttaggtctttttctttgtgctagtctttgctggggtttgtggttggtaagaaatgaccttgtttttgagaataaattggtgaaatcacctttgcaggtagtgtacaaggcaatttctttgatgcataggtggaaggtgctgctgccaaaagaaagagatcgcgaagctttgaacatgctgcttgagaagctgaaggctaagatcgactctcttcatccaatgaacgtgctaccatacaatattagtgtttcagtgttgttgctcttggggttgaggtctcttagtcgtttggatgtctttcttggcagggcttgtaagtcttttggggtttagctatctagcgcttgatgggtactggcagccccagttttttccttgtttttcctttaagtttctgtatttcagaccttgttatgtttggctttctcccaaaagccgggtaaataaattacctgttatcaaaaaaaaaagccaagggagaccagtgataaatgatgtccaagagttgttgataaaaatattaatgttcagctgagtgatgaagcactcgagatatcccctgcttagcttactcggagtgattaatttcgtgttactcagttagacaacctttgctcgtcgtgttaataatgaatccatgaattgctccatttagcttcatggaaattctttttcataggctaatcactgcagaaatcaaccaacgtcgttgactcatagtacaaaactcatgaattgtttactctatctatttatttctgatatatttcaacgtgataagtaactgcttatgttcatattattattcacgccatttagatttcaagttgatcctatgggtacgatgttattcttgttttaatattctggattctggttctgcttaaataattcaagttccctgcttgccatggatgtgtgatgtgtttcaatttggttatttgattccagtttcaattattctagtaccatgcgtagtcatgggagtgcaatttggttctttattcaagttcctgtggataagcgctgatcacgcttactcggctttgccggcaaatgctaggatgtattcactattgtccgggatggaaactactatttcaattcatgcctgcccgggatgggaactactatcttctttgacttggtgtttgaaaatatgtttcctatcaacgaaagaaagccttatgttcaagctttattgccaatgttgtgtacgtgtgttttctagttccatattgtacttgctgagtattttttatactcactcttgtgttttatttggttttaggtacgcattgagaccgacatgcatgggcgggaagtagcacccttatatacacgtctatttgcactctatcaaactatattgcttaggtccataatgatacttaaactatatcatggttcgatcttgtaataatcttttagaaatctattagtttctttccatggaattataaggatggatcgtattatgggaatgatattgttattagtttaacttataattgcatgtcgtggatatccatatttacaagggagactctgccgaaaattctaataattttggaagttagtggtttgagtgtttttcggtgtggcactctaggtacgtggttacttggggtgttacagttggtatcagagcgggcggtaggtccatgggaaataaatatgacaacttaaaatattgatcatgttttccttaggatgggaaaaataaaagtaaaatttgagttagatttaaactaataaaatttgacacactggtgcacaataggatgggattgggtcattctttgcatcacacttctgatttattttattgattaccgatctctatctcattgtatttgtgattactagagttatattgttactagatatatgctcttctacaaataagacctgattatatattaagtaaagctaggaggtataaaaaaattattcagttttgattcgttggtgcggtgtatagtgtggagattaacatttgcacataactatattcggaaagctattagggagaacaacatggggttgcaataatgagttatacttgaggtgtgtgagtgtacatgataaagttttagtttccctagaccttagttaaactagcttgatcatggctctaacttgtgttaatctcttctatagaagtaattaacgttgtatcctataagacttaatgatcctttaagaataggtaacttttcttccatataggcaatgcaaagtggttagaggaggggacttttactctttactttttttttcccaatgccaagtgaggttgtccgagtgtgagtgttaggtcgtgatacatctatcactgtaccgagttaatagtttgggtatgggatggattggcccccatgccatctactcattctatttttttcttacagtggtgtgatgtgtccatgtgttatgcctgatgcaccaaggtagtgatgtcttcacccgaaaagcaaagaaaaaaagtaagaaaaaaagggatgttccattttttagacttgagattcaagggcgatatggcttattagtttcttttttgagttctattatgtgactatggttgaggtaatgaaaaaaaaactttctcatttgtggtacacgttctgaaataattccaaaaggaaaacatttgactttgcattcatcagttggtgacaaatattctcctaatttctaattttcttttttactttcagaaaggaattaacactaaatatttattttggtttcacttttgtggctttcattcgcttggttgttcaaacataagtgttgtgcgattgctttgtagtgataaattataaattattgatatgcacaatactatttgaaaatactaatttaaatcttgttatggagaacttgtattaaatctgaatttctttaccaagtgatttattttcattacatagctcagaagtgtgtgcagtattgatattcttggattgaagttcacagctatttgattattaatctttatttgattttttttatagaatagcttctagattcgcagtttgaggtgacaaacaaactccaaaactttgatttttggttcatgagattatggtaaatatatatgtatatatttcctttttgtctttttttttaaaaaaaattcaattcgaagaggattcttccttctacgcattttcttcaaaaagtggttttatattcggttcatgttctaaatatttccattgtctttacatgtgattcttgaatttattacagatagtcattatcctgatattagatttcttaagaaaaccgtgtttgagactaaatattcatttttttatgttgtttgttttgtttcttgaccttccatattcgattatttcttttcaattacacgcacccaacaaatttttttttattgagtggatttaattcatttactttggaatgtttgagtttcttagaaaattcaagatctatcgatgttcagagcagtttttgaggataatgctttcgttctagttactcagaaagttcattataagtggaacaagtgtggcctatgatccttgagattgacttcgtggatattgtttattacctctaaataattggcaatcaaagatagactttcagtagttgttgaaggggagcaacatactaataagatgtgatgggtgtgtgtttatttctttaaattttaagttaaaagcttgtgttgtattcccgattcccttgaccataaaggttgttttcacaatgtgttttattgctttgtagtatgattcttcatgatgtgttctaatgatttttgaatatgtcccaattgggtgttttagtatgtgcattgcgcttctttggcaagccaatattctcgtctagtaggtctgagttggtttattagctgcttttgaattgttagctaccatactttcttatgctagttaattattatctaccatacctagacgcaagcagtgttgcgaatataggagatgtcctcgacattgcttgagagttctaactactttatatgtatgttttgtgtattcctttccttctttcggtttctcaagctctatagtgggcgaattcgagggcgcattcaatgtgcactttgaccatcgataatgtaataccccgtatatcaaaagatatttaggttttttttagttttggttgacttgttaaaataaagatattaacagaaataaataaaagaaaaatatctttagaagtgggccaatatgagaaggcccataaacccagcccattagttctcccctaaaacctagagagaggggaaccgaatcccacccccccacatagtgccgccacccctctccctagccgttgcctccttcctcccctcctcttgtgttcgcatctcacccatctccagcaaattgctctccctagatctccaccttcatagcttggatcaagaagcgaagtagaaaaacggaacgaggaggaggagaggagtagaaggaggggttagaccggagtctcccctattgtcttctcacaagttctctaaagaaaccctaggtgaggcttatccccttgttgtatcagttgttctagcatggctttagtgcattaatttgtggttagggaaggttagagaaggagtttgggtaattgcggttcggtttgttgcagttctgcatgtgggcagatttgcagtgcttcagtgtttcgatatttcggggctctaaatgttattttctgaaaaagtgtataactaggaagttgtagataatgtttggatatatcttctggccaaagggcacgattttatctcaagtggattaggtggtggtccatcagatcgtgcatgataccaatccttcgttggaggcaagtgcatgacgaactaatcgtgtaattcatggattgtttactctatctatttatttctgatatatttcaacgtgataagtaactgcttatgttcatactattgctcacgtcatttagatttcaagttgatcctatgggtacgatgttattcttgttttaatattctagaatctggttctgcttaaataatttaagttccctgcttgccatagatgtgtgatgtgtttcaatttggttctttgattccggtttctattattctagtaccatgcgtagtcatgggagtgcaatttggttatttattcaagttcctatgggtaagcgctgatcacgcttactcggctttgccggcaaatgctaggatgtattcactattgtccaggatgtaaactactatttcaattcatacctacccaggatgggaactactatcttgtttgacttggtgtttgaaaatgtgtttcctatcaacgaaagaaagccttatattcaagctttattgccaatgttgtgtatatgtgttttctagttccatattgtacttgctgagtattttttatactcactcttgtgttttatttagttttaggtacgaattaagaccgacatgcatgggcgggaaatagcacccttatatacacgtctatttgcactctatcaaactatattgcttaggtccataatgatacttaaactatatcatggttcggtcttataataatcttttagatatctattagtttctttccatgcaattataaggatggatcgtattatgggaatgatattgttattagtttaacttataattgcatgttatggatgtccgtatttacaggggagactgccgaaatttctaataattttggaagtaatggtttgagtgttttttggtctggcactttatgtacgtggttacctagggtgttacagataatctccttgacttgatcaagaacaacgctctgacgtggaagttgatgagatcaatgactggggctcggaaaaaactgataggtaaatagatcaagaagactaggaatgataagacttagctgaatgatgtagaaaaatggagatatcgcttgtttaatttactcgaggtgaataattttaaacatgttcactatcttgaaaatgaatctacgaactgctccagttagcttaatatgaattatttttcttataatcactgcataattaaccatggtcgctgtctcacagtacaaaatacaccagtgcaatgattgagagagaagcatgaaattgtacaaaatctaatattgtttcagggtacgtagtgaaacttcactgaagtactttggtagaatttaaaaggcgttgatgcacaggtagccagattcggtcttagttatgcttaaattcgagctttagagctatacccacttgagttccttgtctaaataaacatccaattgacgttaagggtccgtttcaaatgggatatagatatatatcgactagaaaatagacgcgcctgttagcacgtcggattatttaacaatttataccgcaagcacgtttaaaacatacgagtctttcattttttttattgatctagtgatatcaatatgcagcttaacactgatgcagtgataatcgaataatggaagttatttatatttatcattatgaaaattacatgaatcattaattaatacgatatcccattgaattttgcaaattaaccttacatatttaatatcagtactaagttaatttggttcggctatatcactctttcgattagcaatggagctgagagcatcaagccagatccattacagctgatacctatggctcgatgtggccaaagtaaacacctcgagagcaacgttatagacatccagctctagcgctcggcgtctcctcatcctcacactattttgacggtgtggcgcatggtcaacgctgatcacatacactgcttctctctcctttgatctgcttggttattcaatcggtacggtaaaagaggatgtcttgcccttacttctcactaccctccaagacgaaccaacgtcctgcatggttccatgtgtcagccaatgttatttagcacacgttcattcatagcgtacacttttatctgaaaactttcatctcaaatacattcatccgaaaagctttcattcaagaactttcatccagaaagtttttatgaaaattttcacaagaaaaaatgtatgttgggaacgaatgtgcaccaaatagcaatcctgacttgtgcctcgtgcttagtcaggatttgtgccactgttacttctctcacttcttctgtttgttgtctcaagatttgtacacatatttggtctgaagtgcctcattagcagcgagcgaagcacatatggcgcaggagatcatgagacattatgtgaggatggccgttgtctagccgttgaattggttgcagccaggttgtggtcgatgtgatgctagaactggtggggacacatgaaaacgtccgctctcagttggcagtgaccgcgagctccatgactatactagctaagacaataaaaaggttttctagaaatcttcttcatggtatctggcacatttgaaaatagagaaatggacttatttttccagaatgtttagcccactttccaatcttggagggcttaatttatgaaagaaattattctgtatatatgtagaataagagatccgctgaagcaaacaatttttgattggttacaaactttgtaaaattttgagtcctgtatgtcatttaaacttcttgtaaatattttattctttaaaaaaaatacattgttgggcaaaaccctagcagtcattcccgtaaaaaaaaatggtgtgatactgtgctggcggaaaacatgaaggtgacactagaacggatacccttatctcaatcgggcggtaagccccatctcaatcaggcatggcgtccgtcacaggctagaagtcactgatgtgaagagctatctcaatcgggctttagtcaacttacaaatataaacatttcatatgaaaaatggaaaaatagtcatctgtgacgggctttagttaatgcccgatagagattaagtatatagcccgtcactgatgagtcatctgtggcgggcctatctcaaaagggcctcaagttggtgcacgtcacagatgatggtgatttgtgacgggccccaacttggggcccttttgagataggcccgccacagatgactcatcagtgacgggctntntacattaacaaaatcggcctttacctaagcccgactcaggaagccaacnaaacagcaaccgatgatggtctactatgggtggcggcattggatggcagggtgtgcctatgggaccggcgcatctgggttaatagtcgacatccggtaaaattagaaaattaagttccttgtagccagatggttaacgagtccaaatggggcattgggcccgggaggactacatcccgccc

SEQ ID NO: 34284 - DNA, 30462 bp, Oryza sativa
  unsure (1)..(30462): unsure at all n locations
gagtgtacttcataagttgttttcgtgaaaaaccatggtgtctctttacccagtatggaatcagccataccctatggaaagaggaacccttctcttcaagccaaaaggtaagcccatctcaactcattaaatggcctagtcagtagaacaacagcgtccagtgatgagtcgagttccactgcttgtatttcgccgcactagaactgatccttctatctgtgacaggctcaaaatgcatagaaatagtgggccgtcacaaggctgtcatctatatcggcctgtaaagtgcccgatagagatatggtcgtacagacatgttagaagggcataaagctggggcccgtcacggatgacgccaatctgtgccgggccacaacttccggcccgtttgagatacgaaccgatatctcaaatgggcctaaagctatggcccgtcacagatgatggtcatctgtgacgggccataactttaggcccatttgagatatagaatgttatctcaatcgggcctaaagttgtggcccgtcactgataggtgtcatccgtgacgggcttaagttttatgcccatctaacatgtctgtacgaccatatctcaatcgggcacttttcggtccgattaagatgacttccttgtgacggcccactatttctaagcatattagagcccgtcacagatagaaggatctgtactagtgtgagggctgaggatggtggtggcgatggacgggaaggagatcttttttttttcctttctattacttttcatcaaccatgtttgattgttgattttttttcatcctcttttttttcttttccttgttctctacatgggcccagctcagggcatggcccttgggccagtgtgacagtggcagtgatatgcatatgctctagtggcgcgcgatgcaggtatagcatacatgagtaaagatttatctcaaacttaggcatcaccacgtgcaatgatatatatatgctggtagaacagccaacatttgaagtattgattgattgattgattttcctttggacaaatataaagccgaactaaaattttcagatttgcttatatatgattcttcttttcattggaacaatcagatttgcttcatgaagaaggatttggtagagttggacagccatggatggatctctggaatagagggaagttgttctaaggaatcattccatcccagttatgaaacactcaggactatggactatctgaaaagcaagaaatgttgcttgcttcaagaacaccttgacaaattttcaaatagacataatattctaaagttttatgattggatcaatgtgggctgttttacataactcattgttaagggaataaaagtgggtttggggactcaggcttctaaagcttctaaatcttgtaactagaggatagatgggtaacttttgtttatatgatctgagattgcgtgctcgatgatcaacctgtgttattttggccttaaatgtttcttcatgtctgcaaattttgtggaaaccagtgtcatggcgttaatggagattggggaaggcctctccaatctttctaaaaaagaactctgaactaatgtacactttgatgatcgatgatctccctgactttgatcatcaacaaagctttgtttatcccaaactatttttgccatgtttgcgcatatgtttcatccggcgagttgggacgacttcattgagggtgacctcttcatgggaagttcttcgtgttcccaaatgtttgatctgataaactggccgggatgagtttatcgagtgccaaatcatctatatgtcattacaagagttgggacgacttcattgagcgtgatctctttatattccatttgttcgattcaatattcatttgacagagcacaatgacgtatttagatggaattttcatcaaaatggtcaattttcagtccgttctacgtatttagccttaattaataatggctacattgagaggaataagtttttacggaaacttaaaatgcctcttaagattcagatttttatatggtacatgcttaaaggggtcgtgctaacataggataatttagcaaggagaaattggcatggtagtttgaaatgttgtttttgcatgaaaaagacgtttatttgtggaatgtcactatgcaagatttctttggagagatctacaattttcttctggtttaaatactccgcttagtatatctcatatgtttgagaattggctggtgggggttgataaaaaaactagcaaacttattcttgttggagcatccgctatttgttgggctatatggttgtgtagaaatgatatggtttttaacaagtcaccttctatatcttatatgcaggttcttttcagggcaacatactggctccggtcttgggcttaactactaaagtgtgatgaagatataaagttagtgaagactgcatgtcgcattcttaagtcaacggttatgcagtttttcgctaactttggatggagattcacaaatagaattcaataattttgtgaacttctcatgttgtatgcgtctttagtagttggtgtgctcctatttttttatgactatgtttctttattttgttgaattgctataataattgattgtagctccctgaaagaccgggattctattccattataaaagaaataaattagatcgagtttatcgagtgcaaaattagacaaccccttagtcaaagaaaaaacgccctctgccagggcggcaagggtgtcgcctgcgatcgcatgtccgtgccatttgccacatcatataatacatcatgtgggagggtgtaaaagaaaacctcctagaaagcattcgggatatagatatataaaactaaaaaaagaaaaggaaaaattacatcaaaggtccctcaactcgatagccagatacaaaatcgtcctccaaccgcaataccaagtaccggacgtcccttaactgtcaaaaccgggtatttttcatcccaaggcaggattggagccggatttgtccgacgtggcacgttgaccacggactccggcgctgagtcagcacgggtgggtagttaggatataaagacacatcgatttggcgcggttgatttcttctccatccagcgaaaccctagagcaggaacaagcaagcggcgcggcggcgggcacaatctgggatgcggcgtgcagcagcgggcaagatctggcaagtggcgactcagcgccggagaccgtggtcaacgtgccacgtcggacaaatccggctccaatcctgcctttggatgaaaaatacccggttttgacagttaagggacgtccggtacctggtattgcggttggaggacgattttgtatctagctgtcgagttgagggacctttgatgtactttttccaaacagaaaatatactgaatatttaaaaaagtaaatataaaataaaaaaaattccttgacccaagtgttgcaggcagcagttgtctgcagcagagcccagtaggacatcacggcagcacaggaccactaggcacgagggcataacaacaaagacaaaggcccaaaccaaccagcatcctgggcaactacgtggttagaaatcggatcgatattgtcggctaatgtgggcggaggccaagtgtacaaaatcctgtagatatatataactatatgattataatcagctgatccactggtagagaagtgaacttttgtaccgcttagtaatcctttttttaccggttctaacaaccaagataaagaaaccgagactaaagttttaatctttagtaccggttgaaataaccagtactaagagatgcatacaaagtcaaaaaaaatataaatattgtgggattcaaacccaagatctctcacctcaacccttactcatgtaaccatcccaccaactccacacatctaacttagatagatatactttcttttttatctaaccctagagacatcttaattggtgttaagcgggactaaagatccttcagcatgaatcttagttggtgttaccaattagtattaaagatgtatttttagtaccggttggtaaaatcaatcggaattagagatgtttctaggatttggactttttgaactggtaataaaaatatatttagtacggcttctaaatataatcgagatatttatgttttggtactacgcttgcatactgtatagatcccacaaattaacactacaagcgtggtaaacttctgttacatggtgatagtgaagctaagttgcatagacatcaacttgaatgttgaataagtaaaacgtccgaataaaatgtcgtgctcattaaattcctacgaaatttcaaaacacacaaaagtttcaaaatttttcgtttgaatggcacagtagataggaaaaacgcatgaattcaagacacggaaaaaacaacatgaggcaagactcatgttcattttcctatcccataggaattttaaggaatttgtaaaaaggctccataggattattttcctaatgcttttaaagtaattttctcggtccaaatatgcatgcctacatgttttgcgccgtgcagatattattaggcttcaataatatcgtcaaaagggggctaaacataattcaaagcctgactaagatgtcaagtcgtgacatttttttcaggtaataattccatgtaatattttttcctaacttgtactacctctttttatttttacatcgaatatttacggatggacgtagtactgaagtcgatatctataagcatagctaggggtgttaatgaccgatgagtcttttcaagaccctacctaaccctcatatattttttagataaaaataaatagaaatttagtccaccccattatatagtccttaaattatataagctaaaatgttaaaccctttccaactcctaagtatctaggggtgaaaccgaaacctgtattttacggaatgattgaatttcttttggacaaatataaagccaaacaaaaattttcagctatataaaatcagcctatgattcttcttttcattggaacaatcagatttgcttcatgaagaaggatttggtagagttggacggccttgtggtgcaagttttttcattggcttgcagtcatcgccttgccaagcaagggctgcaacatgatcaggccgaagaatcgatccaacacatcgttgtcacgtgtgttctctaccggcaggtttggtcattaatcgttcgcagtcaagacatgaaccatttctctagctggtggtccaagggagtgaaaggcattgaaaaggattgaaattaaaaaggaggttcaacttgcttgttttacttgtgcctgggaaatttggaaacatacgaatgactgtgtattgaatggcataagtcctagtatatacgatatatggttgtaatccaatcggtgggcaaatgcaagtgtattaaaaagcaggtttgatgcttggctagagcttcaaacctccatgaggttctttgtgggtctctaatccttacagagtaattgtaggactttgtatgtgtttaggtgtaggggtttctaccctctctatgtttttctctcttgcttaatgaaatgacatgtaactctcatgtttgttcatgaaaagaaaaacagtttgctgcatacaggtattatgtatatgaatttaggggttagaaaaacacgatgtgcttctccctgccaatcatgatgtagtacgcacatgccctcgcctctttgtctatgagtttgaggaaggtgctaaatagtcccatattacttgtaaagtatttctttcactggtttttagggagagaacttatggtatcttttcgggggtgagaaaggatatttgcactagttattgtactagtgtgcaacaaccactatttcgaagctaaatatttttaactatttcttgcatccattaagataggaccgatctaataatgtaggaccaatataacatggtctacatttacaaaaggtatcttatttaaatgtagctctctagtgttgagcttccactcttgcttctattttcacacatgtacagtctcagcattctctcctcccattctccactgaggctttactaggcagtgataaatttgaactagatagaacttttgttttggccaatagattaaactaactaaatctattattcatccataatacgtagacctatcgttggatcgatttatagatcttggactgggaggtgctaggaatcccaaaggtgctgatgaattcggtagtgtatgtaccgttggctttggaagaaaatgaaattgattttgctggcacatatatatatagtatttgtattatcctagttatatgtgtatcgtgtatgtagcgagtaattcagtagctggagtagttaagcaaaccaagtcatgcccggcatgtgttcttctttagaaaatggagtcatgctcggtgttagatacaatgaactaaaacgtgatttgggaatattaattagttgctattctgttatgaataaattccggtgaaattgaggttagttactgggtattgtttggacttgtgcggtcaacctatatatagcctattgtttatacttttgattgttttcttgaccgggaattatacttttgattgttcgttcgttcttcaatacggtcaggtaaggagagcgctccatatgtccacatccgatgcctggaagggtgtttcctctcccaccgcattaagcctttatgcattgtgcataaactctacggaagggtatcttcgttattttgacagtcatgccctcggtttacgatgatgtcctgatggtttatgcaaacaactccaaccagcaccagcaccaggatatcctaccggacaatatggtcaccgccgttgccggagaagatagacgttgcgtatgttttacgttaatatagtcatggtttacgctaatagagaaggaccatacgcaacgtaaactatgcggtgggagaggatatggtcattgccgtcgccagagaagatagatgttgcgcatggtttacattaacatagttatggtttacggtaatagagaaggaccatgcgcaacagccatgtggtgggagagcatatggtcaccgccgtcaccggagaagatagatgttgcgcacggtatacgttaatatagttatggtttaccctaatggagaaggatctgccatgaccgctgctttatttagcgtttgtagaagtacaacacaaggtaagttatatatgtagtttagatgaactttcgtagaagatccatataagtgaatggttattcgtttacataaattcctacatggttaatgcaaaaacttattgcaagtacatagccacagcagatctggagtaaatgagcggattacgttctattaaataataatgttatgttgtggccttgtgggccaaccccacaatcatggttcataaacatcgtatctttttttaaaaaataaaagacttaaaagacactgcaatttatagcggatggcccaacaaaagtacatgaaaatagcccatttgcgctttactattttactactaaaacccttacgttttcataattatgctcaagttctcacatctgtattccatttagcaccttaatatttttagaatttattaactactgttagatattttatttgataccccatagattgataagtaattacgtttgaatctctcaaaagtaattacgtaaatcatcatgtggttactcacttactctcataggatcttccacaactactattcatcctcggaacatttaaaaattggattacgccaagcaggacgacaagctgggaatcagcccatacacccaaaaagatagattatatgtcgaggacgacaagggttacgccaagcatggactcagcccatacactaccagctgctgcctacgccaagaagatgagagtttacgctgcaaaaggttagcttccaaggcttgtacgcgtacgcgagcattgcgaggttccctatgcgtaaacacatccatgctatgcttgaaaggctaatttacacacacgaaggataagtttacgtccacgatccacgggcaagcgtgaaccatatgtaggcaagcaagggctgcaacatgatcaggccgaagaatcgatccattacatcgttgtcacgtgtgttatctaccgacaggtttggttattaatcgttcgaaggatgggtataacctacataatcttgccaagtacgtcaagatatgaaccatttctctagctggtggtccaagggagtgaaagacattgaaaaggatatattgaaaaaggaggttcaacttgcttattttacttatttttgggaaatttggaaacatacaaatgttgcgtatataatggcataagtcttagtgtgatggttgcagtccaaccagtgggtaaatgaaagtgtcctttgatgcttggctagagcttcaaacctccatgagttgctttgtaggtctctaatccttacaaagtaattacaggactttgtatgtgtttaggtgtgggggtttctaccctccctatgttttttctatcttgcttaatgaaatgacacataactctcatatgtttttgttcatgaataaaaaacagcttgctacatacatgtatatgaatcagggggttaaaaatacacgatgtgcttgtgcctgccaagcatgatgtagtgcacatgcccagatgccctcacctctagtccgtgagtttgaggaaggtgctaaatatatagcgccatattagttgtaaaatatttcttccactggtttttagggtgagaacttctggtgagttttcgagggtgtgaaaggttatttacaatcctgcaataggttatatgtgggctattgctattgtactagtgtgctacaatcgctatttaatagcaaaacatgttaaactatttcttgcatgggatccattaaagatagaccgatctaatataataatgtagtatcgatctaacatggtctacatatttacagaaggtatcttatatttaaatgtagctctctagcgttgagctacacactcttccttctatttttgcacatatacaatctcagcattctctcctcccaatttccactaaggagtgaggcctcactaaacagtgatatactcgaactagatagaacattccgttctggccaatagatattgaactaactaaatctttattattattcatacataatacgtagacctgtcgttgaatcgattttatcgatcttggattgggaggtgctaggattcccaaaggtgctcaagtgttgggaggtgtacactacatcggatcaggtcacctctgacggccccaaaccctcacatatgagtggtctgggcctggtcagagaacaatggtcactgttgaggtaagtcacctttgacgggcggcgaccgacctttggaggtgacagtcccttctgacggacaagtactctatgccccaccagaggtgagtgtccccagtaacctagagcttgttacaacctgtcggaggtgactcacttgtgacgaatctgaaagtaacggcccgtcacagatgactcacctgtgacggcttttgcattataacccgtcagtgatgagctacacctagaaagaaatttaattgattttgcattatgttaagtaccgttggctttggaagaatgtgaaatcgattttgctggcacatgtatatagtatctgtattatcctagttatatgtgtgtcatatgtatgtagcgagtaattcaatataccgggcagagttagccaaaccaagtcatgccatgtgttcatttttagaaaatgaagtcatgctctgtgttagatactatgaactaaaacgtgatttgggattttttttagttagttgctattctgttgtgaatgaattcgggttgaaattgaggttagttactgggtattgcaagtgcaactaagtaaacattctctcatcatctatctatatatatctatctatctatacctatactaattaattagacactttctacgagctctcgtattatccagaaacgattttgctatatctttgtcgggtgactttttattgatatttgacctttttctgttcgttggatattgcactacgattcgtgctggacagtgcgggatgaggatgagggcccgtgtttggacctgcctcgtggtagtcgagaaattacagtcaacgtgattggacatgttcgtgtttgaacatgatttttttagacaatgtgactcgatctccgtgcgaaaatttcgattttctgcaacgtgtcagtagagtgattttttttctattaaatttgatgttttcttagccgtaggatcctgcgccaagattagttaagaaaattacagtcctatataactaaaattacattcataaatttagttgatacgatatgtaagtgcactataattttaataaaaatattatgtaagtaaatatgtatttgttatttactttaaaatataaaattacaatcgtatataactaaaattacatttgtaggtttagttaatatgatatgtaagtgtactgtaactataactatagtgtaattacagtgtaattatagtgtaattacaatttttagtaggtgggttggtgatttttttttacaatataactatagtgtaattactgtaatatagtgatcaaatgagcctaatctaactatctaaaatctgtgtgatttagacaaaaatatgtcacgtgatggataggtagtcccatgctggagcaagcagatcgttttattctacctccaatacatatctccagcacgtaacggtagaaacggatagtttcctgcggtgacggaagcggcgacaaatgacggaagatggtctatatctggactctaaccggagtattgctccagattggtttctcattccaaacaataaaaatatgtttcatatgtttcataaaattgcatgtgatgcagaaaaaatcaatttttatatgttgtatccagtagctatattagtactaaaatacctattattggttgtatactaattctcaagggcaaatgcatctttttacaatgaacttaatggtcaactgacggtggagtgacggcaatggcataaaagggaggagaaacttgaaccggtggcataaaaggggagaagccaatttgaagtggcatataagggagccggttaatttagagtggcactctgccgcgcctccagtggtgccgccgttgtaagggtcataatctgcccacaccacgcactcagttctcacggatgtgtgccatcctctcttttgcaggtgagagtgcagagtgcagagtgcttcagctgaaagtgagtcttctgattcccctcttcagcccaatagtcctctatgtggattatttgaatctgaatgtacatcattttctttcactatgtgtggagattatgaatatcccatatctacacggcatgtatagtccgactaggtacagggtaccatatatagatagaaaatctttaagaggactcgagttaggtctaaagttgtatgtcaaggaaatatccgagatcctagtcggttacgattgtatcttatctgtaattacatatgccattagggatatggattgtatttggtaatacggacctcttcccctatataaggaggggtccgggtcaatctagggatacattttttctcttagatcatacgatcaataatacactcggcggatcaatccccggacaggagtagggtattacttcttgattaagaaggcctgaacctgtataaaattccttgtttctaaacccatccacttttccaacttgatagccacccccttttagtattgccgaaatcttgtttcgacagttggcgcgcaaggtaggggtagcgtcaagttcttcgccgactaagtgcgatgggttccgtctccggcatcgacgacttcgtcttccctcccgggcaggcgttccggtttggcagcctagacttcatcaccaacaacttcggcaagatttctctcctcgactcggattcgaaccagtcgggaagaggctggatctccgccccgttcggtatcccgaactcggccgaggtctaccccaaggtcatctccaccgagttggtttcaaaccactcggacgagatccaatctacttcaacaccaccagatcaagacaatggggcctatccgccaatcctgatgaaactccccgatgatctggctgtcgtctttactaaaagggcgtcttcttcccgtaggcctaggcgggatccggcttcagcaccgatccggtctagctccagggaagtcggcgtcatactccagccacacggcacggtttcgatggaccaactggaaggctacttcagctcccctggcgtcgactcacgagtcacgaccaacagagatcgtagagtacgatgaattcggctaccgctacgacaaccgcgaccttgacgacttcgacgaaagctttgaagataactacacccctctctattttggcgtcttcatggccgataacgagacggaagaacagcgccaagcccgagaagcagaaggacgacgtgtacaacaggaggccgaacgacgccgactggaagaggagcgccaggcacaagagcaagaacggctgcagcgtgagcaacaggaacgtgaacgggctgcaaaggaggcggaggaccgacgacaacgggccttggacgccgggcgacgagcgcgagaacttattgggcagcaagacgttgaggggacagcggtcttgcacacccctcaacaaaacgcggttgcggtgatcactctcctcgacaccctcctcaaggaagacgcgctcaaccaagttgatcacgtcgtcatcatcttgaaccagaccaagaccatgattgccgcctcggtcccggttaactccgcaagcgtccgcacgccgactggcagccgagttccccatcttcgatctcaagattatcaccagccaagcctcagcatcaccggcgcgggatccaatcgcaggagtaggggtcacgacgagcgatctgtccacccgcctcccgaacgacacagggagcgccgagttgaacggcctcgctccccacctcgtaggcgccccgtcgatcttcgtgatacaatcaaccagcgccgtgcaacacgaggctatgcccgccaccattcaccggatcgctatgacgacgacgtggatggagtcgctgcctttactaacgacctgcgtcgagtggattggccagccggcttcaagccgactggaatcgagaagtatgacggcaccactaatccggagtcttggctcaccgtctacggtctcgcaattcgcgcagcaggaggagacagcaaagccatggcaaactacttgccagtgcccctagcggattatgcccagtcctggcttcatgggttaccccgtggcacgatcgaggcggaacttcgcgaccacttcatcgccaacttccagggcacctttgaacgccctagcacacagtttgatctctacaacgtcattcagatgtctggagaatcccttcgagattatatccggcgcttttctgaacaacgcaacaagatctccgacattaccgatgatgtcatcattgctgctttcaccaaggggattcgtcgcgaagatctagtcggcaagttcgggagcaagcctcccaggacggtcaagtagatgttcgaaaatgccaacgagtatgccaaagccgaagatgccattatcgcgtccaagcaggtgggcaccacttggaagccgaagaaagatacgccgactacgggagggagtggaagtaccaatcacaaggaccgtaagcgtaagcccgaggaacttgttgcaactactacacattcctcccgacaacgttcgcgcgtcaatacttttgacaagatcatgaactcccaatgtccgcatcatcccaattccaatcatgcggccaaagattgcttcgtctacaaacagtttgcagaacaatacgccaagaatgcacggatggcctccgacggagatcaaagcaagtcaaaaaagaaggacgatgacgatggtgccccgacaggttttcaagaccatcgcaaggagctcaaccacatctttggcggacctctggcttatgaatctaaaagaaaacaaaagctgaccaaacgggagattaacgctgttcagcccaatacgcaccaatatcttcggtggtcggagacaacaatcaagtttgaccgctcggatcatccagaccaagtggtccacccggggcggtaccccctggtactagacccagtggttcgcaacgtcaagcttcgcagatccctcatcgatggcggcagtgcactcaacatcctcttcgccaaaaccctagacgacatgcagatctctcgcacagaactgaaaccgagtaatgcgccctttcacggagtcattctagtgctatccgctacgccactcggccagatcactctccaggtcaccttcggtactccggagaacttccgcacagaaaacgtctgcttcgaagttgctgatttcgagacagcgtatcatgccatactcgggcgcctggcgttagccaaatttatggctgtcccgcattatacctatatgatgatgaagatgcctggtcctcgaggagtcatatccctgcggagcgacatcaaacaagccatcacatgcgacaaggaaagctgcgagatggcccaaacccgcgagatcacgatggcccgagaagacatccgactagctgcaaccacggcaagcaaaggagaagtgcctgcaaccaagatcccaaaaagtggagaaagcgaaaccaagaccaagaaaattcctctagatccctctgatcctactaagactgctgtaataggcgctgagttagattgtaaataggaaaccgtgctcatcacctttcttcaaaataataaagatatctttgtgtggaaaccatccgatatgcctgatattcctagagaggtgattgagcactctttacatgttaaggaagacgctaagccaatcaaacaacgactccgccgctttgcacaggataggaaggatgcgatcaaggaagaactgactaaactgttagcagcaggcttcatcaagtaagtccttcatcccgactggctggccaacccagtcctggttcggaagaagatgggacaatggcgcatgtgcgttgactacaccgacctcaacaagtcctgtcccaaagatccttttgggttgcctcgcattgaccaggtagttgactcaacaaccggctgcgagccactcagctttttggattgctatcaggttatcatcagatccgactaaaggaatccgactgcttaaagacttcattcatcacgcccttcggggcatactgctacatcaccatgcctttcggattaaagaatgcagtagcaacttatcaacgcatgatccagagatgttttccaactcagatcggtcgcaacgttgaagcttatgcggatgatgtagtcgtcaagaccaagcagaaagatgatttgatcacggacctagaagaaacctttgcaagcatccgcgctttcaggatgaaattaaaccctgaaaagtgcatcttcggagtaccgtcagggaagctgcttggatttatggtgtctcatagaggcatacaagccaacccggagaaaatcaatgccatcctcaacatgaaaccgccaagttctcataaagaacttcaaaagctgattggttgcatggcggcactcagccggttcgtttcgcgactcggcgagcgggggatgcccttcttcaagctattgaagaaaacagacaatttccagtggggacctgaagcccaaaatgcctttgaagacttcaaaaaactcctcactactccaccggtcctagcttcaccgcatccacaagagccgctgttgttatatgtattggcaacttctcaggtcgtaagcacagtcctggtcattgagcgtgaggaagaaggccatgttcaaaaagtccaacaaccaatctacttcgttagcgaggttttggccgactccaagacaagatatcctcaggttcaaaagctattgtatggcatcttaattaccgtcaggaagctatctcactacttccaaggtcactcggttacggtggtcacatcgttcccactcggcaatatacttcataatcgcgaagcaaatgggcggatcgcaaaatgggccttagaattgatgcccttggatatatcgttcaagccacgaacttcgatcaagtcccaagccttagctgactttgtcaccgagtggaccgagtgccaagaagatatgcccgaggagaagatggagtattggaccatgcactttgatgggtcgaagagactttcgggcactggggctagggttgttttaatttccccgactggagaaagactgagctacgtgttgtggatacatttttctgcatctcacaacgtggcggaatatgaggcgcttcttcacggactaaggattgcaatctctttcggaattaggcgtctgatagtttgtggagattctcagttgttcgttaatcaagttatgaaagagtggtcttgccttgatgataacatgaccgcttatcgacaagaggtacacaagttggaggataagttcgatggactcgaactcacccatgttcttcgacacaataacgaagcagctgacaaactagctaattttggttcaaaacacgaagcagctccttccaacgtgtttgttgaacatctttacgaaccagccgtaccaaggaaaaaaataatcgaggccacggacgctcaagacatagctatgattgaagccgactggagagagccccttataagatttctgaccaaacaagaactcccccaagataaagatgaagccgagcagatctccaggtacagcaggctctatattattcatgagaccgagttgtacaaaaaaaaagtccatcaggaatcctgcagcgctgtgtgtctttggaggaggggagacagttgttaaaggatatacattctcgcatctgcggcaatcatgctgccgcacggaccatcgttggcaaggcttaccgacaaggttttttctggcccacagctgcgtccgatgctgacaagattgtgtggacatgtgaaggttgtcaatttttcgccagacaaactcatctaccagctcaagagttacagactatcccgttgtcttggccatttgaggtttgggggcctgacatggtcgggccgtttaaaaaggcagtcggcgattatactcacctctttgtggctgttgacaaattctccaagtggattgaagctaaaccggtcatcacaatcacggcagacaaagctagagatattttcatcaacattgtgcaccggtttggggtacccaatcggatcatcactgataatggcactcaattcactggcggagtatttaaagacttttgtgaagacttcggcattaaaatctgttatgcctccgtagcgcaccctatgagcaatggacaagtcgaacgaaccaatggtatggtgctccaaggaataaaggcacgagttttcgaccgactaaatccatatgccggcaagtgggtagaatagctgttgtctgtactttgtccttgcgcaccactcccagtcgggccacaggccagtcgccgttcttcctagtttatggagcagaagcaatgttgcctagtgaggtggaatttgaatctttacgttttcgcaactttcgcgaggagcgctacggagaagaccgagtagatgatctgaaccgactggaagaggcccgcgaagcagccttaattcagtcggctcgatatttgcaagggttgcgccgttatcataatcgcaacgttcgatcacgagccttcttagtcggcgacctggttctgagaaaaattcaaactacacgagatcggcacaagttatcccccttatgggaagggccattcataatctccgaagtcactcggccaagttcctactgactcaagcgtgaagacggtactcctatcgacaactcctggaatatcgaacatcttcgtcgtttttatgcttaagcattacttttgtatttccctattttgactgctaacatcaagctttcccttgagttatcagttgggggctactataataataatggagtgtgatttttatcaattcaatttgcttacttgatttatcattgccttgcttgattttttggcttagtcaatgaggactgaaagttttttaatagcttttgcgggttttaggctcaataaggtttgacaaaagcttttaagaaattagaagctaagtttgaaatattaaacacagcataaattcatcagtattgtacaaattgtgcctccatcatcatcatcatcatcattatcatcagaatcattgttatgatataacatcaatcggtatcagttttttcatcatcagagttatcagatccagtcggccgaaggtcgttgtcctggaatctctcaactacataacctgctatcttatcggcggctttctgctcatcgttgatgaggtcaagagcagcttcttcactcgtcctatctgcaaagccatcaatggcgtcaatatcgatcttcgggtacaaagacttggtcattgccaacgccaggcttgccccaatacttccagcctctttgatattcttaaaatatgtatccggagcaactctcagcttgtcgaagatttcggaagcatcgaatgtactcggaccattgttattgaagaacatggcttggacgagtggggtagcagcgttggcgactttatccctggccccgtcaagcctcttgattttgttgactaagacatcgaattgagcctgcgacttgattttgcggtctgcatcaacagattcacatcaacgagtaagcataaagaagataatggcttttgaagtattgattgctagtacctacaacgtctttcaaagccgagtccctctgtcttgccaattcagccttgtcattttccagagtctgaatctgctttcccagttgagatatcttggcggcttgcactatattacctctggttaattgatattacaaagatggcagcataagtaagttggacagagattgtgtgtaccttttgaggagccactcagttcgaagttggagtcttgcagctcggcgatccgatctctcagatcatgttcagttttcctagcaagctccctagcttcgtgcagctggtttctggtagcttcaagggttccaaggtggggaactaacctctcaagagttgcagttttcgcttcgttcctgagatggattctctgcaatacaattttatcggcatttaagctaagtggcaaacaggatggttgaggccgtgcatgagggaacttacgtttacgatacgagtagcctggctgagtgcctttttcagcaggcatacttcatcatcttctttttacttgtttatcacgattccctgaggttgcatatcgtcatcccaccacttgaccagaatgggagggcgagaatcttcagctgctcgtatccggaggacctcttcttcatcaccaatcattgacccttgtatattcataaaggtgaaacaatcgaataaagtctgttagaccaaaatgatttcagagaatgtatttacctgtgatgattttcggttggggacgagtagactcttgtgttttaataggagagctggaccctgggtcattactggtatcctttctaagagggctgtccgcttgggtttcaacttcagggacatctcggtttggttctgtgcccgactagtttccagtcgggggctcctgattaaccccgatttcagcttcggccgactggtttccagtcgggggctcgtcgctgggtattacattgtcggttgtcggctgattgtcacttgggtgatcttctgtggttggctcggtctcttttgaaggacccgtctctatgtcaattggtttagaatcttttccagaaggatctatgtcagatggcttcctacaagtttgagttacgccattattattatttcaatagtgggtgagcagcgctacgagggagacagtcaaacgattcgtacctagaagatttcctgatcttcggcattggacgattggatgttttcttcttagggttggattgctttggcagttttcttgtcgcctctttattgctggattttccagcatcatcgccttcgtcatcactcaggaccaatttcctcttgcacgagtccgattggatggttgatcttgagatgtttgattgagtttcagacctgatttttggtcctccgcttgcctgaccagtctgtcggcgaggtgatcggcgttgggtaattggagggtctgatttcatcaaggcgaattcctgggtatgatgattcaagctttttatcaaccttgcaaatgataaaagaatgcttagaaacgagctgggattttaaatacataccggtggagggggattgaagccattgtatggcaccacaggcagcaagtgcgaatagctgactacaattgcatttgagaagattttatacatcctctccttcatgaccttgaattcaagagattcaggatcttcacagttagggtcatgtttgccgtcgaattcaaaggctgtgcgagatctttctttgatcggggctaaccggctcttgatgaagtgccgagtgatttgttctccctgtagaccttgctcctttagcttcagcatgcgatccatcagggcgagcacttgggcggcttcttctcccattggaagtgaattccaggtgccttgataaactggagggagacaggagtactcggggaatgcaggctcggggttttgtacataaaaccaatttgcatgccagcctttgtttgaagttttaaacggcatggagaagtacttttggctcagagttcccctcagttggaatccagctcccccaactacgcatggcttgcttttgttcggttggggtttgaggaagaagatgtgacggaatagggaaaaatgtggcctaatgcccaaaaagcttcacaggcgtgtatgaagttggcaatatgaactatggagtttgggtttaggtgatgtaaactgatcccatagaagtccagaattccccggaagaaccttgatgttggaagagaaaatccgccataaaagaaatgagaaaataccacggcttcatgagtgtcgggggtcgggaatgcctcgccgaatgccggacgccatccaatgatctccttcgctggaagaacaccgtgcgccaccatctccttcaggttttccttcgttacatcggagggcgcccattggctctcgaagctttctctctcctccgccatggatgcgaattgggtgatgcgatttgctttggaaatggctgaagaatggatggggaatggatgtggtgggtgcgtggatgattttttgtggaattttggaaggtgaatttgagcaaattggagaaccctagttccgcgggagtggttttgtactgtagcgtgaaatggggaaaatggcgagagtctcagcgaggaagacgaagcgacgctttgacttcggcgtttatttcgctagggtatcgggagtgctaatgggcctgggcctatacagtacttcagcccaattctattatcagcgtgactagttgtgatccttagggacttaggcatttttgctttggcaatttttgctcacaacagtatggcccgatgctgttaaaatcctttttaatgcagttagatgattctttggaatcactacgatgcgaacaaaaaggtacccaacagaaaagtgttatactaattttgtaagtcttcttaggctgcaaaagctgttcaggtttgttgagataactggtttttgatcagttatttactcggcatgcttattcttctggtgtgagtcatagcctaggctatttagacttatcactaattatgttatcacatttgtatcacatttgatggatatttttgagaatttttactcggattcttgtcaaatgtgtgaatttatggaccttaggagtgtttatcactcgggcctttccatattttcatttttggtatattaaaactaaaagcagtcggctagatgttttattgaacgccgcatatgccttgctatatgatattcagttgtaaaaccacttggttcttgactatatgtttagttttttaactaaccacatagtcgggggctacacctaattcggtgcatctagtcgatgcactcggtattttctattttagaccttcacagtctttgattttggtactcggagatctatacagaagaaattgaagcactcggattattactttatgtttcaagagaaggccatttcatcgactgtaaaggtcttgggggctactgtggagattatggataccccatatctacacggcatgtatagtccgactaggtacagggtaccatatatagatagaatatctttaagaggactcgggataggtctaaacttgtatgtcaaggaaatatccgagatcctagtcggttacgattgtatcttatctgtaattacatattccgttaggtatatggactgtatttagtaatacggacctcttcccctatataaggaggggtccgggtccctctagggatacgttttttctcccagatcatacgatcaataatacactcggcggatcaatccccggacaggagtagggtattacttcttgattaagaaggcctgaacctgtataaaattccttgtttctaaacccatccacttttccaacttgatagccacccccttttagtattgccgaaatcttgtttcgacactatggcttgatttacactatttgatctagctatcagttcaagtggatacaatcctattgtcatcctttcaccacaatcagtagttttgagaagttaatttctttgcatacactgatgaactctgtagtagattctctgcaggttctttcttgctcaattaattattgctcactctatagcagatcaactctggatttagacttctttggccaagcactatggctaaaattgcatgccaagcttcgaacagaaaggtcaagcaatttttccaaccacggtgcagcatgtggcaatggcactaacactaatttctatcatatgtaggcagatccaagttgatgctggcataggctttggtgaatcactgatgggtgagagacctgcagatttccttgtccaacagagcaatggctgagttctttcagttgtgggatgaaattcagatggtgcagcttcaaccaggaatagccacgactccattcggtggtagctaacaggtgatggccagtttactttctcatcggcttacaacctcttcttcatggcaaagaccaaatgtttatatggtgaactgcataatttcgattctttctgttcatgctgatctgttggttaatctggaaagacgaaacgcttgggtatttgagcagaggtctagacctacagagcaattatttggagacatcaaggagatcacgatttggaagtcggctagcattttttatcctacagtgattatttattagtgttagttgtttattgtggtctgaggctttgcctcatacctttgttcgacagcatagtactttgtactttgtttctccctaatcctttggccaacctggccaatcatttcagtagtaaaaaaatgtgttttcctggtcagattgatatatatatgatttctactaggctgaaactcttggcttggagaaactttgttgcatactatagcaggagctgcagcggattgaaaattgatggcatcaaaggttcttactaatacaagcaataagttgtcaaagaatcattgtttgaatttgttgtaccaaaattccaatcacacttagtggctaatctttttattttgactaaactaatgccacatgttagcagcagtagcagaatttttttattttggtttcaggttttagaactgatgttatttgttgctccaaataatccactgatattgtcaagtgggagctatttgacttgtgtggctagaagtattcgagtcaatcatctgcttgcctcggcctacttcaatagacaacggaggatgctctacatcataatcgtatgcaaagacaggtaatacacaccatatttcccttcatttgcaaagtcgtaataaactgaataagaacaggtaccacattcatatttgtctgatagatctcaaatccatatattgctaatggtctacttctcaacttggtttttacacctcaatgcttgttctgtattccgtttgtcacacattttatcaatgaattacagttctttgaaattggatcatgacttccaacttgcagcaactaattgcattgtatcacacgttcattacaagatactcaaagcaaaaatggcaatatgttggttagcagcttgtacttgcaatgagtaagagcatagaggttctggacttacaatctgaggtcaggatcatgttccatatatttttacatagaacactattgcatgaattgtactatttgtagatgttctatagttaatcaactatgttaccttaaatatacatggtgtgttttagattctgaaatgtttagcaaacttagtcaacatgtagattaactatcacaatttatgtcactttttcatatctagcgaacttatctaacttttttttcaggttacaaaaaatgcaggaaaaacgtttaggctgtcgaagcaaatccatcaggaggacaccctggcatctgatgttgtctactatgcatcaaagagattactggttgtttctactccttctttttgaatgagataatttacgttaatataatgttttcatagaagtgagccaatcttgatttgtttggttaacacaagttatgtgttaaacgtgtgatccaatagtatggctttgtcatgttctcttattagctaattgtaagtccttagcagctggaatgctggatcatgactaacaagtgaaaaggatcagtgatagttttatgctggtgcagacatgcaatgccaaataaaacatggataattccttcttgtttgtgcataattaattgtttgtgcaggcttcttagcactcaataatttatcttttcgaagtttctatagttgttgctcatatacaagggataattttgttgctcagtctcataaggacagctcactacctatccatctaaaatctgattacacatttgcccattaaattctactatgcacaacaagaagccacgattgtgctcttaattcaaatctgaatttgttagaacatattattggcgtatgttgtcgaaacgacaactgcatacgtcgaaagacgtggttacccaacagtggttggaaaagaagtaaagtgtattaaattgggaatttttcttgggatccccctattacatggccctaggagactatttatagcctcattacaggttcttactactagggtttaggttacacaggggaatttacatggttgcccttacgaaagggacatttatatgggcatatagtgtaattgaggtatgtgggctcctaatgggccgccaggcgatcgctagcccaatggccactgggcttgagaagctaggatggtctcatctgccttagcaaggccaaacttgctatggcgaagtcgtctcccttcggtatacacgcttcgccttatatccttcgcccaagaggcctttggcttcgcgaggtacccgcgcgattctccgtccttcgccttcctttctccatagtcttcgccatgggtgcttcgccccgactaatcttgacgtctcaggcttgaatccccgctggtctcatggtttcggtaggtttggtcgaagggcctcatgtcatactgccaacaacgtgtaaccacataaataaatccaaagtatatataatatttttgtttccccatttcaaggtctatatgattttacttatttggttttggtccgcatactggtagtacgcctgagagtggttatgttgatgactgttaagagaatgacaagtcaatatcttgctttgatacctttttttttgcatttttgatttagctaaaaataactatgtactggtaatggttatttttattgttacaaattccaattacatgaggatatgttttataaattttgggtaaataggttgtgcttcagaaggtgtagtttctaaaatttttagtgtaattatgtactcgggtgacatattttgccaaaaacgtgtattgcacatgcacgattattagtaaaggctaagacaaggagatgtgcacgcagtgatgattaatgcccgatcattaatcgactgggcacagaaaaagctagctttctttccgatcaagcttactataggctgacatagtgatatcaccctctattttaccttggtcgctgagggccttatgtggaaaaggatattaactattccctcagtttttttaatagttgactctattaacttttgatacgacattccaccattctttctataaaaatatatatatctcatttatttaaaagtatataatgttatttattttgctgagacatgttttataactaaatttcgtagaaaacctataagctgatgtccattactgtacttcagagttccgaatatttacactactttttttaataaaatgattagtcaaatattattctaaaggttaacaacgtcatccattaaaagtagaggtagccatagttgagtccgatgcacgaacagagactcatctatatggttgatcacctcatctataatttacacaggtaccgctgaatttgcatcttctattcaacacattctcagatatgtcaaacatgcatgttctttgtgtctaattcaagacatccatgaatttgttttattttgattgaaataatagattattttactatatacctattgaatatctgttttgtcataactcataagtgcattgtcaaagcaatcaggtcgattaacatcctaaatcttatgctcactataaaaatttggttatttgatcttagtcttaaaacaaagaatatttttttctaaataaaaactaacaattaataactaattttcagatgtgttgaccatattatccatatgcatactgtatacagtccatagcatgcatattgttgatattaatgtcgttggatttttataagatttattgcgacggtatattgtattaagaattcatgttaaacagaacatgccatagccagaagataccgaggactattcaggatttgttttttttctaaaactcagaattaatagatatagagttgtatccgtttggactttatcaatttaatttctaaataccaaactgataattgtaaattgcaactgacatgtatggaatcttttttcatccaaaaccctataatttgtaaataattttgaattcatatatatggagtaccaatcttggattctcaatttagatccctattaatttaagagtaaatttcacgtgacatcaggtattatggtctaagttgcacaaaacctcaggagttctagcacgtggcacataacctcaggtattatgaccaaaaagtttcacaaaaccacgttattgctcatttcgacattgatttacaatatttttagttctaccatcacatctcaaatttataagttatttatccatcatataaatgttagattcatgcaagtaaatctttttaaaattttgttataggagtaagtcaatttggttaacggtgtgattttgtgaaactttaggaccataatatgtgaggttatgtgcaacacgccaacatctatgtggttttgtgcaacttggaccataataggttgtaaatgacatggaatctttttttattctaagccactataaataaccaataaccaacatatgtaacataaaaaaattatatgtaataatagcagtaataacaacaacggctagtttttttaattgctgatggctaaataccttaatgactttttgataattattagagggtagaataaattaaatataataaattccaaaacatcggcaccgcgacccatgtgtttgtgggcagcagcccgtctgcaacagagcccactaggccactaccacggcaccacagcgccaccactgcacaacaacaaagacaaaggccgataccaactagggtcctgcgggcctaggtttgacggagatttttctgatcatattagaggagtcccaattcaaaaaaaaatttattcataattatatgactataatcagttttttttaaaacatatttcaaatccagacatttataacgcgcgcctactcaaccttataaatacgtgcatgaataacctactcatatgagcatctatgaaagattacaccaccgtattcctatgagcacggaataggttaaaattgatgaagtcaccatagacatctcgctatcagcggaaaaaaataatttgacgtaaatacaagcgcgcatatcaagtctagaacataaatccggggtgagttagttccaccataagaaatataaccaattaaggtacgctcactatgtataatcaattttttagggatgattataatcagttgatcctcaagaacacatgatttcttgtgggacatccctctgattgcccattccttactagcaagcgtgttttttttttatcttgaagtactttttctcacacaaaatatgatacatgttttgcaccatggaggtatatatattaagcttcaataatgtcgtcaaaagggggccaaacgatatccaatgcctgagtaagatgcgaagtcctaaaattatttacaggtcctccatatatatatcctcacccatacatgacagctacctctctcatccatacgccttcctttctttccctctcgtttttgttttctcattcttaaacaatcaagaattttttttataacataaacatgccagacagcaaactattagtattcctagactgctaggtgcatatcagtgtttcatgaacattgttttcttaacataatacatacatatcagaaatatatgttggcttgggagacatcggaaaagaaatgggtacttagtagaaacagacatgggctctggagcatggacggatctgtgaaatagagcgaagccgttctaagggattcattccatcccagttatgaaatactcagcagtatggactatctggaaagcaagaaatgctgattgcttcaagaacaccttgtctgattataccatagacataattctcaaggtttgtaattggatcacaatgtgggctgctttacatagctaattgttaagggatgtctgcggggagtcatgcttctaattaaaacagatggtaagtgggatggtaactagaggagagaagggtagcttttgtttagatgatctgagcctgcgtgttgccgtgttccatgtgttttttggtcttaaatgtttcttcctgtctgcaaactttgtggaaacctgtatggctataatggaaatgggggaggcctcgtccaatctttctcatcaaaaaagaagaattctgaaccaatgcacactttgatgatcgatgatgtccctgacttgatcatgaacaaagcttttttttaccatgtacctcctagctatgtttgcgcatatgtttcatttgacaagtttggacaacttcattgagcatgacatttttcatgttcccatgtgttcgatctaataaactaggataagtttatcgaataccaaatcatccatgtcatgataagagctgggacgacttcattgagcttgatctcttgattttcctatgcattggatttgataaattatgatgagtttatcgagcgcaaaataaggcaatcccttagcctgagaaaaaacgccctcaagcaaggtagcaagaatgtcgcctgtaaaattatcgcatgtccgtttgtgtgggctgatggctgtttgccacgtcatagaatacgtcatgtgtaggagggtgtaaaataaacctcaaaacttgaaaacgaaaatgtactgaatatttaaaaaagtaaatataaaataaaagaatttccttgacccatgtgttacaggcagcagttgtctgcagcagagcccagtagaacatcacggcagcgacaggaccaccagcgcataacaacaaagacaaaggcccaaaccaaccagcatcctgggccactacgtggttagagatcggatcgatggtctgctagtgtgggaagaggcccaattaacaaaattctgtagataattatatatagattttgctatatctcactcgaaagattttttttcttttctcccattatatattactataatcagctgacctctgattattgcgctgtcttgcatactgtatagatcccacaaattaactctagcaagcgtggtaaactatctgttacatcgtgatagtgaagctaagttgcatagatatcaactcgttgaatgtngaataagtaaaacaaccgaatagaatgttgtgctcatttaaatnctatgaan

SEQ ID NO: 34285 - DNA, 24099 bp, Oryza sativa
  unsure (1)..(24099): unsure at all n locations
gtggtttttggagcacntaactattggtacagnagctcatcaaaaacaacggaatagaatgttgtgctcattaaattcctatgagatttcaaaacacagaaaaagtttcaaaattttcgcttgattggcacagcagatgggaaaaatgcatgaattcaagacacagaaaaaaaaaaaggaggcaagacctcatgttcattttcctccacaatttctcgagaagagcctacctattgacgaaaaatcttcctaaagataaaaggaaattcctaaatcttatctaattaatagatagaattaagtcatctgtcatgttttttatgaaattctttcctaaagtcagtctcttttggacaagttctcattggctgattgtgttctttccttaaccaaatccaaataatcataccatattttagcattcataccatcccataggaattttaaggaatgtgtaaaaaggctccataggattattttccaaaggggtcataatacttttaaagtaattttcttgctccaaatatgcctacatgtttcgcgccgtgcagatattattaggcttcaataatatcgtcaaaatggggctaaacataatccaaagcctgacaaagatgtcaagtcgtgacaatttttacagctaataagttgatttaatattttttacctaacttgtattccctcttttttctatatcgaatatttagggatgaacgtagtactgaagtcgaatcaacgagcatcctcaatatatcttttctttaccaagtgggtagtaaaatgtgacccataaaactagatagtagttattttagttctcacaatgtgtaggtattaggtggtaaattggatccaatgtttaaaagaaatggatacgtgaataagagaaagtgaatgagaaagaagagaggagagagtgttttatatttgcttaatgtttgttgcgtggtaatggtgctactacccaatgatactattacccactttactatctgggcttataaatgatgaaccagatagtaggactacttaccacccacttcttaacatattatgggtgccctaagcatagctaggatggtaatgtgtcaagacttatgagtcttttcaagatcttacctaactcttatatatttttagttaaaaataaataaaaattctgtcgtccccattatatacctactccttaaattatgtaagctaaaatgttggaccctttcccactcctaagtaggggtgagactggaacatgtattttccgaccatacgcccaacccgatgtccatgggaagaatataggagggaaaatataatgcctggtatcgtttgatttggaacgtgaacccgatacgagaagagttgtgtccacccgtatgtcccatattattaaacataaatgaaaatgtattacaaatccatctataaacataataaaagattggttaatccctattttacgagctctaatataatattgtataatttttccttgatgtatctcttttaacaccttaattgcttccctatatttaacctctatgaattagagatataaataattattctttgccgaatcccattcgaataaaatagtatgggataggatacttatcagtgatatgtcatacggtattacctgtatctagttcagaactttaaaggaaaatataggttataatatatgggaatgccatgatccaatcgtacctgcctgattttagccctacccctaagcatagcccatcccctgtttcccaaacatgccaaagttctatatattggttcctaatttctcaactctggctgctttcgtttctccaaccagagttggatgaaattttagatgctcgtagcacgcttttcaaactgctaaacagtgtgttttgtgcgaaaactttctatatgaaagttgctctaaaatatcagattaatccattttttaagtttgtaataattaaaactcaattaatcacacgttattaccatctcgttttgcgtgaaacacttaatctttatctttagcctcaggagattcaagcaccacctctcttctaccgccctccatatatccttacccatattgccagctgcagccctttctcatccatacgtattcctttctttcccttccattttttgttttctcattcttaaacatccagaatttttgtaacataaacataccagataggaaacaagtcatattcctagactcctagttctatatcagtgttccgtataggttgaactgaagcacatcagcaagaacattgcttttttttttttacatagtattacatgcataccagcaatattggcttgggaggcctcgggaaagaagagggtactgagtagaagatgggatgggctccggaccaatgatattggatctttgaaagaacaccagttcgttctaacgggttcatgccatctcggttaagaagaagtactcaggaccaatgtgcactttgacaatcgacgatttccttgactcactactacgaaaaccatctttcgtggcggccattttgggtttttgctggcggaaatcatagccgccacaaagcaaaggccagtgaaaatgtagatcttcgctagcggttatcgaccgccagcgataattcattttcgctggcggtcgtcttaagctagccgccagcaaaaatccattttcgctggcggttgccttaagacggcctccagtgaaaatgaattatcgctagcgggttacaggaaccagccgccagtgttaatgctggccaagtttaaaaataaaacgacggacggagcaacaccactccgtccgcctccgtcaacgctccaccattcgaaaatttcacagaaatttacccaagcattcaaaattccacagaaatttacattaaagaattttcattcactcaagcattcaagcatcacaaaaatcaatgcaatagcatcacaaaaatcaacacaataacaaaaaatttgaagtcccttcgccaccgccattgcatctcctccttggctacatcggcgagtgggttgcctagccggagctggtcgtgctacttcctaggctcgcaccgccgcatcttctcgttctacctcgcccacagcgccttcgtcacctctgctcatccaccaccaccaccacacacggatttcagattaccgcgtcaacaaaaatggcgaatcgaagcgcaagaacggatgggtgctgaccttgggaggtgatgaggcggtagacctggacgaggagtagctccaccggcggcagccttgtcccctgcggcggcggcggccttgtccccgcggcggatccggcctcctagcgacgcggcggcggcggatctggcctccccgcggcccggcggcaccagatccggcatccctgcccgcacccgagcaccgccaaccgccgcacccgagctccgccgcccgcgaccgagctcgccaccgcccgcgccagccctctcctccgcccgtgccgaagcatgccgccggccgcgcccgagctcgccgctcacgcctgtggatggagggagagatagttcaagggagagagggagtggaaggaggagataaggtaggtagagtgaagggaggaggatataaggatgggtaggtggagcgacttttaatgccgcgattttttaaagggccagagcggcgcggtcccccaccaggattttcgctggcggtaggataagaggtccgtcagcaaaaattgggatatttttgcaagcggacttcttaacctaccaccagtgaaaacggattttcactagcggttctaaacccactatccctcattagaatcttgcaagcggatttcttatataaccgacagcgaaaaaataggataatgccatgaaaaatgtttttctagtagtgacttgatcatgaacaaattagctttgatgtgtggaagttgattagatcaatgacttagactgactaagatctctcggtgaatagctatgggtgaccagtgataaaagatatcaaagagttgttgatgaagatttttcatgtttttttgggacgaaaaagaagattttaatgttgataggctgagtaaagcactcgagatatcacttgcttatcttattactaggagtgattaatttcatgttattcggctacaccatctgtgttcgttatcttgaaatggatttacggattgctccatttaatttagcttcatatatataagaatgctttataataggctaatcactgcagaaattaacctggatcgctgtctgacagtacaaaatacagcagtgaaatgatggagatagtatcacggaaatgtacaaaatcaaatatgtttcaccgtggtgaaacttcactgcagtatgttggtaaaactttaacgcgtatatatggaaattcgatcttacttatgctcaaatttgagcttatataactacatccacttgagttctttgtctgaaaattccagtttatgcattatgggtcctttttatttgagggcaagatcatataggatatgtccattgatgattttagggatgggacgatctatattcgggatcgctaactagtgatcgatcgcctcgaggctatcttttttttcaccactttttgtttggcaccatatagtttttcttttcggggtaaatttatatacctaaaatttatgcatctaaactttacacacctaaaatttataggtcaaaagtttatatacactatttaaatttgaatttagatttaaatattttttatatagaatatttctatatgtaaagtttatacatatgaagtttactgcgtgtatgtgtgtgtatatatatatatagtaaagtctatgcacatgaatatatttttatgagtattagattttttttattttttaacttgtttttctttaaaaaaattatggtgtagtaggaagaggagaagggggaggagcgtgcacgttaggagagggacgggggtgcccgatccttgtggacgatcacccacccattagttctccctatccatactgggtgtttggctcagtgctcacggatgagctatttttgtttgtggttgaatgaatgtaacgagaataataagatcattaaggctatgtatagttccttcaaaatggcaaaagttttattgttttagagcactttttgttaaatgtatctaaacactggtagcaaaaaagtaggtaagttggcatttgtcatttgggagtccatagcagcaaatttggccaaaaaagcatcgggccccgtgtatgagagaggcaacaacaattaatggcaaaactttaccatgcatctaaacaacaacctgtaaaattgcatgccaaatttttttgccaccaaaacttttgcaaaataatttgccgccgcaaattgatctaaacaggccctatgcaataataaaacacattaattatcgttaatctaattgtaactaattatcaacaaagtagataaattatcccttgtcaactctaatcttgatatggtaattagtaaataaaaattaaaaacaattatcactgatctgttactaatgatgaagacggatccaggaaaaaaatttgggggggctcagttacacagtttcttcaatctccaaccatttagggacctttagtttattattaatggtgaaaaaatcgaagggaatgcttcgggggtatccatgggtcttgtgggtgtaagggggacttgagtcccccctgcacccatgttggatccacccctcgatgaagctaggttagcaaagatgaacggtctcctcccaacaaatttgtggacccatccacatctttatgtgtgatattcctttgcccgtctatcgcattcactttcattcacaaaccaaacacattcaaaacttcgattgccatctcccatccacgcgatatccatccaaacaaactaatattaagtttgctagatggagctcgtgttatttttcattttgcacacaactgggcttccgttaatatatctgctcagctttcggcctgcaaagtgagaaaaggaagaaatcaaagcaaagacaaatgcagttggatagcaaaagttttcttctatatacgtaggcagaaacaatccagcccttatctctgaccgtaaaatctatccgagcaacttttatgagctgtttgcatcatttcagaccgggaatctactttcttcaactttgttattatctctctttacttccaggaatctacttcatttgctttttcatgaattctccaatgtgacaagatcagtttgttctgtaattttaattgttccctggatcaaaagttttcttgtgcatagatatgtgtataacaaacatcaacaagctttatataggtaatcaattaatcagaggaccatagtgtgcaagtaaagtaacaaaccgtttgatagttttgcctttttatgtcctttttgtatatgtagattagcccccaaaactgtagtatgcttattaatttaggacaaattggcatggaagatcaataacaaatgtttgtggcatgcagtgaatatagatagaatttatggatttttagttgagcttcttgacgttacaaacttaattatttacctgtacttttttataaactgcacgagaaaagttaatttgggagtatgtctgcagtggaatgggatccttggctactgcatattgagctacagttagttgcacttgaagccttcttccacgtccgattggaatttggaatgggacatccggcataataagctacactgctacagtaatctgtacggtatttccaaaaaaaactgtaccgatagttgatctatacgtactgcattcttttaagggttatggaactcttcccccgtatggtatgtaaaacaaaacgatagattggtacataattaattaagtatttattatttcatcgtgtcatagtataaataattttaaggtagacacgggtattaaaaatataggtgaaaatgattagataaatattgtgattagtttaaaagaaaaggtaggtaaagaaattaaatagagttggttgaaaggagggatagatggagaaataaatttattttgggataattactatgcaagaaataattacattttcacggaggtagtaaaaaacttgaaaatgaattaatatgatttttaagtaacttttctattgtttttttataaaatgcatggtttaaaaattcaggaagcgtgtgtgctggaaatgaaggagtagaagttagtaaagtggagaaaagaacacactgctagggtgtgttcgaaactatgggttcatctttaatagactactgagtagtttgtacaggacatgaggagaagggtcacattgcttggagtgttttttcttcaagaatgggttgttcccagtttgagtttatgcctttctagctacaggaacttttgcatgctcatgaatctctcagttgtttggatcagccttttggtatttctgaattggataaaattgtaaagaatttacccatagatagagctcctgggcctgatggttttaatgggctgtttgtgaagaagtgttggccaatcatttgtcaagattactacaaacttgcagctgaattttactctggcactttggacttggatcccctaaatcactcttttatcattttggttccaaagaaacctgtccgtgaaggaataaatgactataggccaatatcactcctaagaatttctcttaaaatcctgacaaaaattctggctgacagactgcaaaaggtgatattagaattaattagttagaatcaatatggcttcataaaagggagaactatacaagattgcctagcttggaattttgaatttcttcatcagtgccatcattccaaaagagaaatagttttgttaaaattggacattgagaaggcttttgatactattgaacatgaagccattttgctaggaatggaagctatgagtttcagtgttacatggcttggatggataaggaagatcttttcttctgcctcctcctcagttctgataaatcgggttcctggaaacaattttcattgcaagaggggggtgaggcaaggtgacccactttcacctttactctttgtattaggagctaagcttattcaagctattgttaacagagcttatagtatggggctcctttcaaagcttcttccttcagatattgatccaaatttccccattgtccaatatgctgatgacactctcctctatttgaaagctagtgatagagaactttttattctgaaggctttattacaaacttttcagctggggactggtctgaagttcaatttcaataaatcttgtctcattccaataaatgttgatgaggggaaagctcagaacttagctgcagtttttggatgtaaattggggtatttgccttttacttatttgggtttacctcttggtaccactaagccagaggtaattgattttgcacctttggtggatagaattgacagacggcttactgcaaatgcttctttcttgtcttatggtgataggcttacactggttaattcagttttttcttcactgcccatctactacatgtgtactataatgttgccaaagacagtgattgacagtattgacagagcaaggaggcattgtctttggagaggctatcattggcagcctgggataaggtttgtaagcctaagtgcaaagggggccttggagttctaaacctttctatccaaaaccaagctttgctcatcaagtttttggataagttttacaataagaagaatttgccctgggtcaatcttgtttggacttcctattatggtaatactatccctcatttatcaaatttgaaaggctctttctggtggagagatatttgcaaattgatggatgtcttcagaggtcttgcaaggtgtcatctgaaaagtggaaataccggttcgttttggtatgatgtatggaatgatcaatctcctcttttttactctatgccgaggctatgctcttttgctcaggaccataatgtatcagtctccgatttcctatccatcgaggcagaaggcaatttcacattgccactatctatctaggccttccaggagtttcaagaacttacttctttccttgtggatgttgagctggtcaataaaaatgatgtttggtcttacatttgggggaatatgaagtattcctcatagaaattttatgctctaaacttcagagctgttaagccaacagttcattacctatggctttcgaagtgtaagcagtttctaaaatgaaggtgtttggatggctactcttgatgaatagattgaacaccaaatttatgcttgatcataagaattgtgctcctccaaattatggcctttcttgtgttctttgtcaatcgacagctgtagaagacttaatacatctgttctttctatgcccctttgctcagaattgttggaaccttttaggcattgcctgggatacaaccctttctttcgaaggaatgtttataagggctaagttggattatcaggggagctgttcatggagaagtttctttatgctccttggaatatctggaagtaaaggaatggtttcattttttgatcaaaaaattcctttttgtcttcttggaggcgattcttaaagggtgacctctttcttttgttgtttaggattaatgtgagatatcacgatgtaatcataagctggatcaatctgttgtaatttgttctcttctttattaataaaattatcttaacaacttaaagtagttttgcacgtaaatcgggcgctgacgtcatcgcctgatttccctcgctcccgtcggacgaccgatgcgtagtcgcgtcccaattataatgtgttttttcattgttttcttttccagatttaacatttaaactgctaagtgtataaatataataacttgactctaaaattatttttcattgtctcgtttattttccttcatactattagccgaagccaaccaatttgacatttctattttaggacactttgaaattttttcgagaagaagactttgattttaggactgattttacgtggtttgctggtcactctagttccctagctctatttttatgatatttagaaacataaaaaaacatatatatgtagttattttttaaaaaccaaggtcaaaatttcagaacctttaaaaaaatatttgacaagcatgacattaacggaagctaataaaatataatcaaaatctaaaaccgtgaattggaaatagcccatccggatttcaattctacgctttataatggaactatcccatctgggtttaaattctacgctttagtgataggtactacctcccatataaattataattctaagttgtttaacatatattaaggtttgagaaggaagactatgatgccccttattaaatattgtataggtaggagtagaagggtagttgagagtaaaatagagagaaatttgaacgattagtggttaatgaggccattattactctattgtgataattattttgaggcgaattcaaatcctagaaatacaattgttatgaaacagaaacgtatttgtcactatgtatacattaataagggtgaatgaaacggtctttagaagaaaatgaaaatcgaactggcgaagattctcgggagataaatgccagatgctgaaaatataaacgcagggcgacaatccaacattccttccagagtttttccacccaccagcatttaccgcgcacgcattccgaggcggccccccctcatctcatcaagtctccatctccttgttttcttctgaccaaggagggcattttcgtcagaggatgaacatttccaacggcccaattcttccccctcacatccgtttctgaattctcatcagattcagatccctttccttctgctgtaacaacgtttcctaataattttttttgattccccatccagagaaagaagtaaataattaagcccaaatcttgcatggtgaccacgtgtcagtgacacattctgtcagagaatgggattagacgatttgttaaccacaaatctctgacagaactagagtgagaaacaatctctgccaaaatctagagagagaaacaacctctgcacagagagagagagagagagagagagagagagagagagagaggcctttgtatagtacagttgcccactcatctctcgcactcgcaatgcgccttttgatgtcactcatggctgctctcttttgatcttttcctctttttcttcttcttctttgaagcatcatcaactagggcggtagggcctctttcctttgttcgttttatctttatagcttctctctatctctctctctctctgtgccctcttcttcctagccgaattctgctggtctccattgcggctactgttcttggggttgccctctctctctccttcctttggttttgggcggttttcttttgctgaaaaaaactagttcttgattggttcttgtcatctttgggaggacattgctctgggtgtgtgtcaagattgtgctgggagcataaagctgggatctttggccaggttcttgactatctaaattgtttgttgttgctatgtactaattacccttgcatttgggagctcataagtcataacattacttttctcttttgcagattgtagagggcttctggttcttgtcactgggggtgctttagagcatttcttggtgtccattactgttctgggtcatagagtttccaatctttggcaattactcggaggaattcttgagctgtgtgctactgtttcctttccctgataaatcaaccaagggaagggaaggctgtatattttccctttcttgttcttgatctttgcaataattttgatcatcttgaagaaaagaagtgtaaagtgtttggctgtgaaatggctgaggtgaagcctgaggacatggtccatcatccacccatggaccagctccagggatttgagtactgcatagactccaatccatcctggggtatgtagtgttacactgcactgaagtgttctatgattggttgatttgtattgtagcatagtatatgttactaaccctgagtggttctggttgttgcaggtgaagcaattgctttgggctttcagcattacattctttccctgggcactgctgtgatgatcccaacaatgctggttcctcttatgggtggaaatgatgtgagaattgcttcatttattaacccgttttttatgtgcagtagaattccagcttctgtatcagttgtcaaatgctacagcacattaatattgcaggaccaacatatgactattcttactaaaattttttgtttcatttgcttccaataaaagcatgacaaggcaagagttgttcaaacactgctatttgttactgggataaaaacactgctccagacattattcggcactcgacttcctaccatcattgggggctcatatgcatttgttgttccaatcctctccattatccgtgacccatcgcttgcgcaaattgctgatggccatactgtaagtatgcaatgatcttcaagcttatttcaaataggctattgttaattatggccattttggtactggaaaattttcgttgtatttacctaaagtatctgttttggttcatttgcagagatttgtgcagacaatgagagcaatacaaggctccctgatagtctcctcgagcattcagataattcttggctatagccaattgtgggcaatttgctccaggtaccgcagctcccgcaatatgcttgagtaggacgtacgatgcctttatctgtttctcccctaaaaaatattcttctgccattatatgtccaaatctgtgcaaacatttatactgagggcatttatttgacaaactttgctggaccgatatgacattgatgtgtgtagatattgcagttcagatgataaatattttaatcttcatactagtatgactagccggccactttatgttgttctcagtttgagtagtgggcatcatgactttagagaaagtgaaaatatgctagtatactaatcaaagggagaccaagatactcaaaagtgatgggatatgtttgctaccttcatgtcgacgataagaataagatgacagtagtttgataccatgatgtgcatgttgcaggttctttagcccacttgggatggttccggtggtcgcgcttgtggggcttggcctattcgagagaggattccctgtggtaaaagctctaatagctacccttacttccactctgtatgacagtaccagtcaattcaatgttaggttcttgcaattctaaagtatgcccacataatccagaaaaaaagaatattatctcaacataacctttttgaagcatttgcttgcttattttgtactttctctatttcatattataagttgattgactttttccttagttaaagttctttaggtttgaccaagtttatagaaaaaattattaacatctaccacaccaaagtagtttcattaaatttaatattaaatatattttgttaatatgtttattttatattgaaaatattagtatatttatctctaacttggtcaaacttaaagaaatttgactaaaaaaagtcaaactatttataatataaaacggagggagtaccatataatttatctgataagttaaatattagcattattattattattatttagtttatttgaagcatagaagttaggatccactattattattggtttatttgcatcatactcctagaattcatgaaaattacccaacttagtcgtaaacattcggcatgaaaaaaggggttgattgttgcctatgctaagctgcttcgatcattaattaatcctatggaaacatgttcacttaaatatttacttccaacttggcaaatttgactcctggaacaaatcaattctttgcatgagtcatctctgttatcacctttttaaagctatttatattacaataattgttaacccgtacttaatttggttgttacacattatatcagattgggagatgtgtggagatcggccttccaatgctcatcctgtttgtcgcgctctcccaatatctgaagcatgtaaatgtccggcatgttccagttttggagaggttttcgctgcttatatgcgttgctcttgtgtgggtatatgcccacatcctcacagcaagtggcgcctacaagcacacagccctgctcacccagttcagctgccgaacagaccgtgccaacctcatctcttctgctctatggtttggagtctgccacattagctgattaatttttacatccacattttacaacaaactctcatgttcaatgttttcactgtctcgaaggataagcattccgttcccgttgcaatggggtgcaccaacattcagtgcaaatcatgcgtttggtatgatggctgccgtcgtggtgtcgttaattgaggtaccttgaaatacttagcaaatacatggtttatcagagcatttttcagtgttctgagaacatttcaatactgcagacaactggagctttcatggctgctgcccggttggcaagcgcaacaccaccacctgcatatgtgctgagtagaggcattggatggcaggttagtggtcttctcataggttgattcatgaatcttaacttggaatacccactaaattagttacatgttcataaacatttaagaaccaaattttgtttctggtaaagaaatgtaaatttttggatggataattctgctagtgataaactcccttttaacttttctgctcgaatatgtcaatttttcagggaatcggtaccttactagatggtctatttggcactggtactggatctactgtttctgtgtgagtgcatctgctgtactaatactgagttttcaccctatgtttgctctgtaaaagcacccctaatcttttgggtgttattcagtgagaatgttggtcttcttggatcaacaagggttggtagcaggagagtgatacagatttctgcaggattcatgatcttcttctccatgctaggtagcatttctccctagcattcaacacacatttttgctgtttttttgggagttctgaatctgtcatggttgtaggaaaattcggtgcactatttgcctccattccattcccaatatttgcggctatatactgcgtaatgtttggcattgtcggtaagcagcccaaacatacatgacaaaatgattttttttcgctttttaaatgtatttaatggacagtacactcattttattgtgtcttcagctgctgtgggactatcctttttgcaattcaccaacatgaactcaatgcgcaacctcttcattgttggtgtctccctctttcttggcttatcaataccagagtacttttctcggtataccacgagcgcacaacaaggaccagcgcacactaaggctggatgggttcgtacttatatactctctaacatttcaatttccatttggaatgaacagcatacgaaaatgaatctatatctagtacattgcggtaacacaatgctaattgactgcaaaaaaaaatgtgatattgcctaatgttattccttatttgttgcaataaaaataaaacttagacaagaagtcaagaacattatcatgattaatttcaagtccaaaatagaaaagtattgatattggtttcatgatttatatgctattcattttctgacattggttctccattgttcttagaatatttgacattttcctgcaagtctgttcattgtacatgtttacactggaaaccagaatttgaattgtgctgctcttgtgtgcagttcaatgactacatcaacagcgtcttctcgtctccaccgactgtcgccctcatcatggcggttctccttgacaacacactcgatgtcagagaggcggcaagggaccggggaatgccatggtgggcgcgattcaggacgttccgaggcgacagcaggaatgaagagttctacaccctgccattcaacctcaataggttcttcccaccatcttgagcagagcagagcagagctgccgaaattcagagaatgcaaagacaaagttccagatgcaccaagcagtgaaatgtagtctgcttttgatagggtagaacagaaagttgagctgacaaaatgagcaattttaccagcaggcaaggaggaactctcttctagctgtccacttgtacatagaaacgattcgtttttcttttcatcagcttcaacaccgaggatgtttgattttgctgtaagcaattaattaatatcttgtgaacaactggtcatattagtttgaataagaactgttagttataatttttttatccattacatccatctgcaactagccatatacaactctttatttttcttttgttgaaattcagatgtacatgagcacatccctatggttattggtgacgatgagtgatcttaagtcaggcgaccaatttgcaccaaagtttgacaaaaaattttcatgtcggtcatcacagaaatagcaactcactgaagcaaaaatgtgttctgagccacaaatcacaaatgtaatggaccaagatgtagcacggaaaaaagttaaaacattgttgtgctcatctacgcacagtaaaaactttgtttgtaacatggcaattgtcaaggtaaaaaatgtgtggaagtagatctgataaatcatgtagccaatctctcatatgcctctgatttttgctcactcccaggctcccagccctttcattggtagcccttggctgaaagctagtgttgaatatataagcacatgcatattgatttaatttattccataaataaattatgacattgcagatgtaaattagcataatcgcatcatacgatctacacatataaacaaatcgaatatgtgaaacatagtgaatgcgtaccgagggttttggaagttcggctgcatagtaggaaggactcgcgataccgagcgttgacgacggcgtgcatgtcacaccccgatctggcaccgtcgtacaacggcacctgataggagcgtgtcgtaggaaaaacggcgcgaaccgcttcctacgaaaccgcgatctcagtaccagtcccaggacatagcgctggtacccacggtgacaaatatgaatcattgcaatccttaaaataaatagaggacttatttaccttaacttaggtttgcagctcagaacagcccgagaatgcaaccgacgacgcggacgaggaaaacaccaacaacagcagcagcagcggaaccaacggactaacacccaacaccacaggcgatggctaggaaccaggacgaaatcctaatcttcacttcactccgtcttcacttcaaggcggaggaactatatatatatttatatagagcaagggtgagtactttcgtactcagcaagtcacgggaatttaggtgtttgatgcaagcttggaagagaggcaaggttgttttgcaaatctttgttttgaaattattttgaaatcacaaagtgatttatttctttctaagtttgggccgaaaagagacttgcgtctcgattcgactttaggagatgtttttcaacagctcatttggtaatgtaccgacctctcaggtcagatcattatctctcggctcccagagtcattccacttgattaatcggctcccagagccttttcattttctcggactcccagagtccagctgcccatcagcacaacaatccgcttccacttgggaagcctagtctatgatgtccgtagacatcccgaatcacacagactcgtttcttgaccactcaggtcatccatatgccacataggctgattctagtaacgattcccacaccacaacaacttttcacaaagcacaggcaaacaaatctacgctataggaaacacctcacatccgcccatgaccgtgggcacggctgttcgaatagttagttaacctctgcagagggggtacactttacccacacgacattactaacccggatcatccaacccgtggagaacagccacgtctggtgaccttaaggctttcatgacaaggcatttcaaaagccgacacagggtcgccatatgccaacgagaggagtcccagactgacaacaggttaggtcccagaccatactgtgccaggaagcccgagggttctacccgacaccaccccattgaatacacatgtctcttggcatcaaggcttccctggtttgctatttactcagccaggggtgtcccattgcacccgtgtggtcgcacttgttatatgctcggatgaatttcccacaagaatcggtccttatatgcgaatacgggacagtgccacacaggcacaacccccgcatcgcgagttttcacaatttattttattttcaaacacaccgacaccacatgtcgggttttaaaggcttctcaaacccatttcccaagttttcgacaaacaatggtgtatgtgggatatttggtatacgcgctcagagagcacgaataccgaggtaccacaaaggtggagcgacaaggagtcagggtagtatagcctacaggaattagtgcgactactgggtaggtccatcggtttgacacgcaaaccgaggctaagcaagttaaacatgagtgattctaataatgcaagttgcaaacaaaataataatgattttccaattataggagaaattggtcaaagggtgacttgccttgctcaaggtcttcacgaagcttcacgaatcttcgagaaaacctgcgatcaacgaaaatccggtaaccgcaactatacgcaaacaatcaaaaacctaaacaaaagaccaagaaaatatcctatttagactaaataatagtgccattagatagatctcaattttacggaattactggaaatggaacggagtcaatcggaggaacggatgaagagatatgaattttggaaggtcaatggatttttctggacaaggaaatgatttatcggaattttctggaatacgacaaatgatttatggagtttatagaaataatattctcaagaatattattgacagtcactgacgtgcaggaccaagggaaatgatttatggaattttgggaataaggaattgatttatggaacaaaggaaaaaggatttattaaatcccttggaaaagaaaaggaaagagggatgtcatttagacttcctttgggcggctagggcgcggcccgaaggctattgcggctcggccgaaccaaatgggctagcgcgggcgcgaggaggtggcccattaggggcgcgcgggagagagggagcggtccggtggaccgagtgcacctcgtggggtcccgggaggggcccgcttttcggtgacgcggctcacggagggattggtgcacgcaagggcggcgctagggtttcggggggggatggcgcacgggcggtgcgccggtgtggatgggagtgcggcgggcccacttgcagtcgctcggcttactgtggattgcacgcacaggagggaggacggagggaggggccgaccgggtcggttgactcggtcgtgccgaggtggcgccttcgtggcatgacatgcgggccggcgggaagaggaagaagggggaggccgagatggacggcggacggcggcgacattcgctggggcagcacacggagattcaagggagggggaggacaccggagtgatgggagggacaggaggattcaccggagggaggctggcggcgacgaatcatggcggcgcacgccagcagcgagaaaagggggaaacggcggagggacgacgaggattcaattcaaggaggtgggagcatctccggggttcaaagagtccatttccagcgtcggatggggcagagcgacgccgtggaggtccggcgatgagcggcggcctccgggagcgggcggcgacggcggcaagcctatggcgggtggtggcgaggctaggggcttcgtctacgcgcattcgggagcgctaccgagctaccgcgcgagctaaaggagggagagggcaagcgagaagggagaacggagggaggaactaccgagccgagacgggcactgtgacgagcagccgacggcgcggcagcgagctctccggcatcgggccagggaaggggaggaagacgggtgcctggagtcccgcgtcacgcgtcctcgcacgcaccggtctccccggtgctcggcggcggacggcgactgcgagagcagaggaagggcgacaatcgcgcggtggagtaggagtgtgaagcgggagggattgagatgggaaggggagctcggcttcggttttataggcacgggaagtcggttttgggggaggaaaccgacttaggtggtcaagggagctcggctggcgcggcgcttgcggtcaaggagcagcaggaggtggtcacgggcggccgggctgagaggaaaaaagcaaaaaggggaggggaaaggagctcggctccttgccgatttgggcgagcagagggaggagggagagcgcgtgagagaggggagccgaggctctgcctccacgtcttggacgcacgcgcgcacaggtggagcgagtggcagggcggcatgggcggctgcgcggcgcaggcggccagggcggacgtggcggcgaccggacggtcggccacgcgcgggtgagcgcgcgcgcggcgcgagggtgcggtgaaatttgaaaaggcggcggcgggaatcggcgccggtgggggagcttcgacgggagagagaaacggagagagagagggcgagcaagagaagagagagagcgagcgagcgagcgagagagagagagagagagccgctctctctctctcggctcggagagagagagagagagggcgagcaagaggaggggggcacggctgagaggagggatgggccgagggagtggaattcggcccacaaaaatagagggaggcaaaacggactttgacagagaagttgaattggagggaatttgaatttggaatttgacttggacttcggatgagagggaggagtcgacgaagggattcaaaatggggatttggtattctcggaaccgagaggaatattggcaagggattcaaggacagaattggatttcgcagacttgaatcggaagagaaattttcgaggtgaaggattttgatttcgatgagagggaacaacgggattgaattgagatccttggcacaacttagactcaacactcaaagaacggaaattttcgcaaataggattttgcccaaaatagtttttaacgactcacgaaaagcggagcgttacagtgcagcacccgagcgaaggggaatatgagttgttgtggacgaacaacaagcagtcgcacgacgtgcttcctaaaaatcttattgccggcttctcctagtataggacgtcaaaagcgaaggttccggggacttactctcccgatcaccgatgcaatacagagtaggaggaaaactttagattgatttcacgtgttgcgaggaggcgttggcttggtttatatggatatatcatgatgtttgatcaggacgcctgtatgatctccacaccgtgtaactgaatcggatataatttatccagactccatgccgctccacacaccggattattcagtgtgtatccaaaaccaaaccaaattttatagaaaaacaaaactgcaaaaaaaaataaaccgcattcgtgcaagggtgatgaacgaattttgacggactattcaattgcatgtcgcctatgcgcgccgcctagccatgccaagccaggcgagcgagtacatacatgtgttgctcttgttctccccatcacacatgttggttcaattatgagatagactgaggtatgtggaactcaatgaaagcgcaaaggacgacatcatttggaagtagacagaaaatggtcaatacacgtacggtaagaagtgattatttggcgcaattcaatggcactacttccactgcaattttttccatgatttggaaatcccaggctgaaccaaaacatcacttcattgtttggctctgcagtctttgcagggactcctttgaggatgcaacacatcttgcagaagaatgcgacttcacaaaatcggtctggaaccaaatctgcacttggcaaggttaccggcatatacacacggactcccaatcaatttcagactgggtggaagcactttctaccatcaggccaaaaagtgaaagaaagaaaatcataggaacctgttaaccacttggtggcatgtatggttggaacgaaaccgacggatcttccagcagaaatcgcaaccggcgatccaagtagccttctcgatttaggaaaatatagaccttttgtaatttatctgacttcctttttttaggaggtcctagctgttcagggctaattcccagctctgctttgttcttgtacttaactcaatcttccccttctaatatatctggcaatgctcttgtgccgtcaaagtttttcagaaaagcagagtatcctaaccatggaagaaactagtggcataaattagggctagaaacctactaacatgaagcatggatgaacttaaaattagcaaagtattgtaagagagaagtatcaagtatgcatgttacccgatcggcaagactccgacgatccctcccggcggagtgccgtcaccgaggaatcctccgggcgagaagccaacgtccctgactttctcccgaaatctccctccattcacagactgacctacacaactatttctgcagcatggtgcgttcttgttctgcttcccgaacttggtctattcccaaatggtaggcatgcttcctcaatggatcaatgtcgatcattcaatggatcaatgtcgagcttggttatcttccttggatgctcccacatgtgcagtcgaaggtcggttgccgttcgggccagggcaacaaggcccaatggggccggtcagcgtagctacttgttgtaggccggtcggtcctccaataaatcggggaaaaagtacatcgaaagtccctcaacttgtcatcgaattacaaaatcgtacttaaaccgtaaaaccggatacaacgcgtcccccaacttacaaaactagtgtagactaggtctcttggcggttttgactccggttttatccgacatggcagctgactcagcgtgggacccacatgggtcccacatgtcagcctcttcttcccctcctctcttcctctctcatccctttccacggcgacggttacggagagcagctgggcacggtgcggcggggtagcagctgggcgcagccgatggccagcgggggaggagctaggcgcggccggcggtcagcgggggaggagcggggcacggccggcgagggtggagatgggcgcggctggcaaccgccggggaaggagctgggcggcggcggcgggggagaagctggacgtggtggttgtcgtcgtcgtcggaggcggcggggactagaacgacaacgacaatggcggcggcgacggctgtgaggcggcgccgcggcgcgaggagaagcgcccgagaaggaggccatgcggcaggctgaccgcaacgtcggcgccatcgtcatcaatccgctcttgccaccggggccggtggacaggagaggagacggcggcggctgaggcgggggtgggggcaccggagccgcggcgtgacagtgcagggtgggagctgggttgcgcagggcggggaggagggcaaggtggttcggcggcgaggtggggagagcaaggagaggacgtcatcgacgctgtcgggcggcagcacagggaggagtggcgcgtggtggaggggtcgtgggaggtggtggtgcaagcccaaagattccttcagcctgatcttcaattggatctgtggtcggagctccctcatctggttcgggcaagtagatgattagatgggattcaggcaaggtttgacaacgcacctcatggccgaggagaagctaggctctcaagagactggcaagctccattccgtgcagccatgaagagctggggatccataaatacacggggagggggaggtcgtcttgggtcgccacgttcttgcttgacgccatgggcacaaccatcggagaagcaacggcttccccactcaaccagatccttgaacccctcacatccatcgcgccctgacgccatggaaggcctggctgctacaggcgcagcatttgcctcc

SEQ ID NO: 34286 - DNA, 18571 bp, Oryza sativa
cgtagttaacaaccccgagaaaagtggtctatttgaaaagcaagaaatgttgctgcttcaaggagcccttgatttatttcaaaatagacataatctggagttgttttatgagtggacaagtgtgggcggtttaaaaacctctttgttaaggaaataaagtgggttggggattcaggctagaaaagttaaaaatcttgcaacaagaaatagaagagtaacttttgtttatataactaaaatgcgaacagagtgacaagagtgtgtggaaatgcgggaaatgtttcttcatgccaaaatattttgtgaaacccaggtgtcgggcagttaatggattttggggaagccctctccaatgtttttaaaaaagaactctgaacaaatgcacggtttgatgatcaatgatctccccgactttgatcatcaccagagctttgttaatcgctaaccagttccaaaatgctgccctaggagaggtcctctttcgtagacgttggggtatatgacagtacgaaggtaccactggagtccggcctcccccacgggccagctgccctgcccactgccgaactgaggagcaaagggagagaaaaagaagagaagggaggaagagagggaaggggaagaaggggctgacatgtgggacccacgtgggtcccatgctgagtcagctgtcacgtcgaataaaaccggagtcaaaacccctaagggacctaatttgtactggttttgtaagttgaggaatgtgttgtatctgattttacggtttaaggatgattttgtaattcgatgacaagttgagggaccttcggaactttttccataaatcggttggtctcttttttgatccatgggtgagggaagccggcctgctggccgtactaggctagctgaccagatcaccagatgtggccggtctacaaggctagtggctctttccgtgcattttcgcatgagttccatctgtaactgcaagatattctgaaaaaaaaactcatggaattcattagaaataggcgaactgatcaggataacgtgcatgtatttaatattttgttaaaacgtaggtggtataatttgggtttaatatccacctgaaagggcctgtaaaatttgactttctcaggaagttctctataggaactgcccataatttggagctatacaatctcaagagaaaaaaatcataactcattcaattttttcattaagacgaatagtgaaatgtattttaaaaaatcaacggcatcgtatattaaaaaaaggagggagtaaaaaggagaaagtttatataacatctattgtattaggcttagtgtgcttaactgtctatgatataaaatcaagccggtttttgtatattctgaaaatggattaattagatatctcatggcaaataaaaattaaagtatagcgcgccgggacaacccgaataaactactccctccgtttcaaaatgtttgacaccgttgactttttagcacatgtttgaccgttcgttttattcaaaaacttttgtgaaatatgtaaaattatatgcctacataaaaatatatttaataatgaatcaaatgataggaaaagaattaataattacttaaatttttttgaataatacgaacgatcaaataagtttaaaaaattcaacggcgttaaacattttgaaacggaggggagtagcagtggttaaccccacacgcaaaaagtgctttggctgcaaaggaggaagagaaagagtgttgaccgggggagaagagaggagaagccgggaagagggccgggatggcgtcgagcaacggagagcaacctccagaatcgccgaaggaagcaaatgctgcgcctgtagcagccaagcttgccatggcgtcagggcgcgatggatgtgagaggctcaaggatctggtgagtagggaagacgatgctactacgatggttgtggccatggcgacaagcaagaacgtggacgacacaagacgacctccccctccccgtgtaattatggatccccagctcctcatggctgcacggaatggagcttgccagtctcttgagagcctagcttctcctcggccatgaggtgcgttgtcaaaccttgcctgaatcccatctaatcatctacttgcccgaaccagatgagggagctccgaccacagatccaattgaagatcaggctgaaggaatctctgcgactgatcagcaagcctctggtgctgtatattcgctctcgctcctggagggactgactcttgactcggaccagaactccgcgctgcatgtggtggcagcctccggtgacagccaggcgtatgtggagtgtgcgcggatggtgtacgaccaggcgaggcacctactcggcgcggccaacaacaacggcgacacgcccctgcactgcgccgctgcagctgggaaccactcctcgcgctggctgctgctgcgcctgcgcgtgacagcagcggtgcagcgagggtggatgaccaggagctcctagcaaggaggaagaacaaggtcggtgagacggctttgcacggggcggtccgtgctggccacagcaaagtggtggaggtcctcatgaaggaggatccgggactggccggcgttgatcggcacgacggcacgtcaccgctgtaccttgccgtttcgttgggacgcttcgagattgcgtgggatctgcttgatatgagctctaggaaattatcttactccggaccagatggtcagaatgtcttgcacgtcgcagtacaacacccccaaggtatgcgccacattaccgtactctctttgttgcccttccattacatcagtaataacaaaataattatgtttgttttaaaagatcaattaaatccaactcattatatattcaacaatgcacagcaccgttaaacaacctgtaaataaagctgtatcgaaaattatggttttgaggatatcatctaattaagattgtttgtataaaaaggaagagattcgtgatccccctatatatatactgaggcaaagacttttttttttagtacagattaattaatttgggtctcttactccttttatgataataactctatttttatcttggatttgtatatacttttggatataaagagcataggtaggaagtagacctaatcgactatctcgtcaacatgtttgggtatgggtttgttgcgatctctgtcatgctcatctgattagcttttcgggagtttggcttagttgctttagagcatgtttaaaggtacgtagaactcggtatgagctcttacacggtacatgtttatttagaccatgtccttacgatagttgaaaccattaacctaaaaattaatttatttttattttctttttttcacccacatccaagaaagtttctattatatatatatatatagaggctataagaattgttatttagccattgttaaccgtaacaataatatttatcttttctcttctcttcttatctcttccatgtcagcaaacattcctaatattttgcatgtccttacccctcctagcaggcgcaggacattctatttatacccataactccatccaatccttgtagggtttgtggagataaacttggtatgtttgattttgtacaagtagatgatcatcttattagacctgttttgaagattatatccctttcatatactccctccttccctaaatgtttgacgccattgacttttttaaacatgtttgaccgttcgtcttattcaaaaacttttgtaaaatatataaaactacatgtatacataaaaatatatttaacaataaattaaataataggaaaagcattaataattacttagatttttttaataagacgaacggtcaaacatttttaaaaaaatcaacggcgtcaaacatttaggaaaggagggagtagttcccacccacatgatttggtacctttcaattcaccttgggatcctgtccgaaagacaacgaaacagcatcgcacccctcaccccagctttatcatttgcagggaaggagggatgtgtcacggagagggagggagaagaggagcaggtagcaggtggcttgccgctcctaccagccaacaacggcatgcacccccgccccaagccttaattccagacttggtaccttcgtaccaaggtttatacgtgtaggtatcatctgtgttaccctaggtattaggcttgatgttgtgggtgccatccgtggatggcatggcgcacgacatacctatagacacaagccacattgagatcacgccaggaggaagccatacatctagtcacgtataacctgccagattgcttcatcgaaattagtctgttgggctagaatagctagcatgctccgcatttatgctcggtatgctacatctcaaagctatacatataaactggattagatttattatctttctcgggaacctaaatcaatacttgtcccgtttcctcttaatcccatcttgcatatatcttggtatatatcaaccataccctatgtccataaaatagcagtcagacataacccgccgataaaccgcatactctctcccttttaaagtacttatcattctagatttatcctaggtcatcgtacattttaatactttattatccatttctttaaactcatatagtatgctttcataatacataattcacattctcttatcatttcaaattagaaagaacgacaaatattttttaacgaagagagtacaaccggctattatgaaagcatatacttcctttgacatctcgccatatttttttaacgaagagagtacaaccgttgatttaattgaactgcaatgggtcaacggggaactgcatgaagtaattgttcaattccacgtgctcttccaactatctgcccatggaaagacatcgtacttcagtacttgcttacgccatacgcgtagtttgactgcctcaacgtcaatgagtaaggcctggtctactttccaaatttttttcccaaaatgtcacatcgaattttcggacacatacatggagtattaaaaatagataaaaataaaaactaattatacagtttgcatggcaattgcgagacgaatcttttgagtctaattagtccatgattaaccataagtactacagtaactcacatgcgctaatgacggcttaattaggctcaaaagatttgtctcgtggtttccaggcgagttatgaaattagtattttcattcgtatgcgaaaactcattccaacattcggtcaaacatccgatgcgataccaaaaaaatttcttttcgcgaggtaaacacactctaaacagtgcaactggatctaacccgacagcttgatcggtataaataaaatctaaggcaaaaatcaatggttgaaaaattcatgtgattacatgtacatagtgaattcaatttaggggtagtttggatatacatgactaaactttagtccctgtcacatccgatgtttgcactaatttagtgtattaaacataaactaattacaaaactaattacacagattaaggctaatttgcgagacaaatctattaagcccaagtaatctatgattagcacatatttactgtagcactatacattgttaaatcatgtgtgtaattagttttgtaattaatatatgtttaatactttaaattagtttctaaacattcgatacgatagtgcctttagtacgtgtatccaaactacaccttgccttttgggcttccgtgggctttggtgttttcctgctggcaatatcccatcgccagtcactgccatcagacactacgagcagcacagtccgccgccaaaagcttaaggaagggtgtgtttagatctagacgcgcaaaagttttcgcgtgtcaccttgggtattatataggatgtcgtatagggtgtatgagcactaatataaaaactaattacagcatccgttagtaaacagtgagacgaatttactaagcctaattaatctgtcattagcacacgtttactgtagcactatattgtcaaaccatgaagtaattgggctcaaaacattcgtctcacaaagtagtctcaatttgtgtaattagttattttttagcccatatttaatacttcatgcaggcgttcaaacgtttgatgtaacagtgtaaaattttgtggtgggatctaaacaagcccaaaatggtaggagggcaaagaatgaacagtcagcacaggaaaacaaccaaaattttgacaaattgaccctttaagaaaacttattttgagattgatccatgctaaaaaccaattgaaaaataagccatcggctgagtgacatcgagtttggcgctgatatataacatgtcagcgccgagaaagttgaccctaagatctaaaactctttgccgctgaccccacatactagcatttaacaatataatttttgcctcttggttggaagtttggtagtggtttaatggtttagttgcttgcatggtatatgcaggtcttgtgtttgattcccgtcggccgcatgtataagccatttttgtcacttttttctctcttctttttaatctctcagtagtttgcttttaaaacaaacagatgatttttatctctttttattctctcagttggctttttaaattccttcttttttattctctcagttgttggctttaaaaaaacaaatacttttttatctcttctttttttattctctcagttggattttaaacaaaataaatgcgacattgattattctcagttgtttgcttttagtaaaaaataaatgcgacgctagttcaagaaagcagaaagagaacatacactaatgaaacaataaaggaaaaaaatgcatagcagaggatagaacccaagatatcttgcatgtctctcaccactaggctacacttgcatcacagattactaagtgttgcttccatttttaaccggtacatgaggtcagcgccaaagactggcgttgatcctctgccgcgtggaatgcaccgctagctcatttcggatcttagcaccaacatttccaacactgagacgttatatatcagcgccaaactcgatggtgctgagccgacggctcatttttgcaattagtttttagcatggatcaatctcaaaataagttttcttaaagggtcaatttgtcaaaatttcgggaaaaacaataggtagaactcctgctccatccgcccctaaaaaacgaatatagagtcggatgtgacatatcctaatactatgaatctggacagatatatatccagattcgtaatattaggatgtatcacatccggtagtagattcgttttttatgggatggagtgagtatatgattaggaggtccaactcacttaagatagaaacaggaagattcgatgggaggatggggaatagaacagaaaactattaaatttctgttgtcaacttttaggctaaaacctaaaatgcccttgtttataccggcagtacattaccaccatgtaatttgtaccacaaaagtcctctttttgaaattgaaaaatctgaaacgggccaaattgaatgtgacgaaatatgagctgacggctaactatattaattgttgattggctgactgtttgcttcagtaaaatgtctatatataaaccccaaactgtttgtgttgcttagcccccaaagtaataaaccaagtattttttatctcgatgtattgaaaccccggtttacttaaccccagggtggttttgcacgctggtttcaccatgctgccagtcaagcaacctccaagtggttaatgtgccaatcagcaacatgagctgattaataatattccttcgtcgtccttggcaaactcaagttgagtggaagaaattggacggggcttcgaaggagaccgggagataaattaaggtagaggtctggggcactatgtacaaagtggttcaagtcctacgtgtcttgactgctagcgtggactgccagcatggtgaaattagcgtgcaaaactaccacaagagttatgtttccatatgtagatttaccattttcccccctattatagcgacacggtattatctccttaatgaaccaatggaaggaagagtagaaacacaattaaactaatggagtagaagcctaggaggaagtagaagacaagtgaaacaggcaacaacctgtggcactgctcatgctgacatgcatgctgcaggccacacagctgataggttgcttaatcatttttaaaagaagatgataggcttagtttgtttttgaaacatgtttcaaaaataaagtgtaaattaaaagcaagatgtttttctttctataattgattgtttaggggctttattttttataacaaatcttaaaaaccattattgtttaatagacgtctttatttgtacagccttcgccctctaattggttcgtgtatatttacatgtaagcatctaagcactcaaattaaaattatgtattggttatggtaatgggtattctagtttaagtgaaagctaagaacttattttctaagaattttctaagtttttctatagttagttcactttgctcccttttatattttctagtttctttatgcaatcttattttaagttcatattttgtgagatgacaaaatagtgacagcgtgttacaccttatatgtcaaccattttcgaaaaaaatgaatcaatttttgtataaacatctaagactaaaatatgttctcattatttattgattgatggattagaatgattcgagactatgttaaatacacatacttgtagaatccaattctattgcacagtgtaggagacaacccatataggaaaattttttgcaagtatgcgaagcttctcatagcctagcaggaacacgattggatgatcaaatataactatgaaagcatcaatttttttggaatatgatttttgatgattgtttccatgatttaattaatattacgaattatgtactcgaagccaacctctctacaaataatttgtttagctagactacactgggcaataattaagtacaatgagattatataatcatacatataatgcttataatgcctatccacttgccataattatcattgttttcatgctatattagttagaaaccatagtttatgataatcttttaaaataaatggctaattttatcaggttatgtcattcgattatttataactaatttgcagttaaagaaccatattaacacaactaaattaaattgtttgtatttttacatatgtagattcaaattagtgttgtatatttgctaagtaatatttgaaactataaaatatgatttgaatttttaaatgttgttatggaatttataattacatgtcaaatgtcatctgccacattgtagcttgcactaaaatatagccaacataattcatcaaagtaaaatcacaccaaaataagtgataattacataatttgttttagtcaaacgaatgatgaaaacatagatcaaaagtcaatagtgtaaaaactggaggtaatataaatattttgtggcaaaaagagcagggccggctctacatattttagggccctaggccaactccatgacatgggcccttaggcatacactctctctatatatacacatatgcactttgaatttttaaagtatacttttaaagcattcatccgctaatcacgctgaaaataaatattgataatatcctctatatatgttgctaaaaataccaaaagagcattaaaatggaattactacggttaccttgaaatcttgactaaggatcaagctccagggacttcattaataatacttgacaaaagataagatgacagacatccatttgcttctcataaaaaaatactccttcggacatttcttgatgcaaaatcattaatgatggtatcaagatcaatattgtccaagacatttttctcaatgcaacacatagccaagccatttaatctttcttgtaacatggttgatctcaaatagtttttcaataactttaattttgagaagcttctttcagctgaggctactatcacaggcacagttaaaaggataaatgctttttaggtaacattgcaaacctaaacgtatagatgaaactgatctttaattagtatttactagttactactgactgattaatactttgctagttcaattcaatggagtatggacaatatggttgcagcacagcagtacgcaagtacctgtaaattgaaacctgcagacactctggaagtaggcagattcacattgtgtcagcggtcgccggtcggacgatgtccagggcaaacagtcgacagacaaaggcacaaagctgtgaagggctgaatgctgaagggatcgccggcggcccagcgtggggtgaacttgcagaggcgccgtggagggcgcagggcgatggaggcggattggcggagactgccgccggtagaggagaggagacgagaagactggaactcggacggtcgcgtatgcccgacgattcgatcagaaacttgtatacatgtatatggtatacctaatacatacctaggtcttctgggcccctacttttcctgggccctaggccatcgcacttcttgccgtagcccagagccggccctgaaaaagaggagatacaagtgcacgtgagggagagaggagagggagggattacattctgtttataatctaatctaatctaatggtctaaaacaatgagcccaccaatttaaatgaaaaaaattgagggctagatgtttctaatctattagaatgccacttggtggtttagaagcgtttacagaaatgccacattggcatgagaacgcttgtagtatgtttaatggacttgttcaagataaagtggtataattcaaatatcataaaatttggtgttatatatgaaaaatgtcatgtttaagagtgccatatgttaattttggcagtgcagttggatgctgaaagccgacagagagaaaattaaatcaaagatgaccttttgttagggatcgatgtggaagaacatgactgtattactgtaatagaagtttattaaataatcttaacatcttagagatatttcattctagagatcttatgtctccagttggttgtaggtagattggacgtccagtatttctatgctaacatggccctccgctattgcaaggaaccctaggaagattgattaatttagttttctaaatttgattttggttccatttgccctttgggcttgcttaactgatggtatcacctgctgcagcactgtctgtactgttagagaagtgcaagaatgtcgaggtcaatgtacagcaagaagaccaacaaaggagtattcctcttctcttgtacctcactagtcaaagtgacaaaaatgggagcactcctcttcactttgctgcatcgttgaaaactagtattgaaggtttcacatcgagattatgtgaacattttcgcccgaaacaaagcccaacaacattgcttcttggactcaatgaatctgctatatatcagccagacaacagaggatcatatcctatacttgttgctgcctccaatgggatactcaaggttgtcataaccttgctcaaaaggtatccagattgtgccactttgcgtgacatccaaggaagaactttcttccatgttgccgtggagaagaagcggcgtaatatcgttgcatatgtgtgtgaaaggccaggattttctcctatcttgaatatgcaggacagccatggggatactgctctacaccttgctgtcaaagccggtgttttttcaattttcagctcgttgttccggaataggtaggtttgcctgaatttatcaaatgaggatggtttgacacctcgtgatctttcgtggattatgatacctgcgaggttgtactctaaaaaggtaatcgttctctgccttttctgaccataattatcccatataatacactacagaggccgagtttagttccaaacttattctttaaacttccagcttttccatcacatcgaaactttcctacatacacaaactttcaacttttccgtcacatcgttccaatttcaatcaaacttccaattttagcgtgaactaaacacacctagagttgatgatactatacctatttaactaggctaccacatgttaatctttcagaacccacgatatatgataagtcaactattagcactttctggaggtactgttggttacagtcgccaggaccacttcttcgaaaaatacagcaagaaaagagacgaagtaatcgattcaaacgatatgacaagtgcggcacaggttctcggcatttcttcagcgcttatagcaaccgtgacatttgcagctgcattcacgttgcctggaggttacagagcagatgaccacactgatggtggtacaccaacacttgctgggagctacccttttgacgcgttcattatctcgaacagcctagcattcatttgctctttgctagctaccgtgagtctgctctactctgggatacaatcgagggacatctccatccggcgcaggtactacgcgttctctatgctcttgatgcagagttcaactacgagcttcactgttgccttcgccatgggaatgtacctggtgctagctcctgttactcttaatgcagcagtgtctgtctgcatcatagcatttgtttctctgctacctggaaatatggaaatcggggtatccctagctatcgcaaacacattgaggattagattgggaatttgggcagcgatgtcccaagcaaggccagttctcctgttcacgtggaaaagagtttggtcctgcataattatctttggattgcctggattgatgaagattcatagaaccaaaatggcttgattggcgtgtcacctttttttctgcattgatgtactttcttaatatatcctttattcggagtgttagaagtacatttacacaacatcgtgtatgacagctttgctgttacccctctgcattttaacgtagaatatacctacgatcttaggcagaagatgaaagaggggaattcagagtgtggcaaataagttacagtgtatttactactccatatatactgtaagttttcataaatgtgtgactgaaacttttttatgttccactgttttgaatgaaaaacaaatgtttataatattatctaatcaagatttttttttcattttattggccagccagctaattattatttatgtgcttgatatcacgttcctccaatcgtttgatgatagaaatttgctccaatttaacaaaaagtaccaaatcattttcgatcgttggatctaacaatgcccatcctgcccagctaaatccaacgatccagtatcgtgaggtactagtacctcgaggtactttttgcaagaccagagcaaatctcttattgctaatcatgagacctgtatgtccggactaatataattaagggttaattggatacatgccattataatttttgcgatatgcatgacaacacaatatatgatagttaagggcatgtacaacaataactataatgaattaatgatatgcatgacaatacaatatttattattactagcttggatgagagagggggaatagagaaggatggcttagtcacaacacatatatgagaaagtagagaagagtagtggtatggaatgacattttgtctcttgggcatatccttttgtaaataggaaattttaagtagtttggtgcgaataatattctagttagtgcattgtgttagagttgaacatgccctcaagtcttgtttcaaatggaatgatttctattgctgcacaatcaaagtgtgttgattgttattttgcgatgaacaattggtatatgagattattgattttgatattgggagattattggcaaagtggttttggagatgattgaatttttaggtgatgaacaggagattgctgacagtgtggactggtcagaccgggcagtggttgccggtcacatcggctgtacgtgtgcagtcagaccagccagcccgcggtctgaccaggccacattgtgttaatttcggttttaggttgtttctttggatatctagtggataaatcatgtttatgacttctagatggatactttgcgtatgtaatactgttgtgtgctaacaatgagttaagttggagagagcttgtgcttggatatggtttctttgttgatgcatgtgtaggtgagtcttgatgccttgggagagcgttgccggtgatggatgatgagtcaacttgggagaagatgacatccgaatgatcaggatatcatgcgggatgctaggctaaaaatcaataaatgtgcgtatgggatgcagagttgaatttggagggagaccgaattcggtacaattacagtttgtaagtttgtttcttgtacgggaaggtttccttcgggattaggagttattgtataaggttggttaattcgatgctttaggctacctacctagggtatgaatagtgagggaggcctcccggtatcgtttttgagagagttgagtttagagaaaagttagggtttagagtttcattgagatttttgtgaggagtgttgttgttgcattttgaaaacacagagagaagtaataaattttcaatctatttcgagagatcttcgatttgtatttgctcgggttctgcggtccaaccggcgggacacatgccatcagactggcaggaatacgatggtcagaccggtggcaacgacaggtgacagcggtgtgttaggcggtcagaccgaagctactacactgctcagaccgaaggtcatcgagcggtcggttcggcgcatctactctagtcgaaccgatcgccatcgaattgatacaacttttaattccgccaaaagttttgctttttagtactacaaccattcacctcctttggttggcttggtatttactgttcaatcctacaagtggtatcggaaccttgttttttccattagatttttatcgatctagagttttagccatggctaacatgcttacaactaagccacatgttttcgatggattggattttccttattggtgtgaaaagacgatggaatcttacattatggctcaagattacgatatttggaaaaatcttgctaatgctgatgagattcctgatcaaattaatattgttgctttaaagattgagtttgaatataattgtaaagcatgtaatatttttctcagtggaatttctcgttttgactttggttgtgtttctcatcctcaaactactcgtgagatttggattgttttacctaactttcatcaaggtacttcaaatatcaaggaacttcataaagatcttttcaaaaatgattacataaaatttgcgatgaaacctggtgagactttggatgattatcttgctagatttaacaaagttttgagtaatcttaaatctattgatacatcttatgatactaattactcacaatatgaggtttctcgttactttttaaatggccttgatatttctatttggtagatgaaagttatatctattcaggagtctattgatatgtctactttgattttagattcactttacactaaacttaaaacccatgagaggaatattcttttttgtaaagttgactttaaatctagtgttttggtttctccttcgacttccttggatattggtgcttcttcgtcaaattctaccgctcttgcttctataaatgtcatatccgatgatcaacacgagcaactcgaggaggacttggctttggctattgttggtatttattacgagcacaaaataatctacaggcgcacatataccgttgtagctttcacccaacagtattccagggtattgtatccacaggaaacgtgtgtgaacaatctaataacagaattcatccaatgacaacaattaaatagtaggccaaagatagagatgattcctatgggttaattatctaaattaagtttaggtaaaactctatcaatcgctttcggcacaggtttacccctagtctaccaaggagactctggcctacaactctatgttgtacttgaacatggaggattacaaaggatggacagggttatcaccacctgctgtctacctctacaacccgtgtagcacacagcaaataaaggtaacctctagcttagacatcatgtccacgctattaattactaccctaatctcggatccacatagaagattaaggtactctacctaagagtgatgaacccgtaatgatgagaatatatcttgcataaataataaaagtaaataccaaggagatcacaaatacttatcatctccagccctcctccggaacacccctggatgaatgtcgacatctccggtgctcctccgaaccaccccctcccccgagagaacttcgacatttgacacactcctttcagagcttccccacactcccttccaatattctaattctactagagagtagcctaaatgtataagtgagttgtactccacttgttgtgttgtgccttgagagtgaaatggagaactcattttataagacaactatgacggttactagggcgataaccatccacaaccatcattgggagagcatcgtagtcccccacgtggcagcagatggcgaggggagccgatgtcagttcagctgaactaggagttcgatcgacccttggatctaacatcttcagtcgcgtagacctgaatgcactcctagggtcggtgggaacctccctaccaaagttgggcctaagaggccacaatggtggttcgatcgaactcctagataggttgttttcagccgcactggtctaaatggcctcctggggtcggtgggaacctccctgccaaggttgagcccgaaaggccacaacagtggtttggctgaaccatttttggcccttctcggccaccccttttgtcaggtcactgtccagtgggcccccatgacagtgcacgagggttttgctacggtttgtgggccctccaaatccatgtactcgcgtctgattagccggaggtttgttttattgcatggcggatggttttcgtccataattcacctacatacaaatattcagcaagacttgtgaaaatggtcagtaataaccactatctctaagtttgatattccattttatattctttcatttgtttttatgcgtgcattgattattggatttgctacttaaggaccgtcaacaacacctcacacttatcctttactcatctttgagtaaagctcatggatataaaaaatagagcaaggacttcctgatctcctatttcctgtactctctcctctttttctacagtttgtatgtttgctgctgtgggagggagattcacttcacacgcagtaggatggatgcgtgcgtgcatgtgcaatgcatgtgaaagagcatgtagcctagtgattgcagtgacctgagtagcggtcgtgagttcaaatcttcataggctaagtttctaatttaaaaatgttgtatatatcggtcgtatttgaacataaagaccgataaaaaaaattactcttctctaaaaaaataaaaaaagtaatgcttaggcaagcggggtggggggtgagtgcctgtttggttgatgccctcgttagcatgccggagaaatttgcatgcgtgataggcatataagatgcggataaattgcctggccaggcagcctgacaccttgcttgtttggttgtgcacctctgcctgggaggaaaaaaaacatgattaggatctagattggatctgctaactcacatactagttgaatgacaaatcttggctttttaccgcccctccaaagaattcaacgtaatacccagtttttttttaacaacttgcatacatcaataagaaaaaaagaacagaaaaacacatgaaaaaattaatccccaaatccacgcatctatcataaccttcaacgattcctcccagctagttgccaattgattcaatgaaacaaaccgttgaagccttcagtgtcttgcatccggcgtgggcgtgtggctttagcgcatgcttctgtgaaatcattgtcatgattaatatttgtgatgaacaattggctattcaaatgatttaatcaaagaattggtttgagagtttgtgtgaatgttggtatgagtgcgtgtgactaatgtgggtcaggttgtgatatctgtgtccagaaacggttgttttgtctgattgtgtgcaggtgacttgaggtcagccctagtcaatggtgaggaccgggactatgctcagggaggagcagaggtctattgcggtcgggataccatgtgagaaggtgactagagtctggactcttggaggtcaactttggtcaacggtggggatcgggactagactcaaggaggagttgaggtccagacagtcaaggataccgggtgacgaagttggatacaagatggcatacggtggatagacatcgtgtggattggataatcccaggcgttaccataatgaatggccgcaaggcacatccccctttaaccagatggaataatagcaaaaagatatgctccgactagcccttaggaacatgtgccaagccctgagtgtcgactggagaggaacgcggattttacctttatcgcctaacagagttaaaacaaatcacccct

SEQ ID NO: 34287 - DNA, 823 bp, Oryza sativa
gagatagctcttcacatcagtgacttctagcctgtgacgaacgccatgcctgattgagatggggatactttaggtaaatacaacgaaaattttccagtaccaaaatggccataattaacaatagcctatttgaaataagcttgaagatcattgcatacttacagtatggccatcagcaatttgcgcaagcgatgggtcacggataatggagaggattggaacaacaaatgcatatgagcccccaatgatggtaggaagtcgagtgccgaataatgtctggagcagtgtttttatcccagtaacaaatagcagtgtttgaacaactcttgccttgtcatgcttttattggaagcaaatgaaacaaaaaattttagtaagaatagtcatatgttggtcctgcaatattaatgtgctgtagcatttgacaactgatacagaagctggaattctactgcacataaaaaacgggttaataaatgaagcaattctcacatcatttccacccataagaggaaccagcattgttgggatcatcacagcagtgcccagggaaagaatgtaatgctgaaagcccaaagcaattgcttcacctgcaacaaccagaaccactcagggttagtaacatatactatgctacaatacaaatcaaccaatcatagaacacttcagtgcagtgtaacactacataccccaggatggattggagtctatgcagtactcaaatccctggagctggtccatgggtggatgatggaccatgtcctcaggcttcacctcagccatttcacagccaaacactttacacttcttttcttcaagatga

SEQ ID NO: 34288 - DNA, 788 bp, Oryza sativa
ccctgcggtagatttagcatcgtactgcaagtagttcatcaagctgactcagcattggacccacgtgggtcccacatgtcagccccttcttccccttccctctcttcctccctcctcttctttttctctccctttgctcctcagttcggcagtgggcagggcagctggccggtgggggaggccggagtccggtggcggtgccgcacgtccttccacgtagccgacaccggtggagaagctcctcctgatctttcgtggattatgatacctgcgaggatgtactctaaaaaggtaatcgttctctgccttttctgaccataattatcccatataatacactacagaggccgagtttagttccaaacttattctttaaacttccagcttttccatcacatcgaaactttcctacatacacaaactttcaacttttccgtcacatcgttccaatttcaatcaaacttccaattttagcgtgaactaaacacacctagagttgatgatactatacctatttaactaggctaccacatgttaatctttcagaacccacgatatatgataagtcaaactattagcactttctggatgtactgttggttacagtcgccaggaccactttttcgaaaaatacagtccgaaaagagacgaagtaatccgattcaaaccatatgacaagtgcggcacaagttctctggatttttttagcgcttatagcacccgtgacatttgcagctgccttcaccttgcctggaggtacagagcaaataaccacactgatggttgcg

SEQ ID NO: 34289 - DNA, 2562 bp, Oryza sativa
  unsure (1)..(2562): unsure at all n locations
naagttatttttgtctagcgtcaataaagaaaacatcggtccaatagatccagaaaattcacacctgagcagaaaaaagagtttaaagaaatgttgcagcaagcacgggatcagttcttgaactcattcatgcagacccgcaaggggacacttgttcaaaagtacaaaataaaagtggttagtgatgatcctgggaccagttcttctaaggatggagatgggaaacaagctcgagacggctcggctcaaccgagtgacaaaaggtgctaccgacggttctttaggaaatcaaggcgacaattctcaaggagtccatggagtgcaagatcacggagtgcatggagtttaaggtgatggtgcccaggggttccatgtagtcctttcttaatcagaatagtcggcgtcctcaacgttgtgtcaataattccggagggggggtgcccgccaccttggcataagggtggggtccatcagtcatcccttacctccaaccgctcctgccgcctcgtcagtgccctagcgcagcgtccgccgcgaatccagcggcctcaggccgtctctgcgcgcaataaagagggggaaagcactccccgtgattccctctccctttccccccacttttccctctctctctccccggaattagtacgaaaagtttccccctaacttcgacggcgcatcaatggcggccggatcttccgcaggcgattcccctcatccggctctcttctccccctccggaccctatataaacgctccccgtgcctcctnccaccatttccgccactcgccgctctctctcccgtcggaatagagctcgcgccgtcgcccctctctttccgcggtcgccgccgagctccggtccgccgccgtcgtcgccccggactttctcccgcttcggcgtcgctttcttcgggttcgccgcaacctcgccgacctcgtccacctctccgtttcggtcgccgaccgccggaacgccgccgtcctcttctacccgagccgcgccgccgccttcctccgctccggtcgccgtttccgccgtcgccgtcgaaccggggtgagccgtgaaccgcccatttcgtttccctctcccctcccctctctcggccgccgctccgccgtgcctatggccgccgccggcgaccataggggcgcgggcgcgccgcctcccgtcggctgtgccggcgaggccgccttcgggcgcgccccgcggctgccatgtggggcccggccgtcagccgcccgagccctcgggtgcggctgacgcgtgggacccacggcgccggccggtgtgagccgcgtgcacccggtccaccgtggaccgagaggctgctgcgtgggccccactcccgtggacccggtccgcgcgctcctcccctcggctgacgcaataaatccgattttaaattaaaatttaaatgaagaaattcgcaaatatccatttaaagagcatataaacttcaaatggccataacttggccatttaaactcggaattggaccgttcaagtctctaatttttccttaagaagtcaagaacccatttttgtgctttgtttctgcttgttatatggagtttgttagagtaaaagccttttcttttccgttggtcgtgtagacgctgcagcttcggaagatccgctcttcgtggaagttgaagccggcgtttgggaaagcgagcaaggcaagtcacatgatctttgaacatattgaatcccagtttataaaattatgttgatttaaattattgcattatcgctttatttaaattcccgcgttatcactgttttatttagccatgcctatttacctttgttacgaccttattattattgttattgttattatttccttgttcacactagaataaacaaaaccccaactagtggacactctactcatggtatcactagtatgattttaggtagatgcttcgcttttaattaggtaacattaggcggttttacaactctagactttgggaatgttcgtatcacctggacactatggaatggtttggttattgtgaaattggcttcacaccgctccttctattcaaaatccccaaaatggttttaggctgggctcggggtgcatggttttgatagtagcacctcggccatataaggaccggtcttcgggcctctgttgcaaagcactaccgtactttcacatgtctagtgggtaaggcttagtttgtgactcagtctagttataaacaaaagtacacggatggagatggaagaagtcgggggtcgatggacatctctaggacaaatgaaggctatacgagctgcggcccggtagtcgagatgtcatggcacaaggccggtgtcctgctgctaggggttcagtcctgcctgcctgtcccgggggttcccgccgtaggtgggattgggtcggtactcttgtctatggctaggatgggttggaaactatgtcacgtctttcgtctgtatacccgggaggtatgtggcacgtggttacacctgaggaagatgtgtctttgtgggtaaaatgtacacctttggtagagtttatctattcgaatagcgcgccttcg

SEQ ID NO: 34290 - DNA, 813 bp, Oryza sativa
aagtagcgttaatccatattgatcaggaagtgctccaagtgagtgttcttaaactttccaccattgtcatttcgcacgctcttgatagtgagattatagaggcttagggctggcttttaaaagcgcttgaagacatcttgagcttagcttttgtcatggagaaagtacacccaagtgaagcatgaaaaatcatcgacaatgacgaatctatacttgtaacttccaatgcttatgtaggccacgggcccaaataaatccatatgaagaagctagagtggtcgtggtgtagtcatgatgttttttataggatgtgaactcccaacttgcttcccggcttggcaagcactacacacacgatctttctcaaaagaaaaattagatagccaaagaatgtgttccccttttagaacagatgccaaattcgtcattccaacatgggctagcatacggtgccatagccaacccatagaggatttagcaatcaagcatggtttgggattcactctatctatgtcgaaatcagtgagatagagatcaccctttaacacaccgttgaatgctacggaagagtcatctcgcgtaaacacggtcacatccacatcggtaaccaagcaattaaatcctaacttacacaattgagacacggataataaattgtagcttaatgaattgacaaggaggacattagatagagattgattcttggaaatgacaatcttaccgagacccattacctttcctttaccatcatctccaaagaccatattttccatgatgaactactgcagtcgagttactaaaacgggaaccacg

SEQ ID NO: 34291 - DNA, 1417 bp, Oryza sativa
atggcccctttgaatttcatttcggcctgccgcacatcaaacaacttggatgccaagagattatatgcaacttcattttgcgcttccaagccgcgtaatgtgtaccatcaaattgtggatctcgcccggtaagcacggatacgatgttgggtgaaggaattgaaaggttcttgtaatcaaaaggtataatagctgccttgggtggtgaagttcccttgctgctcgctccatcttgatttccattttccccgtttttttccactaagtccgacatcgtggatcactcaaagcggcgaagcttgaatcaagagcaccctgctctgataccaattgaacgcgctgatgaagcctagaggggggggtgaataggctgtctctggatacttaaaaaccaatcgcagctgtaaaattcaagcagacccggaacttcctggtaaggaagtccggaacattcggcctgccaggcccggaacttccggtgttctaggacaggaacttctgggtaacagaatagagatgaaattcaaatttcgaaacaggagactaagccaatcttcacaagatggtgcacaggtattcttagcagaggatagatcacagaatcatccacagaaacatcacagaaagagacaagagcgattttttcctgaagttcggatctttcgatcctactctctgttgaggggctccaaagagctgggtctcgattaaccccttgcctcacttgtgcaaaaaccccagaggaaatccacagccttcaatcccaaacactcctaggcaaatttctagaattgagtgaccaccaagatccaactcaacctgcttctagaaatccaccacaagtgtaggttgctctacttggaaaacctctagaatctcagcacaagaacttcattcacttaccttgttccctttcggaggagaggagatccttcacaaacttacccgggacatccacaatatgcaacggattctcgcgggcgacacctaaccgtctaggagatcatctccaagagtaataagcaccgagatgacagcccacgagatattccaagagctcatccaagatcctagtcttcactcctctccaaatcttcttctctccctctcaatctctctttctcacaagaattaggctctagattgagtggagaaggcaagaaacacttgtgagagtctagcaacagctctaggtttgaaaagtgaaagtggaatggccaaagaacgagctggaaacgagctgtatatgtataacggctaggtgacgtcatctagctgttactcacaaatttgaactggagactagacaggaagttccggacctgtaggataaatattaaaaatctaacaatcatattatttacatcactttgcctgccgaatcccttcgagggctagcttaccacttcaggctgga

SEQ ID NO: 34292 - DNA, 2077 bp, Oryza sativa
agaaacataagtgctcaaaactgtttttgtaacccgattctagacctatccaattattaatcaggccggtgaacccacacgaacctcccttacccaaaggcctacgatgattcagcccgaactgacaacccgaccatgggtcccagctcgtcccaagccaccccaggccaaccattccacattttagttgttaagcaggttttaagaattaaaacactaacttgggtacattgcacggcttgcccataaccgagggcgcggctattcgaatagattatactctgatcagaggtgtacatctttacccacaagacacatcttcctcacgtgtaaccacgtgccacataccaccacggtatacagacgaaagacgtgacatagtttccaacccatcctagccatagacaagagtaccgacccaatcccacctacggccggaacccccgggacaggcaggcaggactgaacccctagcagcaggacaccggccctgtgccatgacatctcgactaccgggccgcagctcgtatagccttcatttgtcctagagatgtccatcgacccccgacttcttccatctccatccgtgtacttttgtttataactagactgagtcacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaatttcacaataaccaaaccattccatagtgtccaggtgatacgaacattcccaaagtctagagttgtaaaaccgcctaatgttacctaattaaaagcgaagcatctacctaaaatcatactagtgataccatgagtagagtgtccactagttggggttttgtttattctagtgtgaacaaggaaataataacaataacaataataataaggtcgtaacaaaggtaaataggcatggctaaataaaacagtgataacgcgggaatttaaataaagcgataatgcaataatttaaatcaacataattttataaactgggattcaatatgttcaaagatcatgtgacttgccttgctcgctttcccaaacgccggcttcaacttccacgaagagcggatcttccgaagctgcagcgtctacacgaccaacggaaaagaaaaggcttttactctaacaaactccatataacaagcagaaacaaagcacaaaaatgggttcttgacttcttaaggaaaaattagagacttggacggtccaattccgagtttaaatggccaagttatggccatttgaagtttatatgctctttaaatggatatttgcgaatttcttcatttaaattttaatttaaaatcggatttattgcgtcagccgaagggaggagcgcgcggaccgggtccacgggagtggggcccacgcagcagactctcggtccacggtggaccgggtgcacgcggattacaccggccggcgccgtgggtcccacgcgtcaaccgcacccgaaggctcgggcggctgacggccgggccccacatggcagccgcggggcgcgcccgaaagcggtcttgccggcacagccgacgggaggcggcgcgcccgcgcccctatggtcgccggcggcggacataggcacggaggaacggcggccgaaaaaagggaggggagagggaaacgaaatgggcgggccacggctcaccccggttcgacggcgaccgcggaaaccggcaaccgagctgatgaaggcggctggaccggcttgggtagaagaggacggcggggttccgccgttcggcgacccaaaccgaaaggtggaccaggtctgctagggttctgtaaaccccaagaaggcgaaccccaaacgggagaaggtcccgggcgaacaccggggggggacctggacttcgtggcaacggcagaaagaaaagggccactgccccagctttttttccacggggaaagagagcctgcaatggccggaaatggtggagggaggcaccgggagcgttttttttggc

SEQ ID NO: 34293 - DNA, 833 bp, Oryza sativa
aagaacaaagaacaaagggacttaccaccggcaatatccgattcgaaatagcccaaaagctcaaagccacaacccttagaataacacaagccatgattaggagtgtgaactaaatatcttagaattctcttgacgacaatcaaatgacactctttaggctccacttgaaagcgagcacacatgcaaacactaagcatgatatccggacgagatgcacataagtaaagcaaagatcctatcatggagcgatataccttttggtccacacatttaccattatcatcgaggtctaggtggccattagtaggcatgggtgtcttgataggtttggcatcctccatcccaaacttcttgagtatgtctttcacgtacttggtttgagagatgaaggtgccctcttgtgcttgcttcacttgaagcccgaggaagaaggtcaacttgcccatcatagacatctcgaaccttttagtcatgatactactaaattcttcacaaaaagaggcattagtagaaccaaatattatgtcatcgacataaatttggcatatgtataaatcactcttaaattttttagtgaagagagtagtatccgcctttccaatttcaaagccatttttcaaaagaaaatctcggagacattcataccaagctctaggggcttgtttgagcccgtagagtgccttgtggagcttgtacacatgtttggcaactttggatactagaccccgggggttgctcacataactaactcccagaaggtccattgagaaaggacttttgacatcatttggaatacctgaaatatgaaaaccggcttggctaaaagattttat

SEQ ID NO: 34294 - DNA, 856 bp, Oryza sativa
  unsure (1)..(856): unsure at all n locations
ntcctttagtctcatgatctctcaagaagtggtggcgaatatctatgtgcttggttcttgagtgttgaacgggattattgcctatgttgatggcactctcattgtcacatagaagtgggatcttggtgaagttgtagcaaaagtcttttagagtttgttatccaaaggaattttgcttcttggaggaccaaaaaacaagggaccgcccaagaaattggcaagtcccagttgtgctttttctatcaaccttacacttggcataatccgaatcagaatagcccaaaagctcaaagccacaacccttaggataccacaagcaaagattaggagtatgaactaaatatcttagaattctcttgacggcaatcaaatgacactctttaggctccgcttgaaaacaggcacacatgcaaacactaagcatgatatcgggacgagatgcacataagtaaagcaaggatcctctcatggagcgatataccttttggtccacacatttaccattatcgtcgaggtctaggtggccattagtaggcatgggcgtcttgataggtttgacatcctccatcccaaacttcttgagtatgtctttcacgtacttggtttgagagatgaaggtgccctcttgtgcttgcttcacttgtagcccaagaaagaaggtcaactcacccatcatagacatctcgaaccttttagtcatgatactactaaattcttcacaaaaagaggcattcgtagaaccaaatattatgtcatcgacataaatttggcaaatgaatgaatcactcttaaatttttttgtgaagatagttgtatccgccttcccaatttcaaaaccatttttcaaaagaaaatt

SEQ ID NO: 34295 - DNA, 2044 bp, Oryza sativa
  unsure (1)..(2044): unsure at all n locations
ngatgcgtgtcatgcgtaccgcaagtagttcatcaccggatcttccgcaggcgattccccctcatccggcctctctctccccctcccgaccctatataaacgctccccgtgcctccctccaccatttccgccactcgccgctctctctccccgtcggaatcgagctcgcgccgtcgcccctctctctccgccgtcgccgccgagctccggtccgccgccgtcgtcgccccggaccttctcccgcttcggcgtcgccttcttcgggttcgccgcaacctcgccgacctcgtccacctattcgtttcggtcgccgaccgccggaacgccgncgtcctcctctacccgagccgcgccgncgccttccttcgctccggtcgccgttttcgccgtcgccgtcgaaccggggtgagccgtggaccgcccatttcgtttccctctcccctcccctatttcggccgccgttccgccgtgcctatggcccgccgccggcgaccataggggcgcgggcgcgccgcctcccgtcgactgtgccggcgaggccgccttcgggcgcgccccgcggctgccatgtggggcccggccgtcagccgcccgagccctcgggtgcggctgacgcgtgggacccacggcgccggcccgtgtgagccgcgtgcacccggtccaccgtggacccagaggctgctgcgtgggccccactcccgtggacccggtccgcgcgctcctcccctcggctgacgcaataaatccgattttaaattaaaatttaaatgaagaaattcgcaaatatccatttaaagagcatataaacttcaaatggccataacttggccatttaaactcggaattggaccgttcaagtctctaatttttccttaagaagtcaagaacccatttttgtgctttgtttctgcttgttatatggagtttgttagagtaaaagccttttcttttccgttggtcgtgtagacgctgcagcttcggaagatccgctcttcgtggaagttgaagccggcgtttgggaaagcgagcaaggcaagtcacatgatctttgaacatattgaatcccagtttataaaattatgttgatttaaattattgcattatcgctttatttaaattcccgcgttatcactgttttatttagccatgcctatttacctttgttacgaccttattattattgttattgttattatttccttgttcacactagaataaacaaaaccccaactagtggacactctactcatggtatcactagtatgattttaggtagatgcttcgcttttaattaggtaacattaggcggttttacaactctagactttgggaatgttcgtatcacctggacactatggaatggtttggttattgtgaaattggcttcacaccgctccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtgactcagtctagttataaacaaaagtacacggatggagatggaagaagtcgggggtcgatggacatctctaggacaaatgaaggctatacgagctgcggcccggtagtcgagatgtcatggcacagggccggtgtcctgctgctaggggttcagtcctgcctgcctgtcccgggggttccggccgtaggtgggattgggtcggtactcttgtctatggctaggatgggttggaaactatgtcacgtctttcgtctgtataccgcggtggtatgaggcacttcgggagcttgatagtgtaaagagttttatgggtaaagatgtacacctctgaacagagggtaactcattttgaatagcccgcgcctctggggaatggggcaaagcccaaaaggtgtctcctaaaactaaggggggtgaacttttttttagagcaggttttaccaaccaaaaaatgttttacatggcctggtttcttggggggtgggctcttggaaa

SEQ ID NO: 34296 - DNA, 783 bp, Oryza sativa
agtgtcactgcactggaagtagttcatcagagattttaggaaaaaaccatactattaagaggggttccaggtgatgctctgagatatctcaagtgctcttagtgtgaaccaagtttcaaatttccctaggagtcatatttgcaaatactccatctgtccagaactgcaagtccggaacttcctctcgtctaggtccggaaattccggtcttgtgaataagattttcctaagtatagtccggaagttcctgtcctacaggtccggaacttcctatctagtctccagttcaaatttgtgagcaacggttagatgacgtcacctagccgttatacatatacagctcatttccagctcattctttggccattccactttcacttttcaaacctagagctgttgctagcctctcccaagtgtttcttgctttctccactcaatctagagcctaattcttgtgagaaagagagattgagagggagagaagaagatctggaaaggtgtgaagactaggatcttggatgagctcttgggatatctcaagagctgtcatctcggtgcttattactcttggagatgatctcctagacggttaggtgttgcccgcgagaatccgttgaatattgtggatgtccgcggtaagtttgtgaaggatctcctctcttctgaaagggaacgaggtaagtgaatgaagttcttgtgctgagaatctagaggttttccaagtaaagcacctacaattggggtggattttagaaagtaggtgagatggatcttggtggacac

SEQ ID NO: 34297 - DNA, 7930 bp, Oryza sativa
  unsure (1)..(7930): unsure at all n locations
cnnnnnnnnnnnnnnnnnnnnnnnnnnnnnnnnnnnnnnnnnnnnnnnnnnnnnnnnnnnnntgggagcacataggttcgagcagaatattagtaattagttcagttgtgcattttttgaaaaattttctgattcgattgtatttttgaaggtttgttctgtccccatttactgagagcattcgtgcatgttcaagttgagaagattcctcatacatatgtactgcgtcgttactcaaaggaagcaaagagtgatgtcaattttgaccggcgtgatcgtccaatatcggggccagacggtgttaaattatcatacaggacaaaggtgttgtcattggatgcacaacagctagtaaagtgggggaggaggtcgtcggttgctttcgaaagggcaacctcagtgatgaaagtgctgagaaagcagctggaagagattccggcagatgtccatgggttagatgtagatgatggtgtgagtgagcatgaggctgatgttggcgatggagctgggccatcgatccatcggggtggaagtgttggtgatgaaattagcaggcgtccaccgccaaagtcaatgacaaaagggaggggaagcgaccccaatgagacggtccgtctaggtgctcccgaacctaaaaaatgcaccggggctgcagttggtgtggtacatgccctaaaaacccggcgaatttcgaacgtttagcagcagctagcagcaggggcaaagggaagaggggtcgaccaaggggaagtggtagtggtggtagtcgtgggcaaaaagacgtccggaggacaccgatggacgagtgggagggtggacaggaggaggagggctgtagcgttcaaggagacgaaggtgacggcatcagcgcgccaaacgatggtgattgggagggtgaatcagagtgactaaaagaaatttatgttaaatcttgtgtttaagtgcatatttgaactaaatgattgtaactggatgacatggactatgttttgatgaattgtggtcggatatgtgttgacaaacattgtaaggtgatatgttcagtttgtttctattaatattggtagttgtttaattttggtaactaaataaatggtctatgatatactgtgggaaacatttgtgcaataatgggcgcaataaattaaagaagttacaatactggtgccatggagaaacagtactgtaaaaagggggctcaggtcagaattcgtagttagtagatgatttacttaatgtgttcataaggtggatggcttacagtagcaccattcgtagtgtaattgctggcaactataggaacggtgaaagttaagtacgggcgatagtaccggcaggggagtggatggttggaatggatgggttggtgtagataataatgtaactggttcagttgtagtaataaaaaaataaatgaatagcgaaatagcgaccgcatgcattcaacgcttctttggatgtagagtgatgattggaaatgtgtttactttgaattttgagactgtggcgggggtatgattagattatatgtaaataatttctggtgtgtttgtatggatggggtgatgtccatgggagatattggcgccaagatggtggataacaattaggatgaaatggtcaagcgcatggttgggatgctatctttagctaagtcaatatgtatgcgttatatatagtacaccaacgggctgcacagttgcacatcaatatccaggtgggaaagcataggcgcataggctgtctaagctacccgatggctcgccggcctcaccctcaatacatggtgattcatccggctcgcattcaccagagaggttgactccatctccggtgatgcgtgaggtggatctacctcctgagttttgtgttagggggtcgccaacgccagactggccaccaccacctacagaatcagatgaagagaggtttcgagaagatctggagcaatactacaatgatgggtacgtgtccactccatgcccgtcaccaccatctgatctgttcgattgcgaagaaaatttggaggatggagatgtggaagatgataatttgaggcatggggatgtgctgcctaaggataatcaatcaaaggatacagcgtcaccaccgagcaagcgcaagaaggtttaggatagtaccgataagatttgtcgtatttaaattgattattgaattgtcgttttaaataattgctactttttcttagtggctgtgcttaaatttgttagttgtgaatttgtgagttttgatctaatttcatgggcatgaaataaataagtttataagtgtagtgtagatgtcagtgtcgctatcatgatgtattcagaagagatatattcatgtgatttgttaaaacaccatatgatgtgtgctgttagagttatcactgcatggctgtggtgctcgtttggtgtacatgccgtcaagctgccagaaagtagagcagttacttagggaacccaaatgatgttctcactccttcgggatggttatttgccttccagtaaatggtttactatcggctaaattttgcttggggatgacatttcagtgatcacatatgaaaacgaaacggcagtatgaatgcacaatatttttacaagaagatacccacattaacattaacaaaatgaagtagtctcatccacatcggttccattagtacatgtcctaaagttcgcaagcagtggtaactatcaacaaagacttaacagcggtgtcactagtgggagcttccttcaccgttgtcaagaggacgaaggtcctttatggcagagtggatgcatggtgctaggttgaagcgatggaaaatcagttggtgcagcatctgtgcccgaagaacacgtgattcaggctagcaaaaaagaagaaatggcataatcagtttgaaagttgtagcaagtgataacaagagattgcagatggcaatactgtaatgaaatgtgttgtgataaatattaccggttgaaaatcatcagcaagcttgtcaggattcccctggtaccgctccatgtacctcatgacatagaacgcacagtcatttgagcatggcaccatcttggggcatttaacgaactcacgatggtagttgccaaactttttaaatactttgggtataaaggattggaacccattgctgagacgcttgaggaccctctaggccaatgggtagtgatgctggctctcctttcctcctatttggtcgtagtcattggagtccaatatatcaaaactcccttggttcaggtatacgatgtggagtgtccagtggtcattgttgatgattggcagtaaaagctgaacagatgaaacagaagtaaaattagataatatataaagcatggcagtatatatattaacaattggtgtactgaatcctgacctgctcggcctttgaaaggttgacacccttcagacatttagacaggtgttcggctagagcgcgtgggctgaagttgtccttactgccaactctagtaacattctcaatgttgaggagaccctgcagttatatgttaatgagaagcttgttggaaggaatgtgaaataatggatagaaaacgctaaaaacaaatcatgcagtaccgttacagaggtgggtatgaagatcttcttgccaaatgtttctggattatctctcatttcatccttaaaaagcaaagatgcaaaagcatctatgaaaatcccttctgtcatgcttcctgccttgaatgatgcggctatgtccgtggctttagcactgtaacaatccacctcgattaagggagggttgtgaggtaagatgtttgattgggttagtaagtgcggtaggattgaaataaagcagttatggagttgcagtgtacatgaaatgggtaaaaatggaacaaagctcccaaattgagttgggtctcacagtatcaagtcaaggagctgtacggcgacgttgtcatctttgggtacggattggctagctgggggcacgtacctcgctgccctcttgacacaacgtttcacggggctagcatgttgtctagccccgtcgtcagcctctttgttgacctgcatatgatacacatagctagggctcggtggtctgatgggataattaatgccgtgtacaagtgaaagatgggacaggagaagcaggtggtaacctcagtactatcatgataggcaccttccataatgcaaatctgatcaattttcgctgctggctgggagtcagtcaataattcatctgggggcagtgagtgtgacaagttgtcatcatcgtcgtgagaagaatcacctgttcatgttgcttggaagagagccatgattagacatttgaactaatggaatgatgaccatattaatagatgtgctggttgtatgtgattaaggagatggggtcactaaccttgcgtgttatgttcagcggtttcgtcttgtacatatgccgtcagtgctagaagggtattaggaacaccgaagtctggtagtgcaggttcaacggcgggagcagtgggctgaataatacctgcaacagtaaatcatatagtaaagaccaagtgtgcttgcgaaatgatcagtctgtaagcaaacactagctctctaattaaacactagctcccggaccaacagtaagctgcactgtgacagattgtatatttaaaggggtaaccatattgtgaatgcaaaccagtaaacctattactagtatttgctgcacttgggtgcagcgggataggggtcgaactattactgatacataagagtgtagtagaaaataatgaaacagagttaagtacattggtaagccggttggaaaagagaatccttagtaaaattattacttaagagtattagtgatgcaaattactagaagtaaatggtaagcaaaatattggtaatgaggtgacagtaactgggttactggcaaagcatggtattccagcaaggtaggggtccggtgtgtgtattgtgatggtagtgagtgtcttactatgtggccagtttgttgaatggcaaatagaacaagtggtagtaattgaattactttgaatacaaagcagaactatgacatcactgaatataagaagtttaattttgcaaaaaatgagaacaatgacacattatcacaaaaattaggaagtaagaaatgaagctagtgagataaaagccgctatgaaaaccatagttgttgcgtcccaaaacgactctaaaatacatcctcaaaattatgcatagaataagtaaaatccatgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaaaggttttataaaaagaaaaaccctaaaaagtccctttttccccccttcccctcttgggccggctcggcccacctccctccctctctctcctctcccccgcggcccaatcggcctcctccccgcgcgcgtgccgctgacgggcgggcccgcccgccaccctcgctgacgggtggggcccacccgtcatcccctacctcccgccgctcccgccgcctcgcccgtgccctagcgccgccgccgccgcgaatcccgccgcctcccgccgtccccgcgcgcaataaagagggggaaatcactccccgcgattccctctccctttccccccacttttccctctctctctccctcggattcattcggaaagtttccccctaacttcgccggcgcatcaatggcggccggatcttccgcggccgattccccctcatccggcctctctctccccctcccgaccctatataaacgctccccgtgcctccctccaccgtttccgccactcgccgctctctctccccgtcggaatcgagctcgcgccgtcgcccctctctctccgccgtcgccgccgagctccggtccgccgccgtcgtcgccccggaccttctcccgcttcggcgtcgccttcttcgggttcgccgcaacctcgccgacctcgtccacctctccgtttcggtcgccgaccgccggaacgccgccgtcctcgtctacccgagccgcgccgctgccttcctccgctccggtcgccgtttccgccgtcgccgtcgaaccggggtgagccgtggaccgcccatttagtttccccctcccctcccctctctcggccgccgctccgccgtgcctatggccgccgccggcgaccataggggcgcgggcgcgccgcctcccgtcggctgtgccggcgaggccgccttcgggcgcgccccgcggctgccatgtggggcccggccgtcagccgcccgagccctcgggtgcggctgacgcgtgggacccacggcgccggccggtgtgagccgcgtgcacccggtccaccgtggaccgagaggctgccgcgtgggccccactcccgtggacccggtccgcgcgctcctcccctcggctgacgcaataaatccgattttaaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatctgctcttcgtggaagttgaagccggcgtttgggaaagcgagcaaggcaagtcacatcatctttgaacatattgaatcccactttataaaattatgttgatttaaattattgcattatcgctttatttaaattcccgcgttatcactgttttatttagccatgcctatttacctttgttacgaccttattattattgttattgttattatttccttgttcaccctagaataaacaaaaccccaactagtggacactctactcatggtatcactagtatgatttttggtagatgcttcgcttttaattaggtaacattaggcggttttacaactctagactttgggaatgttcgtatcacctggacactatggaatggtttggttattgtgaaattggcttcacaccgctccttctattcaaaatccccaaaatggttttaggctgggctcggggtgcatggttttgatagtagcacctcggccatataaggaccggtcttcgggcctctgttgcaaagcactaccgtacttccacatgtctaatgggtaaggcttagtttgtggctcagtctagttataaacaaaagtacacggatggagatggaagaagtcgggggtcgatggacatctctaggacaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtctttcgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcttgggttggcttgggacgacctgggacccagggtcgggtgcccagttcggtatgaatcatcgtaggccttgggttaaggcaggttagagtgggttcacggccttgattaataagtgtatagttctagaatcgaatgtctcacaaatttgatggncccggtatgacatgaggtcaannnacccac

SEQ ID NO: 34298 - DNA, 651 bp, Oryza sativa
  unsure (1)..(651): unsure at all n locations
nnnnnnnnnnnnnnnnnnnnnnnnnnnnnnnnnnnnnnnnnnnnnnnnnnnnnnnnctcttgatgttgattctagtgatgaggaaagtgataatgaattagatgatgtgcttaagagctttagcaaacccgctatgcaacatttggctaagttaatgagagctttggatagtaaagaacaatcactcgaaaggcaagaagaattgtttattcttgagaagaaaagaaacattgccttagaggagagcctagctaaagaatgtgctaaaaatgaacaactagctaatgagcttaatttggctaatggttctctagctagccttagggatgtcaatgaaactcttcaagagaaatttgctaatttagacaaaagtcataaagatcttgaagttcaatttgacactctttggaatagctcttctcaaccaaatgtgttttctaattcttctaagccatctactagcaatggttgtgctaggtgttacaacattgatttgaactctaatgctactaatgttgatgctatgtaagctcttaagaaagagaatgagaggttgggcactttggtgaaatatggatgcatgaagacataccattcaaaggatgccatttacaagaccatcactgctcatcctaacaaggatggacacgg

SEQ ID NO: 34299 - DNA, 74134 bp, Oryza sativa
  unsure (1)..(74134): unsure at all n locations
ggagagttttttgttcctccagctgtttcagtgacacattagaatgctcaagcttgcatgctgaacaggctgacacactaagtggggcaaaccaccccgctgcctccatggggccttgctgctcgattcattaatccacatgctgccacaagggcgcctgctggaaagcgtgcaaaaaccgccacgcaagtgacgtgagctaaactacttattcagcaccgcaggctttacactgtatgctgaatcctctgcacaacctactgccttggcggtgtttgctgaaacaatcggggattaattaattggcctggagccgaaggtggtacagcaggtgcgggagccgatactggtgccgttggctgagccgatggtgcattaagagggattgactggacgaattgttgattatcggtgattaatggccgataattcgggaatactcctcctggtaggtaaattggtcctgtagcttgatactcggccattgaaccatcaaccattgaaccatcaaagcatggtgtacagcatagtcaacctgatcttgaaagttgttgaactgcaactgtgctgtattgccgtcttgattagggccttcaccttgaaccccctgagtaccatcaccatgaactctaaacgcgttgatgaagcctaggggggtgaacaggctgtccctgaaaacttaaaaacaaatcgcagcggtcaaattcaatcagacacggaacttcctggtaaggaactccagaacttccggcctcccaggcccggaacttccggtgttctaagacaggaacttccgggtaatagaagagagatgaaatttaaatttcaaaacaagagactaagccaatcttcacaagatggtgcacaggtattctaagccgaggatatatcacaaaatcatccacagaaacatcatagaaagagacaagagcgattttttcccaaagttcggatcttgtgatcctactctccgttgaggagctccaagagctgggtctcgattaaccccttgcctcacttgtgcagaaaccccagaggaaatccacagcctttaaccccaaacacccctaggcaaatttctagaattgagtgaccaccaagatccaactcaacctacttctagaaatccaccacaagtgtgggttgctctacttggaaaggctctagaatctcagcacaagaacttcactaacttacctcgttccctttcggaggagaggaaatccttcacaaacttacccgggacatccacaatatgcaatggattctcgcgggtgacacctaaccgtctaggagatcatctccaagagtaataagcaccaagatgacagcccacgagatattccaagtgctcacccaagatcctagtcttcacacctctccaaatcttcttctctccctctcaatctctctttcacacaagaattaggctctagattcagtgtaaagacaagaaacacttcggagaggctagcaatagctcttggttcgaaaagtgaaagtggaatggccaaggaacgagctggaaacgagctgcatatgtataacggctaggtgacgtcatctagccgttactcacaaatttgaactggaaacaagacaggaagttccggacctggaagactggaacttccggactacacttaggaaaatctttttcacaagaccggaacttccggacctggaagacaggaagttccggacttgcatttttgggcagatggagtatttgcaaaaaaaaaagaactcctagggaaacttgatacttggttcacactaagagcgcttgatatatctcagagcatcacctggaacccctcttaatagtacggtttttcctaaaaactcgatttcagaaaataaactatcctatgcacttctcgagttccggtcctctttgattttgtactttttggggggtctccaagcatccatcttccacatcttggactaatgcacctgaaagctactcaatgagctcattagtcccttaaccacatttgtcattaatcacgaaaacccactaggaggattaatgcactttcaatctccccctttttggtgattgatgacaacatggttaaaccttacaaaagattgataagaattttgttttgaatggtccacttcacaaaatcaagccccttcttggtgaatgaaactcccccttaatgtatgcatatggaagatatgagtggagctcatatgcatatatataagggagcaaccgaggagagtttccttcatccctactcattcgtgagatgcaaaaagcagtaagaatagatattatatgcaaaagatacgacacggtgagcactcaaaaagataaaatcaacatcacatcacaaacaacaaataagacactcatagcataaatgaagagcagtataaataaaggcagctaagagcatctaacagacattacattcacacaaatagagaattagaacatgtccatgagttcttaagaataggggccaaaggattgccaggtccggaacttcccgataaaataccaggaacttccggacaagctgacatgacaataaggcgagggagctgccaggtccggaacttccggataagaggatccggaacttccggattaaacagacagcaggcagtaagcatcaaaaacaaaattttgacccccttcgattgcaattttctcccctttggtatcaaagcaccaaaaagagacaaaatcataaggaaagaagaggatcaagcctcatcaatatcgccatcagaaggaatgatctcagtgtcgccggagtgaggagagtcgatgtcttgcccggcggcgtccactgcctcatcgggatctgtaggaacattctcggtaggggcatctgactcctcatcatcactgctctcctcggagtgacaggactcctcattgaagaaacgagaagtgccagagggaccctcaccactaccaatgtcttgagcagtctcataagcagcaaaaggatcaacaaactcctcatcatcagaaatgtcagagacatccttgcctactgcaatccaatcttccttttgacgcctctctatcttctttaccttcttagctgtcttggcacacatgcaaaagatagccttgagagccttctttatgggagaagaagactcagaacgctgaggtgcagcagagaaagaaggagcagctgaggtggaagcacttgtcactctggtggtaggagtagctgaagtagtgggagcatgtggacggaaaggcttgtattgattgtccttgaaataacaaatcccagtcttggcctcaatcatcttcatgatataaggagcatagatgcaacccctctttggctcacacactgtctcatagatctcactccagataagcttcatgatgctgaaatcgggcttgttgtagcgcatgcgactgaggaggagcgcatgcctacctggaagagctgtagcatctcccactttggggagcaaagaccacctgaagatagagtatagcactctataatatggatgcaaccctcgagtagtccccaaacaatccttgggagcatccttctcatacataaaggtagtgctggtcggtgacagagcatcctctacaaagatatgtggacgactcaggtcatcatcatctaaccccaaagctgcaacaaattgtgccatagaaaccctatactgctgcccctgaatggtccacttcacaaaatcaagccccttcttggtggtgccaaagaaagcagtggagtagaactgtccaatcacttcctcattccaggaatactgcaaggccaacaaatctgccgcgtgcttgtgctcacacaccttgcgtacctcattgaagactatgttgttctttgaggacatgtacttccagtctagccacttcatctctaccactggatgagatcttcccatgatcacagagttataccaatcaacctgcaccaaggtcctgaatctgtcatcctgagagtcagctggcagagtatcaggactaaccattctgtcctttccacacttgagtagattcttcagatagttcactcttgggcgtttaggatcaggatcaacagcccttgtcttgtacagcctcaaaggattgctttcagaacctggctcatcctcattgccaccatcatctgactcagatgcagttggggagggagagcggggtgcatcacgaatgacaatgctaccagccctcctggaatggatcggaatctgactcccactgtaaaatctctaactttttctttgcccaatctccccctaggaccacgaaccggggggctcgagtcagcaggaatatcttgagaaagcttttgtctcttctcacgaggcataatgactactgcaacaagaatcaacaaggttggagtgcaatggttaaaagaaacagtattagaatcaaggttactggctgactggacagagaccggaagttccgggccaaaaacaccccggccagcaaaacgtaagaacagaggatttaaccaggccagtgcatgtgacaaaaaaaacctatagatcggcaatccacaaggtagcaggaacaattctatccaaaaggttttctccctaggttcacatatttagagatcggtgcagaaacatgatgaaccaaaagagaagatcaaaagtgctaccttgagagggaaaatcgcaaatcgatcatgggatgaacctcctagccaccaatgtggttgattccacggagaggaatcaaatttccaatgttggaagagaaaatcgctgagaggagcactctagcggcggctagggtttgggaatcggggagaagaagaagtgaggagagagataccaggctcaggctccccctgggtatttataccccccgacccccggaagttccggactggggtgaccggaacttccagcctgacagaacagagggcagtcaggcccaagttcaatggaatagatgagaattcaatgatttggaaatgaaaacctatggacataaggagacttatgatgtatatgaccagccaacagtcaacattacataacaatggtcaatatacatcacaagaagggataaaaaccaaattttcgcaataaaaacacaaacaaaatttttcacataaggtttttttttggataatagagggaatgtttgagctttattcctggtatcaagaccttcttctccacaagaagtgatctcaagacacaaaacctcaatttttttttaatttacgttttagtgacacatgtttggctatgaattagccaaccacccatcacctaatgttacgagagtctaagatattgagctcactcctcagctcgcaaaatcttttctcatctaaaggcttggtgaaaatgtcggctaattgactttcggttgtcacatgggtaaggcatatgtctcctttagtctcatgatctctcaagaagtggtggcgaatgtctatgtgcttggttcttgagtgttggacgggattgttggctattttgatggcactctcattatcacataggagtgggatcttggtgaagttgtagccaaagtcttttagggtttgtctcatccaaaggagttgggcacaacaagaatcggcggcaacatattcggcttcggcagttgataaggcaatggaattttgcttcttagaggaccaagaaacaagggaccacccaaggaattgacaagtcccggttgtactttttctatcaaccttacacccggcataatccgaatcggaatagcccaaaagctcaaagccacaacccttaggataccacaagccaagattaggagtgtgaactaaatatcttagaattctcttgacggcaatcaaatggcactctttaggctccgcttgaaaacgggcacacatgcaaacactaagcatgatgtcgagacgagatgcacataagtaaagcaaagatcctatcatggagcgatataccttttggtctacacatttaccattatggtcgaggtctaggtgtccattagtaggcatgggcgtcttgataggtttggcatcctccatcccaaacttcttgagtatgtctttcacgtacttggtttgagagatgaaggtgccctcttgtgcttgcttcacttgtagcccaagaaagaaggtcaactcacccatcatagacatctcgaaccttttagtcatgatactactaaattcttcacaaaaagaggcattcgtagaaccaaatattatgtcatcgacataaatttggcaaatgaatgaatcactcttaaatttttttgtgaagatagttgtatccgccttcccaatttcaaaaccatttttcaaaagaaaatctcggagacattcataccaagctctaggggcttgtttgagcccatagagcgccttgtggagcttgtacacatggtttggcaactttggatcctcgaaccccggtggttgctccacatagactaactccgagataggtccattgagaaaggcactcttgacatccatttggaataacctgaaatcatgatgagcggcataggctaaaagaattctaattgactcaaggcgagcgacaggtgcgaaggtttcaccaaaatcgagaccctcgacttgggtgaatccttgcgcaactaaccgggctttgttccttacaaccaccccatgttcatcttgcttgttgcgaaagatccacttggtggcgataacattttgcttgggtctctccaccaaagtccatacttgattgcgagtgaagttattcaactcctcttgcatagccatcacccaatccggatcaccaagcacatcttccaccctggttggttccaaagaagagacaaacgagaagtgttgacaaaaacttgtgatacgagagcgagtagttaccccttttcttatgtcaccaagtatgttgtcaacaggatgttctctttggacagtgtgatgtatccttggatggtgcactggggggacctgagcctgatcagaatgctctaaagtgccctcagcatcgatcccatccacttgtgccgttggcatgtcttcactgccactgatccaaaggttccggactatagaacccggaacttccgggcctagagatgtccggaggttccggtcaataggacccggaatttccgactcagcagacacaacacttgtagggctgttggatgccggtgacggaggttgatccctatcttcttggtcatcctgcgtctcgactggtcgtatgtctccaatagccttagtaccaatagcttgatttggatccacaccccctacaacatgtacaacaacttgctctccttgggagccattagattcatcaaatgtcacatccctagtgacttcaacaataccagaggttttgttgaagacacaataggcatgtgcattagattcatagctaagtaagaatccctcatccaccttaggtgaaaacttagatgagcgaggcctcttacttaaaataaaacatttgctcccaaagacacgaaaatatgaaacattaggcttcttaccactcaagagctcatatgaggttttctttaggatcttgtggaggtacaagcggttgatggcatgacatgcggtactcacggcttccgcccaaaagacattcgaagtcttgtactcatcaagcattgcccttgtggcttcaatgagggttcggttcttcctctcaacaatgccgttttggggaggatcatagggggcagagaactcgtgcttgattccttcttcatcaagaaattcctccatttgagtgttcttgaattctcctccattgtcgctttgcaccctcttgatagtgagatcgtagaggttttgggcttgctttgcgaagcgcttgaagacatcttgatcttcgcttttgtcatggagaaagtacacccaagtgaagcgtgaaaaatcatcaacaatgacgaaaccatacttgttacctccaatgcttatgtaggccacgggcccaaataaatccatatgaagaagctcgagtggtcttgttgtagtcatgatgttttttataggatgtggactcccaacttgcttcccggcttggcaagcactacacacacaatctttctcaaaagaaacattatatagaccaagaatgtgttccccttttagaagagatgccaaattcctcattccaacatgggctagcctacggtgccatagccaacccatagaggatttagcaatcaagcatgcctccggattcactctattcacgtcgaaatcaacgagatagagatcaccctttaacacacccggaatgctatggaagagtcatctcgcctaaaaatggtcacatccacatcggtaaacaagcaattaaattctaacttacacaattgagacacggataataaattgtaccttaatgaattgacaaggaggacattagatagagattgattcttggaaatggcaatcttaccgagatccattacctttcctttaccatcatctccaaagacaatattttcacgacttccagccccctcatcaagacttgtaaacatactcctctctcccgtcatatgattggtgcagccactgtccacaacccaacttgagccaccggaggagtatgcctacaaaagagatcaagcttcgatttaggaacccaaacttgtctaagtttgggtcccttgatgttagtcaccaaagcctttggcacccacacacaagtgcggtactcatctttgtaattcccattaaaataagcaactactttgccctctgaatttttggaaattacatatgaatcatagtaaagaccctctggccggaacttcctggcattatacccggaacttccggtcagccccttcggcctattagaagcccggaacttcttgaaaaaacgtccggaacttcctatcttacagggcagaaacttccggtcattttgcccagaacttccgggtgtctgaccagtgaggggacaagtcacctcacttgcttgtggagcttttccttctcatacaaacatcaagcattctttcccatttaccatcacacgcttagacacaggacttccaccagaaaacccgagcccgtgtccatccatgttaagatgattgattgtcttgtaaagggcatcttttgaatggtatgtcttcatgcatccatatttcaccaatgtgcccaacctttcattctctttcttaagagcttgcatagcatcaacattagtagtatgagagttcaaatcaatattgtaacacctagcacaaccattgcttgtagatgggttggaagaattagaaaccacatttggttgagaagtgctattccaaagagtgtcaaattgaacttcaagatctttatgacttttgtctaaactagcaaacttctcttgaagagtttcattgacatcactaaggctagctagagaaccattagccaaattaagctcattagccagttgttcatttttagcacattctttagctaggctctcctctaaggcaaggtttcttttcttctcaagaataagtaattcttcttgcctttcgagcgattgttctttactatccaaagctctcattaacttagccaaatgttgcatagcgggttttctaaagctcttaagcacatcatctaattcattatcactttcctcatcactagaatcaacatcaagagaggtgtgagagcgcttttgagtcatcaccttgcggccttgggccatgaaacaagagtagtggtagaagtcgtcgtcgtcatcactcaagttgttgaagagacgcttcttgcttgaagaagatgacttgaaggcgacggtagcaacaccaccttctccttcaaccttgtctttcggcttgggcttgggcttgacctcgggatcttcttcatctccggagtaaaacacctccgccatgtgtgcctccgccacatgagcatgctctggcttcttcttgcctcccttagccttagcttcatttgacttgggacaattggctacgaagtggccatattcgccacaattgaagcaagccctctttgattgcctctttcccttgtcatcatccttcctccctttgccatagccactgttgcgaagaaagtgcttgaatctcttgacaataaaagccatctcttcatcttcactttcttcacaacttgactcttcttattgttttgccttcaaagcaacttcttgatttttgatcatgacggcattcttcactatttgcctcacttcacgagcttcctcttcttgcatctcatgagacacaattcttccaagaatgtcacttggggtgagtctcttgaagtctttcctttcccgtatcattgatacaagagtgggatttcttggaccaagtgcacggagaagtctcttgagcacaaaatgatttgtcatgtcctcactcccaagtcctttaatcttgttgacaagaatcatcgtcctatcatacttctcttgtggtgtctccttgtcatccatcacaaatcttccaagccttccttccaataagtcaatcttggcctcacgaacggcgggtgatccctcatgagccaattgcaaagtatcccatatctccttggcctcctcaagcccatcaaccttgttgaactcctccggactcaaggcggagagaattgcattggaagcttgagcattgcggtggatgagttgctcttgctccgaagtgagctccatgtcatcatggggtacatcaacacctttacaaacaactttccaaatacttagatacaaagagattagatgcaacttcatcttgtgcttccaagcggcgtaatgtgtcccatcaaattgaggagcacgcccggaaggcacggagacaaagttgtgagggggaatggtatgtttcctgtaaccaaaaggtatagtagctcccttgggtgatggagtttccttgctgctcgctccatcttcatttccattttctccgttctttccccctaagtctgacatcatggatcactcaaagcggtgaagcttgaatcaagagcaccttgctctgataccaattgaacgcgctgatgaagcctagagggggggtgaaaattcaatcagacccggaacttcctggtaaggaactccggaacttccggcctcccaggcccggaacttccggtgttctaagacaggaacttccaggtaaaagaacagagataaaatttaaatttcgaaacaagagactaagccaatcttcacaagatggtgcacaggtattctaagcagaggatagatcacagaatcatccacagaaacatcacagaaagagacaagagcgattttttcccgaagttcggatcttgtgatcctactctccgttgaggagctccaagagctgggtctcgattaaccccttgcctcacttgtgcaaaaaccccagaggaaatccacagccttcaaccccaaacacccctaggcaaatttctagaattgagtgaccaccaagatccaactcaacctacttctagaaatccaccacaagtgtgggttgctctacttggaaagcctctagaatctcagcacaagaacttcactaacttaccattttccctttcgaaggaaaggaaatccttcacaaacttactccggacatccacaatatgtaatggattctagtgggtgacacctaaccatctaggagatcatctccaagagtaataagcaccaagatgacagcccacgagatattcctagtgctcacccaagattctagtcttcacacctctccaaatcttcttctctccctctcaatctctttttcacgcaagaattaggctctagattcagtggaaagacaagaaacacttcggagaggctaccaatagctctaggtttgaaaagtgaaagtggaatggccaagcaacgagctggaaacgagctgtatatgtataacgactatgtgacgtcatctagccgttactcacaaatttgaactggaaacaagacagggagttcgggacctggaagaccggaacttccggactacacttaggaaaatctttttcacaagaccggaactttcggacctagaagacaggaagttccggacttgcatttttggacagatggagtatttgcaaaaaaaaaaagaactcctagggaaacttgacacttggttcacactaagagcatttgatatatctcagagcatcacctggaacccctcttaatagtatagttttacctaaaaagttgatttcagaagataaactatcctatacacttctcgagttccagtccgatttgattttgtactttttggggggtctccaagcatccatcttccacaccttggactaatgcacttgaaagctactcaatgagctcattagtcccttaaccacatttgtcattaatcaccaaaacccactaggaggattaatgcactttcaatgttaagaatcaagctcctgtagccaatgaagccacagcctatgaagcaagaaggttggctaaagggaaaagtgttgtaattgcttcggtcaacatggttttcacgttgcctgctgaatttgggatcaagcaagccaatgtcgatgaagtggaagcagaatcagctaaattaattttatcactgtagaaggcaattttcgagaagccagagggtacagaaaattggcatctcaagtcattatatataaatggctatgtcaatgggaagccgatgtccatgatgatggtcgatggtggggctacagtgaatttgatgccttacactacattcaggaagccgggtagaaacgccgaagatctcatcaagacaaacatggtgctcaaggactttggcggcaatccatcggaaaccaagggagttttgaatgtggagctgacagtcggcaacaaaaccatccctacaacgttctttgtcattgataggaagggttcttacagcttgttgcttagaagggattggattcatgctaattattgtatcccttcaactatgcatcagtgcttgattcagtggcaaggcgacaagattgaaattgtgccagccgacaagtcagtcaatgttgccggtgccgatttagctctttgggagatggatggtcttgattgtttatctggaaaagtttgggatggagattttctaaaagtgtccgattctgatatacagccagttgaagatggagaacccaagctattattttgagggtgtcgtggagggttcaaacgtctacaccaaggacacagtagatgatctcgatgacaaacaaggacagggtttcatgtcggctgatgatttggaagaatttgatataggtccaggtggtcgaccaaggctgacatttatcagtaagaatttgtcttcggaattcagaaccaagttaatagagctgttgaaagaattcagagattgcttcgcttgggagtattatgaaatgcctggtctcagccgatcgattgttgaacatcggctacctattaaaccaggggttaggccacaccagcaacctctgagaagatgtaaagccgatatgcttgaacctgtcaaggctgagattaaacgattatatgatgttggttttattcgtccttgccgatatgctgagtgggtttctagcatagtccctgttatcaagaagaacggtaaggtaagggtgtgcatcgatttccgaaacatgaataaagctaccccaaaggatgaatatccaatgccagtagccgatcaactggttgatgctgcatcaggacacaagattttgagttttatggatggtaatgcacgatataatcagatctttttggccgaagaagatatccataagacagcttttaggtgtcctggtgcaatcggcttatttgagtgggttgtgatgactttcggcttgaagagtgctggagctacatatcaaagagccatgaattacatatatcatgatctaatcggctggttggttgaggtctacattgatgatgtggttgttaagtctaaagagatagaagaccacatagccgatttgaggaaggtttttgagagaaccaggaaatatggcttgaagatgaacccgacaaaatgtgcttttggcatatcggctagctagtttttgggatttcttgttcatgagagggggattgaggtgactcaaaggagtgttaatgcaatcaagaagattcaacctccggagaacaagacagaactgcaagagatgatcggcaagatcaattttgttagaaggtttatttctaatttatccggaaggttagagccttttacaccattgttgagattgaaagctgatcaacagtttacttggggggcagagcaacagaaagctttggatagtatcaaggaatatcttagctctcctctagttttgattcctccacagaaggggataccttttcggttatatctgtcggccgatgataagtcaatcggctcggttttgatttaggagcttgaagggaaagagagagttgtgttttatctaagtcgtcggctcttggatgcagaaactagatattcccctgtggagaagttatgcttgtgcttatatttttcatgtacaaggttaaggcattatctattgtccagtgaatgcaatgtcatatgcaaagccgatgtggttaaatacatgttgtcggctccgattttgaaaggaagggttggaaagtggatattttccttaactgagtttgatcttcggtatgagtcgccgaaggcgattaaaggacaagctatagccgattttattgtagaacatcgtgatgattcaatcggctcggtcgagattatgccatggactttattctttgatggatcggtgtgtactgatggttgtggtatcggcttagttataatttcccctagggggcatgttttgagtttgcttatactatcaaaccttatgcaaccaataatcaagctgagtatgagacagtgctcaaagggttgcaattactcaaggaagttgaagccgatgctattgaaataatgggagattctctgctagtaatcagtcaattggcaggggaatatgagtgcaaaaatgatacattaatggtttataatgagaagtgccaagaactaatgaaagcatttcggctggttactttaaagcatgtatgacgtgagcaaaatattgaagctaatgatttggcccaaggggcatcgggatataagccgatgatcaaagatattaaggtcgaaattgtagcaataacagccgatgattggagatattatgtgcatcagtatttacagaatccatctcaatcagcttcttggaaattaagatataaagtgttgaagtatactttactggatgatgaactttattatcggacaattgatggagtgttgcttaagtgtttgagtgccgatcaggctaaagttgcaatcggcgaagctcatgaagggatttgtggtactcattaatcggctcataaaatgaagtggttgcttcggtgtgcaggtatttttggccgacaatgctggaagattgtttcaggtattacaaaggatgtcaagattgtcagaaatttggagcaattcagcaagcgccggcgtcggctataaatcctatcattaaaccatggccattcagaggttggggaattgatatgatcggcatgattaatcctccatcgagtaaaggacataagtttatattggtggcgaccgattatttcaccaaatcggtagaggcggttcctttgaagaaggttgattttggggatgcgatacagtttgttcaagagcatataatctaccgatttggtattcctcaaaccattacaactgatcagggttcaattttcgtgtccgatgagtttgttcaatttgccaatagtatgggaatcaaactgttaaattcttcaccatattatgcacaagctaatgggcaagctgaggcatctaacaaaagcttgatcaagttaattaagaggaagatttctgattatcctcggcagtggcatactcggctggccgaagcgttgtggtcttatcgaatggcttgtcatggatcaatccaggtccctcctcataaacttgtttatggccatgaggctgttctgccatgggaagtgagaatcggctccaggagaacggaattacaaaatgatttaacaaatgatgagtattataaccttatggccgatgagagggaagatttggttcaatcatggttacgagcccttgcaaaggttactagggataaggagcgaattgctcgacactataacaagaaagtggtgcccaaggatttttcggaaggtgaacttgtatggttgttgatttggccgattgtggagattatgggtaccccatacccacacggcatggttatccgactagtcataggggatagcttatatatatggaatatgtaaccgatcatgacttgggtattacgtttccttttatattatggagcggcttaaagtcttgatttgataatattgtaaaatagatttaggaaaccaataccgtattggtgaaggtttctatcttgtaatcctgccccccatcctatataaggtgggcaggaggccctctagggggcatgacacaaactgatcatcagatcaatatacacccggcggattcaaatcaccaaacaggagtagggtattacctctcatcgagagggcctgaacctgtctaaatcctttgtctccgcatctatccacttttaggtatcgtgcgctacccccttttcatattgccgaaaatttgtttcgacagttggcacgccaggtaggggtgcgtcgagtttctatcaacaagtgcgatggaataatttttagaggtcgccggtatcgtcttggcttctgtagcatgagatccacttccgtcgacatcgccttcatcttcggactggttcttctcttctggagtctgcctttcattgccattgccaaaatttccaactggaccaaaccagtcaaccgggcgtcactcatccccgatcaattcaatctataaccagaagcagctgtttccatcaaatcgactttactcgtgagatcaaattggatgtcttcatgtccgtcgaaatcatcgaagaaagtaactcgccgagattgatcacgaattggcgtcaacggctgcgctgatcttttcaagaaaaaacactagttacagcacctcatcaattaattttcctcgagattgagtcttttgcacttgaagtccgaagcggagtctactaacaacagatcgatctggagccatacatagcagagtaaaatctacttcaacggcagcagggcacatcaagcgatcaggaaagaattatctagccactgctcttgatggtgcattacttatttaattggcctatagctgtgctgtacgtgcgcccaatcatgagggctgtcaactagttgacaatcttcattcatctatctacaatgcaagcatgcagcaagcgacatagtcttgcatcaagacaacaaccaaggtctcgatccggctattccgagttgattcatctctgttacaaaaattccggccgccacgacttggatcatcaacaattatcagtcgattgctttcgctgccgccgactggtgtcctcgcctatacggttggttggtcacaccactgtttatgggcgaccacgtcttcaccgatcggcttgccttcgccgccgccgactggtgtctccgcctacacggctggtgtcacgaccggaaataacccaacgggcgttccttacgtgcgtgtattattccttgtcccaggaggcaaggtacaccaaaagttgatacaattcagagtttaacaagcggaagcgtaaataattaatttattacatgggcggcgaaggcccagcacacacaaagacaaacgggaaacagcggaagactagggcgacgaccacaggcgctagacggcaggcacgagctagacaccaaagccttcatcttccaggaactcctctcctgggtttgggaaaaattgagcaagactgagtacaaccaccgtactcaacaagacacacccacaagtgcagaataaatgtaagggagtacaagggggttatcatataaggggttagggtttgcagtaaacagcattaaaagacacttagttgctcaaagctattttgtaaatacgatcctagcgctatacaagattattagtcaaggccgtgaacccacacgaacctgccttaacccaaggcctacgatgattcggaccgaactggcaacccgaccctgggtcccagctcgtcccaagccaacccaggccaaccattccacattttagttgttaagcaggttttaagaatcaaaacactaacttgggtacattgctcggcttgcccataatcgagggcgcggctattcgaataggttatactctgatcagaggtgtacatctttacccacaagacacatcttcctcacgtgtaaccacgtgccacataccaccacggtatacggacggaagacgtgacatagtttctaacccatcctagccatagacaagagtaccgacccaaccccacctacggccggaacctccgggacaggtaggcaggactgagcccctagcagcaggacaccggccttgtgccatgacatctcgactaccgggccgtagctcgtgtagccttcatttgccctagagatgtccatcgacccccgactttgtccatctccatccgtgtacttttgtttataaccagactgagccacaaactaagccttacccactagacatgtggaagtacggtagtgctttgcaacagaggcccgaagaccggtccttatatggccgaggtgctaccatcaaaaccatgcacctcgagcccagcctaaaaccattttgaggattttgaatagagggggaggtgtgaatccaattccacaataatccaaccattccatagtgtccaaatgatatgaatattcccaaagtctagagttataaaaccacctaatgttgcctaattaatcagcgaaccatctacctaaattcatactagtggaaccatgaataaagtgtccactagttggggttttgtttattctagggtgaacaaggtaataataacaataacaataataaggtcataacaaaggtaaataggtatggctagataaaacagtgataacgcgggaatttaaataaagtgataatgcaataatttaaatcaaaataattttgtaaactgggattcaatatgttcaaggatgatgtgacttgccttgctcgctttcccaaacgtcggcttcaacctccacgaagagcggatcttccgaagctgcagcgtctacacgaccaacggaaaagaaaaaggcttttactctaataaactgcatataacaagcaggaacaaagcacaaaaatgggtttttgacttcttaaggaaaaattagagacttgaacggtccaattctgagttcaaatggccaagttatggccatttgaagtttatatgctctttaaatgaatatttgcgaatttcttcatttaaattttaatttaaaaagggtttattgcgtcagccaaggggggaggggcgcgcggaccgggtccacgggagtggggcccacgcggcagcctcacggtccatggtggaccgggtgcacacgggctcacaccggccggcaccgtgggccccacgcgtcagccgcacccgagggcgcgggcggctgacggccaggccccacgcggcagccactcggcacgcccgagggcggccatgccgacgcagtcggcaggaggcagcgtgcccacgccccgatggtcgccgccggcgaccaccggcgcggcggagcggcggccgagagagggaagggaagggagaaaggaggcgacggtccacggctcaccccggggcgacggcagcgacgggggaggcggtggcgcggctcgggtcgacggggacgacggcgctccggcggtcggcgaccgaaacggagaggtggacgaggtcggcgaggatgcggcgaagccgaaggaggcggcgccgaggtggaaggcggtccgaggcgacgacggcggcggaccggagctcggcggcgatggtggagagagagagcgacgtcgtgagctcgaatccggcgaggaggaagggcggcgagaggcggaaacggacggaggaggtgcggggagggtttaaatagggttggaagggggagagggcggccggaggggaatgaaaccggcgcggcattctcgggctccatcaatggcaccggcgggattaggggagggtttccaaacgaatccaagggagagagggagggaaaaatggggggaaagggagaggggatcacggggagtatttccccccactttattgcacgcggggacggcgggatgcggcggatttggcggcggcggcggcgcttggcgcgggcggagcagcgggagcggcgggaggtcggggatgacgggtggtcccgacccgtcagcgagggtggcgggcgggcccgcccgtcagcggcgcgcgcgtggggaggggccgaatggcccacgggggagaagagagagagagagagagggggaagagcgagatgggccgagccggcccaagggagggaagggggactttttagggtttttctttttataaaaccttttcaactttgtttatttcttaataattattatttgtactctgaaaattccactaaaatttatttacacattttaggcttttaggaaatatacaaaaatcctctaaggcttatttgacttttactttgcacattttaatttttggaggctttcacatggattttaattattctaggcataatttaaaggatatattttagggtcgttttgggacgtgacagctggcctattatgccgccgttgttgggcgtcttcgctttcaccatcgaccgccttcgttgccgccaactggtttcttcattgttatttatggacgactttgttcccacattggccacctctgccatcaccaaggggaataatgcaaagctaagtcatcatttatttcattctttatatgatattttccttttcctctgcgtcactatgtcaactggttcgccgttgactagtgagtcaggggctagagatgttatatcatattttttaaacattttttataatatttatcttgattgcttgcgacatattctgagtacaaaagtgtctatcgagttatggagttccatcttcctatgctttctgtttgttttgccaatggatagttgcctttgggccgattcctagcacccgggggcttgttggatggaccgaataacgcaaggtgctaagtatgattcgaaataaattaaaagcatagagataagttaatttattttctgctcttaataattgcaaaagtacccgagtagtaaactctgacccgtgaaactttgttccattaatgacaaactcatgtcactcatatgcatgtttgggaagtgcttaggccgactcctggtgcttggtggctatgactagtcagacagagtgtttaaacgtaatgagtcatctgctcggggaaaatcaaaattgacaagagaagaaatacatatttataaatattttaaaatacttgaatttttctcgagtattatatttatatcagatactactcatcctatatgtttgttctacaggatgcaaatccagatatgcataaacgagattcatggctttaagcttatctcttacgctccaggaatggatcagtcagaacatcaccgccggtttgctttcgccgccaccgactggtgttaccgcctgcacagctggcctattatgccactgttgttgagcgtctacgtcttcaccgaccggtcgcctcgtccgccgccgactggtgtttccgcctgcatggctggcctattatgccgccgttgttgggcgtctacatcctcaccgaccggctgcctcgtccgccgccgactagttaatgaagacattcctagcattcactcatctccaaatgaagctacacttgatatagctggtccaattacaaggagtagagctaaacaattggagaaggaaattcattctcaggtgaacgctaaccttatgcttaataatcagattacattgaatgaacctatgcttttgagtacttgtttcaatgttcttaggaatgatggagtgcacgaacaagcatgggatgatgatggattctgcccgccaaatatatgcaaggaacctggacgtgcatgagagaggaaagaccattcagctaccatgaatatcagccattgaagtgcaagcaaataattcgggagttaggaatgcatgcaaccagcaactgggttgctgtccacacacgctccagcatgcatgcagagaataccaaccagccaggcgtcctactaggcttggtttttaataaaagtagtgctgcaacttcccactacatgttctcaattattttccaccaagctgaaactccactagtgctatatatccctgtaatggatgacgtgaacagtaactcgtgattgcaatttcagaataccaactcttggaattcttgttccagcgtgagtcttgagaggcttgcaaacttgttcttttgattcctgagggagttgtcgaacgccgaactgtggttcacccagtttgtgccttcacgtctatacggcgtgattgcgtgggctgttcgtcggtacgtggaagggtgattgtctcggtagttcgtcgcgtggacagcctcgcggtgcattgcctcttcaccaggtcacgcaacgacaatttatcaagttcgcagatcctacgagaagatcgggccacaacaacttgctacacgtgctgcatagacatgtgcatatcatctggtatcagagccaccgtttcctcagtaggattgttcttgtttttggtaggatagagtttaaatacctactgtccactgatagccaaaaagaaaacctacagcccaaattcatacgtgctactgattttgtagtttgctttatcgagttttaatcctttaagatttgtctagttgctgaattttcttttccacatcgttctagttgttatctttgttctaatcatcaaatcgcttgctgcacgtacccaaccatcccacccttgatctgatcgtccttgcttgctgcatatatataaacagaaaaaaaaaatatatacccacccatcccacccttgttttcttcccgccacatattccccaaccgagtttcttgtttttgtgctgcgccatccatcttagtgatccttatgagcccctttagttgaaagttgtgctgtgtttgtcacaaaggttaaaagaaaagatgtctatgggtcaaaagaaggactgaaaacaacgagttcttgaaaaaaacaagaaaaaaaaaaggaaagaaaagaaataaaagagaattgtgttcagcacaccaaaaggggtttgggcagcaacaagttacggttggtgcaaattggtgttcatctatccacttcctgcatcttgttcctttctttgtacatcttttcctttatattcagcaacttagacttgtgttcttggattattattcggttttgcatccctacatttcagtgcattccacttacatattaccccaccaagctccacttaaaagcaccgtgagttgttgcaccgtcgtcgctgttacaatcacttttccactacagattgcagccacggttcttgctcttttcagggagagaaagaacttgttttgtaagtggtgagggagtgattccacatatattccacatctatattgtcctatttttttcccctctactaatattgcaggacgtggagatggtgccgctgtttcggtggatgaatttcaggagttgcgtacacaaatgaatgatttggtgcagcagctccaaactctccaattgaacatgccacatagagaaccgccaccaaatgaggatgatgacattgaggaggaggatgaggtagggcgtcgtcccgctggccgtggacgtggcgggcgcggtcgtggttttgctaattttggtcgtgctcggcgcgttcctattggaggtggaggagattatgatggtgatgatcatatgttgtccgacatggatgatcatcgacatggtggccatcatggttatcgtgaccgccatcgtcgtcataatgatgatggtttaagacacgtgaaagtgtctattccccctttcagcggacaggagaatgctgatgcttattttgaatgagagaccaaggtggaacaaatatttgatttgtatgaatactctgctgaaaagaaggcaaagcttgcagccattgagtttaaaggctatgccataacttggtggaatcaggtccgtactgaatatcagagagttgggcatgttcgtataacttgggaagacatgaagagagaaatgcgacgtcgtttttttcctgcatattactctcgtgatctacatttgaagctgaaacgtcttgtgcaaggtactcgtactgttgatgaatattttcaagaattggaaatgtgtttacttcgtacagggataactgaagatgaggaatccacaatggctcggtttctggttggcctcaataaacccattgctgataaagtggatatgacaaactacacatgtctcactgagttggttcattttgcaaagagggctgaaaggcaaattgctacgtcttacaaatacaatgcttcatggcgtcattcccaacagcaaggggatgtcatgcctcaattccaacagcaagtagctgcaacgcccaaatcctcatctcgtggagcaaatagatctcttccaacttcttccaaacaactggatgtgaaaggtaaagctgtgagttcaagtcagcccacttcttctactgcagccacccaacgcaagacaagcaagattgagtgttttaagtgtggtggtcatgggcataagcaagctgaatgtcccaatcgtcgtactattattgcacttgctgatggttcttatgattcacaaagtgaagaggaggacgagtttaacaatgtatttgcagatcttaatcttgacacttgtgagtattcagcagaggatggtacatttgagctaggtctaaattgtttagccattcaacctattccaacttttgctcacaatgacatattacaagatgttgtttctccatctttcagcgagattactagtgatgattttgatgagttgcttgctgattttcctgatttgacgccttctataatgaacacaccatctacttctttggtggtgaggcgagttctttccactcaatttgttgctgctgaacaaggccaacgccataatttgtttcaatccagatgcaaagtgaaaggacaagtgtgccgtttcatcatagatggtgggagctgcaataatattgttagtgctttgcttgttgagaagcttggtttgcagccacgtcgccatccacatccataccatatgcaatggttgaataattctgggacagttaaggtttcagccatgattcgtttgtcattttccattggtgattatcatggagaggtggattgtgatattgtccccatgcaagcatgccatttgctgcttggtcggccctggcaatttgatgtggactcggtgcattttggacggtctaacaaacacactttcattcacaatgacaagaaggtggttcttgttccattatctccagaggagatacatgcttcagatatggctcgcaagaaacgagaggaatctgacaaaagaaaattgagtgagatccccaacacaagtaagggagagagttctaacccatccagccacatacagcctcatgccaatcctaaacagccacgccacactaagtgtctctttgtgagcaagagtgatatgtgtcgcgtcccaaaacgactctaaaatacatcctcaaaattatgcatagaataagtaaaatccatgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaaaggttttataaaaagaaaaaccctaaaaagtccctttttcccccccccccttcccctcttgggccggctcggcccacctccctccctttctctcctctcccccgcggcccaatcggcctcctccccgcgcgcgtgccgctgacgggcgggcccgcccgccaccctcgctgacgggtggggcccacccgtcatcccctacctcccgccgctcccgccgcctagcccgtgccctagcgccgccgccgccgcgaattccgccgcctcccgccgtccccgcgcgcaataaagagggggaaagcactccccgtgattccctctccctttccccccacttttccctctctctctccctcggattcgttcggaaagtttccccctaacttcgccggcgcatcaatggcggccggatcttccgcaggcgattccccctcatccggcctctctctccccctcccgaccctatataaacgctccccgtgcctccctccaccatttccgccactcgccgctctctctccccgtcggaatcgagctcgcgccgtcgcccctctctctccgccgtcgccgccgagctccggtccgccgccgtcgtcgccccggaccttctcccgcttcggcgtcgccttcttcgggttcgccgcaacctcgccgacctcgtccacctctccgtttcggtcgccgaccgccggaacgccgccgtcctcgtctacccgagccgcgccgccgccttcctccgctccggtcgccgtttccgccgtcgccgtcgaaccggggtgagccgtggaccgcccatttcgtttccctctcccctcccctctctcggccgccgctccgccgtgcctatggccgccgccggcgaccataggggcgcgggcgcgccgcctcccgtcggctgtgccggcgaggccgccttcgggcgcgccccgcggctgccatgtggggcccggccgtcagccgcccgagccctcgggtgcggctgacgcgtgggacccacggcgccggccggtgtgagccgcgtgcacccggtccaccgtggaccgagaggctgctgcgtgggccccactcccgtggacccggtccgcgcgctcctcccctcggctgacgcaataaatccgattttaaattaaaatttaaatgaagaaattcgcaaatatccatttaaagagcatataaacttcaaatggccataacttggccatttaaactcggaattggaccgttcaagtctctaatttttccttaagaagtcaagaacccatttttgtgctttgtttctgcttgttatatggagtttgttagagtaaaagccttttcttttccgttggtcgtgtagacgctgcagcttcggaagatccgctcttcgtggaagttgaagccggcgtttgggaaagcgagcaaggcaagtcacatgatctttgaacatattgaatcccagtttataaaattatgttgatttaaattattgcattatcgctttatttaaattcccgcgttatcactgttttatttagccatgcctatttacctttgttacgaccttattattattgttattgttattatttccttgttcacactagaataaacaaaaccccaactagtggacactctactcatggtatcactagtatgattttaggtagatgcttcgcttttaattaggtaacattaggcggttttacaactctagactttgggaatgttcgtatcacctggacactatggaatggtttggttattgtgaaattggcttcacaccgctccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtgactcagtctagttataaacaaaagtacacggatggagatggaagaagtcgggggtcgatggacatctctaggacaaatgaaggctatacgagctgcggcccggtagtcgagatgtcatggcacagggccggtgtcctgctgctaggggttcagtcctgcctgcctgtcccgggggttccggccgtaggtgggattgggtcggtactcttgtctatggctaggatgggttggaaactatgtcacgtctttcgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataattgtatagttctagaatcgtgtttacaaaacagctttgagcaactaatgtctttaaatgctgtttactgcaaccctaaccctttatagtataactcctttgtactcccttgcattcgagacccctcgtgctgagcccgcgcccgtggttccccaggagggggaagcctccggcgttggtagcacggaggatgcgctgttgctcaccttccgtcctggcccgtcgtagcggtagacgagcagttagtaggcttgcgcgtgtgttctttctcgtttgtcttcttgttggagttgtgtggggcatggttatgccggtgtgtggcataactgtgtcggagcctgtctttattttatttgcctaagcaacttgaactttaatgaaccaatttaatagcagtaataaattcaagaattatggtagtcgtgggtggttagctttaattgtcagctctctctgtttgctggttctgtgtggggttttcagatgttgacgaccaggagaagtgctgctaccggtgatggcaaccaacccgaaggcagcaaccaccaccaccagggcaggccaccttcacctcctcctacgcctccaccaccaccaccagacaccaacgccattctcacccaaatcctcgcccagcaggccaacatgatgactgctttcctccaccacctccaaaattcgccacaacataatgctccaccaccacctccccaacactctaaactcgccgagttcctccgcatccgcccacctaccttctctagctccaacaaccccgtggatgcgttggattggttgcatgccgtggggaaaaagctagacactgtgcagtgcagcgatgaggagaaagtcatcttcgccgcccaccagctgtaggggcccgcatctttatggtgggaccatttccaggctacgcagccagaggggcaacctattacttgggctcgcttcaccgccgctttccggagaacccatgtgcccgccggagtcatggcccttaagaaaagggaattccgagagttgaagcaaggcaaccgctccgtgatggagtatttgcatgagttcaacaacctggcccgttacgccccggaggatgtgcgggaagatgaggagaagcaagagaagttcttggcaggaatggaccctgagctgtccgtccgtctagtctccggggactatccggatttccaacgtctggtggacaagagcatccgcttggaagccaagcacaaggaactggagtcgcacaagcgccgcttggcgaatttccgcaatcaacagggtgctaaccaaagggtccgctacaccaatccctatccagggggatcctcctcgcagcagcaacaacagcagcagcaacctcgctccgcgcctcgacctcaattcgtggtgcgcgtcccacagccgcagcagcagcagaatcaacaagggactcgtgcgccccgtcctcctacgccaactgtgcagcctggtcaaggccgcagggacgctcaaggtccgcagcgtctgtgcttcaactgcttcgagcccgggcactttgcggataaatgcccaaagccgaggcgtcagcaaggccaagcgcctccccgctccaacaacggtgggaaggatgtcattcggggtcgggtgaaccacgtgacggccgaggacgtgctgacaactccagacgtcatcgttggtacgttcctcattcattccatccctgctaccattctgttcgactctggagcttcccactcgtttatatctgtgccattcgtggggagaaatcagttgggggtagaaaggcttaggaaccctctgctcatcaccacccctggaggggttatgacagcaaagtattatagccctgccgtccccatagaaattcaggggattccttttccctcggatctgattctgctagacaccaagaacttggatgtgatccttgggatgaattggttggctcaattccaaggagtagtggattgtgcgagacgcactgtcactctgtaccgagggccggaacaaccggttgttttctttgcacccccaacctctgtcagtagttccgaacttcatcagataggactgtcagaaatccccattgtcagagagttcggagacgtgtttccggaagaactacccggtatgccgcccaaacgacagattgagttccggatagatcttgctccaggaaccacacctctgtacaagcgaccctaccgtatggcagcaaatgaactggctgaagttaagaaacagttggaagagttgaaagaaaaggggtatatacgtccgagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcgatcagcttaaaggtgccactgtattctccaagatcgatcttcgttccggatatcaccaattacgtattcgtgatgaagatattccgaagaccgcattcaccacgcgatacggactgtatgaattcacggtgatgtcgttcggtttaaccaatgcacctgcctttttcatgaacttaatgaacaaagtgttcatggaatacttggataagtttgttgtggttttcattgatgacattctggtatactcacaatcagaggaagaccatcagcaccatctccgtctggtattgggaaagttgcgggaacatcaattgtatgccaaacttagcaagtgtgagttctggttgtccgaagtcaaattcttagggcacgtgatatctgctaaaggagttgctgtggaccccgaaacagtgaccgccgtcattgattggaaacaacccaagatagtcactcaagtccgcagtttcttaggtttggcaggatactaccggaggttcatcgagaacttctccaaaatcgctcgacccatgacacagttgttgaagaaagaagagaaatttgtgtggagcccgcaatgcgagaaggcgttcaaaactctcaaagaatggctggtttcctcgccagtgttaatcttgccggatactcgcaaggacttcatggtgtattgtgacgcttcgcgccaaggattggggtgcgtgctcatgcaggatggtcatgtggtggcctatgcctcacgccagctacggcctcatgaaggcaactaccctacccatgatttggagttagctgcggtggttcatgctctaaaaatctggcggcactatctcattgggaatcgctgtgaaatatatactgatcataagagtttgaaatacatcttcactcagtcggacctgaatcttcggcaaaggagatggttagaactcatcaaggattacgatgtgggaattcactatcatcctggtaaggccaacgtggtcgctgacgccctaagtcgaaagagccattgcaacactcttaacgtccgcggcattccacccgaacttaatcaacagatggaagccctgaacctaagcatagttggtcgcggattcttggctgcgttggaagccaagcctaccttgctcgatcgaatccgcgaggctcagaagaacgatccggacatgcatggactcctcaagaatatgaaacagggtaaagccgctggtttcacagaggatgaacacggaaccctatggaacggaaatcgagtatgcgttccagataacagagaacttaaacagctgatacttcaggaagcccacgaaagtccttattccatccaccctggcagtacgaagatgtacttagacttgaaggagaaatactggtgggttagtatgaagcgggaaattgcagagttcgtggccctttgtgatgtgtgccagcgtgtcaaggcagagcaccaacgaccggccggacttctccaacctctccaagtacctgaatggaaatgggatgaaattgggatggattttatcaccggacttccaaagacccaaggtggatatgattctatatgggtagtggtggatcgattaaccaaggtagctcgattcattcctgtgaagaccacctatggagggaacaaactagccgagctctacttcgcaaggatcgtgagtctccatggcgttcccaagaaaatcgtatctgataggggaagccaattcacctctcacttttggaagaagctccaagaagagctgggtacccgattaaacttcagcaccgcataccacccgcagacagatgggcagaccgagcgtctaaatcagatcctagaagatatgcttcgcgcatgtgtcctggatttcgggaagacctgggataagagtctcccctatgccgagttctcctacaataacagctatcaagccagcatacaaatggcaccttatgaagcgttgtatgggcgcaaatgccggacaccgctcttgtgggatcaagttggggaaagccaagtattcgggactgatatcctgagagaagctgaagctaaagtcagaaccattcgggataatctaaaggtggcacagtcccggcagaaaagttatgcagataaccgtcgccgtaacctggaattcgcagtggacgattttgtgtaccttcgggtcacgccattgcggggtgtacacaggtttcagacaaaagggaagctcgcacctcggtatgtgggtcctttccgtatcgttgcccgacgcggagaagtcgcttaccaattggacctgcccgcctccttgggcaacgtgcatgatgtgttccatgtgtcgcaactcaagaaatgccttcgagtgccatctgcgcaggccgactcagagcaaattgaagttcgcgaagacttgacctacgtggagaggccagtgaaaatcctggacaccatggagcgcaggaccaggaaccgggtaatccgtttttgcaaggtccagtggagcaaccacgccgaagaagaagctacctgggagcgtgaagacgagctgaaggcagcccatcctgatctcttcgccagttcttccgaatctcggggtcgagattccgtttaaggggggtaggtttgtcgcgtcccaaaacgactctaaaatacatcctcaaaattatgcatagaataagtaaaatccatgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaaaggttttataaaaagaaaaaccctaaaaagtccctttttcccccccccccttcccctcttgggccagctcggcccacctccctccctctttctcctctcccccgcggcccaatcggcctcctccccgcgcgcgtgccgctgacgggcgggcccgcccgccaccctcgctgacgggtggggcccacccgtcatcccctaccttccgccgttcccgccgcctcgcccgtgccctagcgccgacgtcgccgcgaatcccgccgtcttccgccgtccccgcgcgcaataaagagggggaaatcactccccgcgattccctctccctttccccccacttttccctctctctctccctcggattcattcggaaagtttccccctaacttcgccggcgcatcaatggcggccggatcttccgcggccgattccccctcatccggcctctctctccccctcccgaccctatataaacgctccccgtgcctccctccaccgtttccgccactcgccgctctctctccccgtcggaatcgagctcgcgccgtcgcccctctctctccgccgtcgccgccgagctccggtccgccgccgtcgtcgccccggaccttttcccgcttcggcgtcgccttcttcgggttcgccgcaacctcgccgacctcgtccacctctccatttcggtcgccgaccgccggaacgccgccgtcctcatctacccgagccgcgccgccgcctttctccgctccggtcgccgtttccgccgtcgccgtcgaaccggggtgagccgtggaccgcccatttcgtttccccctcccctcccctctctcggccgccgctccgccgtgcctatggccgccgccggcgaccataggggcgcgggcgcgccgcctcccgtcggctgtgccagcgaggccgccttcgggcgcgccccgcggctgccatgtggggcctggccgtcagccgcccgagccctcgggtgcggctgacgcgtgggacccacggcgccggccggtgtgagccgcgtgaacccggtccaccgtggaccgagaggctgccgcgtgggccccactcccgtggacccggtccgcgcgctcctcccctcggctgacgcaataaatccgattttaaattaaaatttaaatgaagaaattcgcaaatatccatttaaagagcacataaacttcaaatggccataacttggccatttgaactcggaattggaccgttcaagtctctaatttttccttaagaagtcaagaacccatttttgtgctttgtttctgcttgttatatggagtttattagagtaaaagccttttattttccattggtcgtgtagacgctgcagcttcggaagatccgctcttcgtggaagttgaagccggcgtttgggaaagcgagcaaggcaagtcacatcatctttgaacatattgaatcccagtttataaaattatgttgatttaaattattgcattatcgctttatttaaattcccgcgttatcactgttttatttagccatgcctatttacctttgttacgaccttattattgttgttattgttattatttccttgttcaccctagaataaacaaaaccccaactagtggacactctactcatggtatcactagtatgattttaggtagatgcttcgcttttaattaggtaacattaggcggttttacaactctagactttgggaatgttcgtatcacctggacactatggaatggtttggttattgtgaaattggcttcacaccgctccttctattcaaaatccccaaaatggttttaggctgggctcgaggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggagatggaagaagtcgggggtcgatggacatctctaggacaaatgaaggctacacgagctgcggcccggtagtcgagatgtcatggcacagggccggtgtcctgctgctaggggttcagtcctgcctgcctgtcccgggggttccggccgtaggtgggattgggtcggtactcttgtctatggctaggatgggttggaaactatgtcacgtctttcgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggcctttggttaaggcaggttcgtgtgggttcacggccttgattaataattgtatagttctagaatcgtgtttacaaaatagctttgagcaactaatgtctttaaatgctgtttactgcaaccctaaccctttatagtataactcctttgtactcccttgcatttattctgcacttgtgggtgtgtcttgttgagtacggtggttgtactcagtcttgctcaatttttcccaaacccagaagaggagttcctggaggatgaaggctttggtgtctagctcgtgcctgccgtcaagtgcttatggtcgtcgccctagtcttccgctgtttctcgtttgtcttcgtgtgtgctgggccttcgctgcccatgtaataaattaactatttacgcttccgcttgttaaactctgaattgtatcaacttttggtgtaccttgcctcctgggacaaggattaatgcacgcacgtaaggaacgcccgttgggttatttccggtcgtgacaatatgagagaagtgagaaacaccacagccccattctttgtgctcttgcacaaggaggtcctactttcaactaacgatttaccttcatcgctgcctagtgttgttcttgatctcttacaggacttcgaagatgtttttcccgatgagataccagctggacttcctccactccgtggaattgagcatcaaattgatttggtaccaggtgcttctcttccaaatcgtccagcctaccgcaccaatcctgcagagacaaaggaaattcagcgacaggtaaaagagcttttggacaaagggtatgttcgtgaatccttatcaccatgtgctgttcccgttcttttagttccaaagaaagatggctcttggcgcatgtgtgttgattgtcgtgctctcaatgctataactgttcgatatcgccatcccattccacgacttgatgacatgttagatgaattgagtggttccatcattttcaccaagattgatttgcgtagtggctatcatcaaatccgcatgaaacttggtgatgaatggaaaacagcgtttaaaactaaaattggtctctatgaatggcttgtgatgccatttggcttgacaaatgctccttcaacttttatgcgcttaatgaaccatgttttacgagctttcattggcaagtttgtagttgtttattttgatgatattctgatctatagcaaatcatttgatgaacatcttgatcatatccgtcaagtacttgctgttttgagggaagagaaattgtatggcaacattgctaagtgcaccttttgcacagaccgtgttgttttccttggctttgttgtttccgcagatggtattcaggttgatgaagagaaggttaaagcaataaaggattggcctacaccggtaaatgtgagccaagttcgaagctttcatggtcttgcaagtttctataggcgttttgtcaaaaatttcagcaccctcgctgcaccccttaacaatctcacaaagaaggatgttccattcacgtggggccatgaccaagaccaagcatttcacacactgaaaacaaagctttgtgaagcaccgctgctacaacttcctgattttggtaagacatttgagatcgaatgtgatgcaagtggtattggcataggaggtgtactgctgcaagaaggtaaacctgttgcctacttttctgaaaagctaaatggtccacatctgaattactcggtttatgacaaagagctttatgccttagttcgcgttttggaagtttggcaacattacttgttccctaaagaatttgtaattcattctgatcatgaagctttgaaatatcttaaaagccaaggcaagctgaaccgtcgacatgctaaatggattgaattcattgaaacatttccctatgttgtccaacataagcgtggtaaagataacattgttgccgatgccttgtctagaagatgtgcattgattacacaactagatacgaaagtgcttggtttggaatccattaaaacactttatgctgttgatgctgattttaacgaacctttctctcgttgcattgatggaaaaggttgggataaatattatgtgcatgatggcttcttgtttcggactaacaaaatatgcattccagcttgttcgattcgtcaagtccttttgcaggaagcacatgccggtggactggctggtcattttggtgtcaaaaagacattggacatgccctctgatcatttcttttggccacatatgcgacgtgatgtccagcggcacgttgggtgctgcatcgtttgcttgaaagctaagtcccgcctcaatccccatggtttatatactccattacctattccacatgtaccttgggaagatatatctatggactttgttctggggttacctcggtctcagagggggagggattctatttttgttgttgtagatcgcttttctaaaatggcacattttatcccatgtcataagagcgatgatgcttcacacgttgctgatttgtttttcagggagatcgttcgtttacatggagttccaaagactattgtttcagaccgggatacaaaatttctcagctacttttggaagacattgtgggctaagcttggcacaaagttgttattttcaaccacttgtcatccacaaacggatggacaaacagaagttgtcaaccgtaccttgtcaaccatgttgcgtgctgtgttgaaaaagaatttgaagctatgggaagactgccttccacatgttgaatttgcttataacagggcagtccattctacaacaaactcttgtccatttgaaattgtttatgggtttataccgcatactcccatggatcttttgcctttaccattacaggaacaagttaacttggatgctacgaaaagatcagactttatcaagcggttacatgcggagacaagaaagaatattgagaagaaatcagcacaatatgcaaagcaagcaaacaaaggtaagaagaaggttacattccagccaggagatcttgtatggttgcatctatgcaaggatcgctttccccaacagtgtaagagtaagttatcccctaggggtgatggtccgttcaaggttctccaacagataaatgataatgcttacaaacttgagctgccacctgaatattccaatgtgagtaccacattcaatgtcaaggacttgcttccatttcctggtgagcctgagtcgaggacgactccttcccaagagggggaggctaatgaagacattcctagcattcactcatctccaaatgaagctacacttgatatagctggtccaattacaaggagtagagctaaacaattggagaaggaaattcattctcaggtgaacgctaaccttatgcttaataatcagattacattgaatgaacctatgcttttgagtacttgtttcaatgttcttaggaatgatggagtgcacgaacaagcatgggatgatgatggattctgcccgccaaatatatgcaaggaacctggacgtgcatgagagaggaaagaccattcagctaccatgaatatcagccattgaagtgcaagcaaataattcgggagttaggaatgcatgcaaccagcaactgggttgctgtccacacacgctccagcatgcatgcagagaataccaaccagccaggtgtcctactaggcttggtttttaataaaagtagtgctgcaacttcccactacatgttctcaattattttccaccaagctgaaactccactagtgctatatatccctgtaatggatgacgtgaacagtaactcgtgattgcaatttcagaataccaactcttggaattcttgttccagcgtgagtcttgagaggcttgcaaacttgttctttcgattcctgagggagttgtagaacgccgaactgtggttcacccagtttgtgccttcacgtctatacggcgtaattgcgtgggctgttcgtcggtacgtggaagggtgattgtctcggtagttcgtcgcgtggacagcctcgcggtgcattgcctcttcaccaggtcacgcaacgacaatttatcaagttcgcagatcctacgagaagatcgggccacaacaacttgctacacatgctgcatagacgtgtgcatatcactagtgtttccgcttgcatggccggcctatcatgccgccgttgttgggcgtctacatcctcaccgaacggccgcctcgtccaccgccgactggtgtttccgcttgcacagcaggcctattatgccgccgttgttgggcgtctccgtcttcaccgaccggccgccttccccgccgccactggtgtcctcgcctgcacgactggcctattatgtcgtcgttgctgggcgtctacgtcatcatcgatcggccgcctcgtctgccgccgactggtgtcctcgcctgcacgaccggcctattatgccgccgttggtgggcgtctccgtcttcaccgaccggccgccttcgccgcagccgactggtgtcctcgcctgcacgacaggcctattatgccgtcgttgctgggcgtctatgtcttcaccgaccggccgcctcgtctgccgccgactggtgtctccgcctgcacggctggcctattatgccgccgttgttgggcgtctacgtcttgaccgaccggccgcctcgtctgccgccgactagtgtctccgcctgcacggctggcctattatgccgccgttgttgcgcgtctacgtcttcaccgaccggccgcctcgtccgccgccgactggtgtttccgcctgcacggctggcctattatgccgccgttgttggccgtctacgtcttcaccgaccggccgcctcgtctgcggccgactggtgtcttcgcctgcatggctggcctattatgccgccgttgttaggcgtctacgtcttcaccgaccggccgcctcgtccgccgccgactgatgtttctgcctgcacggctagcctattatgctgccattgttgggcatctacgtcttcaccgaccggccgcctcgtccgctgccgactggtgtttgcgcctgcacggctggcctattatgccactgttgttgggcgtctatgtcttcaccgaccggccgcttggtctgccgccgactggtgtctccgcctgcacggctggcctattatgccgccgttgttgggcgtctacgtcttcaccgaccggccgcctcgtccgccgccgactggtgtgtccgcctacacggctggcctattatgccgccgttgttgggcgtctacgtcttcaccgaccggccgcctcatccgccgccgactggtgtcaccacctgcacggctggcctgttatgacgccaactgatgctatcttcttcacggctggctacatcgccgtcaccgctaataggcgtcagcatcttcaacacaagctgcctacgtctgctgaccgactggtttcttcacttccatggctgcatgattctctaccactactgatggacatcatcgtcttccatcgccgactggttatgccgctgccgactggtgcttttatcttcacaactgcacgtcttcactaccggtttgcttctgttgccaccgactcgtgttcacttcatcacggcaatgcaactttgtcatcatggtagagtgacttcatctttattatcttcggcaccggcaaactctattgctgctacttcgcaagttttgctactgcaccaaccacgacatctttgtgaacctcgacatctcgtgatgcagcaacgggggttcccgatctttcgatgagaggaggataaacttcgatttggggaaggatacgacgttggcggtccgactacaactaccacaggggtgctgcgccttagcaaccggtacaccgactccacgttgttgctgttcttgccgtgccaagaacaaccttgaacctgcaagcaatcgaagaacaagcaagaacaagttgacaaggaaacagctcacggcacttgtcaaatgatcaaacttaaacaaaccaaaatggggttctgaatacaagtatccgggtggtctagccgacacacgcgagtacaaggaagtagctgcagctaaacttatatcaaaacaaaacccaaagtgcaaaatggtggctgctaggagtttatataggtggaggaatgaccacgagaggaggtgggagcaaaccctaggttttgtggacccctaatgggctgtaatgatacaaggcccaagcccaagtttctgatgtaaagaactattttcgtcattctgagcagcctgggtcaaagttgatggtgaggccacacatagctgaaagtagacgacgagatctttccaacaagtactcatttgccccgtttgtcctccggagtgaagagcattgacttcatcaaatcagcgctgctagtgctgcttgcgatttggttcctctcccatattcctaacaacaagtagatcacaacaaccatttagtagcacccaattctgagaagaacttgtatgattagctaggaatgactttacctgataattaagttcacgagctcgagctctagtcattggtccttgctgtgcaataggcgtggttgtatcgttggaagggatgtcctcatcatctcggcatgcgatgccgtgttattttactacaacaagtggctctccaatattcaggatttctacttggacatcttcaacgcatatcttcaatcaagcaatgactactcgatgacaagaagttacagttctcgactctatgttcagttgtttcccaactaaccaaagagtcgggggctacacaaatacaagactctcaaaattcgacaagctgaagtaatcaattaatcagccaacgagtcaattccaggagtcattatcttcgtcttcgttttagagcagagttatcaaccaatcagctcagtttcgacgagttggacaacatcatctattttcctccaagtgaagcatctgcaacagctataccaccaatttgatggattattgtcactgacatcatcaccagcacctctgcttcatcggccctgacatcaactctgttgctaatggatgactatgtcttcgccggcttattatttcactttcacggttactatcgactggatcaccgacatcgttatcttcatcaacatcctatcaagcctcttcaacatagcccactctactgctattgatgggcaacttcgtcattatacttgatcatctatgattgctgcttatcatcattactgtcggttgcgtttgtcgtcgccgactattttcttcatcttcataattggtggatttcgtcatcgcttttgatgcgtatctacatcttcaccgtcggctagctttcgtcaccaccgaccgatatactcgccttcatggatggcttattatgtcaccactaatgggcatcttcatctacttcaccagctgcatcgtctgtcaccgactgattattttgctgctatggctacacaactttatcgctggacgccttcatattcattgctggctgacctgactgttgccgactggtttcttcacctccacggctatgcaacttcatcacttttgattggtatcactatcttcactactaccaatatttttgccacttctggtgggcaatattatctctatattggtcgtcttgtctctatgccaactacgccagctactatcaatggaccattgtaactacgacagaaggacaagctatatgatcaggggcttactatctcaaacacaagtatcataccttcaatttggacttgttccggatacatgcaacatgaattcatgatcatgggtctattttctatgctcaaagactggactatttattattccccgtaagggttatcaaccgaatacttgcgccagtcgggattcaattattatatattttgcagtatctcataagggataatcactcagatcagaagctattcatatgagctacacttggtctatatcacccagaagatttattactcgggagcatattacatgcgtcatactttaaagggtgtcgaaggcatattttttggcctaggcctaatatgtctgcagcccatattttcaggtgtggcctgtcacgttcttttagggacttaggcactttttgcttaggccaaagtgcgcgtgatctagtgcccaataccttaaaatccttttataccgcagttactcaactttttaggagttggtacaatgcatcttaaaatgtgtcaaacagtaaagctttatatagctgccccggtgacttttttatatagtcatggcgctgtttgggtttatcaagcaattgattggatacaatatcattgctttttgccacgtaagtgtgcatttttattgaccaatattatggcttaggctgattatatattttggtcattttccggacgattgataaatccttatgagtttatttactcggattttataccacatatgccatatatttccaggtgtggtgaaaccatgtgtcttttagggactcaagcacatctgttaaagcagtgtgcacatggtgtatgcccaatactttggaaatttatttattcacaacatacaagcttctttatagctgttttgctatgtgtattcaatgatgtagtcagctttaggttgcacacatcatattttacaaagcagtcggtatatcactcggatcatgttattcagggattcacaccgcatatgccatatattaatattaagtcacttggttgactacaattatcaaaaccactcagttggtgcatctattaggtacatctattcgatgcacctgactttatttttcagccctccataatcttcatatttggtaaaagtactcgggagatcatggcgaagatgattgaagcactcggctttggagtaatctagttcgagagaagattatctttccgactgtgaaggtctcaggggctactgtggagattatgggtaccccatacccacacggcatggttagccgactagtcataggggatagcttatatatatggaatatgtaaccgatcatgtcttgggtattacgtttccttttatattatggagcggcctaaagtcttgatttgataatattgtaaaatagatttaggaaaccgataccgtattggttaaggtttctatcttgtaatcctgccccccatcctatataaggtgagcaggaggccctctagggggcatgacacaaactgatagtcagatcaatatacacccggcggattcaaatccccaaacaggagtagagtattacctctcatcgagagggcctgaatgtcacgcccggaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaattacggtctagagaagctccggctccactcccacaggcagctcaactggggtataagccaaacgtcttctccttctggatcctttttcttcaactgaggttgattgattattgcaagaataagcatatgacatactgcacaagccacacagcaaatatgcaagtgcacaaggataccaaaggatggcataatataggctcatttgcaaaagcagcatttagcaaaacatttaagaggagtaaaacagtggagtaattaatcagaaattttaatcaacactgaacagcacacccatgctgcacaggcccaaccatcctgaacaaccatacccggctgtacagatctaactccaaaccaggagctaagcaaattattaccagatataacatccataattattgtgagaggtgtgagactaatcacgaaaaacattgctcaacccgcccataaccgcgggcacggctattcgaatagttttactctggccagaggtgtaccactgtacccacaagacacaaccccacatcatgtcaccatgtgcctcaataccaccacggtacctcggaaaggagttgtgacaataccccttgcacaacataatccattacagcgcacctttcctggatcataatcacccccttataaacaaggcatggactccccagcgacccccgtggacttctcgccacttctcagtctggcgcactataatgaatcacgctacacaaaagataaagccgttgcccacgctggcttgtggttggcacgataaatgtttcacaacagtagctcgcgaaccggtccttaattgtcatgagcacgactctcaaaaccatgtgctcacaacccaccattatcaagttttagttggcaagtaattaattaaccaatcacgattaaccatcgtgaactatcattaagccatccttaaataatagtgagtcataagttatcccaatagtgtgctaatgtttctaagcatggctaagcaatcataactaatatctagctgaaccaatatataaagcccaactagtcaagttataataacccaaggtatcaaggaataaagtaatcaatgcaaattggccataacaaaggaataagttcacaccacccggtgacattcgaaaataaatgcacagctgaaataaatagagaatttaaatataggatcaacatgctcaaaggattgtgtttaggatctgtgtgacttgccttgcaataatcgatcttcaattaatcttcttgaatacttccggtgcactcacgaaccttcgcaacgacggaaacgacaagctaacacgcaaaacgaagaaaaagactaataaaaaccaaataaacagtacatataaagtaaacaaacatgtagatcctgattttagatgaatttagcaacttgaaccactcaaaaccgagttacgatgatttagttatgaatttccgaagatttaatctattagaaaaacaggaaaaagaaaaaaacgatgatgacgtcatgatgatgacctcatcaatggccggaccaagatggcgacctcgccggagatttgatggtcggcctgcgactttggaggacatgaacacgtagaggacgacgagacgaacccaacggtacccaccctcgaaccaaacgacgaacgacgacggccggcgacgaggtctagcggcggcgcagcttcggtcgacggcggcgacggggctgcggtggtaggcggcttcggggagatagcggccgagcttgcccacacctcggcgcaccttacggcgatgacggcgaccggcgacgacgacggaggcggcggcgcgacgcgaatggagctcggccggcgacgacggcggggtggagcacgtggcggcggcgctacgaggcacgggagaccacgggagagggggcaaacgaaagaggaggactagggggtcctatttatagccttggattgaagagatcggactcctcccgcaagaaatcgatccgggaaatcaaaaactcggttttggagataaactcgaaaacgagttcgattcggacaagatactcaacgatttgctccgatttttgggggtaaagatagaggaggataagaggaatatttcccctcaactaaattttagaaaaacacaaggggaaaggtcagatttggaggagaaaaaccgagccaaatcggtctcagttcggctgctagaggtagaagataaacagtgtcgagggaggcaaattagacttttcgtcttgggctggctgaaaacaaagcaaagaaagaaagagaagggggaagctcggctgggccgacttgggctgcacggccgtgcagacaaaagagggagatgggctggaaagggcccaagactaggaagaggattattattacttttccaattaaattaatcaatgaaatgatctttgaattgttaaaaatacttcctatgctcaaataattccaagaaaaatcttgaacatacttgtacacccaaagtatttaaaaatattaaaaacagaccatttaatgattaatttaatatgtgggtaattactgaaatgctctttgtatgattaaaaattaagaattgagctccgaaacatctgagaaaatttcagagagtgtaattaatcatggagaatttaatgaaaattaaatccatccatgctttatatttaggaaattttatttcccacatttaacttcacttgtaaattaatgaacatttaatataaattctaataataatttattaaataatttataaatcctgaaacaaaaatcaggatgtgacactgaacctgtctaaatcctttgtctccacatccatccacttttaggtctcgtgcgctacccccttttctatattgccgaaaatttgtttcgacaccgattgggacttgggatagcaaattcggcaagtggtcgccgaattgggaaggaccgttccaaattcataaagtagtgtctaaaggggcttacatgttgcaaggactcgatggagaagtctatggaagagcattgaatggcaaatacttgaagaaatattatccaagtgtttgggttaattcatgatcggctgatgttgccgatacatgatagccgatgtatttgcatcgcctcgagatgaccgatattgcccttagttgtttttctattgtaatcggttgtggtttgccgatttacaatggccgatattattatatcacccttagttgtttttctactgtaatcggttgtggtttgccgatgtacaatggccgatattgttatatcgcccttagttatttttctatcgtaatcggttgtggtttgccgatgtacaaatggccgatatcattgtgtcgcccttagtcgttcttttaattttatcaatgcttttgacattgtaaaattagggggcacatatatggaaaattgcaaatttttgagcaaaatatggagttaaattgaatcggcatgacagttattgagataagttacataaagagttagaggtccttagccgattacaaaaatttctaagacctattacataggatgtcactgagacaaatatcgctggatagccgaaatagctctttgcctaatttgctctacttcttcaatggctttggtgtcttgagcatcggttccaaggatgattttcaaagacttggttagatcagcaacattcttgatagccgatttgagtcttaccttctgttcttcgatagattttgggagatcagctagctttttatgttccatgtccagttcagcatcacattcttcaagttgtgccaagagctcaatcttgcgagcttcgagccgatcaatattggacctaatcggaccctcagatagctgatcaagtttggccttttcttcatgaacaagctgccgattggtttggattgtagcttcgatatcttcacgctcccgacgttcggctagtcttagcttggctttttccaacttgaattgatgctgctcgagataaatagctagagtaaggatatcggctagctcatctgggattagagcttggatctcatgtagccgagtcctaattggcacacagtttaccaccaagttatccagtgattatgcttccagccgatgagagatgtctttgagggttttcttcacatcatcggacaggggaactaaaggtttgctggtggtatcttcttctatttcttcgtcaagataatctttaatattgaaagaaaaaagattgactaaagcctacaaaagagaaatttgaagatagttagatattaaataaatatagccgatctaggatttggtgttcgaaaggatacttactgggatagcaggagcagttggttgtatttcctcctcaatatgatgactccccacagccgatggagttcggtcacttgacgattgctgtacagaaggagaaggaggtggaggaggctgtaaaaagggacaagtgttatatagaatcggctgagatcaactagtaaaagaattgagaatatcttactggtggagccggtttgagaattgttgctgctggtttctttttctcggcagctttcttcttctgcgactatagaatcagtgggtaatcggctataagtaaataaatagaaagaattgaaagaagttggttacccttgaaaaatgagctggagcagaaggaatcggaggagtttgcttgggcgaagccgatggtgtttcctcagtgtcacttacattagctgcagcctagtcaacatcctcgccaatttcttcttcatccagagcttgctcgatggatggatccaaggcaggcagctgttgacagaaaacacgaggcctgggagatcggcttaactccagtgcaggtccaaaactcaccttcgggtgtgttagcgtgccagttgatttgatcctgcaattaataagaaatagagacaaagaaaccgcagttaaatctataaatgatagccgatcggctaggtgccgatgacatatcatttatctttgagccgatgtcatatgtgaatcgatcggcggttgtaaatagacaataaagaactaaatctattcgatcagctgtagatattaacaacatatagttcctatatcaatatatacttaaatcaagtgattggggtagatcggttgccatgccgagacagtataaatcacttagattgaaatatatattaataacagccttatatatgtttaaagcatagctgatcagatagatctagcatgtatcggctaatactccgatactactctatatcaggatattgaaacaagtataatgtatcaaacaaaagcttaatatacttaaatgcaaataagatcttgacataaaggacagatttaacatatcgctgaagcatatagagcaaatacaattaaatcaggtaagatcagctgaaactccgacgctaccctaatcggcgaccagaaggcaggctagagattgatattctaagcacgacttaatagatcaaactcaactgatgcagcattaagtatgaaaagaggaacaatatctagacaatcaagccgctggaagtttcatagagtggtagatatcttatataatctaggtcaacgtcactatttaatccaatcggttgccttctgttgacagatgttagccgattataggttagatgacgatattgtcgaagattatgtaagatatacgataatttgacgaattacatagacaagattagagtatcataaagatggaagcactaatcccgaggacagaatccatcataacaagttttacctcttgttgaagatcgaaactgatgcagctcaacttgaaagcaagaactcatcgaaataaaactaaagcaacaaggtggtgatgcgccgagattgtattgaacgtgtgtgttcttcaagttacatagggctcgggtctatttatacccgagaattacaagatatgtccataacggacacgactatgatctctaacaaactctaagataccataagtctttgcagcagacttttgcccaagcatatctataaggaaattacataaaatatcctaattaatagatacaattgccttctcaaacctctatccatgtgtggcaatcatcttgaagtgcctcaattcaacccgacgtcatacatcaagttgtattgtcggaatcgactgcatcggcttacctagtccgactcagacctagccgatcctaatcgtagccgatctggactccagccgattcctgctctgttttcgaactcgatctctgccttcgacttcacttcgatctaatcttctttcccgatgccgatattaccaattttggatgttaacacatgccccccaagtctagaatatttggtaatgtttcggatttgctgtaaatcgactctgagcaagtttcgcactttgccgttttccgaccgttactgccgtgctttaaatactaaccgttaccctcgagaagtctcacacagtcctcctccgttttcaccgctgaaaccaactttgttctctctctctctctctccggcgatctccccgacgtacaaagcaatccccaggcgatttcgttcctgatcaaatctccacctgcggcgatgtcgtcttgtaatgccctagaaaaaaaatagaataccgtagaggatatattggaagttcctaaggttttggtgtttgaaattagaagaaaaacaaaaggtatatgctagctaggctagcttttggccagcccaaggcccagctgccccctggacatcctcaaaacactaggagatcccctccccacctccccctagccgtcttttggtacccctgggcgcccacctctccctctggtcgacctccccatgggtgccctactgcagacctaggaagaagaagggaagaagaagaaagggaaagaaggaagcggagggaattgagatgaagaaggaaatgaggggttttggttgccgctgcccatggaggcctaggtatctaatacatgatcctttccccctgttttggttttctattagggtttagatcaagtgttggaagcgagtaagtttgggatcaaccgatttattcctcaactgggtttttttgctgatctgccaccctacgtagttctgccttggctgccttttcggccaacataatgggatttcctgtgaaaagtctctatacaaaagttgtagataacgtgtagatctatcttctgaccaaatggcatgagtttatatcaagtggtttaggaggtatcaatttctgaatttggctgtctgaatatcgatgcatttttctgtagtccaggtttagagggattttagaggatcttaatgatggaatcagagaatcttgtgtttacagaagttgtagcatatgttttgatatacctcctacataaaaattgttagctttcatcttgtagtttgttgtcagtgctcttttgaatggttgttgcacagttttctggtctgcacttctctgttttgtgccatgttttaggcccgctaaatggaagaattcaaatttgttctgtagatgtcagaaatgatatattttgctgtgttatgtgatgtagaattggaggtatcgaattgttaatctatgctgcttttatcggaagattatcggtgatttgctttatgttgtttggggtgggatcccagcgtaggaagcgtatgtgtgattcttgaatgattatgcatgttgtttgagtctgagccggtgtttattctaggtgatgccacttcggaatgcaactagagttcatctcatcatcggtgaaggcaagtaaacgtagcagtggtttgctacaactttgacttgttatttgattctacctccacgttgaaagtatatatcatcaaccaagattattatatgttacaccgaggattttcctatctgaatcatacttattgtttttacgctgtttatggttatactttatgctcttggttataataaccttatactgatctcaatcgaaggaatgtcgttctgttgttatactctggaattcatactgcatttgcatgacatgcattgcatttgaagttatgtcgtgaacctatggttgcgactgtaccggtatagcatcgtatattgccgtaatatgatgcagcttcacgccttgttgggtgtgaagccaggagtacatatcattgcattgcatatgcacatattgtaggatgttatgagaattatcgatcgatgatatctttgagaagtgttttcttctctgggatttgtgagtatatggatctgattggtgacgctatgaggttttagtccttggatattgaacttgtctttatgtgaatcataacttggtatttaattagttatataataaacatgtggtttaaatagcttgttaaagccgtttgcttgctgagtttattctcaccccccttagtcttttcaggtacttgctgtgacatgtttgtatgaagggatgggattagctacacagtcacacgacatgatctcacttagacatgagtattgtaatatgctgataagattacttgtgtttatatataatgggctaattaattactagagttgttgaccattggtaaactacttttttcaagcctatccctacatgtcagtcaattgttgtatcataactttaatctatatgttgctgcttccgcgacgttttcttgtctaaggtagttgttgccgaaatttgattgttttggcacttatgtatggttgtttagtggcatctcaggattatgaggttttctggggtgttacacgtcttccaccagcccttctattgtgccatcggccgagtacgctgaggtaagttctcactggctagatcccttttcctcgcatcaaatcgatttctccttttctcatcatgttttctgcttcccgattcttttggatttgcagcacctttccaacctagtcgcgattaccagcctttcgcacaagaaccactattttcttggcccaatcggcaatcttgacccctctgatttcatcatcggtgaaaccaacatgatcccctttggactagccaaccctaacctgggtcactggaagaataccttcaagtcttggccatctctcgaaaaacctactcctgataagagctggaccacctggtaccaacgcgtatcggctagtaagaaagttcactcggatgagattgagatcagccaagcgctcgctctcacgatagccaattctgctaaggatgaacctatgatggctgccgccacctatttctggtccaacaccatcaataccttcttattcaaccaagggccgatgactccaactttgatcgacatcatcatgattactggattagatgtaacttcatcagctaaccctatgagtatgaacaccaagaaccaatttgacttcaagaccaaaagcataggtggctggtctggctatgtggcggcatatatgggccaaggatctgttacccctcgagagcatgtagctttcttgctcatgtggctggaaaagtttctcttctgtggatccagttgtggccctataaccaactggcaatttgtagccgaagccttagaatcaaagaaaagatttccattgggcaaaatccttctcggctatctgtaccaaatgttgaacaatgcatcggctaaaatagccgtcggctcaatagtcggagcaggtggaccattgtggctgctacaaacttggttaaacctgatagtcatgaaggttgtcaatcggccctatgtgacaagataaattcccattgccagagccgattgtagaagacgacggagaagagcgcacccatcgcagatgcatgtcatatggagaatatgcatccacaccaaccgatgctgaagcaaagctatcggctgagctgctcaaggaatggttctgtagcttctacgaaggttttatgaaagatgcacggatcaggtttccttatgaagactcagcagaccttgaacttccatcagactttagatttgaagacattaatcatgaaaaattccaaaaatccagagaagttcttatagctgcaatcagcccatgcatccttcctgtcggcattcaccaagggagaaacatccaagtctcctacgagttttatcacccaatgagctcggccaaacaacttggattgggccaactcccaatcggcttattctttgccgacaagattcagtaccgaggacaaatcacatccactctaatgatggatcggctacttaacctactaggaccccctctaggcagcattgataatattgagttggcaggatttagaagcaaaaactttgacagatggtggggtgaatggaagttgcatctatttcatcaattggcttcaatgtatttgacagatctattccctgacgtcataccccaggtaaactttgtcattactaaattgcataatcggttagccgattcattacatgactaatcttttgctcctattttgcagacaacagagtcctccccttcacatcaaagtaacagtggcaaaaacattgaatatgctccaggtctaattccgaatggaggtggactatctccccccattatcggctaccatgcccccaagacttcaactctccttcacggcctaaccagggatccagccgatgcaggcaagaaaaggaaaaccagatcatcggccgtgagtaccttggccttagctccaaagaaaaagaccaaattcaagaaaactcaaccgactgataagccgactgatgatttgcccgccttggatccatctattgtacaagctttaaatgaagaggaaattggtgaagatgttgaccaggctgtagccgaaatgagtgacacagaaagaacaccatcggcttcacccaagcaaacgcctccaactccttctgcccccgttcattttacaagagtaagtatctctctttgacttcttctgaaattacttccctcttcggctaattactcatagactttgtggttgcagaaaaagaaaactgctgtgaagaaaaagccagcagcaacgattgtcaagtcagccccaccagtaagatgtctttaattcttttacttaatcaaactcaacctgctctatataacacttgtctattctacagcctcctcctccttctccttctgtacagcaattgtcaagtgaccagactgcatcagctgtgtggtgtcatcacatcgaggaggaagaacaaccagctgctcctgctatcccagtaagttttcctttgtctcaacaattagatcggctacattttacccagctcttactctttccgaaattgtctctgttggttctagccggtctcttctcttttgacatcagagattaccttgatgaggcagaagaagacacttcaagcaaagctctagctcccctatctgatgatgtgagaagaacacttgaagatatctctcatcggctagaagcctcttctttagatagtttggtagttgactgtgggtcaattaggacacggctacatgaagttcaagctctgattcccgaagatttggccgatgtccgaactccagccgcttatctcgagcaacatcagttcaagcgggaaaaagccaagctaagactagccgaacgccgtgagcgcaaagagattgaggccacaattcaagctaatcggcagcttgtgcgtgaagagaagaccaaacttgatcagctatctgaaggtctgatcaaatccaatattgatcggctcgaagctcacaagattgagctcttggcgcaacttgaagaatgcaatgccgagctagatatggaacacaaaaagctagccgatctcccaaaatcaattgaagaacaaagggcaaggctcaaatcggctatcaagaatgttgctgacctaaccaagtccctgaaagtcatctgtggaactgatgcacaagatgcccaagctattgaagaagtagaacaaattaggcaaagggctattttggctatccagtgatacttgtctcaataacttttgtgtgataggacttagaaatctttgtaatcagctaagatactctagtactttactgtcttgacaatcctttgtgccgattaatatgacttcaaaattcgctcaaaaaatttgcattttgatatatatgtgcccccctaattttataatgtcaaaagcattgataaaattataaaaacaactaagggcgatataacaatatcggccattgtacatcggcaaacctcaaccgattacaacatgaaaaaacaacgaaaggcaatataactatatcggccatctcaaggcgatggaaacacatcggctatcatgcatcggcaacactagccgatcatgcgttaacccaaacacttgggtaatatttgttcaagtacttgccattgagcgcccgtccatagacttcaccatcaagcccttgcaacatatatgctcccttagacacaaccttataaatttggaacggtccttcccaattcggcgaccacttgccgaatttactatcacgagtcccaattggtaaaatcaattttcatacaagttcaccttccgaaaaatcttttggcaccactttcttattgtattgccgagcaacatgttccttatccttggtaatctttgcaggtgctcgcaatcgtgactgaacatgatcctccctctcatcggccataaggttgtaatactcatcagctgttaaatcagtttgtaactccgttcttcgagagccgattctaacttcccacggcaaaacagcctcatgcccataaacaagtttgtaaggagggacttggatcgatccatgacaagccatcctataagaccacaacgcttcagccaaccgagtatgccattgccgaggataatcagaaattttctgcttaatcaatttgatcaaacttttattagatgcctcggcttgcccattagcttgtgcataataaggtgaagaattcaataatttgatacccatgctatcggcaaactgaacaaactcgtcggacacgaagattgaaccctgatcagttgtaatagcttgaggaataccaaatcggtagattatatgttcttcaacgaattgaattgcatctctagaatcaactttcttcaaaggaatcgcctccacccacttgatgaaataatcagtcgtcaccaatataaacttatgtcctttacttgatggtgggtttctcataccgatcatatcaattccccaacctctgaatggccatggcttaataataagattcatagccaacgtcggcgctcgctaaattgccctaaacttctgacaatcttgacaccgcttataatatctgaaacaatcctccagcattgtcggccaaaaataccctgcacgccgaagtaaccacttcatcttatgagccgattgatgagtgccacaaattctttcatgaacttcgccgactgcaactttaacctgatcggcactcaaacacttaagtaatactccatcaatcgttcgataataaagctcatcatccaacagtgtatattttaatgccttatatcttaatttcctagaagccgattaagatggattatgcaaatactgatgcacatcatacctccaatcatcggctgtcattgctgcaacttcaaccttaacatctttgatcatcgacttataccccgatgccccttgggccaaatcgttagcttcaatattttgttctcgagacacatgcttcaaagtaaccgaccgaaattccttcatcaattcttgtcacttcttattataaaccattaacgtatcattcttacattcatattctcctgccaattgactgattaccagtaaagaatcccccatgatttcaatagcatcggcttcaacttccttgagtaattgcaaccctttgagcactgcctcatactcagcttgattattagtcacatacggtttaatagtataagcaaactcgaaacatgcccccctaggggaaagtataactaggccgataccacaaccatgagtacacaccgatccatcaaagaataaagtccatggcactaattcaaccgagtcgattgaatcatcacggtgttccacaataaaatcggctatagcttgtcccttaattgccttcggcgactcataccgaagatcaaactcggttaatgaaaatatccactttccaacccttcctttcaatattggagccgataacatgtatttgacaacgtcggccttgcatataacagtacactcgttggatagtagataatgcctcaaccctgtacacgaaaaatacagacacaagcataacttctccacaggggaatatctagtttcagcatccaagagccgacgactgagataaaatacaactcgttcttttccatccaactcctgaatcaagactgagccgattgacttctcaccggccgacagatacaatctaaaaggtatcccttgctgtggaggaatcaaaacaggaggagagttgagatattctttgatattatctaaagctttctgttgttctgccccccaagtaaattgctgatcggccttcaatctcaacaatggtgtaaaaggttctaactttccagataaattagaaataaaccttcgaacaaaattaatcttgccgatcatctcctgcaattcggtcttgttttccgggggctgaatcttcttgatcgcattagcattaacactcctttgagtcacctcaatccccctctcatgaacaagaaatcccaaaaactggccagccgatacaccaaaagcacattttgtcggattcatcttcaggccatattttctggttctctcgaaaactttcctcaaatcggctatatggtcctcaacttctttagacttaacaaccacatcattgatgtagacttcaaccaaccagccgattagatcatgatatatgtaattcatggctctttgatatgtagccccagcactcttcaagccgaaagtcatgacaacccattcaaataagccgattgcaccagggcatctaaaagctgtcttatgaatatcttcttcagccacaaagatttgattatatcctgcgttaccatccataaaactcaaaattttgttccctgacgcagcatcaaccagctgatcgactactggcattaggtattcatccttcggtgtggctttatttagatctcggaaatcaatgcacaccctgaccttgccattcttcttaataactggaactatactagaaacccattcagcgtatcggcaaggacgaataaaaccagcatcatacaatcgtttaattttagctttgacatgttcaagcatatcggcttgataggtaaccgatgttctacaatcgatcggctgagtcctggcatctcaaaatactcccaagcgaagcagtctctaaactctttcaagagctctatcagcttagttctaaattctggagataagttcttactaatatatgtcggtcttggccgatcgctaggacctatatctatttcttccaaatcatcagccgacatgaaaccttgaccttgcttgtcatcgagatcatctaccgtatccttagtgtagacatttgaaccctccacgacgccctcaaaataatagcttgggttctccatcttcaattggctgtatatcagaatcagacacttttagaaaatctccatcccaaacttttccagataaacaatcaaggtcatccatctcccaaagagctaaatcggcactggcaacattaactgacctgtcggctggaacgatctctatcttgtcgccttgccactgaatcaaacattgatgcatagttgaaggaatgcaacaattggcgtgaatccaatcccttccaagcaacaagctgtaagaacccttcccatcgatgacaaaaaacgaggtaggaatagtcttactgccgactgtcagctccacatttagaacacctttggtctccgatggattaccaccaaagtctttgagcaccatatttgtcttgatgagatcttcagcatatctacccaacttcctgaacatagcaaaaggcatcaaatttaccgcggccccaccatcaaccatcattttagacatcggcttccattgacatagccgtttatatacaatggtttaagatgctgattctctgtcccctcaggtttctcaaacactgcctgttccggtgacagaaccaacttagctgattcctcttccacctcgtcgacatcgggttgatcgatcccgaattcggctagcaaggtaaagaccatgttaaccggtgcagtcacaacactcttcccttttgccaacctctttgcctcatcggctgcaacattatcggctacaggaacctgatttttaacatgccactcctgccttggctttgctttcttcagccgatgattaatttcttgttcaacctcctgaaggtgctccctgttcctcaatctctgaacccttctcttctgattcttcgtgaaaatactagaaggacaccattgattcttcctgattacattgtcctcttggccatgatcttgatttactggacccaatctttgatgaacagaaactcttgtctgccttagccgattgcacccagggcagttttcaatagatggcaacctcataccttcattccagcagaatctagagaactcacaaccccaatgaggatcaaaaccatcatcgtattcttcatgatgcttctcctgctgcttgtcatacttcctctgatatttgttgataatcttagccgaattcacctgaaaaccccttgcacgggccctatcggctgtttggccagctgtatgcaccatattaacaggaaaagggttaccatcgaccttcatcggctttttggaatcatcaaacctaatcttgcatccctcaatggccacctgaatctgctgtctaaaaaccttgcaatcgttagtagaatgggacccagaattatgccatttgcaatacctctttttgcctaattcctcatccgatgggattgtatgaccagcaggaatttgaatttgcttctctcggagtagcagatcaaagatcttgtcagctttagtaatatcaaaatcatacttctcctcatttccagaactttttacccattgacacggtatgacctttttactcctcacccattcggctgcagctatttcagaatcgtcctcgtcatcatccgacccatacatgtaaggacaaacatgattaaccttcttagagcttttcctgacttccacagacctatgctcatgcaaggttaccttctgtatcagatgtgacaagctatcaaagtcttcagacgagaatttctctctaatcggagcaatcataccctaaaaggccagatcagctaactgggcatcagttaaactcaagctgaagcatttgttcctcatctccctgaatctctgaatatactcgtgcacaggttcatcatgccgctgcttaatcgccatcaagtcagataatttcatctcatgaaccccactgtagaaatagctgtggaattgcttctccaaatcggcccaactattgatcgacccatatggcaaagaggaaaaccaagtaaaagccaatctagacaaagataaccggaacaacataaccttcagagcatctacagccgatgcttcaccacactgagctaagaatcggctaatgtgctcataagttgacacaccatcttgtcccgaaaatttggagaaatctgggactttgaaccgattgggaagaggaactctctcaaaccactcagggtaaggctgccgatacaagcttccagtctcttttggtttaagcccaaactgttccctcattacgtcagcaatcacatcggcccacggtcgtttctgagctgctccctgcgactgttgttgcatgggctcgaactaaccgtattgagatgcaaactgaggttgagccagtccccctggctgatattgggcttgcggggaaggagcctgatattgataattcaagttgcccccttggtaattatgaaggttcggctggatattacgtactaagtgttaaggaacaacttgaggcattactgtgccatccggctgtacgtggtgaacaagtgttctgggacaacttgatttaaaaattgttgtacaggctgaccactaggcgttgcaaacccggccgatgcgctcattgaaccttggtgctgaatcggctgaaccatctgctgtcttaatggcgtctgctgaatcggttgtagaggctgttgctgagctggttgcatgacctattgttggattggttgcacagcctgttgaattgggagtgtttgttgaattggctgctgctgtattggatcaacaacaggttgaggtggcagaaacgtggcagcaacctgatcttgggccagccgattcgcaacctacccactatgctgtggccgctctctcactaacaactgagggttcaccggctggcctggcaccaccgctgacagagcaagtagggtagttgatgccgacgtcatcggctgagctgttggtgcaacggagggaaccgcctgaatagatggctgaacatcggtgatcaaagaccgataatttggaaagacacctccttgcaaataaaccgggcctgcagcctgatgctcagctattgaaccatcggctattgacttcatcatgtttgataaggtattgactaacaccccggactgattgatcaaagcatgatgcagagcgtagtcaacccggtcttgggaattattgaaaaaatcttgtgccgcgtcactattctgattaagatgtcctccctgcaacccctgagcaccatcaccttaaactccatgcactccgtgatcttgcactccatggactccttgagaattgtcgccttgatttcctaaagaaccgtcggtagcacctttgtcactcggttgagccgagccgtctcgagcttgtttcccatctccatccttagaagaactggtcccaggatcatcagcaaccacttttattttgtacttctgaacaagtgtccccttgcgggtctgcatgaatgagttcaagaactgatcccgtgcttgctgcaacattgcttcaaactctttcttctgctcaggtgtgaatttttctggatcgattggcacgatgtttccttcattgacgtcagtcaataataacttctgcatcttttccttaacagagccagggctagctggggatgctgatggtggtggtttctcggccatgaggaagaattgttggctgacttcttaaaggtcccactggacgtgccaaaagcgtgttgactgaaaacatgaggcctgcgagatctgcttaactccagtgcaggtccaaaactcgccttcgggtgtgttagcgtgccagttgatttgatcctgcaatcaacaagaaatagagacaaagaaaccgcggttaaatctacaaatgatagctgatcggctaggtgccgatgacatatcatttatctttgagccgatgtcatatgtgaatcgatcggcggttgtaaatagacaataaagaactaaatctattcaatcggctgtagatattaacaacatatagttcctatatcaatatatacttaaatcaagtgattgggatagatcggttgccatgccgagacagtataaatcacttagattgaaatatatattaataacagccttatatatgtttatagcatggccgatcagatagatctagcgtgtatcggctaatactccaatactactctatatcaggatattgaaacaagtataatgtatcaaacaaaagcctaatatacttaaatgcaaataagatcttgacataaaggacagatttaacatatcgctgaagcatatagagcaaatacaattaaatcaggtaagatcggctgaaactccgacactacccaaattggcgaccagaaggcaggctagagattgatattctaagcatgacttaatagatcaaactcaactgatgcagcattaagtatgaaaagaagaacaatatctagacaatcaagccgctggaaatttcatagagtggtagatatcttatataatctaggtcaacgtcactatttaacctaattggctaccttctgttgacagatgttagccgattgtaggttagatgacgatattgtcaaagattatgtaagatatacgataacttgacgaattacatagacaagattagagtatcataaagatggaagcactaatcccgcggacactatccatcataacatgttttacctcttgttgaagatcgaaaccgatgcagctcaacctgaaagcaagaactcatcgaaataaaactaaagcaaaaaggtggcgatgcgccgagattgtattgaacgtgtgtattcttcaagttacatagggctcgggtctatttatacccgagaattacaagatatgtccataacggacacgactattatctctaacaaactctaagataccataagtctttgcggcaaatttttgcccaagcatatctctaagaaaattacataaaatatcctaattaatagatacaattgccttctcaggactctatccatgtgcggcaatcatcttgaagtgcctcaattcaacccgacgtcatacatcaagttgtattatcggaatcggctgcatcggcttacctaatccgactcagagccaggcgatcctaatcgtagccgatctggactccagccgattcctgctctattttcgaacacgatctccgcctttgacttcacttcgatctaatcttctttcccgatgccgatattaccaattttggttgttaacagcaggtcatcagtcgacttaattttcttggatttggcctttttctttggagctagagccaatgcgtccacagccgatgacctagtttttcttttcttgcctgcatcggttggttccctgatcttttcttgcctgcatcggttggttccctgattaggccttggaggagagttaaactcttgggggcatgatagccgatgacagggggagatggtccacctccattgggaatcaaacctggggcatattcaatgtccctgccactgttgctttgacgtggaggggaagagtcgattgtctgcagaataggaacaaaagattagtcaagtaatgaatcggctgacaataacttagattaaataatctaagttaatagatctgtcatgtacatcgaggccgattggtgaaataggtgtagcttccattcaccccaccatctgtcaaagtttctgctcttgaatcctgccaactcaatgttttcaatactgcccagagggggttcttggaggttaagcagccgacccatcatcaaagttgatgagatttctcctcggcactggatcttatcggcaaagaataagccgattgggagttgacccagtccaagttatctagctgagctcattgggtgataaaattcataagagacttgaatgtttcttccctaatgaatgccgacaggaaggatgcatggactgattgcagctgtgaaaacttccctggctttttggtatctttcatgattaatgtcctcaaacataaattctgatgggagatcaaggtctactgagtcctcatagggataccagactcgggtatctttctgaaagccctcataaaaactgcaaaaccaatccttgagcaattcagccaatagttttgctccggcatcggttggtgtggatgcatattctccatatgacatgcatttgcgatgattatgttcctctccatcatcgtctacagtcggttccaacctcggaaattcagcttctgtcatagatggccgattgacaactttcatgaccattagatttagccaggtctgcagcagccaccatggtccacctgccccaactactgagccgacgactatcttggccgatgcattattcaacatttggtatagatagccaaggaggattttgcccaaacgaaattgtttctttgattctaggacttcggctacaaattaccaattggttatagggccacaactgcattcgcagagaagaaacttttccagccacatgagtaaaaaggccacatgctctcgaggagtaacagatccttggcccatatatggtgccacataaccagaccaaccacctatgcttttggtcctgaagtcaaattggttcttggtgttcatgctcatagggttagccgatgaagttacatctaatccggtgatcatggtgatatcgatcaaagttggagtcatcagcccttggttgaacagaaaggcattgatggtgttggaccagaaataggtggtggccgtcatcagaggttcatccttagcggaattggctatggtaagggcaagcgcttggtcgatccagatctcgtcccagtgaactttcttaatagccgataaacgcttgtaccatgtggtccaactcttctcaggggtggttttctcgagagatggccaagacttaaaagcattcttccagtgacctagattagggttagctaatctaaagggattctgttggcttcaccgatgatcaaatcagtggggtcaaggttgccgattggaccaagaaagtaatggatttcatgcaacaagctaggaatcgcaactagattggagaggtgctgcaaatccaaaagaatcgagaagaagaaaacaagatgaggaaaggggaaatcaatccgatgcgagaaaaggagatctagccgatgaaaactcacctcagcgtactcagctgttggcgcggtagatgggctgacggagcatgacattaccacaggtggagatttgaccggagatggaaccactttggaatcgccttttgcgtagaaggaatcaccggagagagagagagggcaaagtttgcttcagcggtgaaaacggaagaggacggtgtgagatttctcgacggtaacggttagtatttaaagcacgggaataacggtcggaacacggtaaagtgcgaaacttgctcggagtcgatatacagcaaatccgaaacattaccaaatattccggacttgggggcatgtgttaacaactaaatttagcaatatcagcatcggagatgaggattagatcgaggtggaatcgaagacgaagatcgattcgggaacagagtaagaatcggctggagtccaaatcggctacgatcaggatcggttggatccgagtcagactaggtaagccgatacagccgattccgacaatacgacttagtgtacgacatcgggttgagttgatatgcttgaagatggttgccgcgcatggatagagtcctgagaaggcaattgtatctattaattaggatattttatgtaatttccttagagatatgtttagggcaaaagtctgtcgtaaagacttatggtatcttagagtttgttagagataagagtcgtgtccgatatggacatagtttgtaatttttgggtataaatagaccccgaaccccatgtaatcaattaacacacacgttcaatacaatttcggcgcatcgccacccttttgctttatttttatttcgacgaggtcttgctttcgggttgagctgcatcggtttcgatcttcaacaagaggtaaaacttgttatgacagcttgcgttctcgggattagtgcttccatctttatgatactctaatcttgtttatgtaattcgtcgagttatcatatatcttacataatcgccggcaatattgttgtttaacctattatcggctaacatctatcggtagagggcagctgattaggttaaacatcgaggttgacttagattatataggatatccaccactctatgaaacttccagcagcttgattgtctagatattgttcttcttttcatacttaatgatgtatcagttgagtttgatctattaagtcgtgcttagaatatcaatctctagcctgccttctggttgccaattagggtagtatcggggtttcagccgatcttatctgatttaactttatttactctatacgcttcattgatatgttaaatctgccctttatgttaagatcttgtcgcatttaagtatattagacttttgtttgatatattctacttgttttaaaatcttagtatagagtggtatcggagtattagccggtacatgctagatctatctgatcggctatgctatgaacatatatagtcttgttattaatatatatttcgatttaagtgattcatactgtctcagcatggcgaccgatctatcccaatcacttgatttaagtatatatcgatataaggagtatatattgttgatatctgcagccgatcgagtagatctagttctttcttacttatttatgactgccgatcgatacataaatgacatcggcccaaagataaatgatatgtcatcggcatttagccgatcggctatcgtttataggtttaactgcggtttctttgtatctatttctcgttgattacaggatcaaatcaactagcacgctagcatacccaaaggcgagtttggacctgcactggagttaagcagatctcccaggcctcgtgttttccatcaactcctacccgcgaacccccctacccctctcaccatcccccgtcacccccaccacctacccaccagtgtcaccactcgccacccatgcccatccacctctcacaacccacaagatgtaccccataaccgccaccgccaggacgcctttttttattctgaccacaacttatcgagaataattcatttactgaaatcgtagagacgcacacgcctcaattagtaacgcgtttactaggccaacagttctattgccgcagcccatgatcggtcaaaacggaaacggctgaaacaaatcgccgcaaaaggggcagtttctgttttagtctctctcctttatcctcaccgtcaaccgtccacggtcatttcccactttccacgctctcctccccgtctccgtcgactccacccctcgccgatttcgccgcaatcccttcaccgggtacggcggcacgcactcccctcacccacattctagttgccgacgaccgcggcggccgcatcgaggaagtccaccgtgccatcggcggcgcctagccgcggccgaggcggaaagcaccccgacggcggcacctagccgcgaccaaggcggccaccaccccggcgaccctcattggtacgcgcgactgaggaatcaacacacgcacaccagagctacactgattttagcaaaggttagtacaagcatctacactacctgtcatacacatccatttctccgatctaatccaatacccattgttcagctacattttttaagatgaagcggaagggaaaaatgccagagaaggttaggagagtcaagttcatggggtcgcaataagaatgcaagattgtgctcgatcaatcctagccgagtgagggcccaactacccgctccaagcgagctcgtgcagacggaggaagtcaacaaggaaccgccaaaaaacgtggccgcaagaaccagtaggatagagccctgaaggacgctgcacttgttgaggtgaggcacactctattctttctcaaaaaccctaaccctttattccctttgtttggttgctgtccatttatttctgcgtgtgtggttgtcgtcttatatgattgggattgatgtagggaccatggtactaccaaatctttctgtttttgtcctattcataaatccgacaggagctttatgttctgtgacccaccatatttttcccccacttgatctaaatcatgggtaatgcttttcatataattaagggttaggattaaaggtaagaggcagaatgcacggttacgatttagggctgtcttttggtgtgtgggaattcatttacccaacacattagccaaacagggcaatagtgtaggaacatactcagtgttagtaaatgcattactctcatcagtgttagtaaatgcattactctcagtgttagtaattgcttaccagaggtgagatttgaatactagtacaactagactttgaaatcaaatcagggtactgacacatgttcccaacaagctagtagtgagactgaaaactatagcaaaaaatgattacagatgatcccattgtcgatgctatcgaggctcctccattcgcttagttatcatgtgaaagaaaattcatccctataaccactttagttattcaattttatgtcctaaatgctaaaccatatttgtattgcagctgctagcgacaaagcaatctgtctttacacgctgtagcccgaagtttgcacacgatgcatgtcgtgcgttgtcgccgatacaccgacaagctttggcagcgcttggtctgggtgagcttgcaaagatgactctcaacggcttggagcagcctgacctcacctgctggctaatggatcgcaaagacccaaaatcgatgaccattgacatatttgagaataagaagatagtcataactccatggaaggttaaaattgtcttgggggtcccattgggaggggattcattcactggtggagaaaccatctttggtcggtcggccgaaatccacaatagtcccggatacttttataaaccgggactaaagatgatctttattcctggttggtggctacaacgggcatatgtgatctttaatcccggttggtaacacaaactgggactaaagatcatctttagtcctggttgtagagatgtcagacgttgtcagggcccccgggattaccaaccaggactaaagatccccccctttatatatgccttcttcctcctccagcccgagagcaagcttcaaaatttctcaaagaaagaggggagatcatgccaaaattttttgtgaaatttttttagtgattatatacaaatcggaggtgtctagaacgttagtaacttcatcctccaatgttttttggttgttatattacttttggagctacgtttcacacatttttttttgtctccaaaactttgttgtaagtttatcagacagaaaatttgtgtggggaagaagaatatatagaaattttattctcatagttttaaatatgatgaaaattaatcttaaaaaatagaaaacaaactaaattgaaaattaagagaagtacaacattaatattagtttagaacttcaaaaattgttaataagaattgcttgtcgaatgagtttttaattattttatcattactgtttgactgtcattattgtacgaaaatttatttatgtacgatttttttttatttcatgtagatggatcggcaatggatgtacgctgaccggcggtccaaagagtttatcgagggcgtgcattatttttcgagagtggccaaagctaacaagcgtaacggttttatttgttatccatgcaataagtgtaagaaccagaaggagtattctgcatccaggactgttcatttccacctgtttgagtcggggttcatgccaagctataattgttggacatcccacggtgagcaaggggttgaaatggaagaagatgaagcggaggacgagaacattcctgactgggctcagtacgctggatttgaaggaaatcaaacgggcgaggtggacagggatgctggcgataaaaacgctgcggatgatcttggtcagatgttgcaggacgcaaaaggaggactgtgaaagtgaaaaggaggcccataaattggagcggatgttagaggaccatagaacgtcgttgtacccaggttgcgagtaggggcacaaaaagttggatatcattctggagttcttgcaatggaaggcaaaaaatggtgttagtgacaaggtatttggcgatttattgaaactcgtcaagaacattcttccggagggaaacaaattgcccgagacaacgtacgaggctaagaagatagtctgccctctaggactggaagttcagaagattcacgcatgtccaaatgattgtatcccatatcgcggtgaggagtaccagaacctagaaacatgcgctgtttgcaaagcactacgatacaagattagacgagaggatccaggtaaagttgacgagcagccaacaaagaagagaattcctgctaaggtgatgtggtatttccctaatggaaaaagtacgaattacccccccgaactatgacgacagtttgaattacacccctaaaccacaaaaccagacattttataccctgaactatctataccggactaataacccacctcaacccaatccaaagtggtatcgtcctacgtggcgtccacgtggcaatccagtcagcaattttttttaaaaaatggtggggtccacctgtcatactctaacacatctctcttccctcttctctcaatctctctctgtcactgtcttaaatgtcattggtggccggcgatgggtgcgcggccagcacggtcggcgcagcgcttggcgcggcaaacagcgagcgcggcgggtggcgggcgtggcgggggtgcggctggcggcgagcgcgggggcgggcgcggatggcgagcgcggcgggtggcgtgcgttgcggngtgcaccggngcgtggtgggggccgttcatccctctagtgtggccggggtgccgccggccgtggtggacaggtggccgtcacgcgtgaatggacccgtgccacccctgttttagcgcggccttattcttacgtttatcagtgtccttcacctgtgtctgtataattatcgtgatatattctcgttccattcgcagtgctctcgtcctttcttgttctagaacccacacggctactctttctctcactctcgattgacacgtgca

SEQ ID NO: 34300 - DNA, 36780 bp, Oryza sativa
  unsure (1)..(36780): unsure at all n locations
cgcgtnntattgttgacgtcgtcagaggtacacnagttcatcacgggggtgcggcgggcgtggtggagaggcgggcggcaggcgtgatggcgcccgtgccaccccgctgtaacgcccccccgctgaccccgtgttgccgtgcccccccccctgtcatggcgaagtgcggtgaattggcgagggtggaggcggaggttgtctccgcccttccgctccgagcccctggcggccgccgacaccacgcccgagctcctagtcgtcgtcttcaacctggggccgtcattctctctctctcacccctctctctttggccatcgggaggtcggcgccgccaccgcgcccgagctcctcgtcgttgtcttcaacctagggctgtcggtctctctctctcaaccctctctctcgggccgttgggaggtcggcgcgcacggcaccgccacctcgcccgagctcctcgtcatcatcttcaacatggggccgtcggtctctctctctctcacccctctctctcgggccgtcgggaggtcggcgcgcacggcggtaggtcgacttggccgtggccaccgccatcgccgccaccgcgcccgagctcgcagtcgtcgtcttcaaccaccaacctcatccgcccctctttggaggccgccggtcagtatccgtcgcccttctccttgctcggctctgccgacggcaccagagagagagaacgagggagagagagagacgaccgccgtctccaatgtcctcagcgccgtccgccacccgtctcgccctccccaccgcgtccgccgcgcggggcgcccaccgcgccctcccaggggaggactcgttgcccgccgcttgaacgcgctgatgaagcctagaggggggtgaataggctgtccctgaaatcttaaaaacaaatcgcagcggtaaaattcaaacagacccggaacttcctggtaaggaactcccgaacttccggcctgccaggcccggaacttccggtgttctaagacaggaacttccgggtaacaaaacagagatgaaattcaaatttcgaaacaggagactaagccaatcttcacaagatggtgcacaggtattctaagcagaggatatatcacagaatcatacacagaaacatcacagaaagagacaagagcgattttttcccgaagttcggatcttgcgatcctactctccgttgaggagctccaaagagctgggtctcgattaacccctttcctcacttgtgcaaaaaccccaaaggaaatccacagccttcaaccccaaacacccccaggcaaatttctagaattgagtgaccaccaagatccaactcaacctacttctagaaatccaccacaagtgtgggttgctctacttggaaagcctctagaatctcagcacaagaacttcactaacttacctagttccctttcggaggagaggaaatccttcagaaactttcccgggacatccacaatacgcaacggattttcgcgggcgacacctaaccatctaggagatcatctccaagagtaataagcaccgagatgacagcccacgagatattccaagtgctcaccctagatcctagtcttcacacatctccaaatcttcttctctccctctcaatctctctttctcacaagaattaggctctagattgagtggagaaggcaagaaacacttgggagaggctagcaatagctctaggtttgaaaagtaaaagtggaatagacaaggaacgagctggagacgtcatctagccgttactcacaaatttgaactggaaactagacaggaagttccggacctggaagaccggaacttccggacctggaagacaggaagttccggacttgtatttttggatagatggagtatttgcaaaaatgattcctagggaaacttgacacttggctcgcactaagagcacttgacatatctctgagcatcacctggaacccctcttaatagtacgggttttcctaaaaactcgattgcaacaaataaactatcctatgcacttctcgagttccggtccgcttgattttatacttttgagggcgactccaagcatccatcttccacaccttggactaatgcagctgaaagtcactcaatgaactcattagtcccttaactacatttgtcattaatcaccaaaacccactagggggattaatacactttcaatctccccctttttgctgattgatgacaacatggttaaagcttacaaaagattgatataaattttgttttaaatagttagaggtgaataaaactcccccttagtgtatgcatatggaagatatgagtgaaactcatatgcatatctataagggagcaactgaggagagtttcgttcatctctacccattcgtgggatgcaaataagcagtaaaagtagacatgatgtgcaaaagatgacatggaaagcactcaaaaaggataaaatcaacatcacatcaaaaacaataaataagacacacatagcataaatgaaaagcagaaaaataaagggcagctaagagcatctaacagacattacattcacacaaatagagaattagaacttgtccatgagttcttaagaataggggccaaaggattgccaggtccggaacttccggataaaataccaggaacttccggacaagctgacatgacaataaggcgagggagctgccaggtccggaacttctggataagaggatccggaacttccggattaaacagacagcaggcagtaagcatcaaaaacaaaattttgacccccttcgattccaattttctccccctttggcatcaaggcaccaaaaagagataaaatcacaagggaagaagagggtcaagcctcatcattatcgccatcagaaggaatgatctcggtgtcgccggagtgaggagagttgatgtcttgcccggcggcgtccactgcctcatcgggatctgtaggaacattcacggtaggggcatctgactcctcaccatcactgctctcctcggagtgagaggactcctcattgaagaaacgagaagtgccagagggaccctcaccactagcaatgtctcgagcagtctcatatgcagcaaaaggatcaacaaactcctcatcatcagaaatatcatagacatccttgcctgctgcaatcctcgagtagtccccaaacaatccttgggagcatccttctcatacataaaggtagtgctggtcggtgacagagcatcctataatatggacgcaaccctcgagtagtccccaaacaatccttgggagcatccttctcatacataaaggtagtgctggtcggtgacagagcatcctctacaaagatatgtggatgactcaggtcatcatcatctaaccccaaagctgcagcaaattgtgccatagaaaccctatactgctgcccctgaatggtccacttcacaaaatcaagccccttcttggtggtgccaaagaatgcagtggagtagagctgtccaatcacttcctcattccaggaatactgcaaggccaacaaatctgccacgtgcttgcgctcacacaccttgcgtacctcattgaagactatgttgttctttgaggacatgtactgccagtctagccacttcatctctaccactggatgagatcttcccatgatcacagagttataccaattaacctgcaccaaggtcctgaatctgtcatcctgagagtctgctggcagagtatcaggactaaccattctgtcgtttccacacttgagtagattcttcagatagttcactcttgggcgtttaggatcaggatcaacagcccttgtcttgtacagcctaaaaggattgcttttagaaccaggctcatcctcattgccaccattatctgactcagatgcagctggagagggagagcggggtgcgtcacgaatgacaatgctaccagccctcctggaatggatcggaatctgactcccactataaaaatctccaactttttctttgcccaatctccccctaggaccacgaaccggggttctcgagtcagcaggaacatcttgagaaagcttctgtctcttctcacgaggcataatgaccactgcaacaagaatcaacaggttggagtgcaatggttaaatgaaacagtagcagaatcaaggttactggttggcgggacagagaccggaagttctgggccaagaacaccggaacttccggcctgcaaaactgaagaacagaggatttaaccaggccagtgcatgtgacaaaatcctatagatcggcaatctacaaggtagcaggaacaattctatccaaaaggttttctccctaggttcacatatttagagatcggggcaaaaacatgatgaaccaaaagagaagatcaaaagtgctaccttgagagggaaaatcgcaaatcgatcgcgggatgaacctcctagccaccaatgtggttgattccacggagaggaatcgaatttccacagttggaatagaaaatcgcccagaggagcactgtagcggcggctagggtttgggaatcggggaggagaagaagtgaggagagagagatcaagctcgggctccccctgggtatttatacccccgacccccggaagttccggattgggatgaccggaacttccggcctgacaaaacagagggcagtcaggcccatgttcaaaggaatagatgagaattcaatgatttagaaatgaaaacctatggacataaagagacttatgatgtatatgaccagccaacaatcaacattacataacaatggtcaatataaatcacaagaagggataaaaaccaaattttcgcaataaaaacacacacaaaaattttcgcaaaatttcacaaaagagtttttggataatagagggaatgtttgagctttattcctggtatcaaaaccatcttctacacaagaagtgatctcaagacacaaaagctctttttttttatttacattttagtgacacatgtttggctatgaattagccaatcacccatcacctaatgatacgagagtctaagatattgagctcacttctaagctcgcaaaatcttttctcatctaaaggcttggtaaaaatgtctcctttagtctcatgatctctcaagaagtggtggcgaatgtctatgtgcttggttcttgagtgttggagaattgttggctattttgatggcactctcattatcacataggagtgggatcttgttgaagttgtagccaaagtcttttagggtttgtctcatccaaaggagttgggcacaacaagaaccggcggctacatattcggcttcggcggtggataaggcagtggaattttgcttcttagaggaccaagaaacaagggaccttacacccggcataatccgaatcggaatagcccaaaagctcaaagccacaacccttagaataacacaagccatgattaggagtgtgaactaaatatcttagaattctcttgacgacaatcaaatgacactctttaggctccacttgaaagcgagcacacatgcaaacactaagcatgatatccggacgagatgcacataagtaaagcaaagatcctatcatggagcgatataccttttggtccacacatttaccattatcatcgaggtctaggtggccattagtaggcatgggtgtcttgataggtttggcatcctccatcccaaacttcttgagtatgtctttcacgtacttggtttgagagatgaaggtgccctcttgtgcttgcttcacttgaagcccgaggaagaaggtcaacttgcccatcatagacatctcgaaccttttagtcatgatactactaaattcttcacaaaaagaggcattagtagaaccaaatattatgtcatcgacataaatttggcatatgtataaatcactcttaaattttttagtgaagagagtagtatccgcctttccaatttcaaagccatttttcaaaagaaaatctcggagacattcataccaagctctaggggcttgtttgagcccgtagagtgccttgtggagcttgtacacatggtttggcaactttggatcctcgaaccccggtggatgctccacatagactaactccgagataggtccattgagaaaggcactcttgacatccatttggaataacctgaaatcatggtgagcggcataggctaaaagaattctaattgactgaaggcgagcgacaggtgcgaaggtttcacaaaaatcgagaccctcgacttgggtgaacccttgcgcaactaaccgggcttttttccttacaaccaccccatgttcatcttgcatgttgcgaaagatccacttggtgccgatgacatcttgcttgggtctctccaccaaagtccacacttgattgcgagtgaagttattcaactcgtcttgcatagccatcacccaatccggatcaccaagcgcatcttccaccctagttggttccaaagaagagacaaacgagaagtgttgacaaaaacatgcgacacgagagcgagtagttaccccttttcttatgtcgccaggtatgttgtcgacgggattatctctttggacagtatgatgtatccttggatggtgcactggggaggacctaagcctgatcagaatgctctaaaatgccctcagcatcgatcccatccacttgtgccgttggcacgtcttcactgccactggtccggaggttccggactgtagaacccggaacttacgggcctggagatgtccggaggttccggtcaataggacccggaacttccggctcagctgacacaacacttgtagggctattggatgtcgatgacggaggttgatccctatcttcttggtcatcctgcgtctcgactggtcgtatgtctccaatagccttagtacctatagcttgatttggatccacaacccctacaacatgtacaacaacttgctctccttgggagccattagattcatcaaacgtcacatccctagtgacttcaacaataccggaggttttgttgaagacacgataggcatgtgcatttgattcatagccaagtaagaatccctcatccaccttaggtgagaacttagatgagcgaggcctcttacttaaaataaaacatttgctcccaaagacacgaaaatacgaaacatcaggcttcttaccactaaagagctcatatgaggttttctttaggatcttgtggaggtacaagcggttaatagcatgacatgcggtactcacagcttccgcccaaaagacatccgaagtcttgtactcatcaagcattgcccttgcggcttcaatgagtggtcggttcttcctctcaacaatgccgttttggggaggatcatagggggcggagaactcgtgcttgattccttcttcatcaagaaattcctccacttgagtgttcttaaactctcctccattgtcacttcgcaccctcttgatagtgagatcatagaggttttgggcttgcttttcgaagcgcttgaagacatcttgagcttcgcttttgtcatggagaaagtacacccaagtgaagcatgaaaaatcatcaacaatgacgaaaccatacttgttacctccaatgcttatgtaggccacgggcccaaataaatccatatgaagaagctagagtggtcttgttgtagtcatgatgttttttataggatgtgaactcccaacttgcttcccggcttggcaagcactacacacacgatctttctcaaaagaaaaattatatagacaaagaatgtgttccccttttagaacagatgccaaattcctcattccaacatgggctagcctacggtgccatagccaacccatagaggatttagcaatcaagcatgcctccggattcactctattcacgtcgaaatcaacgagatagagatcaccctttaacacacccggaatgctatggaagagtcatctcgcctaaaaatggtcacatccacatcggtaaacaagcaattaaatcctaacttacacaattgagacacggataataaattgtagcttaatgaattgacaaggaggacattagatagagattgattcttggaaatgacaatcttaccgagacccattacctttcctttaccatcatctccaaagacaatattttcacgacttccaccctcctcatcaagacttataaacatactcctctctcccgtcatatgattggtgcagccactgtccacaacccaacttgagccaccggagaagtatgcctacaaaagagatcaagcttgggatttaggaacccaaacttgtgtaagtttaggtcccttgatgttagtcaccaaagcctttggcacccacacacaagtgcggtactcatcattgtaattcccaataaaataagcaaccactttgccctctgaatttttggaaattacatatgaatcatagaaaagaccctctggccggaacttcctagcattataaccggaacttccggccagccccttccccctattagaagcccagaacttcctgacaaaatgtccagaacttcctgtcttacaaggcaggaacttccggtcattttgcccggaacttccgggtgtctgaccagtgagggggcaagtccggaacttgcttgtggagcttttccttctgttacaaacatcaagcattcttccccatttaccatcacacgcttagacacagggcttccaccagaaaacccgagcccgtatcaatccttgttaggatgagcggagatggtcttgtaaagggcatcttttgaatggtatgtcttcatgcatccatacttcactaatgtgcccaacctttcattctctttcttatgagcttgcatagcatcaacattagtagcatgagagttcaaatcaatattgtaacacctagcacaaccattgctagtagatgggttggaagaattagaaaccacatttggttgagaagtgctattccaaagagtgtcaaattgaacatcaagatctttatgacttttgtctaaactagcaaacttctcttgaagagtttcattgacatccctaaggctagctagagaaccattagccaaattaagctcattagctagttgttcatttttagcacattctttagctaggctctcgtctaaggcaaggtttcttttcttctcaagaataagtaatttttcatgccttttgagagattgttctttactatccaaagctctcattaacttagccaaatgttgcatagcgggtttgctaaagctctctttgattgcctctttcccttgtcatcatccttcctccctttgccatagtcactcttgcgaagaaagtgcttgaatctcttgacaataaaagtcatttcttcatcttcactttcttcacaacttgactcttcttcttgttttgccttcaaagctacttcttgatttttgatcatggcggcattcttcaccatttgcctcacttcacgagcttcctcttcttgcatctcatgagacacaattcttccaagaatgtcacttggggtgagcctcttgaaatctttcctttcccgtatcattgatacaagagtgggatttcttggaccaaaagcacggagaagtctcttgaccacaaagtgatttgtcatgtcctcactcccaagtcctttaatcttgttaacaaggatcatcatcctatcatacatctcttgtggtgtctccttgtcatccatcacaaatcttccaagccttccttccaataattcaatcttggcctcacgaacggcgggtgatccctcatgagccattgcaaagtatcccatatctcctttgcctcctcaagcccattgtcacaccctgatttttgtttcaggatttataaattatttaataaattattattagaatttatattaaatgttctttaatttacaagtgaagttaaatgtgggaaataaaatttcctaaatataaagcatggatggatttaatttttattaaattctccatgattaagtcaactctctggaattttctcagatgtttcggagctcaattcttaatttttaatcatacaaagagcatttcagtaattacccacatattaaattaatcattaaatggtctaattataattttgttaagtactttgagtgtccaagtattttcaggatttttcttgaaattatttgagcattggaagtatttttaataattcaaagatcatttaagtgattattttaattgggaaagtaataaaatcctcctcctcagcttgggccattttcagcccattccttcctttccttcctctctcttccgccggcccaacctgagccgcctcctctcctctcagctcagccggaaaagtctactttccctccctgcgctactgttcatcttccaactcaggcagagcccgagccagccgtgccgtgcacagtgccgccgcctcttccttccaaatctcgcctccccgttgctctttttctccaattttgttgaggggaaatattcctcttatcctcctctatctttacccccaaaaatcggagcaaatcgttgagtatcttatccgaatcgaactcgttttcgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgccgccgccacatgctccaccccgccgtcgtcgccggccgagctccatccgcgtcgcgccgccgcctccgtcgtccccgccggtcgccgtcatcgccgtgaggtgcgccgaggtgtgggcaagctcggccgctatctccccgaagccgccgaccaccgcagccccgtcgccgccgtcgaccgaagccgcgccgccgctagacctcgtcgccggccgtcgtcgttcgtcgtttggttcgagggtgggtaccgttgggttcgtctcgtcgtcctctacgtgttcatgtcctccaaagtcgcagccgaccatccaatctccggcgaggtcgccatcttggtccggccattgatgacgtcatcatcgtttttctttttcctgttttttctaatagattaaatcttcagaaattcataactaaatcatcgtaactcggttttgagtggttcaagttgctaaattcatctaaaatcatgatctacatgtttgtttactttatatgtactttttatttggtttttattagtctttttcttcgttttgcgtgttagcttgtcgtttccgtcgttgcgaaggttcgtgagtgcgtcggaagtgatcaagaagattacttgaagaccgattattgcaaggcaagtcacacagatcctaaacacaatcctttgagcatgttgatcctatatttaaattctctatttatttcaactgtgcatttattttcgaatgtcatcgggtggtgtgaacttattcctttgttatggccaatttgcattgattactttattccttgataccttgggttattataacttgactagttgggctttatatattggttcagctagatattagttatgattgcttaaccatgcttagaaacattagcacactattgggataacttatgactcactattatttaaggatggcttaatgatagttcacgatggttaatcgtgattggttaattaattacttgccaactaaaacttgataatggtgggttgtgagcacatggttttgagagtcgtgctcatgacaattaaggaccggttcgcgagctactgttgtgaaacatttatcgtgccaaccacaagccagcgtgggcaacggctttatcttttgtgtagcgtgattcattatagtgcgccagactgagaagtggcgagaagtccacgggggtcgctggggagtccatgccttgtttataagggggtgattatgatccaggaaaggtgcgctgtaatgggttatgttgtgcaaggggtattgtcacaactcctttccgaggtaccgtggtggtactgaggcacatggtgacatgatgtggagttgtgtcttgtgggtacaatggtacacctctggccagagtaaaactattcgaatagccgtgcccgcggttatgggcgggttgagcaatgcttttcgtgattagtctcacacctctcacaataattatggatgttaatacctgataataatttgcttagctcctggtttggagttagatctgtacagccggatatggttgttcaggatggttgggcctgtgcagcatgggtgtgctgttcagtgttgattaaaatttttaattaattactctactgttttactactcttaactctttgctaaatgctgctttcgcaaatgagtctatattatgccatcctttggtatccttgtgcacttgcatatttgctgtgtggcttgttgagtatgtcatatgctcattcttgcaataatcatcaaacctcagttgaagataaaggatccagaaggagaagacgtttggcttataccccagttgagttgcctatgggagtggagctgaagccatcgctagaccgttaattccgttgctgttttcttttctttgtaagtatgtaacgttattattaagatggatttgtatattaaattgtcagtttgtgtacctcggctgattcctggacgaggattttatgcacaaattagttcggaaattactagtgaatttccgggcgtgacacccatcaaccttgttgaacacctccggacttaaggcggagagaattgcattggaagcttaagcattgcggtggatgagttgctcttgctccgaagtgagcttcatgtcatcatagggtacatcaacacctgtacaaacaactttccaaatacttggatgcaaagagattagatgcaacttcatcttgtgcttccaagcggcgtaatgcgtcccatcaaattgaggagcacgcccggaaggcacggagacaaagttgtgagagggaatagtaagtttgctgtaatcaaaaggtatagtagctcccttgggtgatggagtttccttgctgctcactccatcttcatttccattttccccgttctttcaccctaagtccgacatcgtggatcactcaaagcagtgaagcttgaatcaagagcaccttgctctgataccaattgaacgtgctgatgaagcctagaggggggtgaataggctgtccctgaaaccttaaaaacaaatcgcagcggtaaaattcaaacagacctggaacttcctggtaaggaactccgaaacttccggcctgccaggcccggaacttccggtgttctaagacaggaacttccgggtaacaaaacagagatgaaattcaaattttgaaacagtagactaagccaatcttcacaagatggtgcacaggtattctaagcagaggatatatcacagaatcatacacagaaacatcacagaaagagacaagagcaattttttcccgaagttcggatcttgcgatcctactctccgttgaggagctccaaagagctgggtctcgattaacccctttcctcacttgtgcaaaaaccccaaaggaaatccacagccttcaaccccaaacacccctaggcaaatttctagaattgagtgaccaccaagatccaactcaacctacttctagaaatccaccacaagtgtgggttgctctacttggaaagcctctagaatctcagcacaagaacttcactaacttacctagttccctttcggaggagaggaaatccttcagaaactttcccgggaaatccgcaatatgcaacggattctcgcgggcgacacctaaccatctaggagatcatctccaagagtaataagcaccgtgatgacaacccacgagataattccaagtgctcacccaagatcctagtcttcacacatctccaaatcttcttctctccctctcaatctctctttctcacaagaattaggctctagattgagtggagaaggcaagaaacacttgggaggggctagcaatagctctaggtttgaaaagtaaaagtggaatagacaaggaacgagctagaaacgagctgtatatgtataacggctaggtgacgtcatctagccgttactcacaaatttgaactggaaactagacaggaagttccggacctagaagaccggaacttccggactacacttaggaaaaactttttcacaagaccggaacttccggacctggaagacaggaagttccggacttgcatttttggacagatggagtatttgcaaaaatgactcctagggaaacttgacacttggctcacactaagagcacttgacatatctctgagcatcacctggaacccctcttaatagtatggtttttcctaaaaactcgattgcaataaataaactatcctatgcacttctcgagttctggtccgcttgattttatacttttgagggggtctccaagcatccatcttccacaccttggactaatgcagctgaaagtcactcaatgaactcattagtcccttaactacatttgtcattaatcaccaaaacccactagggagattaatgcactttcaccgtttgcctgagccgagagagagagagagggacgacgatgacgacgtaggccgcatcctccaatgccctcctcggcgccgcccgtcgctcgccgtgccattcctgcactctgccgtcgccccccgcatgccgaccgcctgtccacgcgccactgccgccgcccactacccgtcgacacacgcctgagagagagaagggggagggtgaagagagataatgacaggtgggccctatattttcttttatttttttgttgattgaatttccacatcagcgacacgtgtatgccacgtaggagaaaaaccgcttaggaatgattcgggggggggggtaattcttccggtatcaatagttcgaggtgtaatatgtctgtttttgtggttcgggggagggggtaattcatactgccacagtagtttgggggggataattcgtactttttccttccctataataccacggctaaggcgtttgttcaggaacaagggaaatgctagaatgatgcgatggcacgctgaagaacgtcaacaggacgggatgctgagacaccccgccgatggttcgcagtggcgaaacattgacagaaattttaaagactttggaaaggacgcacgaaacatacggtttggtttaagtacggatgacatgaatccttttggagagatgagcagcggccatagaacttggcccgttacgatgtgtatctacaacctccccccttggctatgtatgaagaggaagtacataatgatgtcgattattattcgaggccccaagcaacctggtaacgacatcgatgtgtacctaagaccactggtcgaagatcttaaactgttgtggaaaaaggaaggtgtccccgtgtgggacgaggacaaacaggaggagtttaacctacgagcgctgatgttcgtaaccatcaacgattggcctgcacttagcaacctttccgggcagtccatcaaggggtacaaggcttgcactcactgtatggatgaaacagaaagtacgtatcttaagcactgtaggaaggttgtgtacatgggtcatcgtcgattccttgctgcaaaccacccggtacggaagaaaggcaaacactttgaacataaggtggaccaccgtacgaagcctaaacatcgcagcgggaaaacagtgtttgctatggttaaagatcttaaagtagtgtttggaaaggggccacgacgcaacgccaccgccgcgacacgccaccgccgcgccgcaatgccgccaccgcgccacgccgcagccgcgccgccacgccgccgctccactgccgccacgtgaacgtaacatgaacttaacgagaacgaacgtgaacaaacgtacgtggacagacgtgaacgaacgaacgtacgtgaacgaaacgtgaacttaacgagaacgcgaacgtgaacgaaacgtgaacttaacgagaacgcgaacggtaacaaacgtgaacgaaatgcgaacgtgaatgaacatgaacgaacgtgaatgaaacgcgaacgaacgtgaacgaaacgcgaatgaaacgtgaacgaacgtgaatgaaacgtgaacgaaacgtttaacgaacgtgaacgaaacgttaacgaaagtgaacgaaacgtgaatgaaacgtgaacgaacgtgaatgaaacatgaacggtcgccttatatgacactacgtgaaatacaatatatgttactttgcgtttagactaatacatttttttgtatgttgcagaaaagacgtcgtcgttgtcgtccctcaagcctgagtggtagctagccctcgaaggaattcgcaggcaagtgatgtaaatatatgattgttagatttttaatataatatcctacaggtccggaacttcctgtctagtctccagttcaaatttgtgagtaacagctagatgacgtcacctagccgttatacatatacagctcgtttccagctcgttctttggccattccactttcacttttcaaacctagagctgttgctagactctcacaagtgtttcttgccttctccactcaatctagagcctaattcttgtgagaaagagagattgagagggagagaagaagatctggagaggagtgaagactaggatcttggatgagctcttgggatatctcaagggctgtcatctcggtgcttattactcttggagatgatctcctagacggttaggtgttgcccgcgagaatccgttgaatattgtggatgtcccgggtaagtttgtgaaggatctcctctcctctgaaagggaacgaggtaagtgaatgaagttcttgtgctgagattctagaggttttccaagtagagcaacctacaattgtggtggatttctagaagtaggttgagttggatcttggtggacactcaattctagaaatttgcctaggagtgtttggggttgaaggctgtggatttcctctggggtttttgcacaagtgaggcaaggggttaatcgagacccagctccttggagcccctcaacggagagtaggatcgcaagatccgagcttcgggaaaaaatcgctcttgtctctttctgtggatgattctgtgatctatcgtctgcttagaatacctgtgcaccatcttgtgaagattggcttagtctcctatttcgaaatttgaatttcatctctgttctgttacccggaagttcctgtcctagaataccggaagttctgggcctggcaggccggaagtttcggagttccttaccaggaagttcccggtctgcttgaattttacagctgcgattggtttttaagtatccagagacagcctattcacccccccctctaggcttcatcagcgcgttcaattggtatcagagcagggtgctcttgattcaagcttcaccgctttgagtgatccacgatgtcggacttagtggaaaaaaacggggaaaatggaaatcaagatggagcgagcagcaagggaacttcaccacccaagggagctactataccttttgattacaacaaacttaccattccctctcacaacttcgtctccgtgccttccgggcgtgctcctcgatttgatgggacacattacgccgcttggaagcacaagatgaagttgcatctaatctctttgcatccaagtatttggaaagttgtttgtacaggtattgatgtacctcatgatgacatggagctcacttcggagcaagagcaactcatccaccgcaatgctcaagcttccaatgcaattctctccgcgttgagtccggaggagttcaacaaggttgatggacttgaggaggccaaggagatatgggatactttgcaattagctcatgagggatcacccgccgttcgtgaggccaagattgaattattggaaggaagggttggaagatttgtgatggatgacaaggagacaccacaagagatgtatgataggatgatgatccttgtcaacaagattaaaggacttgggagtgaggacatgacaaatcactttgttgtcaagagacttctccgtgcatttggtccaagaaatccctctcttgtatcaatgatacgggaaaggaaagacttcaagaggctcactccaagtgacattcttggaagaattgtgtctcatgagatgcaagaagaggaagctcgtcaagtgagccaaatagtgaagaatgtcgccatgatcaaaaatcaagaagtagctttgaaggcaaaacaagaagaagagtcaagttgtgaagaaagtgaagatgaagaaatggcttttattgtcaagagattcaagcactttcttcgcaagaggggctatggcaaagggaggaaggatgatgacaagggaaagaggcaatcaaagagagcttgcttcaattgtggcgaatatggccacttcattaacgattgtcccaagtgaaatgaagctaaggctaagggatgcaagaagaagccgaagcgtgctcatgtggcggaggcacacatggcggaggtgtggtactccggagatgaagaagattccgaggtcaagcccaagcctaagccaaaagacaaggttgaaggagaaggtggtgttgctaccgtcgccttcaagtcatcctcttcaagcaaggagcgtctcttcaacaacttgagtgatgacgatgacgactcctaccactactcatgttccatggcccaacgccgcaaggtgatggctcaaaagcccctctcacacctctcttgatgttgattctagtgatgaggaaagtgataatgaattagatgatgtgcttaagagctttagcaaacccgctatgcaacatttggctaagttaatgagagctttggatagtaaagaacaatcactcgaaaggcaagaagaattgtttattcttgagaagaaaagaaacattgccttagaggagagcctagctaaagaatgtgctaaaaatgaacaactagctaatgagcttaatttggctaatggttctctagctagccttagggatgtcaatgaaactcttcaagagaaatttgctaatttagacaaaagtcataaagatcttgaagttcaatttgacactctttggaatagctcttctcaaccaaatgtgttttctaattcttctaagccatctactagcaatggttgtgctaggtgttacaacattgatttgaactctaatgctactaatgttgatgctatgtaagctcttaagaaagagaatgagaggttgggcactttggtgaaatatggatgcatgaagacataccattcaaaggatgccatttacaagaccatcactgctcatcctaacaaggatggacacgggctcgggttttctagtggaagtcctgtgtctaagcgtgtgatggtaaatggaaaagaatgcttgatgtttgtgagagaaggtaaagctccacaagaaagtgaggtgacttgccccttcactagtcagacacccagaagttccaagcaaaatgaccggaagttcctgccctgtaagacagaaagttacggaccttttgtcaggaagttccgggcttctgataggccaaaggggatgaccggaagttctgggtaaaataccaggaagttccggccagagggtctttactatgattcatatgtaatttcaaaaaattcagagggcaaagtggttgcttattttattgggaattacaatgatgagtaccgcacttgtgtgtgggtgccatagacaaacatcaagggacccaaacttagacaagtttgggttcctaaatcccaagcttgatttattttgtagacatactcctccggtggctcaagttgggttgtggacagtggctgcaccaatcatatgacaggagagaggagtatgtttacaagtcttgatgaggagggtggaagtcgtgaaaatattgtctttggagatgatggtaagggaaaggtaatgggtctcggtaagattgccatttccaagaatcaatctctatctaatgtcctccttgtcaattcattaagctacaatttattatccgtgtttcaattgtataagttaggatttaattgcttgtttaccgatgtggatgtgaccgtttttaggcgagatgactcttccgtagcattcaagggtgtgttaaagggtgatctctatctcgttgatttcgacatagatagagtgaatccagaggcatgcttgattgctaaatcctctatgggttggctatggcaccgtaggctagcccatgttggaatgaggaatttggcatctcttctaaaaggggaacacattcttggtttatctaatgtttcttttgagaaggatcgtgtgtgtagtgcttgccaagccgggaagcaagttgggagtccgcatcctataaaaaacatcatgactacaacaagaccactcgagcttcttcatatggacttatttgggccagtggcctacataagcattggaggtaacaagtatggttttatcattgttgatgatttttcacgcttcacttgggtgtactttctccatgacaaaagcgaagctcaagatgtcttcaagcgcttcgcaaagcaagcccaaaacctctatgatctcactatcaagagggtgcgaagtgacaatggaggagagtttaagaacactcaagtggaggaatttcttgatgaagaaggaatcaagcacgagttctccgccccctatgatcctccccaaaatggcattgttgaaaggaagaaccgaaccctcattgaagccgcaagggcaatgattgatgagtacaagatttcggatgtcttttgggcataagccgtgagtaccgcatgtcatgccatcaaccgcttgtaccaccacaagattctaaagaaaacttcatatgagcttttgagtggtaagaaacctaatgtttcatattttcatgtctttgggagcaaatgctttattttgagtaagaggcctcgctcatctcagttctcacctaaggtggatgagggattcttacttggctatgaatcaaatgcacatgcctatcgtgtcttcaacaaaacctccggtattgttgaagtcactagggatgtgacatttgatgaatctaatggcttccaaggagagcaagttgttgtacatgttgtaggtgatgtggatccaagtcaagctataggtactaaggctattggagacatacgaccagtcaagacgcaggatgactaagaagatagggatcaacctccgtcatcgacatccaatagccctacaagtgctatgtctgctgagccggaagtttcgggtcctattgaccggaacctccggacatctccaggcccggaagttccaggttctacagtccggaacctccggaccagtggcagtgaagacgtgccaacggtgcaagtggatgggatcgatgctgcgagcactttagagcatactgatcaggctcaggtcccccctgtgcaccatccaaggatacatcacactgtccaaagagatcatcccgtcgacaacatacttagtgacataaaaaaaggggtaactactcgctctcgtgtcgcaagtttttgtcaacacttctcgtttgtctctcttctttggaaccaaccagggtggaagatgcgcttggtgatccggattgggtgatggctatgcaagaggagttgaataacttcactcgcaatcaagtgtgaactttggtggagagacccaagcaaaatgtcatcggcaccaagtggatctttcgcaacaagcaagatgaacatggggtgattgtaaggaacaaagcccggttagttgcgcaagggttcacccaagtcgagggtctcgattttggtgaaaccttcgcacctgtcgctcgccttgagtcaattaggattcttttagcctataccgctcaccatgatttcaggttattccaaatggatgtcaagagtgcctttctcaatggacctatctcggagttagtctatgtggagcaaccaccggggttcgaggatccaaagttgccaaaccatgtgtacaagctccacaaggcgctctatgggctcaaacaagcccctagagcttggtatgaatgtctccgagattttattttgaaaaatgtttttgaaattggaaaggcggatactactctcttcactaaaaaatttaagagtgatttattcatatccaaatttttgtcgatgacataatatttggttctactaatgcctctttttgtgaagaatttagtagtatcatgactaaaaggttcgagatgtctatgatgggcgagttgaccttcttcctcgggctacaagtgaagcaagcactagagggcaccttcatctctcaaaccaagtacgtgaaagacatactcaagaagtttgggatggaggatgccaaacctatcaagacgcccatgcctactaatggacacctagacctcgaccataatggtaaatgtgtagaccaaaaggtatatcgctccatgagaggatctttgctttacttatgtgcatctcgtcccgatatcatgcttagtgtttgcatgtgtgcctgttttcaagcggagcctaaagagtgtcatttgattgccgtcaagagaattctaagatatttagttcatactcctaatctttgcttgtggtatcctaagggttgtggctttgagcttttgggctattctgattcggattatgccaagtgtaaggttgatagaaaaagcacaactgggacttgccaatttcttgggcggtcccttgttttttggtcctccaagaagcaaaattcctttggataacaaactctaaaagacttttgctacaacttcaccaagatcccactcctatgtgacaatgagagtgccatcaacatagccaataatcccgttcaacactcaagaaccaagcacatagatattcgccaccacttcttgagagatcatgagactaaaggagacatttgccttacccatgtgagaaccgaaacccaattaaccgacatttttaccaagcctttagatgagaaaagattttgcgagcttaggagtgagctcaatatcttagactctcgtaacattaggtgatgggtggttggctaattcatagccaaacatgtatcactaaaatgtaaattaaaaaaaaagagcttttgtgtcttgagatcacttcttgtgtagaagatggccttgatactaggaataaagctcaaacattccctctcttatccaaaaatccttttgtgaaaatttgcgaaaatttcttgtgtgtgtttttattgcgaaaatttggtttttatcctcttcttgtgatgtatattgaccattgttatgtaatgttgattgttggctggtcatatgcatcataagtctctttatgtccataggtttctttttctaaatcgttgaattctcatctattcctttgaacttgggcctgactgccctttgttctgtcaggccggaagttccggtcatcccagtccggaacttccgggggtcggggatataaatacccagggagacccgagtctgttctctctctccttacttcttctcctccccgattcccaaaccctagctgccgctacagtgctcctctcggcgaatttctcttccaaccgtggaaatttgattcctctccgtggaatcaaccacattggtggctagaaggttcatcccgcgatcgatttgcaatttcctctctcaaggtagcacttttgatcttctcttttggttcatcatgtttttgccccgatctctaaatatgtgaacctagggagaaaaccttttggatagaatttttcctgctaccttgtagattgccgatctataggattttgtcacatgcacaggcctgtttgaatccactgttcttcagttttgcaggccggaagttccggtgttcttggcccggaacttctggtctctgtccagctagccagcaaaccttgattcctctatttttccttttaaccattgcactccaaccttgttgattcttgttgcaatggtcagcatgcctcgtgagaagagacagaagctttctcaggatgttccagctgactcgagtcccccggttcgtggtcttagggggagattgggcaaagaaaaaattggagatttttatagtgggtgtcagattccgatccattctaggagggctggtagcattgtcattcgtgaggcaccccgctctccctctctagctgcatctgagtcagataatggtggcaattagaatgagcctggttttgagagcaatcctttgaggttttacaagtcaagggctgttgatcctgatcctagacacccaagagtgaactatctgaagaatctgctcaagtgtggaaaggacagaatggtgagtcctgatactttgcctactaactctcaggatgacagattcaggaccttggtgcaggttgactggtataattctgtgatcatgggaagatctcatccagttgtagatatgaagtggctagactggcaatacatgtcctcaaagaacaacttagttttcaatgaggtgcgcaaggtgtgtgagcgcaagcacatggcagatttgttggccttgcagtattcctggaatgaggaagtgattggatagttctactccactactttctttggcaccaccaagaaggggcttaattttgtgaagtggaccattcaggggcagcagtatagggtctctgtggcatagtttgctgcagctttggggttagatgatgatgacttgagtcgtccacatatctttgtagaggatgctctgtcaccgaccagcactactttcttgtatgagaaggatgcttccaaggattgtttggggactacttgtgggttgcgtccatactatagagtgttgtactctatcttcaggtggtctttgctccccaaagtgggagatgctacagcccttccaggtaggcatgtgctcctcctcagtcgcatgcgctacaacaagccagatttcagcatcatgaagcttatctggagtgagatctatgagatagtgtgtgagccaaagaggggctgcatctatgctccttatataatgaagatgatagaggaaaagactgggatttgttatttcatggaaaatcaacacaagcatttccgtccttatgctcccactacttcagctactccttcttccagggtgactcgtgcttccacctcagctgctccttcttcctctgctgcaccttagcgttctgagtcttcttctcccataaagatggctctccgggctatcttttgtatgtctgctaagactgctaagaaggtaaagaagatagagaggcgtcagaaggaagattggattgcagcaggcaaggatgtctctgatatttctgatgattaggagtttgttgatccttttgctgcttatgagactgctcgagtcattgttagtggtgagggtccttctggcacttctcatttctttaatgaggagtcctctcactccgaggagagcagcgatgatgaggagtcggatgcccctactgagaatgttcctacagatcccaatgaggcagtggacgccgccgggcaagacatcgactctcctcactccggcgacaccgagatcattccttctgatggcgatgatgaggcttgatcatcttcttcccttgtgattttgtctctttttggtgccttgatgccaaagggggagaaaattgcaatcgaagggggtcaaaattttgtttttgctgcttgctgcctgctctgtctgtttatccggatgttccggatcctcttatccggaagttccggacctggcagctcccttgctatttttgcctgtcagcttgtccggaagttccgggtattttatccagaagtttcggacctggtagttctttggcctctactcgtttggacttatggacatgtaataattctctatttgtgtggatgtaataactgttagatgctcttagctgctctttatatttattgcattttatttatgctttgagtgtcttatttgttgtttgtgatgtgatgttgattttatcctcttgagtgctcattatgtcatatcatttgcatatcatatctattcttctgcttatttgcatcccatgtaataattctctatttgagcctcattcatatcttccatatgcatacacaaaggggagtttcattcatctctaaccattcaaaatcaaaattctgatcaatctttttgtaagctttaaccatgttgcaatcaatcacaaaaaagggggagattgaaagtgcattaatccccctagtgggttttggtgattaatgacaaatgtggttaagggactaatgagtttattgagcaactttcaggtgcattagtccaaggtgtggaagatggatgcttggagacccccccaaaagtataagatcaaagcggaccggaactcaagaagtgcataggatagtttatttattgcaatcgagtttttaggaaaaaaccatactattaagaggggttccaggtgatgctctgagatatctcaagtgctcttagtgtgaaccaagtttcaaatttccctaggagtcatatttgcaaatactccatctgtccagaactgcaagtccggaacttcctctcgtctaggtccggaaattccggtcttgtgaataagattttcctaagtatagtccggaagttcctgtcctacaggtccggaacttcctatctagtctccagttcaaatttgtgagcaacggctagatgacgtcacctagccgttatacatatacagctcatttccagctcattctttggccattccactttcacttttcaaacctagagctgttgctagcctctcccaagtgtttcttgccttctccactcaatctagagcctaattcttgtgagaaagagagattgagagggagagaagaagatctggaaaggtgtgaagactaggatcttggatgagctcttgggatatctcaagagctgtcatctcggtgcttattactcttggagatgatctcctagacggttaggtgttgcccgcgagaatccgttgaatattgtggatgtcccgggtaagtttgtgaaggatctcctctcctctgaaagggaacgaggtaagtgaatgaagttcttgtgctgagattctagaggttttccaagtagagcaacctacaattgtggtggatttctagaagtaggttgagttggatcttggtggacactcaattctagaaatttgcctaggagtgtttggggttgaaggctgtggatttcctctggggtttttgcacaagtgaggcaaggggttaatcgagacccagctccttggagcccctcaacggagagtaggatcgcaagatccgagcttcgggaaaaaatcgctcttgtctctttctgtggatgattctgtgatctatcgtctgcttagaatacctgtgcaccatcttgtgaagattggcttagtctcctatttcgaaatttgaatttcatctctgttctgttacccggaagttcctgtcctagaataccggaagttctgggcctggcaggccggaagtttcggagttccttaccaggaagttccgggtctgcttgaattttaccgctgcgatttgtttttcagtttctagggacagcctattcaccccccctctaggcttcatcagcgcgttcaggtcccaggatccccaaccgtacattcctcctacaatggtcagccctttaggcaatcgtagcagttgcgcctcaacggggcaggtaggatcacagagcatagacgccatgcaaacccaggatgaaaccacctgccccgttgatgacatgactcagcggacaccatgtgagctgcatattcccttcaagaacttatcaataaaggtaagctcatagtttttagattttagacttgtccattccgcaagttgctgcttatatatgttgattactaataaataacctctcacaacgtgaaggtggcgtcgggcatggccatcccaacggacccttcagggacttaccactacaggccgattccagcaggatactccaaggtcaaagttgagtttgtggaagccacgtacgaggacctcgacttggactacgctggaggagacggtgagacgcatctacgagacacaagccatgccattatactatggcgcaagtagtacaccatcctccttgggcaacaagcggcgtctcgtgcaccatctcctccggctccgccatctcctcctcaggctcctacaccgtctcctcctcatgctccagcaccgtctccacctcaggcttctgcaccgactcctcctcaggctcctacaccgactcctccgcaagctcctcgtccggcattttccaagtcaagggcaacgaagggcaacgaagaaggcgaaagttgacaccgccaaaaacaaggacccagggtacgattgcacgcaagaggagcttgacgcttatgtggcatcaaaagtcagcagacaattgaagcctcgaagtctagaaaagaagattcctatagactcaagtgtcaggaacttcttcaggggtatgtctgcacttgccaaggaggccataaagctatcggactatgagcgagcacttaataaagcatcttctggaaactccaaaccagtcccttagcttggagagcaaccaaaccaggagatcgaaccgttggtgaccggtgaagaatttggaatacaagattttattaatgacaccgggctaactagggatcaattgctacgaggcgcaccaatcaaaaaggcggaagtgaaatacatgtacgaacccggtaaaccgcttgtcaagcctgagcaactgcagtccctaccgacacaaatgtacaaattccatcaactgtacatggagatgagcaccaccggtagagagataatcggagcgaggatcagggacacggacttcttgcaaggagaagatattctctgaatcaatttcaagggtatctacgaactataccagctggacgccctcgacgtctctattatgagttgttagactttgtaagtatcgttcagttagatttcttattacatttcctttaattaattaggtccttatatataagtacacaatatataatatatactaccttttatctttgtagaatggagattcaaacagcccgacggcggggggttttcgatactggattcatcgaccctcgtaaagtaaacgtcgaaatgatcaccaagtatccgcaagccacagaggacaatctcgtccatctcctgaaggcgcagcattacaagacattcatactattgtcgtacaacatagagtaagtttttactatcttcctaccaaatttcattcccgtacgaacatgctaagtgtttcatatgtaatacatccgacgcacattgcagattccactgggtccttttactcttcgacttggaggcctgcgtagtcaacgtatatgactcaatggataaaaaagagtctacgtttgaccaggtttttgaacttatagacaggtactgtcataagttccaatgttaattacgaatcttgttataattaattgctactacgaatcatagctttaaactccatgtagggcttggtatcggttccgtcatttggtccgcggcaactgaagaccaagacttaggcggaagtttaaatttcatgtgagtacaaatgctctacatttatattgaatctccaattcaaatacaagtgtatatatattaattagatctctcgctgtttgtcatgtatatatagtgcgcaaagcaagcccagggaactaacttgtgcagctacttcgtgtgcgagtattgccactgccttgcaaaccaaatcatcaacacaacagagcttgatgtacgtacaaataaattgaaaatttcattgcgtacgtatcgatttgttgttcactaattaatttcatacattcataggttattcgcatgtgggataacctcacacacaaggaatttatcacggcggttcaagaacaactcatgggattcatcaacgaacaaatccttgatcccgagggtgaattctactgcgacggaaatacaattcataggtcgtttctgagataacgactactactacatcgaagtctgtcacgccctaaaaatcgcctaaattaaaaatgcatattttaaatcatttttagaaattattttaaaagcctacaagttaaactctaataatctaggaaaaatttcaacataaaattgagctagataaaattttattaaatactttgcttgttcctctattttctagatttttctgggaattatttgagcaagggaagtatttttaataaatgaaacaacatttcacgaattattaccaacattccccctccccgcgcgctccaaagccggcccacgccggcccaacccgccccgccgccgcccccgagcccgagccgccgccatgctccatcaaatccgccccaatccgtccccctcgagtccgattgattgaggagttttgatcccctcatcctcctctatctttaccccaaaaaatcggagcaaaccgttgagtattctaaccgaatcgaattcattttcgaatttatccccaaaaccgaatttcgattttcttggatcgatttcttgcggtgggaatccgatctcttcaatccaaggctataaatagcaccctagttgtcctcttttgtttgccccctttcccgagctctctagtgcgccgtagagtcgccgccgcgtcgctttagccaccggcgtcgccggccaaccaccagccgcgccgcgccgtcgccctagccgttgccgctgccacctctcgccgccgtcgggtgcgcgtgaccgagggctagcccggccgccccctccccgtcgtcgccggccaccggaggaccgccgccactgtagtccgagtcgccgccgccgcccctctcgtcgccggccgtcgtcggtcgccgttcgtcgtttcggtgagcaccattgggttcgtaccgttgccctctacgtgtaggtgtcctccaaaaccccggccgatcatcctagctccggcgaggccgccgtccgagccaagccgctattgatgacgtcatgctgacgtcataatcctttctttttcagttttttaatagatgaaatagattaaaacttcggaaaatcataaataattcatcgtagctccgattcgagtggttcaagttgataattttttctaaaatcgagatctacatgttaaaaatatcgacatgtactgtttatgcttgtttttgtactgttttgttgatttttggttatttgctttagtttccgacgttccggaggagagcgtttcagttgaggaaggttcggaggtttttgtggaagcccaaggcaggcaagtcacacagatcctaaacagccctttgagcatgttgaacccgtttaaagctattgttttatttcaacctatgtattattttcaaatgtcatcgggtggtgaaccttttccaattaattaatggccgaagatgactttattttcgtatgggttataatttgattagcatgaaccttatatattggattggttcagctaaatgccatatgtatgtttgcttagtcatgcttagaaacattagctaattaaagaggaataaatataaattatattatattattattattaattatggttaaatttaatggtagctcacgatggttaatcgtgttactgttatgaaacatttatcgtgccaaccacaagccagcatgggcaacggctttatcttttgtatagcatgattcattatagtgtgccagactgtgaagtagcgagaagtccgtgggggtcgctggggagtccattgcctctggttttgacggggagattatgatccaggaacggtgcaccatggtgagttgtgttgtgcaaggggtattgtcacaattcctttccaaggtaccgtggtggtactgaggctcatggtgacatgttgtgggattgtgtcttgtgggtacagtggtacacctctgatcagagtaaaactattcgaatagccatgcccgcgattatgggtgagttgagcaatgtttttcgtgattagtctcacattattcattaatggtaattgtgataattaatttgactcctggtttggaatggtatattcctggtatggaggtttgatttgtacaaccagggttggttgttcaaatgaggtagggcctatgcaacacgggtgtgttgtatagtgtttatttaatactgattaattattcaactgttttactattctcttaaatatttattaaatgatgtttatgcaaataagctatattatgccatcctttgttatcctgtgcacttgcatatttgctgtgtggcttgttgagtatgtcatatgctcattcttgcaatattcattcatcagaggaggagtacttcagtgaagctgatgatctggaggattaggcttgttccgggttgagatgcctatggagtggagtcgccatagctgttctgtagtttgttttagtttatttttttccgctgcgtagaatgttattctttgagaggaactatccacctctgtaataatttattatttgcgaatgttaaataggcatttatttgtactctattatcaatttgttattgtgtgcctcggctgattcctggacgagggtttaacactcatgtaagcgtttggaattttggatagaaattccgggcgtgacaaagtcgtagctagctaggacatcataatgaattgtaattaatacatgtctatttttctatatgcatgtacacatttactttagtgtaaatatatattttggtcatatatatatgcacataaaatgttaagtgctttaatatatatatatacatatgcatttgcataacatatatgtataaatacatatatattatgcatgtatatgtattgaaacatatataaatataatatatatatatatatatatatataaaccatgctgcaatatggccatgcaaataataaaaaggtcagctcgatctttggtcccggttggtaacactaaccgggatggtggttggtgttactaaccaggactaaagatcgatctttagtcccagttatttcacccgggactaaagatagagatcgtctcggattggtaaccgggactaaaggggggttatgaaccgggactacaaacggtttcttcaccagtgattgcaattaccagaccgagatataatgtcagatgcactagcagacctggctattgagcttgatctccctgccaaatccgacataatggtcatcattaacaagatgttgctaccatccactggtctgtatatcaggcccaaggacgcatggattggatctgatcttcaaaaggtagcaaggatcaattggtcgaaggctgtttttgatgccctccgcgacaacgttattctacggcacaagaacaaaacaggcccaaggcagcagacatatatacaccgccgcattacattccttgtggtaagcatcccttatttacccaaccattccatttccaatgcagctttaattttctaatgttattgtcacccttctctatacagctgttgtacatcaataacctcaaggtgccaaaggattcattgacagttgatcactgccaaactcctcgcatacagctctacaccaagcagcttgtggaggatatttcgcaggaggatcgtgtcaccgattcatctggaaactatgtgtttggcaacctccctgtgagccctatgtcaatattgcattatatttatctgtttgcaatatagggaagagcctgtcatctatctgaactgaaatgcactgcttttttattgcagatgaatggtattcttggtttatgctatagccaccctgactatgacaaggaaaaagaaccacgtggggacaattccggcactccctttgctgacgagttggtttcgacggtagaaatttctttccccagcatgtttgacagtgtaggtccccatttaagtggtctccaagatgagcacaagcagcgtgtactggatgctcttggtgaatatgatcaccagtcaaagttaagtgcagatgctattgccaaacaaattaggctggttcagacatgccatgcgcgtgtcagcgaccatatcatcagcatcatcaggggtgaaagccgcactcaaccaccaccggatccacaaccacaaccagcctcacattcacaaccagacaaccaacacggcccagttgcatcgcaaaccagtgaggaagcacaagaccaccacactcacagcaccccggacatttcgcctaccaactccccagcacttcagccttccaggatcataacaccagatgctgcgttgaatgcgacaccacagatcacatccactgaaccacaccctcatttaccaggggagctgtttccgaccatggacaagactgccactggagatgaaactcaagcccacactcctcagccagatgcggattttcaacgtggcggcgatgttggtattccactgcaaggaactaattttaataccccttctttacacacacaacgagctgtgcacaaactcactgtatttatttttcggtcctactcttacctgttatagttttatttgtgtaaacattagtcagcatcctcaatcattcgcaaggtgtaatgccttcgctcgctgttatgcaatgttcttctagtaattcatttggtggcccctcaattattattctttatacaacatttaccttcagtacaaaacattattgccacacactttaatatttctgtaacaacaatatctgttgccaataggaagacctgtgctaataacaatgattacaactgacatctacatttatccgttgccccaggaattattgctattaccatgactttcgagggcacatacacaacccaatcccatactgcagatggtattgaacggcaccacgatctgccagatgcggatgttgaacatggcattgagaccgacatctccatgcaaggttgtctgcgtttccagtttttctttcccactgcataactttcgcaaccatgtggcactatactcattttttttgcaaagtatagtcataatcatatccagcgttgctatatttctgttttctatgcatacctcccatctaattagcaattatcttactaactgatacacttgtgatgtgagcaatgcaattactaccatggattcttttgccaaactacaaaattgcctcatagtaatacccttactacctgcacaatactcacactgaacctctatagccctacctgcagtaccatccaattttagcaacccatttactacaagctcattacatttatcttgtatatcagtttcccgtatatatgaacattaatcaaagtccttactaataatttcatcaatgtacttagctttgtctacttagtaaaatttcctttaaatgtattagtgacacctttacccctactctatcgctgcaaccatgtgcaataacgtttaccaataggattacttacttgtgccataccacaggaaatactgcaattgacgtgactaccgagggcacaaacacagccaaatcgcactctggatatcaaattgatgggcaccaccatcatccagatgcggatgttgaacacagcagcgatattgacatccccacgcaaggttttctgctcatccagttcatttgctttacactattgtcacgaccggaaataacccaacgggcgttccttacgtgcgtgcattaatccttgtcccaggaggcaaggtacaccaaaagttgatacaattcagagtttaacaagcggaagcgtaaatagctaatttattacatgggcagcgaaggcccagcacacacaaagacaaacgagaaacaacggaagactagggcgacgaccacaggcacttgacggcaggcacgagctagacaccaaagccttcatcctccaggaactcctcttctgggtttgggaaaaattgagcaagactgagtacaaccaccgtactcaacaagacacacccacaagtgcagaataaatgcaagggagtacaaaggagttatactataaagggttagggttgcagtaaacagcatttaaagacattagttgctcaaagctattttgtaagacattagattctagaactatacaattattaatcaaggccgtgaacccacacgaacctgccttaacccaagggctacgatgattcagaccgaactggcaacccgaccctgggtcccagctcgtcccaagccaacccaagccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacgaaagacgtgacatagtttccaacccatcctagccatagacaagagtaccgacccaatcccacctacggccggaacccccgggacaggcaggcaggactgaacccctagcagcaggacaccggccctgtgccatgacatctcgactaccgggccgcagctcgtgtagccttcatttgtcctagagatgtccatcgacccccgacttcttccatctccatccgtgtacttttgtttataactagactgagccacaaactaagccttacccactagacatgtggaagtacggtagtgctttgcaacagaggcccgaagaccggtccttatatggccgaggtgctactatcaaaaccatgcacctcgagcccagcctaaaaccattttggggattttgaatagaaggagcggtgtgaagccaattt

SEQ ID NO: 34301 - DNA, 779 bp, Oryza sativa
  unsure (1)..(779): unsure at all n locations
ggtggttgnnnnnnnnnnnnnnnnnnnnnnnnnnnnnnnnnnnnnnncatctgatcctttcttctgtgttgccattcgatttaacagttcatgctgtgcaggtgaaattgcattgtgcgcttcgtatcgctgaaaataaagataagattgagcattcgttcatttttcacctgagattattactgagcgttgcatgtagaggatcgaaggatcccattaaagagtgggttttaacaatatgaggatcactgcaacaaatcaggtacattttccaagtgagatgagagaggtcattgagactagaaggtggtctgatttagtatcaaaacatgagaactcatcttcaccaacaaattcccaacagttgatactgatcatccaggaacacgttattcaaaagtaaaaaacgggggaggggcaaaataatcagttctgactcctaatagcagccatggtagaaacgacatatacattcaaaacattgtcgcgttgtattccagatagaggttaggcatgaataaacatcaccttagagaggcaatttacagaatgaaatctgcgatgcatgttgaatgcctttgcatagaggcctacgaacccaggtcctacttcatgagtactagagtactggtactacataactagagtaaacatgaagagtgctacagtgtattgcatcaatgatttttgcggcatttggtggaactggaatcgataatgagatgatcccagtgaaatatcacctaatggctctttgtggcgcttcagcaaaatcttgt

SEQ ID NO: 34302 - DNA, 18923 bp, Oryza sativa
tcagcaatgtgatatttgcaatcaggcatttaatcaagtgataatttgtggtttcaaatacaagcacacgaatggtgtggcgacctcgcgcgctgctagcgaagtagcaatggctacacgttcatctaagcaaatctggagaatccctgaaggggtatctagctatatataggggtggtagctcgacctaggggtgcttagggtcgtgctccaccagcttggggcgcaccccacatgggccccacatgagccggggtcccaaatgtagttacaagcccataggcccgttataggtgatgcgacaccttgttcctgtgattctggccacacgagatagaattcagagaagaggctggatccgttagaaagagggctccgagagctttccatcaagtactcacgggccgaaaacggaggtcgtatgcagattcggtggccgtttgaagtcagcagtgtagtaggtggccgaatcggattccagcacttggagtacttgatctcgatatcttcttgttcatccatgatgtgagcaatggttgcatccgtggtagccatggtcacatcaccttcccctccgtcgtcgactcgtcgtcaccggctggaaggagagggaggggcataccagatctagaagataacgtcgccgtggtatccatgctcccttccgcccctccatgcccgtcgcctacctccacccctcggctatcgcctgtctccaccacgcccaccggccgccgccgccgcctccgcgcccatctgccgccaccgctgcctccgcacccgctgcctttcacgcgcgccatccaccgccgctccacctccacaccatgccgcttcgctccgcccgctcgggcgtatcggttctgttcggctggagaaaatggatgctggggttggggtttggtcctgggaacgttgatgtttatatttttttttctttgctctcacagtaaacttggtagactgttgttaatcaacctcaatatacgtgagagattaattagtaactatgtgaagcatgtttagcaaataacattattttttaactaattcaggcttaaaaaacatatacataacaaagttggttagaagatattattaaaatatatgaaaggtgatatggaggatgtaatatggatgatttgttggagtaggaataaatatagagagagaatctttttagatggccatccaaactgagatatggagtaccgaaaactgagatatggagtaccgaatttagatgagttgctgggcatgctctaagccagatgctaatactacatatgcatggccatctatttcacatactctcatgatgcaactataaaacaacaacatacgtgttcttacttcgtttttgtggttaatttcgccgcatgttcttaatgcgtttttttgtggttcatggtatccatatatgctacaagactacactagcatgactgtgccgtatatctcgtatatgtaccatatgtgttttgattgacagtggcgtacaccatgtagctgcactaaatttagtaaaaagaaagaaaacatgcatctgaattattcatataaaagaaacacgtattcatagacagatctgaactagtaacggacaggctgaatctgtagtgaatctagtaggcagcgggtggtttgggcttgttgttcggtttgaggatgagatcggctagaggataccagattattggtcgcttatgggcttggacgccggcagcgaagaagaggatcagggcccagtccgacatcacggcctggtacaccctcggcaaggggaggacgaggctcatcaccacgagcagcacgccgcacgagagcgcgaagccgatccccaccgccgccgtctggaagtccgacgatctcatcgccgcgcgtgaggccgctgacgccatcgatccccggccccctcccgccgccgccgccgccgagagaattcccttttttttttcttttgctgatcctatcaatgtttctcttggcccttgccccccttctctttcaatctgttgctgtttaggttatctgatgttggttggggtatatatgaactggaaaaatataaatcatgtactaatccgtgtcctaaaacatctcggtccccgatctgtttggttatctgatgcgtattggctcgcgcgcgcgggtcacgaggctggtcgctcaccactctccacgcctcccgccattgccgtccagttcctctcacacggagcttggccagctcggcctcatataatagcatatatgttttctcattatattattcaaatatattaaaatgacaatataattttaaattttgtaataactttacaaaactactaatgtgcaatattcatatggtattttatatacgtgtttgttattaattattttttaattccaaattttctgtaaataatatttttatatagactataggctcttcttccaatattatttatttttatttttgaatttttattatttctaattgtatttctatgtgtactctaaactcatttttcaattttctttagtttttaatttcgaatttcaattacttctaaattgtattcctatattgactttaaactcttcttcccatgtttttcttaattttgaatgttagttatttctaaattatatttttatacggactctgaactctacttttaatttaattatgtttattccgaattttagttagttttaatttctatatgaactctatactctacttctaatatttcttatttttttaattccgaatttctatttttttaattgtatttctatatggactctatactctacttctaatattctttatttttaattctaaatttctattatttcctaattatatttctatatggactctatacacttctaatattccttatttttaattccgaatttcagttatttcctaattgtatttctatatgactctagtctcatcttctaatattccttattttttaattccgaatttcaactatttctaaattgtatttctatatggactcttgtctcctcttctaatattccttatttttaattccgaattttagctatttctaaattatatttctatatgtgtaagttcaagtgccttaatttggtttcggtgattaatgacacatctaattatatgagactaacgtttttatgagcctttctttgactagtcttatttggatatgaaagtaaaaatgatgagaggtatgtattaaaaacttcacatattctaacttggtctctcttgtggatccaaaatatagtgtgagctccctcattgatcttgattgataatgtgcatatgcattccttcatatccatatatatatgcacatcttgagggggagcttattctatattttattcattataagatctctatcttgatttgaaattatctttcatctcatcttattgtattgtttatatcaggttattatctatcacaaaagagagaaaagattgaaagattttggattaaacaatttgtgtaattgttgctttggtgatagatgataaatcgatgtttatgggattaacctctctttttcataagttgttaactaggttatttcccgatgatgagatgtggtagatatgcattctttggtgatggaccttaatcatgacaaggatgaaatgcatggaaataaaacgatatgtaccacttcttatctcctttttgataggtttatatgtatgattttcatgttattgttatataagtgtgagactaatgtttactcgagtcatatcttatttagtctaatttacattaagagcatggagattatgaaggtatatgttttatattggtctacatcattactacatatgccttctctatgtgtataggataaaccccccattggttcttctttacttatgcatacacttgtctctcttgtatatttctttgtatgcatatacttagggggagcaaatcctatacatttattgtgtatgttctagatccatgttgttcacctattatttatatcggatctttgcacttgagcttgcatacgggtatatgacacttgaggtgtaaatgaatactcaacaaacatatccatatctttcatatgcaaccggttggtcatcaagtgaaggatgacaaccgatttgttgagactaatgttctcctttgagatgtgaaaaggaataggttccatcgtaatgaggctaatggatgacaacatgggttgatggtcaccaagacaaggacatcgccatgttgacaatagtgaagtcaagattgtgatgagaagaaaggtttgacaaaggatggtcaagacctcggaataaacatggttcaagcaaatggtcacgagtgttgatcttggctcaagcattgaccccaagttggatggcgcaaggcaaagatataatagacctaaaaatgttttcttagtcttttcccggtcttggtgtttggtgtagaccggatttgctagataggcgccgtactatcaagaggggtctatgaagcgagcatgtggatgatcttgtgccatattagttcatatgcatataggtgtattttgtgggcttgtctagacaagtgtggtgagttttatcaagtcccaaacaaagagagaagtgggcacatcctataggtttgggtagcctcatgtggttatgtccggtggagtatcctttggagtgtgagctatttctccctgataaaagttgtgtttattggatggattgttcatgggttggatagccctttgaataagctttccatatagtccaagaacgccaaattccgagatccgagtcaagagatatcgtcgttttactaacggttggttgtgctgaaaagtgacctgcggtctgaccgtaggccttaggtcggtctgaccggggctgttagccggtctgaccggtgtggtaaggccggtctgaccggccctactggtctgttgcactggtctggtttttggtggcgatacagagccgccagagccgcaaccggtcagaccgagccgacggcggtctgaccaagccgtggacggtctgaccggccactacactgctgtcagaccggccaggttgagtgggctcaatgattgccctgtaacggctagttttctagccgttacaaagtagtccggtttgaccggccactctatggcggtctgaccggccgagcacagagttggggatttcgactccaacagctagtttaggtggttgggagtatatatacctactccccagcagcaagattaaggttttggcactccattgcattatcttgaacctttgcaagagctctcacatccttgtgaacttagtttatctagtgatgtgttagagagtgggataagccaatccaagtgcattgcttcattgttatagctagtgtggcacttgatcatcctcagcaagcatcctagacttgttactcttggaggttgccgcctcctagacggcttgtggaggtgttgcccggtgacctctccgaggagattgtggaggaggcccgacgccggttgtgagtagtttggagttcaccaacttcggagtgaaggaagaactactctagtgatcgaggcttgggtagtcctctccgtgggccggctcccaccttgcccacctcttgacgaagggggcgtgcggtggcttcgtggttgagcggtggagttgggctcgcctcaacggggattaggaaaccagcgagtttccgaacctcggtgaaaaatccctcatctcttgtcccatttatttgttgcatttacatttgagcaagtttacatagtagagcttatttgtgctattatcaccctaggcttgcaaaccttaacatagagtagcttctttgtgcacttacgtgagactagttgatttaggttttgaattgtgcaaaaccgttttgatttacgcttccgcatacaaaactcgattttagccaaaagttttaaaaccgcctattcacccccctctagtcggccaaaagttttaaaaccgcctattcactcccctctagtcggcctccttgatcctacaatatggactatgcttttttctttttctttttctccgattaatgtgagaatttataggtcatgagagcgaacgaggagactcctttttctatttctttaataatataatagatttggacaggcccttgttcagatttattggactagtatatattctatccaattccaaattgatgcgttgaagacgcctgctgaggtgtgatagagtaggtagacgatcgatgacatatttgcggatttgcctctcggactttattctcaacacgcgcatttctctcacgaccactcacacaaagggaatttgatttgagtgttgtggagtaggtcaatatataagatgaaaggccttgcggacaagatgcagtccgcaggaaagcaccttgatgatgatctcgtctcctacatccttgctagtatggatgttgattttaatccggtggtgacatcagttgcaaaccggactaaagctatcactgtgggtgaactctttgctcgacttgttagctttgagactcgtatgaagtcgtgaaggctttcgaccgcagacaaggtggtgactgcggccgcggacgtcggcgcgacaataacattcatcccatggaaacaaatattaattgttagatttgtcattataattgcttccaaattatttctccttccattttattcatattataagatactttgattattttttcaaatttttaagtttaaccaagttaacatggaaaaaaagcaacacatataaaattaaattagtttcattaaatctaacactaaatatatttcttaataatttttttgggttaaaaatattgttatatttcttttatgaagtagtcaaacttaaaaagatgtcaaaatgtattctgatatgaaacagagggatgactatttttaaaaaatttagggtcacaattaacaaataatagtcatatactatgtttattaaagaccgtcttataatatataaacaaacctgcattttggatttgatcgattgatttagttgtgagggaaaaaaccccattaatccgtaccacctcctccaaaaaatactcaatccttgatactctgtaataaatatggccatatatattgctaaatacagtctgcggtctgcctatacttttgatttttttttcaaaccaccctgttaggggttaattaatctaaccatataatgtgtggtccaaaaccgatacacgcatcatcgcaggggagagaaaacggctcaagtgtgtactggttgccagcatgtttgacttggagcttcgattattctatgcgtgtcttgtacccaacgttgcagttgcactgccaccgagggcagcaacttgccacaaactttctttgccctaatttggtacgagcaccaagggattagactaattaaacctattgagaaaccggtcactaatcgttaactacctctacgtatactctaaaaacctcgtgaacagtcactggcatgtagaaccaattacgcctaacctgccaacaaatactataacgttagtgtgtctagctccgtaagagcaagaagaataatagtaagctataaaactgatataagctatagtaagctataaaattgatataagcttatgtgaaaaagagaagtaacaaaaaaaataaataaagaatattggctgttatgcaagagctagtttaacacgtgttgcaagacaaatatattaaatgtataagtaagagagaagaagaaaaattaaagctaatcttataactaatctatcatatatgttggttttaaaatgggctaaatgagtttacaattaaacttgctataacaaacatattctcgtaataagataaggtgagaacacatgacagccgccgaccaactaattaagccccaaacatgagacaaaaacgacctcgaattaatcatgggtggcaagtgcgagcctctgacagaataattggacctcaaatcgatcgcttagttaggatttatttctgacttgtgatctgcgagcgctgtgaaggtggggggtgatcttgatttgtttagcccagctgtggggcaagatcctaagctggctgggtttagcagttttcaaacgcttaaataatgcgtcgccgggtttggtgattagcgctgggaatctcttcgcagatgggaacaaaagtccaacacgacaccacacagggcaatcgggggcagcgtcctgccattttccgctgaaaattttgatcggtggttgacccctcttccgtgtgtgggacacgggtgaaattaaacggcattacgtccatggaaatggttctcgattgatcggtagttttcgtattttatgaattctacaaattgactttatatagatgtttaaaaatttattttacttttatagaaattatgtttgatcactcagcaatttctgtttcgtttatatttgacattctccctccgtaaaaaaacatagtattagaatgtgataacgactctataagaatgtccaaattctttgtattattatatgccacatcttagcacaaggttgtttttgttttttttttgacgaatagagtagtgcgcaggggtgcggtactctctatagtcgtcgcagctttcgattgtgtaacaacagggctcgtttgaaacacgagaggggaattactgtcaacgatcactgtgaaaaaaagcctgtaaattttctcgctgtcgcgagcactagcaacgcactcgcgactcacacatgtgtgtgtggcacgctttatggtggcacgcgtgcgtatgctagggctaggaaggtctcgcaggcaggcaggcaacgagaggcttttctcctctataaaaagtggttactgtgcagaggtcaagccacacacacacacactgatacacagatcggcagaaaggaaggagaagcagccaagcagaggccccggtcttgtcaccggaaagagagaaaaagagaagtgaaattgaggaagaggaggagaatgtgatggcgcaacaacagcggcggcggcggcgcgggggctttctcggcgtgctcctccttcttcttctactcggggggctgctggtcttcctttcccttctcgatcgcgtcgacgccggcgccaccggtttcgtcaggtagtactctgttgcgctatacctcgccgtcgccggccggccgtgcttctccctcttctttcggtttgcatcgtcgtcgtcgccgtcgttgcgctcatgcccgtggttctttctttctttcttgcagcgaatctcgattggaatgagggaaaagtggcggtggcgactccgctaggacaggtttgcctgccttcccagttcttgaatctttgatcatctatgtgcatcctctcctcctgattacgctactctttaattaatcttgtttttgctgtgacagaagccggtgccgccgccgaagaagaagggtgaccggccgccggagagggtggagatggagtccatcaacgactacggccaagccagcgccaacaaccgccacaacccgcatccgtgacatgacctgccaaccggagctggatcttaattagctactactagttaattatctatgcaatgttctcctcattatctaaaaaaaatgtaatgtgttctcctcagtataatactctctccgtcctacaatataagagattttaattttttatttgtaacgtttgaccactcgtcttattcaattttttttgcaaatataaaaaacgaaaagttgtgcttcaagtacggtagataataaagcaagtcacaaataaaataaataataattttaaaaaattttgaataaaataagtggtcaaacgttacaaacaaaaattcaaaatcccttatattataggacagaggagagagagtacttgttagtgccaagctcacacaccactctccttgctggtcaacctgtacttgtagaggcatgcatgtaccttcacctttgcttcgttttcgtattagaaagagagatcaagagaagcatcgatttctagctttgtactttcgagttcgtattagctgaaagggacaaaatctgaagatgcaggcagtacatttgtcactcgcaggggaaaaaagtgcatcgactaaatttgacccaaaattaattcagcagcttcagtcacaactaaaaagttcagagagcttgggagctgagcagaacaaacaattcttgcaaacgtatgtaagttgagtccgccccaattcatgcaagtttctagcatctatagcttctttcataattaaaatctccccacaaacaacccagcttttcatccgatgatgaataatgctgagatcaaggccaaagcggtgactggtgatgacgccaaccggcggatggagcagccgctatcctgactctgctcggaccaggggctcttatgcaaatactcagacgctaccattggtaggctggtagcgatccaatgttttgcaaagattttgcttctctcatctcttgcttttggttaaatcttatctctcaactctaaaactgggtataacatctcctctaactttaaaaaccgatgtaaattaacacctttagtagttttgaaacggtttctgctcacgtggttggtcaactggtccacgtgtgttgatgtggcatcccgttatcaaagaaattgaaaataaaagtggggcacacaagtaagtgacaagagtaaaattttaaaaattgtgaggcccacttgttagcccactactcccttctcaatcttgacgtgtcaccgctggcggcagtggacagtgacggtgatgacatgcatcacccacaatgacaacgagcactgccgtcgcacacgctgtcccatactcgtgcttgaagagccccccgtggcggcgttgaagttgggtccggagacggcagtgtggttggcgacggcaggggtagcaagggaaagagagtagcgaagaagatttactgcttccccatgccaccggcctgtctcaccttctgagcgtcctgctgatatgagagtatcacctacctctgattggctcgccagggaagagaggaaagagaaagaggaggagaggtgaggaagaagatgaaagaggaggaagtcattggcatgtgggtcccacctgctgactcagtgagtcaaatctgccacatcagtagaaaccactccccaaacacccaaggagttgatttacgccggtattcaaagttgagggaggcgttaaaccggttttgcggttgagggttgtgattcaatcagaaccagagatgagggaggccaaatagacttactcattttgcaaaatgtcgtacactggctttaatgggctaggcccacttgtccattgggcgcccccctataccttgggcttccaaccaatccatgggccgggaaggcatcggacggccgagatcctcccatccatcgcggtgtcccgatcgcggccgtcgcaaagtcgcgcacgggacacaagccgaggagggttttgaaaccatcttgggttttccaactttttcaccgcccgcgacaagtccagcgaggcgcttcctcctctcctctcctctcctctcgcgacttcgcggcggctcgctcgcctgatccatccgtgtctcgcgcgacggcgccatggcgggggaggcttcgccgcccgcgccaccggagatccccacgaggtgccaccactgcgccggccccctctccaaggacatggtacgcgtgatcccgctccccccaccccaccacagctcgtcttcacctccccgggatctctccccttggtcgtgcaggctccgctgcaggagtcgtgggtggctggtgcccctgcgtcgcgttcgagtggggtttagttttcgtttggcgtccggaattgggtcgtggttctagttggtaagttatggtgccatggtggtgttggctgttcatgtatataggttgtttctcccccttgttgatttggcctgcaccgtggtttgtttttggatcatgctgtgtggatggctacctaccctatgacaagtagtttcggctcgggagggaagagttttgtttcacgccggggtcaaactaatttgtgcgattgaactgattcgtcgtgtgtgggtgcttttgaaggaaacgagcagctggacggtgcctccactggttcgagatagcttctccatggtttgtgttcctttgtcttcaactgtgctgcacacataaattactctctctttttttgtggttgcacaactttatcgaattcggcttttctttatctgtttttcttgtgttaggttgatactattgtacattcttttttctatcttgtaaattctgatcggtatgttgctaaagttgattagatttgtttcatgacatgtatgtgatttgttataattacaaacttttacataatactaaagttgtcctagaagatctttgctaataatatttgtgttatgttctgacagattggttctgctattgggggtacagctggagcattttatggtttcaaccacagtaagttgctaacccatttcattcagttactcatgcacaagttggtattttgcaggaaagtaaatcattaggtttctaacaataccttttagcaccttgtttgcacttaatttactgtggggggttctaatagttagcttactgtggggagttctaatagatagcaatatcccctttgcttgcttggctagtttactgtggggagttctaatagttagcatacttataatagtcatttgccttattggtgaacctcagtcatttcaaagctcagaaacatatgtggacaagataatctgtagttttttattgtctcggaaatgtattgttcatgttgtccactcaatgatgattgttatcttctttgtaaaaacaacaccttgcacactatagaacacctttcttgtacatcctctctgtgtccatgtctatatgcatggtaattcctcctgttttaagttattgattgcaacttttgttggcggatgcatcttgaacaaaattgattgaccatgtttgccctttcataaaagttgatatatcttctgagcagcactgattttgaacttcttttgtagctatgccttttgttcgacggtacataaaagggccaatgtggatgcattttcttgttggtgtaagtgacaattctttttcaaagtttatattatattattatcaatctattgagcatgaattaggctgtgttcgggagtgagggttgggtcctagaacgcaaaacgaagcagtgtttagcgcatgattaattaagtattagctaaaataaatttgaaaaatggattaatataattttttttaagtaactttcatatagaaattttttataaaaaacacaccgtttagcagtttgaaaagcgtgcgcgcggaaatcgagggaggtgagttgggaaagtagagataagaactcagccttagagtgttgcagtttttagatggtgtattattttttcacttcctgattatgtttcacaatctctaggtcatctcaaaactagaaacacaatttgatgccttttcttgacacctccgtttctatgtaaattattttaaaacactacagagaaagcattcaaatttcatgttctatctcttatcgccaaaacatctcttatgttcttttacttggacgggatcgtgagttcaaattcacgcgtatggtcacagactcacagttgcatccaaagggcagtctcagccaaatgctgtgcagttccttctggttcaacaaatgctgtgcagttcctgactttcgattaactaatggtgataattactatattcacaacatttaattgactgtctcatggttattacagataaaagtgttctcgctattactgataaaagtgtataaactgcgcagagatgctaccttttgaagcaaactgtggacattgataactctgatctttttttaaaaaaaaaaatcttgcaggcacctccagttattgtcttctcttctgcatgtgctgggttagcaggtcagttactactattttattttattttggttttttggccatttaactatttttttgctcatagttctgttgtctacaaactcaaattattatttgagttttgtgatatcgtggattcgtggtcattatattaggtttcaagccgatcttatttaagttttctgcagagttaatctatcttcctgtttgttttattcctgatgatgactagttgcgatgtttctatagtgccttgatacctgctcatcatagacagttacttgaaactatgagtcttatgactacacatacatattctgtttttaaggatgttctatgcactctttaaaatatgtatgtgagtacctttcttgttgtttacatgtaaacaatgccaggacgtagtgttatattgtttatgctgatagatcttatgagctcgtgaaacattgactagtcatctgccatctggttactgtgtggtccatgttatttctcattgacgaacctagcgagtcaaggttcatcctggaaatgttttattctcttcctcaaatcttatcttctattcaatggatctccatgaaattgttcgctacagatacattgattggaggccaaaaaaaaaaatcactaaagcgcagcaatgacacatgtggttttaataataatagaaagaactaatagttggaatattcagatgtagttcaaaacctcattaaaattgttgatttttgccatgtcactgtttttattcactatgcgtgatggatgatctgaaggttgatatgtttgtaggtgggacaataccagcgcttgcacagctggtatcatcatcctatcactcagccacagcgtcgtcctttgcccacacaacttctcgtgatgaaatgcataaggccagaagctcctcgacattgtgatctacagtggcagcaaattgttaactggaatcctaactatccaaaacaccatatactattataaatgtgcatgtgttaccacatatcatctgttttatgaggaatgctcttgtaaatggtaaaactttcccctgtgaatagtgcttatatatgttcccaattttgctatttatcaccatgcacaggctgttatttttgttatggtgtcgcaataagcctggagtgttgcgaattgtgatctgctttaaccttcaggatgccattttcgtttgcaatatatatgcacattaccttttgctctctacttgtctaaacatttaccatgtacgatgtctgtcgttttgactgttttacgcgcatgccattgaagtgagtttttacttatgtgatctgtactcctgcctcaatttatttgatggcatgtggcagattaaagtgtgttgtgccaccctaggaatctaatctaggatacccctgccggtgccggatcaccgtttgtgatgaccgtgcatgatagggtgtggcatggtgtccaatgtttttgcatgcattgaatcgtagccatcatacattgaattctcgcgcctcgtttcggatgccatttgatctatctcctctcgctccatccatttcatgtgccaaaaaggccactgatgatgcaaaacagtggcgatctctggctgaatcctcgcggaatggcagtgtgtggacgtgcctctctttgcagccttgtgttgtgatgtgttggagtacatgcttacatgtgtacatacgccgaggcactgtgagatgcatctagccacctgcgtcactgcgtgcgactgccaagatctctcgccgaaagttcgacgagatccagtgctctttcaagcactcactcatttggtgctttggcgatgcttcgagatgtttgggaagcttgttgaactagagtggagatagatcatgtatgcttgtgttaattttggcatgttcctttttagaaccaaagggagtaatacagctactatcttaatataattcacgccctatttgggtataactctaggctgcgttcgttcgttgtgatgagttagttagtttgtgtgttttgttttccgcgcgtacgcttccaaactactaaacggtgtattttttgtaaaaaatttttatagaaaagttgttttaaaaaatcatattaatccatttttaaaatttaaaataattaatactcaattaatcatgcgctaatggctcacctcgttttgcgtatcttcccaatcttctccatctccttcaccccagctgacaggattggaatccttgcgtccacaaatattacacatggatacttatggttggattttagttaagtcagcaaaattgtcactggactttatctcttgtagtactccctccatactcacaaaggaagtcgtttaggacattgacacggtcttcaaaacacaactttgacttcttgtttctataaaaatattcattgaaaagtgatatatgtatacttttataaaagtatttttaagacaaatccattcatataatttttatattttcaaactcaacaacttgagagttattcatgatttatattttcaatgtttgacttaaacattatcctaaacgacttactttacgagtatgaagggaatatgtgttaagcgagtgtactcgtaagcatatgtgctcgtctgaattgaaaaattaaaaatctgtcgtaggatgttttctaaactgaaaaaaaaataatatatattttaattatttgcagcagcacaacgtgataatagcaggttgtatggcgcattagccttggactgatcggtcctggccgaagtgcaacgctgtaaacgcagagcccagtgcaccgcaacggaggaaaaccgattggccgccgccggtgtcgtccgcccgcgcgggggactcacgtacatcgttgtaccgcgcccgccgcactccttcgctcgcgcgacgtcaaccacacacaatttcttttagagaaaatataaaaaagcaatccactgctccctccatcacataatataagggattttaagtttttgtttgcactgttttatccctcgtcttttattcaaaaaattttaaaattattttttttttacttactttattatccaaagtactttaagcataacttatcattttttatatttgcacaaattttttaataagacgagtggtcaaacagtacaagcaaaaactcaaaatcatttatattatgggacggagggagtacaaactagtctaagctaataaaaaaattttgagacacatgacacgtactttaagaaatgaaaaccagcggcacgtccctaatctcactaaagtctggttgaaaatccacctacatgtgcgtaatattcgtggacaccaggatttaaaccatattgggtgaagtcatgcactcacaactccaccaccacaccacgggtgcttccccaaattgaacataaattttaattagcttttaacaattcttagggtgaaatgatcttttatagcggttaacaagtaccgctaacggaaacctaccggcagtgatatgtctagcacaaagacacttgtacaatatcattatcggaaagatgggtttgtcaatgattcttcttcgattgatacgcttgtcgatgatatttttaaaatgttctcttttttaatacttcctctgttccatattatatctaaatttattaatattcatatgaatatgagcaatgtaaaaaaaagtatgataatatgaaacggaaggagtataaggaattagatcgcgcgagcgacgcggacacactcatgccgctcccgcttgcccactgacgcgaagcgtgctcgagtgctcgaccagccttcgtctccgctcgcctcgccgtcgccgtacgtcgccctccgcgacagcctgtgctcccgtggctccacccgctcgcctcctcctacaaatcctccatcccgcctcacctcacctcacctcacctctcactcactcacacgcgataaaagagtttgcaacaagtggtctccttccatggacaggtacagggtcgcgccgcgacctgtctacctttccgccgccgccgccgccggcggtgatcacggcgatgggccccgccgcctgccacgcggtgtcgccggcggcggtggcgccgagctcgacatcttctccgccgagcgctacttcaacgcagacgacgtcgtcaagaaggaggagtaccgcgacgaggagcagccgcggcaggaggtggccgtggatgcggccagccagagcggacgcaccgtggcgtgctcatcggaggcgagctggaccagccgctccgggctgctctccggccacgcccagtccgccgcgtcggcgggtgctgctgctaagctccagatgggtggtgccaatggcggcggtttaggatcacggcgccgcttaaataatacctaagttttatgtttaacgcaccctcttgactttttcgcataacggcttatttaaaaatttaatataaaatattttaaaatcctaaatttatattataatttttttatcataaaacaagttacaacaaaactatgcgatttatataattttttttagtaagatgtcaaacgtcatgttaaaagacaacggcttgacggaagtacttcttaaatgccatatcctttatatactttttttcgtgtgaaaacaaatcttgtttcgtttgaaagaaattgggatttaatctaactgcactttgggcccccattttgggtttggcttttactatatcagctccgaattttaaaaaacttttgctgcgtgcgtcttctgtaataatatataatagattcttctattgtgtcaaaagctcctcccaaacttctctaagaagtgggcctcatttttttcaaaattttttttcccgccttttttttaaaaaaggaaaaaacggattcttattggttggtctttttccccaccttgttaaaaccaccaatctttttccaacttctagcttggtgagaatgttacccacctttctacg

SEQ ID NO: 34303 - DNA, 7780 bp, Oryza sativa
  unsure (1)..(7780): unsure at all n locations
gaggaaggtttaacaaagagaccatttcaaaatatcatcgacaagcgtaccattcaaagaagaatcattgacaaacccatctttccgataatgatattgtacaagtgtttctgcccgcccgcaagcgctcaccgcggcaagaagcccggctccggccagcggtgggggctgttctctcgtgactgcccctgcgccggcaggaaggcggtcaccgtcgacgtcgcctccgagccgaggagcccggcgacgccgagaacccacgcgaggtttgaaaacagccatgtcgtcgccgacagcacgatctttaaagcgaatgcgccgccgccgccaccgccatgcgaggaggagcccgtcaagatgaagatatctccggggagcagcacgtttcctcctcccctcgcgaacagtatcttcgcggcggcgccgaacaggggcggcggcggcggtggcgcggcgccgttcgccgctttcccggcgccggacattgttggccgccgcgtcgtgagctccggcggcttcacgttcccggtggccgtcggcgcggcgaaggtggtgagcaccgttggcgacgagccgccgcgcgagtcgctcgaggtgttccggcccatagacgaggagtcggtgctcgccgacccaccggccgatcacctggcgacggtgggcggccgcggaggaggaggaggaggcctcgccgcaggcttcgcgcgcgccccaagggtggcggctgtggtgaccgacgaggaggcaatgagcgacgcgagctcggacctgttcgacctcgagagcttcgcggcgtcgtcgtcgttcccgaccacgtgccgcgggcgcagcaaccggcgcaacttgcgggaggacgacgacgacgacgaagaccttccgtacggcgccgcggccgcgcccggcgccgccgtcgagccggcgctgagcgagtgcatgtacgcacgagcgaggtgagcgtggtgtggagcgtggccacggcgaaggcaggcgcgttcgacgcggccagcgtcgccaacttctccagcgcggcgtccgcatgctgcgtcgaggagttcagcttcgtcccgccgcctgactccgccgccaccgctggcggcggcgaccacgagggcttcaccgccgccatgtcgcgcagcgccgcccgcaagaaaggcggcgggttcttgagcagctgccggtgcgagaaggctgtgagcgtcgggccaactcccgtccggatggtccggccggaggtgaacgtcaagaccaccggcggcggcgcggcacggtatcaccccggccgcgtccgcatgccggtccggacgtgaactcgccgccggtgagcaccggcgacgtacatacgttcaacgagcgggagaacgcgaaggcgtgcgctatggtttaattagttttgatgtgtaaatttgtgagtgagaaatgtgttggtgtaaggaatgcacatttgtgttgtaataaaccaagacttttaatttctctatacagatttcgtacgtacatatcccttcagacccttcacagagaggggagggggggagggggggttcgctccgcctctccctatacgcttcttcccttcctcctctccttcttctcttcctacaacatattaaaccataaaaaaattttaaaaaacaaatagttagaaaaatttatgtatagaaatactatatataaaaaatttgaattcaaattcaaattcaaattcaaattcaaatttgaattaaaatttaaatttgaattcaatttgaatttgaatcgggtatgtaaacttttgacttataaacattggatctataaactttaggtgtataaactttagatgtatatagaaaatatttgaattcaaatttaaatttgaatcggatataattcaaattcaaatttgaatcgggtatataaactttagttctataaactttaggtctataaacttaactttaggtgtataaactttagatgtatagaaataatatatatgaaaaatatttgaattcaaattcaaatttgaatcggatatttgaattcaaattcaaatttgaatcggatataattcaaattcaaatttgaatcgggtatataaacttttgatttatatactttagttctaaaatctttaggtgtataaactttagatgtatagaaatattatatataaaaaaaatatttgaattcaaatttaaatttgaatcggatatataaacttttagtctctaaactttatatgtgtaaacttgaggtgtataaactttaggtgcataaataaatttactaaaataggaaagtaatgcggtgccaaaaaggaaacaggtgaaggaaggaaggggtgaggtggggagcgaatctgatcgctaccccttccccagggcgagcgatcgccaaacagcatttctgttcacaagttggtttctttgattatagagaagatgtaacaagcacatgcatcatccgtaaatgcattagaacgatcaggaagaaatactctctccatccctaaatatttgacgctattggtttttttaaacatgtttgattgtgtatgttattgacaaaatttaagtaattgttaatcctttttctaacatttgatttattgttaaatatacttttatgtctacatatagttttacatatttcacaaaagtttttaaataagacgaacggtcaaacatgttaaaaaagttaatggcatcaaatatttagagacagagggagtagcatatagcggttggctgaacaaatccgtaaattgacattgttatggattgaaattttgttgaacagtcataaacttgcaaggatttgaaatgaaaaattgttaatggatggcctttgatgtcatatatctagacaatcagataggccaaccgctagttttcaacagtatagatttctacaattagtgatttggttttatagatagaatatgtactacaatgctatatatgatagtattaggttatttgttggaccgtttattggttaacatttacacaaatgcaagttggacttttaaaagaaaattaatcatattagagatatgtcgctatttttttgtttatttaaacatgtgttaagggtgtatctatgaatgtgtgggtgtggtattgcgtgtaataatggtgtatgtccgtatcggccatatatttttttgaaaaaaaaacattgaagattctcttctctacccctctctcttcagctccataaagaaatatatatgcaatcgagaaaagttttaaaaaaatagtatgtatattcttcctttaggctgacgtcaccctacgtccgtacaattatataaagacaacgaatgtcttaatgagattgctttcctttattgtgtaccttctagataaacttatctcttttatggccttctgatgcacttgatttgtcaattcaacatggagacaattaatccaaaaacgggatcaacacgatgtgatgtgtggcaatgcccatgttgagtgtgggaggcaagtacgttgactgtttagcatctagctagacgtccgtgtgtacttaactcgtgcaaattaagccccactgtatatgagttgttgttgctttgttgggaccacatttcatacacatgactaattagtgctataaatctacatttgcattaacgttattagacggctgttttgtttttaagttgtgcttgctctctaattatctgaaaacaaaaatggaacgctctacattttatttgacaaaaaaaatccctagaactttttaaatgtcaaattgtcgaaatactctaagatccatacagtgctatggtgtttccaccttgccctttacccctgcacgaataactccggcacgacgaataaaatgtagggtttaattaactctgaaatcctaagtaaacactaactcgtcttgctgtcaccgttgctggagccaggggcggatctacagtagtaccaccagtgtcaggtgacaccgacgacttttgataaaagctatgtttaaactgtctatccataattataacactatattctaaatataattagtatgatatgacaccgataaacacgttatgacaccaatgaactaaatttctggatccaccactggctagagctgaaggagaattgagctacagtcattggagcacgaatctcgaattaaatcccaatattagaaatttttaagacttgggtacaaattttctaacgaatgacatttagcaaattttttttaaaaaatcaccaatcgtgagctaattagtcgcgagtagattgcaacatatatatgccatatcatgtccgcgtcatccgtatggggaagatcgagctagcattctggagtttggtttctcatgaagctttctcgccgatcgtttctaagcaaacatgcataatgtacaaattgtacatcatatgaacccatgcatgcgtgcgctccaaaaattcaaaaaagaccatatacacgaaagcgagacttcacataaataacgtacgcggcattccctcgtccagcaagtgcaaattgctacagtgggctagcaagcaagccaacgagctagctagcaatcaggacacttggattccaacaaaaggataagccggccggcgaccgatcgatgaatgtatcaagtttgtcacccagtgcatcaaatgaatgtatcagaatactaagaagatggatttttgcctcgggagggaatgtcccgttgtttctgataggtctcctaaagttgttatgattttctttaaaaaataacaaaattgataaagatgaaatatatcattctataaacacataggaggaagattaacaaaattgacaagatcaaaattgaccagacaatggacttcgctgcttaaggaggaagatggccaaagagtaaaagatggttgcatgatattggagaagagagtttctagtttctttgcaatgagagggtggaacttaagaagaagattggaagtttaatgctctcttttctttgcaccatggggttttgttgtcttaagtactgttttggctaatctctgtcattgtctaagtgtccgtttatggtcactcgaatttgcgttaaaccttttgtaagggtgtgagcctaagtgctcgtgtaagagacttttaggctgtgtacattttttgggtgtagaggccggtttaatctattatctaaaaaaacacataggattaaatttaacttctaccatttgcaaaaattaaaataaactctactagtatatgtatatttacagttaaattgttatatttatcgcaatttataaaagttgattttttttatattataaagagagagcttgtattattgatggaaatagggattgtattcctggtttattataaaagtcgaattgaacttgtgtgtttgtagaatatgtgtatcacatactagtttatctcattatatatttttttcaaaaaagaactcttaactatttagacgatgatatccatgtaactcgtcgatcgacagatattgaaaaactttgtggactaccaggttcatccatacccctccggcagctgacgaagctacccatgctttgcacgagcacacacatgacacactgtgctcagcttaacctacatatctgcatgcgctacgtggcctcgcgggcggccacaggctgcgtcgccaacaaaattcaggaattatttctggataccgcctgtttccgatgagctacagagctagctatgccgctgctagagtttgaagtgggcaacatgcagcagcaagggatgggggcggggtggccatgtggaacgcgtgtgggcgggcgtcgcatgatcgatcgatcgctgggtattgatttgtgaacaaactggccagcggcggcggcctagcctacgacgcccacctggaactaagagcaagtttaacagtattgtcaactactagccccaatttatctatagacaatctaatagctcatttatacaataattatatactatatacttactattaatacctggtcctacctatcatacacacgctgcgtcttgagtccgtgctacagctggctacaaatttgtagtccgctgcccttctctctcattatttatttccttaaaatatgtttgcagctggcttatagcttgctattgtacctgctctaagagaaacgttgtaaccagctgtagcacggacttcaagatacagtgtatgtattatagatgggacaatgtattaatagtgtactccctcccgttttattttaattgatgttttggacaatgatacagtcaacaaaatatatgtttgatcttatttttctaatataagatatataataaataaatatatggtaatttacttttcttatagtgctttgaaagacaaatatatatttattgttctagttcctttaaactaaacatttttaaagttattgatggtcaaagttataaaagtttgatctcaaccatgtctaaaacgtcaattaatatgggaccggagggagtagtatatatatttatagataactattgtatgaattaactattaaattgactagagatgatttaaagctagtagttgactatacttaaacttggtcttaacaaagctgcaagtatggaacggtggaacccgaggtgttgtggggcccggctgcataaggtgaaaggggcgcgtgggtccatgagctgtggggctcacatatcaacccctcaaagttagagggtagtaagttagagcatctttttacaaggcgagagtatggtttggacttaagacgtacaagaggatggaataattgttgggcttgtttagattagtgtcaatttttttttttgaaactaagattagtgtcaatttttgacatgctagtattttgaaagttttgaaagtttcgcaagtttagacactatcaaattaattggtagagctgagttggtattagtttaggcaaaaattggtatcaaatcaatttgttatttttaaagttgccaaaaaaaatggttgggcagaatttggcactaatataaacaaacccgttatctcccgcatgattctattaacatgcccagcatagcttgattgttctgaataagatgaataataggtgatatgttatttgattttgcgatggtatttgtgggcataaacgaattatggattaactgttacgaagttaattggttgtttttaaaattatcgtaagcaatttatacgtaagcttttctaaaaatcgcacagtttagaatcttgttaagcatcctcgtgatagtatatgagaggaattagggcctaattctgaactgcacacaaaggaaaacacggtttatttactactatttcaatattataagtcgctttaactttttttaaaatttttttaaaaaatggttaaatttgttgaaaaatatagtaatattttttaaaaaatattattaaaatatatttaattttacatttaatggaactaattcagtgtgttgtgtatgttgctaaatttttctatagatttagttaaacctaaagaagtttaattagaaaaaaaaatcaaaatgacttataatatgagatacggaggaagtagatggcaacttctgcttatgatgggcgatctgatcatcttattcagaagagccaatcggaccaaatggtgcggtggatctacaaaagttttagaccataggcaagtatagttatatcaagtgtttactaaaagaaatttatttacaatactataagtaacgctcaaattatattgcatgttcgccaacaagttatgacatgatgagctacttgaagtagatcgagnatctatccacgctt

SEQ ID NO: 34304 - DNA, 2825 bp, Oryza sativa
  unsure (1)..(2825): unsure at all n locations
acggttgatgtacagcatagatcagacactcatcattattctatttatttgatattaggttatttcttaataattgcggtctctgatacactaatacactatgagtatatgactaacaaacaaacaggtacatatgccacttagcaatcctcaagccaaaaccgagtgctaaaggtaaaacacacacatacacaaacaaaaaaataataattcggtagctcaaacaagtaggcccgtgaacaccagatctgacagatatacttgcataaaacataacatgcatgttcccagatatcccttttgttttcgtagtctacgatcgatttgtaactctggaaagttggtttctttaaacgaggcatgggtgacctttttgttccagagaaaaggaattcaggagtgctcaattcatgcaagttgaagtgtacatatcatcaaattattctgtgaggaggaatgcaacatgttatccattctgttttcttcccatttattatcgagagacgagtgattgcccaaacttttctcacggattttcaatgatatcatgaacagaagatatacataattaattattatcctccagctcgtaaactggcgaaatgggtccaaacattcattcaggtctctacacctactcctagctgactgtcattgacaaatttgatttgtcccatctctcaagtctcaaccgagctaatgctgaagtagtgttctgttgtaggaatgaaacacaactgagcttgaccattttaagggctcctttaaaatgcaacaattttataggaattagcccaattcccataaaatttgtttccaaatcccatatcttcaaaggaggcctgaagatgtacatcactgaccagccatttcctttctagcacagcacgaaacaacacaaatgtccaaagctagcaaatattcagatgcacaggaattgaacgcatacaagtacacggcacatcaaattatttattatggaggaatgccacagggtatccatcagaattttttttccgccgggccagcagcaaagaaatgccccgaccgaatttatccatcagaattttctcatttatatttcaggaagatgtcaatgcatcacagccgatggtccaaacgttccatcctagttagctaactgtatatattgacctatccgatattcccaacccatgactggagcaagcaagcagttcaactcagctaagcacgaagagggaggagctctcaagccagtatgctacctccctcttcgtgattcggggaatcagttccactatagaaggaggcctcacttgaggcgtccgaaccgccaccattagcctccttgtcagcggatacatgtgaatggtcctgaggcagggtgatgccgtttgatttgaatgaagaacccatcttaatgtcatcggctctcatacgctcagcatagctattgtattcgaaggtagctggattccttccttcgaatgctgagtcgagcttgtccaagtcaaagacgtcagccattatcttctggctctctttatcgctggagtacacaaatttcaccttcttgtaggtctcatggtccaaaaatggcttcactatctgccaacagtaactaatgttaggctaccttatctcatgacaacagagtaacacactaaaaatagattaattttactgtccttgagaatatgcacactttgtaatgttaatttgtggttcagtacctcaacattagggaggtaccaaaacaatacactagcaagtgtggttgaacggtaaaaatcctatatggtaaaaagacggaagaaagaataagtgaataactgtactctcaagatattttaaggttgttctcaccttccagaaggactcaaatatcctaggaggattgtaaaggattgctaacccaagcctctcagggtaacagtcttgcaagacgttcacagtctctcgggtcactttcagcggtgtgctccccaatgtccaactctggaagtctgtcagccagaccatcttctcttgatcttccgtcaggctcataattgctttctccagacagtaaacaagatatttgatctgtccctttcctgaagtagtgttctgttgtgtttcaaagttaaacatgtaaaatcagcacatagcatgcaatcaaaccagaaactgttgtggcatagctgtcacaaaatattggttcataacaaatgatctaacaatgcacacatgcacacacccaattgatttgagaaacaataagaaaaatccggaataataaaattataaccaaagagtgagattctccttttggtttttccaaatgctgattgacttcaagctaaaattgtaaagatgtatgtatccctccgttatccacatggtcgatttgattcatagcaggaaggataacatgatagcattgcacacattgtatggagaagtaattatgtcccttttatctggaaggtataatcccaatctgatttcagagcatactagatggttggcagatgtacaactaatgcagatgagtagatacatacaaagtaaacagaaagcacgagctatatcaaaacaagactgttatgatgttaatgtattcctttcttcctgccgaaagtgcactaacctgtaagcctggcctcaggacaagaacagttcttccatgtttgtccttgtagtcagccctatatatctttcctgtctctgcttcatgtgcaacatcatcctgaaggttgaaaggacaataagattacattatgttgtaaacctgaaaatgcagttcttccttgtatcaangntttcttnntnnncgagtgactgtcaacntcctnccctct

SEQ ID NO: 34305 - DNA, 12013 bp, Oryza sativa
  unsure (1)..(12013): unsure at all n locations
acgcatggatgcacttactnnnnnnnnnnnnnnnnnnnnnntcctaagtatcaagaatgttctgctttagcatcacaatgctttctccccaatgattcatagaatgctatcctcctattagcacaatcctgtctaaattgacactaacagcagttattcctcctgtctactccctctttccacaaaatataagaattccaagcgtaatttgtccataaatataaggattcctatagtgccacttgaccacctctcattgaaattacttcccaccttactcccaactactcttccaccccccccccccaaccatcccccatttagtgaggggcaccaaagtcttttagtcttaaccttaatcccttctaaacaacctagaaattacctatggctctcagcatcaccaatgtttcagttataatgctatttctattacagcccataaagaaatgcatattcaattgatgattaacacaagcatacccagttaatcttttgtggcatatatgacacccgccactttacagctgacttcatcattttacttgctttctgcacgttccagtttcttgctcgaagaaatctcaggcacgaggcatctgaaaggaaatcttgtatttcttctgatgagtgttcaccaagctccttacgcaagtcatttatctgttcatcagtagatagcacaacaacaaagtaaatggttcaaagcgagagtaactaaattaaattacgaagagatatacaatcaagggatttttttcaataccttctcctgctgctcttctagggtcaagtttttctctgttgtagcaccattgcttgacttgaatagaaaggacattttagtacctcgacagagaagggtccactagatacggaactgaaaagcaataaatatcatcagacatctgaagagtactaaatatgcacgaactactttctgttcagcttccttgtatgaaggcaaccatctgaactaaacaacagaataacagcttatgaggcaggtgcgagaaaaaaacttgccgttaacaaaaattcagtttcatacaaaagataacagaaagtaacaacaaatgctactttaaactgatatcagtacatggttagctagctgctaccgcatgtaattcatacgtggctggaagagcagtatcctaaatgagaagcatttcacagaattcagaaggccgtgcttctgaaaaaccagccgattcagttccacagaagacaaaattgcgacccgaaactgatttcttaagttaaattgaccatccaagatgtcactaagttaaagtagcatcaccatataccgtatgagccagatccggcaacgctaagtttcttgcagattttacaagacaagtagccgagtcaagatcacgtcaacgcaaacaatcccggtggcaattgctactactacatcttcaatcctagtagcacgacacatcacagaacgaacacccgcaattcgagcacgaacagtcacagatcgccggcgtatacctaatgctcctcacatcaaagattaggtagtagagaaatccgatctttggccgagtagaagaaaaccaacctggatcgatgcacccccagcccccaacaaccggggaggctcgcggatcagggccccccgcctgggcacgacggctagggctggggtggggaggtggcgccggccgaggtgggagagtggtggtggtgggggtgggggtaacgtgagcaggccgatagtgcagacaacggtgaaactgaagggtaagggtgggtggggttttcctagacagaatggtggtccggtccggtacggtccgtctcccgtggcgtggtggtggtggccgtcggtgcgggtgcgggcgtggaagacgggacgcgcgccgggtgccaaaggcaaaggccccccgcgtgtatgaccggccaaagatgccgggtcaagcgcggggtcggggtgggggtggttaagtatgatgcgcgatcacgggagcgcggagtgtggactggaatggagtgcaccacccaacgagatattaccactcttaggacaagtactatgagcataaagcatagtctcataggtgtcacataagctaaaatagtgaggtggaggagagaagagatgaaagagatatgcagccacctctcagagcatccgcaatggttatctataggctctctacaagatatccaagtcagcatattttcctatttgaaagagattaaatgaagagagagagtaaaactatctactaacctggagatagtctatagaaaaaaacgatgcaatagattagagagatatagatacccatatagacatactattaaggtgatttactattaatctagtctattgctgagatgtacatgttttatagaaagcaccttactttactattgcggtggatctcatgcaagatgcaaccaccacacaaaattcaagacaaaaggagagagaggaagagtagattaggcaaacaaacattggggctagtgtattagaattagtatagatgtgatatattgtacatattacctctacatttattagttgatgatgtggtcaagattagatgcaacatccacctcttttataaaacttgcctttatgctccgttcggtagtacaagttcccagctcctcctcctcgttttccgcgcgcacgcttttttcaaattgctaaacggtgcgtttttttgcaaaaagtttctatacgaaagttgcttaaaaaatcatattaatccatttttttaaaaaaatagctaaaacttaattaattacgcattaaaacgctgtttcgttttgtgtgccggggagtgggctcaagcacagtagactataagctaactttaaacatatatcgataatataaaagaggagggagaagagtaggctacaaatttattcagctgaagcacgaactcgaatacaagtatttgtatgacaggtggaaccatataagtatatgtttatagataactattgtatgaattgactattaagttggttataagtgatttggagctagtagttggctatactattaaacttgctcttacatgggtaattattaaagatttatcactgaactacgagtaataaatctttaattgttatatttaaaagtggcaaataaaagagtgctcgcacaagatttttttttctaaaactagttttacatgcaatacgttatacgtgatcgtgagatttttttttctttcacttttcttgagagtttttttaagataggtttttaaggaaggaaggagaacaactaagctggtggttttttaagttccttttcttaaaaaatataaagaaatatagcggttttttaagaaacactacgcttttaaactacttcagttgcctttgtttttataattttgtagaaatacattatgttttaaaaatatacccgtgtcaccgaccaacgggagattaaaacatcgattttgctatatatatatgtcgacaaatttttccctaaaaatttgacagatgtaattacagtacaatcgtagtgtaattacactgtaacttgcatgtaattacactgtaactatagtgtaacttgtatgtaactttcaaaaatctctctgtaacatgttatttcggtaaaatggaggtcgtgggaacaaattctttcacatacgtgtgtgctatgatttgttttcttcctcaccaaaacaaatcttgtaatagatctaacgattcaaaattatgtgaaacttacatataagttacactgtagttacatgcaagttacagtgtaattacatataaattacagtgtaattacactacaattgtactataattacatctgtcaaatttttggagaaaaatttatcgacaaatggataggtagtcccttaaaacattgttacctcttgatcgagcgacactgggccatgtcgtttctcaattgaaaaacagcataactgacactagctaagacggcaagacgcaacaggcaagtgagcggaggagcacctagcacaagcatatgccaacaggcggtggtgcggcgcgtgcgagcaaagtcacattgaggacacagtctcacccagtaatccgatgtatgatatgctctgttcaggagacgcaaaacgaagtctctattattgcatgattaattgagtatttgctttttttaaaaaaaaatagattaatatgatttttttaaagcaactttcgtatagaaattttttacaaaaaaacacaccgtttagtagtttgaaaagcgtgcgtgtggaaaacgaggaaagggggttggaaactactactaccgaacgcaggaacacgaggatcgactcctctcaatcagcaataaatgtagggcttgttttgcgtcggtaggacatgaggatgtttgtttgttacaaaatttctgaagatatattcatacaaactagtgtaaaaggtttattttctccatttttaaatatttgcactgaggcactattgatacgtgctttgacaacttttttctttaaaaacataaatacttagaatataaaacatcttcttttgtcaaagtttgttgtgcgctgaacatcttagctagtgaaaagtaaattctaaaatgcttctgggatgagccacatcatccagtgaacaatggttattgcatcaagaaaaagacaaaataaaagagaagagagttgagccatcaattataaagggaaaaatggatgatgaatttctggaaccttccaacaatttggaaatgagagagagaaagagcaaagaaagaaatgtagcattggaaaagagtgggggagtcagctagcttatggcatgtgataattttgcactatgcacactcagtagaaattatgttataaataaaatctcatcctttatttataaataataattcgaatttttttataaatggactatcggcttataggcttatattttatctatagataatccttacaacctactaattccaaattactgctgtaacttgaatgtcacaatatcacataacatactaataaaatttgctatgattttaatgttatactttggttcacttctttagcataaaagctaataggttgggcttaagaatgagtgtttcacctacagatacgctttcaggttatagctgatcaactacacttctctcaacacatacttaacataatgaaacgatgtttattgttgccaatttaaattacatgctcatgtacacatataacatgatggttaaagtcgcgcgaacaagcgacattatatgctagtaaagttgatggatgatttggtttgaagccaaaacttgcataccaaaatattggcattttaaacggtcattttggtaatgtttggtttgttaccaatccttgccaataccacataaatattgtcaaaatattggcattggcaaaaacttacctataatttggcatcgccaatagtttggcatagttacaaaccaaacaagacctgaaacttttgttcattgtagcctacccatcttaaaattactattaggaaaaattgaaatatatagtaaaaatttgaaattaccaagtaaacgctaccggagggagtatgtttcttttttttaaaaaaaaaaagaaaaaaaggaaatctccgccagaacgccacccggcatcgtctggactctggatcctcctggatccatgctagaggcctagagccatagattactgatttattgtacatactttcaacatggcagatgttcttctcgaatggctctcggcgttttgttaacacaaaggggcgtaatgtgtcatgtcgagttgtcaacgaagatggtagagggattccatcaggctgagcgcagatcggaatctatctatgagtataaatgataatgatgtggatacagttaattactaatgacgtggacacgctttaagatgctctagtctctttcacaggtcaaatctcgtgttcaatagtactataggagtagcagccaaggagcagtttagttagtattatgtactcctccgtcttaaaaaaaattcaacctaggactttgatgcgacataatatagtacaacgaatttgaagaaacctaactcctcttttttttcatcctccttttttttctcttccaaatttctctctccataaatattttcattttgaaattatcattgtttaagatgtgtagcggcaagtttgttctcatgcaaatgcttttcatctacagaaaaaaaactttcactaattgaataatcaaaatttcaatttttggtcaatgaggtatagcaaaatacatatgcgacgaattatggaatagccactcgatcgattttgtgaggctattaaaaagtgtacgtaaaggattctccgtgtgatgacgcatgaagcaagtgtaattgggctcaatgctatatatgatttctgactttgttttgccattattttatttatcttgtttcagtttgtcatttaaattggcagagtttctacccatcgtaaaaattatcttcaaacccaacgccatttttgctagttataaacttataaataaagaaagcgctggcctgcacctgtctggcccaatcggctgggcttgcacccactcttgggccttgggccagtgggccgtaagggaaagagagaggaagacacgagcttttcttctcctcttcctctcccttcgcccgcggcgacaaccctgaacccttctctctcttcttcaccaccttccctgcgaccagcggcgcgcggcagcggcaggcggccaccgggatggcgtcgtcgtcggggacgagggaggtgctcatgctggaggccccgccggcgccctccggggcgccgtggcgcgcgccgccggacgcggaggccgtggacgcgctgccctacatcgacggcgactacggcgacccggcggtgaagcgggaggtggaccggatggtggaggaggagatgcggcgcgggagccgcaagcccgccgacttcctccgagacctcccccccgtccccgccatcgggttcgaggtagattcgcgatctctcatctcctctcctctccttgtgggttcttggagcagctctagttcagcgtcggggtcgttgcgttcaactatcttttcaggcgaaaaaaaatagaactgtatcttttctttcgaatgtgattcgcgttagggttatagctacttgtaagaatgaaacgggttagaggctggggggtgtatagggttagtagttgtgtactcgaaagtgagagcacattgctaaatactgtacattatcctcctttagaactgtgcttataactatgttttggtggcggaattttggattatagttgagctaattaactgagtatatgtggcttgcttggatttgtatagaacttttttttttgtaaagcttaatgttttgctctgctataatgtctgtatgttaacgttgatcctgaaaagaacaagagagtatttttttctgttgccacatgcttcaattgattagctcgtatggaggacagatgcctgatggtccgtgccttcaaattttctgaaataataataattgatagttttgactagatccaccctgctgcaaacagaaaagcaacatattttggctgcaaatatttaacttttttacttagcaacatttcttgaccaccaaatgaacctattgatttgatcggttacttgaaattaagtatacaatttgaggcaccaagaactgaaatataagctcttttccatgttctgtgtgcattgagctaaaccgacaggcaatttgaacctgtggcagtcaataatatgacctaaggtatcaaaagtgcacacggcagtcaatgaagaatagttattataagaaaaaagaactaaattgaatgggcattcacgctttgatgatttcatctaaataattcttatgagatgtaccagtctaggtgtttgcatcatattaactctgctccataatagttgtcttagagctcagagagcaaggaaagggttaataccttttttttcacaaagtttgcccttttggatgatataatctgtgcttatctgtgcaattgagtcatatttgaagatacatacagccatttaattcgttgtaggcttgtattgcttattgaaattatacaaaatatttgaatcacaatttgggtttcatttttttagaacttatgcctcatcatgtgaatatgtttacaaccttatgagtttttattatttgatactcattttgcacatctgttctagaatcatcctatgcttgctaaagagtacgagcgtgttagagctgggaaacctcctgctaccatagagatgtcccgctatggtttggagccacccccagcgaacaagaggaatgatgttgctgcatggaggcaggctctaagaaatgctcagagccagctgcaccatcaaatcataaggtaagagtagagagccacagggtactgaactaatgaaatttaccatcaaaggtgcagtatcgttgaacgttgtgcatttgattgtgataggatcacagggaccagtgtcttcctgtggcatgtccttttgataatttttcattaccataatagcttttaagctttccctggtgtggaaaacatagacttcgagaatagtatcagagtagataggatgggctgcttgacaaaggtttctgcagtctgtttaaaataacaagcagtattattttgataaaagagcatgttttttggatacactgacaatttgtaaattggaggattgtataatgctcatagcagaagacttttccttgtactttactaaatgtatcttgggtaaattaagatatttgatcatgtattgcctaatatcagcttcaacagtttacttgacaatgggagctcctaggttagttatgattgaacatgtaaagcttcgatcatgttacttcagaattcgactgctgtacgcactgtgtaggatatactgcttttttctgaccatggtttcttatcatctatggagtcagcatacttctatgctattattagttttgaaataaagttaatattgcaggatagagaatctggagcttatgctgaagtatggtgttgaggtttggaagcttcagaatagacaaatggaatcagttttgtctaggtaggctattgtgacataagtttattatctttgaatttggagctacgtatcctgtgttattcatgagattcatttagagccatttcagtactcctgtttgtagactctggtctcatatgttgatagtgtagcttagctgtttaaacttccagtaaagcacttattttgatatttgaagcacttatttcgacattcttgtaagtctcaatgctacttatcactgtaacaatatggatggtagattatttttatgcctgattgcatggtatctaagatgtcgaatatagcatttatcattctagcagcatatgatgggttgatctctttataggatgcaaaagatggctgtcgaatacaatgagaagatagaaactgtcaaccgcgagaggaaatttcaccaggtaattatattactcctgctcttgttcttaaccacggcatatttcacagccaagctgatcatttgtgttttgatcagcaaaacactggtggtcaactccatgccttgacgacggaatggcaggagctgtgtcagaaaaatatagctattcaagctgcatgtgttgatctgcagaatcagattgatcagcttaaacttggagctaaagaattgtactccccctctctccctactttcctccctctctctccacatccacatgactaacagattccttaacaggggaatgcccatcgatgacagcaccggaactaatcagcaagcatcatcagccatttgaggtactatttgttattttgttctcaaagaaagcagtattcttaggagtattgaagttaagtcaagagacaaaatctaccttcatcatgcttacaagtttttaccacagcacagatacataggtagcaatggaggtgagacaattccatgagatgggagctggaggtttccatcaaggcacatctttttgcatgatctgcagttgccaaatccaagataacaatctaggcgattaccttgacaacccgcacttgtgattgtattccgttatccatttttcgaggacttgtgtgcatatggagacctgatagagaaacagatcgtatgcatgctgtgtttctgttccaagtgatctaacctgtgtgagaggcagaaatctcatcactgaaatagaatgtaccttgacattgaagcgtcagttaaggtttttgttatttatgttgacatgtttgtgtactcttcctgctgttaccatacagttttactaaacatgagttgtactaaccatggaggttgatatggaaataattactacctccatcctaacatagaagtaccgacaggatctttgttcagatcactagtaataggagatggtccattccatccatccggttttaggtttttatattttgaaatggacgtagtattatacttagcatgtcatggattgaattattgaagtaagcccccaccttcctggtcggcgtagtcccttgaggccatctctaagtttgtaatgaaaaacaactatagttcacctagagcgtgaatactctattttgattttatgaaccacacctcaaaagaaaatcttagttttgaaagcactaaagcaactagaagttcattttccggcatttattttttttgtttaaaaaaatactccatgtaagaaacaaatcttcagctttaaaaccaaacattattcaactactataaaagctatcaaatttaaccttcaacatggtttcttctcatgttgaagaaatgtttttgagttattttaaaacacagatagatcatatgatccaattaaccctattctgtgaaagggcatctagcctaatggttacaagagtctcagtagcacctgagtaggggtggaactgagctggaaacaagataaaacttgagctcggctcggctcatttcctggctgcaagccttcttattgaaacacctcttcatatatattttataattattagaaaaagtaaaaccaaatcatcaacatataaaatttaaataagtttgtttattcaattcttcaaaatcttaatgataaatttcaagttgacaaataataacgccatataaagtaaaataatcgatataaacacacgatggcctaggctcacgagccaaaacaagcggctcgcgagctagctcggctcggctcattttcagcaacgagctgaaaaggaggcttgggcttggcttgtttggcttacgagccgagtcaagccaaccaagctcgagccaagcctaagctgagctcacgagcctaagcttttttttccacctctacacctaaggtcctgagttcgacaccccatgggaacgaattttctaggatttagcggcgctgtactttcagtggtaggcgacgtacccgtcgacagcgaggtgctgacttcatcaatctctccaggatttgccggcctagtcttcgaagatgctcataggggtagggtttgcgtgcgtgtgttcatagggtgagtgcgcgtgcgttgagagtttctgcgttgtactgtgtaattcaaaaaaaaaaaaaccctattctagctacaaagaaataagcatcgaaacacaaaggttcatttgaaaatctttgaaatttcatcaaacacccctgtccaaaattcataaaaaaaatttgagctgtggcgccatctcccatcccacccagcttttgctgtaccaccatgccgcgaccggagctacactccaatctcccactcgatccccacaaaaacaatttgggtaaattcgacaacgccgctacactccaatcttccactcgcatctcatctggcatcaaccatggccgcagccgtcgccgccgccgcctgccactccccggcgcgcctcgtggtcacctgctcgagctccgccacgcccgcgccgccgcgtgatgngctactgtagcagtcgttcgtcctnncacacg

SEQ ID NO: 34306 - DNA, 978 bp, Oryza sativa
  unsure (1)..(978): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttaggtgacactatagaagagctatgacgtcgcatgcacgcgtacgtaagcttggatcctctagagcggccgcctactactactatacggctgcgagaagacgacagaagggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcacaaaaaaaaaaaaaaaaaaaaaaaagtcgtatcgatgtcgagcgatcatgatgatgatgtcgacccgggaattccggaccggtacctgcaggcgtaccagctttccctatagtgagtcgtattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttnnnnnnnnnnnnnnnnnnnnnnnnnnnnnnnnnnnnnnnnnnnnnnnnnnnnnnnnn

SEQ ID NO: 34307 - DNA, 785 bp, Oryza sativa
  unsure (1)..(785): unsure at all n locations
catgcgaatgatctatgagctngcacccatcaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttaattcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttggattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctgnattatcntcaccttttatttgatccctatttatagattacgctgcgttgctaacgggccgcaccttctatttctcaggg

SEQ ID NO: 34308 - DNA, 753 bp, Oryza sativa
  unsure (1)..(753): unsure at all n locations
tgaagcggtcgtcgcccatttccatacagaatcttcgactaatgtcgcgtggcaaactcttgctgaccgtgaagtccaagaagtacccacatttgcgcatccaggaacacatcgtgacccgagccagctgcgaaatcttccagaccctgctggcgccgcacagtgccgaatcctcgaccaagagcagcggtttggcgtgggtctacttgaacaccgatggatctctggcctacaacatcgaaacggagcacgtgaacacccgggataggcccaacatcagtttgattgaggagcagggcaagcgaaaggccaagctgaaggatctgacgccgagcttcaacttcaaccaggccattggtagtgtgaagaagttgggtcccaaggtcctcgagtcgctgtatgccggcgaactgggcgttaatgtggccaccgagcatgagacgagcttgatccgtggccgcctagtgccccgtccagtggccgatgctcgggactcggcggaacccattctgctgaagcgacaggagcacacggatgcacagaatccacatgccgtcggcatggcctggatgtccattgacaacgagtgcaatctgcactacgaggtgacgctcaacggtgtgcccgcccaggatctgcagctgtatctggaggagaagcccatcgaggcgattggagcgccagtgacgaggaaattgctcgaggaattccnctgcagaagaagggatcgaattaccaggntgcaaagggccc

SEQ ID NO: 34309 - DNA, 777 bp, Oryza sativa
  unsure (1)..(777): unsure at all n locations
cgcgttgatggcttctcgntggtacagtagttcatcaatacttttgatccccaaagacagggatacgaatccaagtttgatgaccaccaacaatagaaaacattcatgtgaatagtccagcatacataaggtattgcattaaacaaagccgtatgatctgtagtgacacttgtgtataaccaaagtagtaggattaaaacgggagcaaaaccttacttttgtctacgcttttgtgctttgtcagtttgatttcacacatgatgtgcaaattatcatgtgttttgtgagggtaaattttggatatggtccagggaatatatatatatatatatatatatatatatatatatatatatatatatatatatatatatatatatatatacatactagtacaacctgtcaggtgtgggcctactatgaggcaaaaaggtttaagtgagaggaaccactgatatatctttgggcatatgcattggctcattatggtaatttaaaacaacattttttacgttttgatacaggagggtataatataatattatataatccatcaaaggtttcgatattgagtagaaagattatgggtagtgtacaggggcacaattatgctgccttctagttttttatagtacaagcattatatgaatattttaattggaatgcttatttttaaggagcattttctgttttataagaccattttattcctctttccactcgctaagcaaaatatgagcttcttttttgagagaatatcacttattcactccctcn

SEQ ID NO: 34310 - DNA, 6343 bp, Oryza sativa
  unsure (1)..(6343): unsure at all n locations
gcgtgccgggtagactaaccagctggtacagnagttcatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttctaattccatacttgcaactccagacattccaatatggagatctagtgcactgtgaaactacttttgagaagatgggccgcacatcacaggtttgtgtctaaattctgatcagcttctttcttattttcactacttttcggatttttgtggtcccaatttaagcttgtggatgcatttctgaacatatttcaggtaaacatcatatgcggtcaatgcccaaataaagaatgcaaaggtctgttgatttttcttattttccatacacctttctgattcttggggggagtactaactaaaatttgattatggttggctgcatataacaagtttctgattcttgcggggagtactaactaaaattgataactttattataggcaaacaaggatgcatctgtagtatatcttatgatgaactgatgtgcaggtaaccagtttactttatttgcattttgggtgaagttttctttctgataattgatgcagtagttgtggattttacccagtgcctactgcctatactaattttcctttttagtttcttgtaaatgcatcccatccctattttatgtttgatgtactaagtactaactgccaggctctcccttgctgtattcaaaaaacttgtaagagttggggatgttttcatttgtatagaactattagtgtggaagtagtaaccggattccaaaaaattttatgttcgctagtaaacagaataattgaaccaagattactatttttttagaggaaaccatgattactattgagtctaggtcttctcatccaagttgttcccatgctgttagcatgccatgataatatcttgtaaaacgaaagacaatattgtgttaaactttgaagcggtttagcacaaacttttttagacacaagaagaggaatagatggacaaggatgtaatcatgtaaattgctttgaacagaatggtgccaaactttgtagagaatatgactgatataaacatgattctctaaaatcaaagaaaataaagtttgaacattgagtatgatatatatttcaaatctgtgattgcttcttggtgttttgttttactccttttttatatgttcttatatatgtttatagcattatggtgttacttgattgattctagtgtgtgcttgactggtggctaaatgtgatctttctgtcagggtgactggtgaacttgctatcccatgtcctaaaagtggtccaagagtatttaagggtttcactgtcggattccatccccggtcatcagagttggtaatgctggctgattggcttttcttatttttggggatcttaactattatttcagtttgatttacaagtaattttgttaccctaggtttataatggattgactcaactgggatttgagcaatctcatcatgagttcaggtattatcctgtcaaagtattgttaacttttaattagatgatgttggcctatttaagcttcagcttatctgaatagaaaatacgtaattggacactttgattgctttcagaaaagaactttcatcaggcttaatataggatgcagtgcctagagagggttgacttgtttttaggtgggatttctgtaagttattaagtataaagcctatatggttggttggacccagctgtctctgtctgtggggtgatctagttgcttgagtaaccagtttgttacttagtggctacaacagatgcatggcatgggctagaccactcaggcactgacctgtcattgtgggaacttttgggggggggggatgattaaatgaaacaccccatatccatccaaatgcatggatggaagggaagtctttaaacaaaatgccatatgttcaagtcaaaaactagagtttgttgttttgccatgaattctggtgctattagtggatccaagtaggtgctgaaataaatgtaggtcggacagggtaataatcaaagcttattctgatgcatattatgtaagaaaaacttggacatgattcaaaacgtgattgagtgatggatagtcctaaaatggttgattggatgaatgtaacacaatatatatagatatattttttgttatttcccagtacatgtgaaaattttcaactagtcctaaactcccagaatttctgctgtgaaattttaaacaaccgctacattatttacatgtaatttccattgcattattctgttttctgtgcagctttcagggtgagcagagtcatgtatccctgtatcttagtgcagtgttttcactctcaggacttgttggaaaaccttccttgaaggtagggaaaaaaggatttaggccataaaaacaacactttttccatatgtttttcttcattgatgaaatgtttttttcccatcagatttcgtacttttgtgatgttgtatgttgctccgtgttagtgaccacttcatcagtgcagtcaagcctagcttagttgataataatactgcagttgtcattagtagaactgtactgtatacatgtaacttttaaaccattttattgaaccaggttaatccagttaaagggcttgatgtgacactgacaggatcagggaccaacggtgctatgcctactaccctgtcccctacaattctgaatgtgatctggagatgttagttgcatccttgtctctccgaacagatgcattgatacattcaatgtatgagcttgttttctatattttgtaggtgaaatcgcgcggagcagtccttatgaggtcaacattttgattccagtagaaggctatgatccaattgaatttacgctcaccaaagaatgtggttggttcgaccacataattgtcagttctacataagtgcatattgacttctagtcgcatttagacacatttcaattgagaaaatttcgtacgttagaaatccgatgggtttagttttcaataatatgggacataaatttaagaaaaataaaaaaaactaacattcattttaacttagtgtagtttgcaattctatgattagcaccatctgaatatttgctctgtagattggacaagtgtgttcctatcttgaagtcaagaagtcaagatatttatggcaatcattagtttattatatttatcttgaagatgaataactactaaaagctgcatataactagtattgtgatacaagcaaggtgaacaaaagttagttgattagtcttacaattctcatcttccttgttcaaaaatgcacagatatatttcagtttgattaccctgtgagttatgcatttgtttgtttgtgtagttcatatacaagaaaaagagagtaatccaatgagaggctgggcaacatttgggattatttcttgcatgtatgtgtgccttgaactttgtaaattagcttcacagcaatggtatatatcgtaccatgaattacaaagtctgttttctgaaattagctcttcctcaaatttggaatcgtttgtttcatatgtataaattgtcctgggccttataaactagcttcacagtgaccacctcagattctttcgtaaacatctttgttgcaattagttttcctctgacgctctattcatcgattttttactgtttttctatgggcatgcagcttcattgtgttgtcaagtctactttgttgtggaggtttcatctacaaaacacgtgtccaacatcaggtaaaattttattctgtaaaacaaaaatcttataagcaatactgtgcagaattgtcttgataaatggcacctttgcgccaatttcagtctggtttatatgcgctgcctgggatgaccatcttgtctgccttcctagatgcggtaagtgttgaaacttttatctgaactacctgctcattgccatatgacaaagtaattaataatcatataataaaatgccaaaatacttatttgtaacctaatcgtttgtgatcaggttggtggaccaagctacatgagagcagatgatcatggcggaaaccatgcaagccaagcatcatgggaacgcatgcctggtacctcacaagcagcagagcatggcaccaaagataggagatacggatcactttgaactgaacgatgctttagtttttgagggttgcttttttgtaagtttgaagtattctgtaatcagacaaactctgcacttcatctgcagttgagcttccgaagcattgcttatcatcttttcagcttagatggtgttatgaattgtggtggtggatcattcagcatgccaccatcgtcatcgccatccgatcgacgtgcatgctcattagcagatactagacctctgttcttagatagtgctccctccagtttttaatgctcaacattattgactttggacatatgtttaatgatttatcttattaaaaaacttatgtaattataatttattttgttatttgttttattattaaagaaaagcatgactttatattttttttgcatacttacattattttttttaatataagatgatgaatagtccgacgtacatccaaaaccaaaagtcacggatgtcaacatctatcatatctagggttttcaatttcgaaatcagttttttttttgtcgggggagaccgaaatttcggtaatttcagaaattttttttggccaaaattatttgaaactgactgattttgattaaattcgaataaaatttgaccaaattcaaaaaaaatgcaaaaaaaaaaaaaactgaaaatttcaggtgagatttgagcttgccggtagggggcgaaattaccgaaatttcaaaccgtgatcatatatttaccctgtagttcaataaatagttttactcaccactcattctttttattcatcgctcaacggtccagatcatctcgctcacatccaacgcatgcatcagaatcaactagccggaaaatcgcgcacgcgggatccaccaaatcgcgcgcccttctccctccgcgcgcgcctacgccaaatcgccaaccgccgccgccctctctcccgcacccgtcgcgaatccccctccgcctccgcaatccgccgcggcacccacacctccctcccctcccagatcgccgccgccgatcccccgcgtcctccaccgtcgccgaatccccttcagcgttggatcgagcgccgtcgtcatcatcatatcctaactgaccaagcaagcagcggtgattttttgttgaaggcggtttaattaccttcgttattcggttcgtgcaaccacactctctcaccttcacttgacacacggacgatcgatgggcaacgccgtcggcgcggcggcgaacggcgtcaccgccttcttcggcaacaccttgttcgcgccattccgatccctcttagacgtctcctgcgagtaagaacttctgttttttttttttactgaaattgatgttcttgcgtccgatgagaagaataatccgtgtaaatgttgttcaaattaatcgcgcgctgattttgttgttgttgttgttatttaaattaattcttgatcatcttctagtggcgtttgcgcgggaacatgggacgcgttctgcttcatcgaccatctctgcgcgctcagcctcggcaaactcatcctgttccttgtcctctcctacctcagtaagttttgctactcgtagcgtttttttttgtttgaattctatactaaatttcatccaagtttgttctaaattaatctagcagcgtgttaattgatatttcgatgatttgatttgattcgcagtgctgctggtgatgtggaagctcggcggcaagtgcgtgctcaagagcgcctgcaagacggccatggcggcgtgctcctgctgctgccacgccatggcggccgcgccgtgctacctctggcgcgcgctgcggagcaccaggcgcgtgcgccgcgggcgccgccgccgccgcgacgacgacgtggaggaaggaagaggaggaggaggaggatggggcggctcgtgatgaagtacgtgcagtagcaagnggtccataacgcgg

SEQ ID NO: 34311 - DNA, 12777 bp, Oryza sativa
  unsure (1)..(12777): unsure at all n locations
ttaccaaccctgatggcctttcgccgccgttgaaaacgcgggggacccaacgacggcgttttggaaaggattggaaggtgtgggtcccctcgtcggatttcggaagccgaaggggtttcctcgaccggttcggaaaaaaaggccgtcgccggtttgcaattttgggtaaggcgcgcccgaaggganaagggcgccgattttggtggatcccgcgtgcgcgattttccggctagttgtttttgatgcatgcgttgaatgtgagcgagatgatctggaccgttgagcgatgaataaaaagaatgagtggtgagtaaaactatttattgacctcaagggtaaatatatgatcacggtttgaaatttcggtaatttcgccccctaccggcaagctcaaatctcacntcacatcctccaccgtaggcggggagtccggtggcgtccgccggcgccacggtagtagtgacgtcgtcggcgcgagtaagcaagagcgaatgcggcggtctctgcggctgaggccggcgagcttcaaggataagccggtgcccacgccgccagaaggagcagaagcagccatggccatgggaagaacgccgccgccgccgcaggccggcgtctccggcgtgtcgggtcgtcgtcgaggagaatgtgatcaaaggtgttcgtcccgtcgccgccgagtggccatggcgcgcgcgggaatctgatggtttaaatatgttcctttactcaaatatattcttgtctcgcatctccaacttagatatattccatctgaatcacactgtctctgttgttattcggggaaaatctatagttcaaaccacaaatatgatgtaaatcgtaaaacttttactctcgctaaaacttaagtatcagagtagtaaatattttactttggatgatatgaacaaatcttagatgtcactttttcatcatatgtagagcctgtttactttgatgaaaaaaaaaaaccttaccaaattttggcgttgccaaaattaccaaaatttggcaggatttcttatatagttatcaaaatttggtagcaaactaaatatagctatttttttggcaactttaccaaaatctggtaaggttgaaaatggcatcaaaagtgaataggcccgtagtttctaggtttgtactctatattttcctctatttttcaacaacatgcctttatattctatcacacccatccctagaatacattatttttagctatgcacctacacatagaggtagagactagagagtggtctaaattatgaaatataaaactaaaacaatgggtatctttaaattttatctaattatgttacggcacataattagtttgttggtatttattttatgaaaaaaattaagttacttacatttttcactgcttcgaggtacaaaaactatccttccacaggtcattcaaaggaattcggatcaggtgcagttgcagtagtaactgcaacttagcaactgcacgcaacatcggccatccatttttgcgatcaatggtcttgattcgtagctacagtaaccatgtgaacagtaattcgtgctacagtgtttactgctacagtagtgtgaacagtcaatacgtgatctaggccgtccagcttgtatccaacgatgcgtactgctactgcttagggtgcagtcactgactgcacctgatccatatcccattcaaagatgataaaattatccttaccagtgtgtacggacggccctgttcgtttcttctaaaagtagaggatgaaaatttggattttcgtggcacgctttttaaatcgttaaacgatacgtttcgtgtgaaaattttcaatatgaaagttgctctaaaatatcatattaatctatttttcaagtttgtaataattaaaacttaatcaatcatacgttaatatcactttgttttacgtaaaaaaaaaacttaatcttcatcttcatcttcatcttcgttttatgtatgatttttgattatgtgcaaatttcaaaaatcaaacgttggtgtggctaaagaaataagaacaggtgcgtggcaaaacaaattggtgacttttgacttttaagagacgatgtgataacattcatcgaaaggactggaattacattgagtacaaaaaagaaacaggattaattttgaaaaagaaaagcagacagggcttgcagactgcaattacacctcatgccaccacacttgcgtggtgacatccaaactggaaaacaatctctaaattacaacggtgaccaaaagcaaaggaaatatattgatgcaaattaaaccgaacccgctttcatatgctagatcttcttgttaaccacacggcagttcttgcggatttctccgtcgtaaccagtgaggggattgatgttccccatcttggttatcgagttcacgtagtgctcgaagaacagcggttcgttttctgcatagcttctgacgagacccgcgatctgcgggtctcgtcctgtccacagaacttcatttgaattgaggagccctcttccctcgatcagcagcttgtaataggtgttgtcgaatttcgaaggggtagcaaactccagtgggcgtaagttgttgtcaccgccgttgcgtgggcatgttgaggccagtgtggagtagaacattctctctagcgttttgtcaggctggttgtctctgtgctggttgtagagcctctgcttgaagctcacacatctggccattccaatggtgtggcttcctgtcaatgcagaaaaatgtatgtatttgtttggtgagaaaaatattattagttgtttcaattatgttaatgcaggaggatggtttggattagcattttaattatcccagtatgactagagctacactatccttatatttgttgttcacttaattttctggcaaatttcattgctagttatgctttgtttcagtgtttttctcatcttttctaggttcttgcagtactttgaaagattaaacatgtgacaagaaactgatgtggagaacatgtacaaacaaatctattttattccgccggatttttttttactacattaccttaaaaaaaatctagtttcaacactgaagaggtggaattaattcaatacctgacagtgccacaaggtccaccttatccagtccttgcctttcaaagaatttcacaagacgatgcagtgtcgcatttggtggaggaaggttcttgtttgctaatttcatatatgctgcctttgaatccttccttcctagtggaagttcccagtatgggccaccgctctgtcatgagataaaaaccattaaatttcatcatgcttgtggtagataattttaaactgaggttagaaacattatttttacttgaaatgccagtgttatatatacatctacatccaaacaagatgaaccaaagtattgtagttgctttcaaaaattctcttattgtgttctcttgaaaaagaatgaagtctatattttaaacagatgaatgaagtttttttttttaattttaagagcagagatgtttaccagaactgttgaacctctcgcagctagggcaatggtgtcagcacaagagactgtgtgtggacaagcttcttcaagtgcagccttgatctcgtctataacttcaaatcctctaatagaatttttgttaggaatagcctttttctcgctcacgaattcttcactgtcatccaacaaaaccgacgcgtcgcatccctgaaatttcatcgagacgatcaaaaccacttctcatttatatcaatgagtgaacactgaaaattgtgtttccttctagaaattttgtgttcttttagaacaaggaggacacttgaaaatgtgctaacctgaacaaagcagtcatggaacaggagcctgagaagagaagcagcaatcctctgctccttggcaatagccttctttaggacagagaccacaatctcatcagcttgtgggcatgtagccttatagtaatctggagaaagaactggctttggtgggctctgcacaactgggtgaagatcctcatggtgagcagggaaagcaagagctacagtgaagcacagagaagcagtgaaaattgcagaaagaacagtcttggatgaagccatgatagcttctggagagtgagatgctgtgaatctgtggtttgattagttctcgcaatttcacttcgtatttatagaactcaagaactctcaaaatgttatagaactcatgttgtttcagctgcaacattccatttcatccactccactagctaagttgtggtaagaaaaaggaacatgcatggagttgctttgggtgtacctgatattctctactgcttgatttagaggctgcttttgtcttgtgtatcagttaccactatctgatgtctcataatgccttgccatgctaaactgacctgcctaaacccttttggtctcttattattggttccacttcaagaacaatgagaattttataatcgggctatatatatgtctttcttgtgtaaggcactacacataattgaggttttcactgctatggttttgcatttttggtgttctaataatacatgttgggaacagaaagtgttggcatttgttcaacctacttctctaaaataatccctggtaatataaatcgaaaatgttggaattagctgtagctactccaaatacatcgatccttgtaacacaactgagagagcttgagaagaaagcacatctacactttagtactaagtagtgtattaggacagctttggtaactaggaatttttaactgtttcatttcgtgtatatttatgcatgcatgacagagcaaaaagtttaaaatctcacgagaccctaatatatacactgaccaaatttagtgagaatttcgacacataacacattagttatccaacaaatgtaattattcagaaatgtaacatatatttcctttgaaagatccttgaccttatacaaacaatgcaagttaaagtcttgcactttaaagcccatgttaaccacaagagcactgctcccgtcctgcattttgtaccgcatggtacatgtacagcgtggtaccaaaacccatccagccgttgattttacgggggtaggataggaacaggcaaagaagcaaggcaccgctccatcctttgattttgcgcgacttctctcccgaatcagacgtgagacccgctgaccagacatcataaaccctagccgccgaacaaatgtccaccttctaaatcgcgccccaaatctcgccgacgtcgccgcccgaaatcacatcgccgccggaagcatctgccgccccaaatcacatcgccaccggaagcatctgccgccccaaatcacatcgccgccggaagcatctgccgccccaaatcacattgccggaagcaactgcggccgtagcagttgccgtcgtctgagtcgctgaagcagccaccattccccttaagcggtgtacatcgccggcggagaagcccttgcgatgcggcggctcaattaggactaattgctagggttaccccttcactccagcactcatcgatccagatattgtgaaaagacatcagtgctcttgcaccaaacgttttcaggtggtactgcgcaaaggatgcaaatggtaccgcgtggtaccgtgaattcctaaccgttagatctgtgcaaatcaacggcgcaaattttgtaccttgttggtaccgcgcggtacctcaggggtgtgctggacgataaaattcctataaccacaaggaaagtaagttcagacttgcagttgtgctgatcagtattcagtggtagagactagagaccactgtaaaactattcaaatccagtattttcaagggttgaatactactacctccgtttctaaattcttgtctttgactattactattccacttaaccgttaacacctcctaaatggttaaattacgatgaacgaaagattaattcttatataagttagaatcctacacatactttgataacacggtatcttttctttgggaaaaaaaaagacgagtggcaagttaaaatgtgaatagtgcatggtgacaactgacaagtttttaaggaacggagggagtataatacagtaaactctcatatggcaatacaggagctatagacagatctcgctgtctgaactgtgcgagactgtgtctgttaacagtagccatcacctggtcggtgctgaatatgcatcaatgaacagttaccactgttaatctgtttcggacgcctgggtagttggatcaatgaactataaacaaaatatactctgaatccctgaactttaactttcggccaaatgcaacatgttgctctgtccgggtttcagaatttttcagacctaagcttagagtgcaattcagtgcattggcgagccttggaatgcaaccattttggaaccccacaggtatggtcactcgctgtctcgtacagtgacgcgatgaatgacgattcccaattgcacggcctaataattaatcgatgaattaacctacttaataaactagtaattaactagccagcttctggagacaaattagaaatagctgcgcacgtacatgatcatgtgcgagtttcgttgctgtcttagcacgcaaatgcccggccttccaatcttatggagatcatgcataacacgaccggttatctgcccggccggggtgaagcagagtaatcacgtgttcataagcgtgcagccccatcgtttcgcttattacagcatatttacaaacgaaaagtagtttgtaaataaaacttttatatgcgtgttgttagcgatctaaaagcaaaggctgaaaaataaacttcgataaaaaatcctaaaattaacttcaaatttaaggttgaaaatttaaattttgactgataaacataagtataagcgaaaagataagaccaatggtttattgggtttatgcaggggcggatatagaattctagtagaaaggacttatgtcctttctcctcaagctctctcatactcttccttaattttctccctcttcttccctctctagtctctcttatctccttctctcaatggtgatccaccggggtagggggacttgagtatccaacacccacgctggatccgtctctagatatgtgagtatgttacctcgtatcaatcagaaatatgcttacatgtattaattgtgtgtagacaaaagagaaactgtagttcagtactcccttgtgctttccataaaattagcctattgttcgtgcgttgttataaaattttaattaataaaaattatcgctaatatgttattattgctattttctttatatatgcatcatctcttaatttgcaggcggcgctttataaaatttggagatttttttaccagctttaggtagtgattaatggcgcgtcggaaaatatggctacggctgcatgccggccgggcggcaagtggttcttggccgaccagtcggcgcaatcaattcaaatgtaggacttgacgtgagaaaaatactatatagagaaacataagagaaagtttaatactatagccaactaccactccaaattatttatagtcaatataatgaccaattcatacaatagttgcttactacactattaatatcttgtcccatctatcatacacacattacgtcttgaaacccgtgctgcagctggctacatatctacagcccgctgctcttctctctcttcttttatctctttaaaatatatttatagctagcttatagcctgctattatatatgctccaatgcactcaaactttcgacacaacagtatactagttaggcccacacactgctgccgctagctgcaagcatatgctacacgtaagcacgttacgtgcatgtccaattaagtgataattaggacatgcattcacgatcaggggtggatataagagggctcaagctggcctctactactgacacgaggatcatacaagcttcccttacaaagatgggaagatgagcttgtagcttaattttttctagtttgttaagtctggattcatcactgttcaagataaaatgactagaacaatgttggcagaatattaaatgagttatcacatagaataattctccacaacatcaagacataatgagaaaggagtagcattaaatttgaatatgaatcaatagtgtttgcattagaaaaaaatagtatccagtactgattcataatgtggatatggaaatcatggctactttcttttattgcggtggcccttagctacttcctccatgcccatttaattgtcacatttgcaaataactccaagatctatgcaagaaacccttcttctttccaaaactaattctcatcgatcaacatgctgtgttaggcatacatgatacatgtacatgtggatatgcaaaagtgcaattgcatacatgggagacatgcaacgatgtcatttactcatgcacagataaacgaacatatgtataacgatgtcattcacttctacgcagataaacaaataaacattataatagatgatgattaattttgaaagaccttaaaaaatttatatgataattaaatgggtatcatagagtgggcagtgtgcatgcatgcatccatcattcactagtaaaaaacaatatttccagatggcccaaaagtgatttttgtgtgcagacctccggtctgtctgtccggaagggtctacgaaaatccaattttttcacaagggtggcgcgcccgcacacaaaaatcaaattttcacgcgcgggtgcttatgttgtccacacgcgaaaacaaaaatccaaaaaaaaacccgcacccgtcggccgatcgccgcgcacccggcggcggatccgggagggcacgttcgtccaccgctgccgggctccttccgccgacttcgtcgtgctcttttcggcaccgtcgtgctcctcccaccactgctgggctcttccattgctgtcgtcgccgtgctcctccttcaccactgccgtgctctttctcccaccgctgccatgctcctcctgccaccgaccgatccgggcgggggacggccgccgacactggatctacgcgtgggacgggccttaccactcgcctgccaccacgtgcccaccgggcgactgccgcgcgcccctcaccacctttgactcccgccgccccacgccagatccaccaccgcttgctcgccaccaccagatataggcgagggagggccaccgtcgcccctcgccgccttcaacgcgtgaagcgcccgctgccgcacgcccgggagagagagagaaagagagataggagtatgaggaggagagagaggagaggagataaggaggaggtaataaggacagagagagaggaggggatgacttgaaaaaatttgaagtgctaaagagggaaagatgaggtaactcagatttctggcggaacccttaagaagcccgtctgcgaaaatatatttttccgtgcagccatttaagaggcccgtttggaaaaatgactctatttgtatatacgactcgctaagagggtcgtctgtcaaaatagattttcgcatgcgagtcttttaaggagctgtatacaaaaatatgagtcgatttttaatagacgtggacttacgatttgtctgtaatctattaatctgcttattcaggaaaacttgtgacttagcttgatatagccactatttagtcatctcaatttggcagttaactcagttagttagctagctatggcaactaacaacgtgcatgcacgtacgaggagaagttgatcagatctgatgcattgcattggcgagtagttgatcagatcaacatgcgatcgatcgatagatgatcagatgtgctatcgctgtcaaattaaagaagaagagaaattgaagggttcgcaacttcaaccgttgccatcatcacttgattgatgatcgatctatcgatatatcgatcgaggtcatagtcacatggtagtactagtggaatgaatgttagttggataggtgatctaagcatggatggttccgttaatcgtttgttgacctcacccctctcggaaagttgactagctctgatagatctctactagctagcttaattagctaggtaaacgccttagttaattacagtagtttgtgtaacacaatagcacaaaatgattactatgtgcatatgatcgccattagagcatatcctatagcaaactataagccaatttaattaaacacatgtcgaggagataaaataagagagagtagcagcgagacacatatctgatgacagctgcagcacggactctaagacaaaatatgtgtataataggtaggactatatattaatagtgtacgtaatatatgtttatatgtaattattgtatgaattgtctattaaattgactatagatgatttggagtaggttatcggctatactattaataaacttgctcttacgtggctgtaggtaggctatactattaatcgcatgcagcactaaataattaattaacaaaattaagcacttgtaaaacttttctcgtgagctagtactccatctagctagatcatgtcagaagcagagtactctagtagttatatatccaatgcagtcagttttcctctaaacggctaccgtttaacggtcttgagctttggattagcacaagctaattaactaacccaaaactttaccacgaaactgcagcttttttacaaagaaaagagaggtcgtcgcgggaagatatatcgacaacaaaaaaagatataatttggttgggtttgatacaaccgacagcaagccactggagattatgaggctttgacctaaaaagagctatagttaagctagctgaacaacacatatgtgcagatgatcacaaagttagtagctggtatagctaattagctatgtctccatgcatttctcattctttctttctttattttgagagagagtcaatcactccatcagccagtcaggtcccatataattgacacctatactaatcaaaatcaaatttgagtcaagctgttatctctagagattccatggccggtctgatgctgtgtttagttgccggctggatgcagagcaggtgaaaaaggccgtacagccagatggaagcagacgagcttgttagttggagtggggccctgtagttggtacacttgtactttggccacttatacttgatcttgcacaattatgtacttctaatttggtacactagtacccctactactggtcatttgtactagctagctagcactaccacctttgatcttgtacttatcatgattcatgattatgcacttaatttggatttctcccatgcatgatacatcatgggaatttagggcaatagggttatggggcactatggttatctatgtactccagtattagagcatcactaatatatatggcaaagtgatccatatagatgggacccacataaatagtttatccctatggtaatgtccacaatgtatagataaaaggtattattagtagaagagagaggagtagagatagataatataatttatttcatatgggtagtccatatgcatatggtatcttttgctattttttctatatgaactagttgcacaatggtaataggtggctgaatgaaatattctattgcttatggactacttttacaccatattataaaatggatagctagatgtgatttagtttgcttaattaatgtaggggatgataagaacacaaatgtactatccacatgctttcccatggctcaatgcatgtctgccacatctttcctttctcgagaatcgagttgtaagttttaacaaattgatgtgacatggataaaatgagtgtgtcagagtggttagttagttgttgcaaaaatgggaaaaaaatgattgagcaatatattggagaaagttcattttgttttctttttattttttaattgtgcatgcatgtcacccctatacttgaatattcaaatatgattgagctataagaacattttcaaaagaaaaaaaatgtatgcaatatctcgaccctttagtagaaactttttggtattggtgggattagtcccatatatagtgaacttagataaattaatgctagtattagtatataaaccaacacactgtgtaatcataacacatattgcctaattttgatgattgagagagtgtcgttgtgtgtgtgtgtgttaagaaataaaaaataaaaggggtactgtacgttcgtagtattacatttctttcggttattgagctttgatatatgctactatggttatggtcttgtttggatcctctgaactattaaatagccatccgaaatcttgatatttagaagtattaaacgtagattaccgacaaaaccgattccataacccctaggctattttgcgagacgaatctaatgatgtatattaatccatgattagattcatcacgcaaaataacctaggggttatggaatgtgttttgccaataatctacgtttaatacttctaaatagcaagattccgaagggctccggatccaaacagggtctatgtcttatgaaaaaccaacttctgagttccgaggatgaactgtaaaatcatttatctagatttatctctagaagttgtccttttttttacggagggtgtatttattttgtttttttatttgaagttggttagttaaaaaagaaattaggggggatgtttttaatatactctagcaaggacataaccaaacatggaatcgaatctacccacgcgtcgtctttgactcttttggtcgatatacatgccatgcgnctgatggactgcgacatcaggggttcactcacg

SEQ ID NO: 34312 - DNA, 17822 bp, Oryza sativa
  unsure (1)..(17822): unsure at all n locations
cacgattctacccaggggtcgtctttgactctttggttcaataaccatgccatgcgacttgcaagtaggtacgtccaattgtattatatgttcactgttcatggatcctgttagagtgctagtataatagtagtatgataacattgaatatgttaattatcacctgaaatctgtttctgtaaaaaataatttcactcatcactatacgtgtatattgacatttttttttggataatcaaatttgtgccagctatatatatcttctaacttaggatattctgcataaaaacatatttacatccatgcaccaaattatcaagctaaggcactcatgtttcaactttcaaattaaagcatagagctgttttgacgaaattgcacgtgtttttggatcatttgatgacctaggtaaacccgagaatcagtttgcaaaattatctttgtgatacagaggttaattcgatctgtccaaggcttctgtttctgctatcgcaatagtaagctgcagacaattaaccataatgtttctacactgtaatgaggttaacttaattacccttctattagccacagatttttctaccttttcttttgcagcgtataacgtattaacgtggcatggcaggcttgcagccagtgtcaaattaatattcattcgcacgcacgcttcagattgcgtaaaagtgctaaatattttccagaagaaacgtggaaaagacatgcacaatagctcccttcgccagcaacacacacagcacttgcaaaataaggcagctaactaaaaataaaaaccaatttctcctgcctaactttcaaaaaaaaaaaaaactgtttagccattgaattccttggaagccaagggctagtcttaacagtcaacaaagcagtgatcaacttgccttaatctgtgatcaacctcctaatcccctatcattactaagaccttagacattcttagtataacattttttaggcttccattccaagggaccttgttaaatacttgctttgtttcataatacaagttgccaaaatgtcatgtatgctagtattggggaaaacatgagtaatttatagggctttggatactaactatatcttttcttttttccttaacttaagcttgcttacaagcagatggggacggggtttggtaaaagtataatcagaaaaatacattaagcaaccctctaaccaaatcatttattagtgttcaagtcctgtatacatcggaacaggttagcataagaaaccaatgtcaaattatcttcaatccagtttgaaaaacttgtgttggttagcttctaagaaatgtgtaggacctattcaaactttggtcttctcttgcacagtaagcatgactaatacattgcaaagatcttaaaactatatactaagttataactctgtaggaaggagaggaataggatacaataaaagtatcattagccttacaacacaacagaagtcaaatgagcaggtactcttgctcatctcacttttgtctcctctaaggttttggcagtagggatgccaaatctgtagcctcctttgaggcatgtggcgtgtgtacttgccatggtaatgccctaccacatgagttgtgagtacattacaacaataattactgggaccaaaataataggtatgatacaaacaaacatgaaacctaaaggcattgatcccatcaaaacaaaatatatattgtgttcaggcttaagagataaataatcaacacaaaaactaccatacgcaaaatgaagagagagaggttaatgtagatcaccattcagattcagtagtactacacccttccaaaaatatatcatttttagctacaaactttcctcgtcatggcaaatatgaagttttttttgggacggccgtattaagatgaaagctcctagatcgatttatgtcttgatttattcatcttgtgttcattgagtcaggtacttatgatataaaatcacatagtaataatgttctttaaaaaagagcctttttctgcactacatttgcagatctacatcagaacaagggttctagagctatacacgtagcatgcatacctgtgactgtctctgtgagcctgtgactgtaacaaccgccatgctgcttccttcaagaaacggccactgatatgtgcttcacagaagaacaaggctgccggtgacaaagccttggaacagttgaagaacctgctttgtgacaagaatgtaggccatgcaagacacctaacgccgaatcatcatcacgcaccgtgtgttgagagttggtacatggcacatctcgtttgacctgatcgaccgatcccccatctccatgcatgtgttagctaggatatcagcacctgtgttgtacaacaaaatgcaccatggtactacacatcctctctccgaccattgatgagccatcagaactcccagttgatttgatcgctgcaacaacatacaaaaggtaacttagtttggcagtacaattatacaaggacaacagcatatgaaaaatgttggatattatcctttgatataacgtttctactaataagtatacggaatgtagcatcatactttaaatgagccatcaaaaatgccagtttgatcgctgcaataacatagaaaaggtaacttagtttggtggtatctacaaggacaacagaatatatgaagaaaccttagagattatactgtgatataacgtttgtagtaataaatatacggcaatgtagcatcatacttttgatccccaaagacagggatacgaatccaagtttgatgaccaccaacaatagaaaacattcatgtgaatagtccagcatacataaggtattgcattaaacaaagccgtatgatctgtagtgacacttgtgtataaccaaagtagtaggattaaaacggaagcaaaaccttacttttgtctacgcttttgtgctttgtcagtttgatttcacacatgatgtgcaaattatcatgtgttttgtgaggttaaattttggatatggtccagggaatatatatatatatatatatatatatatatatatatatatatatatatatatatatatatatatatatatacatactagcacaacctgtcaggtgtgggcctactatgaggcaaaaaggttaaagtgagaggaacgactgatatatctttgtgcatatgcattgcctcattatggtaatttaaaacaacatctctaacgttctgatacaggagggtataatataatattatataatccatcaaaggtttcgataatgagtagaaagataatgtgtagtgtacaggggcagattatgctgccttctagtttttcatagtacaagcagttatatgaatatttaattggaatgcttatttttaagtagcattttctgtttcatcagaccattttatcctctctccaactgctaagcaatattgagcttcatttttgagagattatcacttatcactccatctacacttgttgacaatgacaagcattaaatcttcaaatgactttgctaaaattaaagccccaaacaaaacaataagacgaccgaaaagccttgcaagcaagttggagttactattagctgataattgatggaattactgaagcagttgagcacaatgcgtagctagctgacttattttatacgcatcaccctaacaacccaagctgccctgccgcgtctcatctcactgtcctctgctccaaaccacccttcctacatgcacccccccacaggtgctatatatgccaccccatgcccgcctcttctcgccacccacaaccaagagaagtagaaacaaacagagagcaattctcttctcctacctagcaacctagtgcagtgcagtgcagtgcagcgaaggtttacttggcgacttccatgggttgcctgttgatgctctgcttggtttctcccctcctcctcgccacctctgtccacggcaacccgtggtatgggtatgggtatggcttgttcccgcagttctacgaccactcgtgccccaaggcgaaggagatcgtgcagtccatcgtagcacaggcggtggccagggagaccaggatggcggcatccttggtcaggctgcattttcatgactgctttgtcaaggtactgtgatttctcttctgctgtagcattctttacttgtcttcacaaagctaatggtgctcggttgacatagcacctgcagtgtagcctgcaaaaacataattcaaatgagttgtatgcttagtgcaactagaaaggcaattatatgcgtttcacttgcttttgcgatggttaaatccatatgaaggtattgcaaatagtcatcaaaaatagagaaaaaaaagacatgtatttgcagatgcaactttagctgttacataacgaaaacgcaaagtgtaggagatcaaacctttgttatatttgtacctaggtattaaaaaaggtacccttaggagcatggaagaatctatagttattaggcaaactttttaccactgataagatagcctaccaacattgcccatgcgagcactactttctgccttggtgatatgatgagtccgtaccatgatttcttgattattcactttcttttcaaagagaggatgactatttaattcaaatgcacaataattggcgctctcgatgtttcatttatcagagaccttcacccagtacaggaccctaaatcaatatatattttgctgttccgttgcatgtgcctaatctatgtactacttccatgtacctaatctatgtaccaacattgtgtaggggtgtgacgcgtctgtgctcctggacaacagcaccaccatcatcagtgagaaggggtcaaaccctaacatgaactccctcaggggtttcgaggtcgtcgacgagatcaaggccgccctcgaagcagcttgccccggcaccgtctcctgcgccgacatactcgccctcgctgcacgcgattccactgtcctcgtatgtagcagagataagctctatcagaaccacacaaaagaatatcacattcggaaatagaaggagaaatgaactgtgtattattattatttctgtatgagcttagagaaaagaaccgctcctaggatgagctcaacagtgccgtgttttgtgactgaatttgcactcaaacctgcaggttggtggcccgtactgggatgtgccacttggccggagggactcactgggtgccagcatccagggctccaacaacgacatcccagctcccaacaacaccctccccaccatcatcaccaagttcaagcgccagggccttaacatcgtcgacgtcgtagccctctcaggtgaacttcttcttaccatcttatgagtatgtgcgtccatttcttgagagagatctttcttacattgcacaaaaatgggtgcatacatacaggtggccacaccattggcatgtctcggtgcaccagcttccgtcagaggctctacaatcagagcggcaatggcatggctgactacacactggatgtgtcctacgcggcacagctgaggcagggatgcccccgttctggtggtgacaacaacctcttcccgctagactttgtcagccccgcaaagttcgacaacttctacttcaagaacatcctgtctggcaagggccttctcagctctgatcaggtcctgcttaccaagagcgctgaaacagcggcgctcgtgaaggcgtatgctgatgatgtcaacctcttcttcaagcacttcgcacagtcaatggtgaatatgggcaacatctcgcctctgactggatcacagggggagatcaggaagaactgcaggaggctcaacaactactaccactgaggttgtcttgtgtgctgagttttacaaggtggtggtagtggcatgttttgtttaaataagtaaagctggttgtaatgcgtcaaggctgtttgatcatttgtgttattgtgattgcgttgcaaaacgtgtatgtttaataattcaatatataaaatgagttcatttggttgttctagatctggttgtttgacttaccaaattctgactctcgagtccgaactcatggtacatatccacctactcttcatgagttaccctagtactccagccgtgctagctttgacatttgtcccctgtcaaaatgatatgatgtagtttgtaagaaatacctacagttactcatgtagtcatgttgtatgctgtatctcaagaaatctcccagtccctgatgtaatcatagtctaaactctaaacatgacttgaccagtccctgatgtaatcatttagtctaaactctaaacatgacctgaacaatttcataataatcaccactaaggtatacaaagtatgaaaattcaaaaggtttgcaacagtaccatggaagaagtaaaccatccaatttctagaccaagaaatcaggcaaaagtgatatatttcagtgtatttatagccgtggactattaacagtctcatctttatttggcagctacagaacaacaattttcaaggatttatggccacaatgttttttttaaaaaaaaaatgaacttaactctatgctttttgatcattaagtttcagaacacctaattctacagccctacaggtggaggtgaccaacaggtagggcaggtcagcaagccagtaaactgtgttttggttactgttgattttgtcaaccttatgagttatgaccttaaaacacagaataatgtgacactagccaaattaaatacctgccgatttctactaatatggccacaaaacatatttgtgttatttactgaaagaatgtgtctggacatcacatgagtacattctttaaaagaagttaaaaaaacatagctcctctaaaggatgcatagaaaggagtttggctgacagtagctccctttctttcgtacaatgttttttctttaatcatagaatctttgtatgccattccctaaaaaaagaatctttgtatgccatagttgtctagttgaatacacccactaatgtgaagagaggaaaccaatgtcaattaagaaggaaaagacctaaatgccaaacatatcaactgaggttactagagttgaatgcaacaagatagacactgaatttcaggatcttgaacaatgtcaccatattggacaaacatatacacaacaattgaccaacatgaatgacaaaaggaaaatacatgtacccgtatgtccaccatcagaggccttctctaactactgaagtttggaacctaaggcattcagggtgctcatccaggttgcactgctcaggctgtaaagagagacaaaaacagttagaccataaaggttagataacgagtcaaaaggacacatcatttttgttagaagagagaaatgttcctgcatgtgatagttaattccacctttatgaaccctattttgccaactgacaagacagttcagtcatgttgacaaatgttttcctcacctacagaacacaggacagaagcaggtctaagatatctcgtggtttcttaagtatgcatcaccaagcttcagttatatctaaaagaacatgatgtacttacaagttagatgacactttgtttgccaatgatgatactacaaaccagcaatactttgctaacagaatgaactagctaccaaattcaactagaattctgaatcattgcttcaattgctttgttggccttaatcagttccccttttaagcaaagtgaagcgattgctggataatatgtgtcaaagtcatcatggaaagaattccgtagcaaattatcatagtaaatatcagtatcatcacttggtgtgcataaattctcagctccatctattgtgggttgaactgtgccttcagaaattccatgaagacagttgctagaaacaccataagtagttgaacataaaacttgtccaggattatccatattacgatcataagccacaggtgtctctacgttcttcaggtgactaagcgtgctacaattattagaatctgaagaggatacagacatgagcgccacttcatttaggatagtcacgacctcatcaatcctcccttgctcacaggcagaaaatagaaggccaccaaaagattctgcttggatcttatccccaacactgtttatgaactctgcaacttctttgcactgaaacatctctctcaagatgctcctagattcttccattcttccttttgcatagagtcctttgaccaggctcatgaagccaacaaaatctggaaccatctccttatgatagtattcactaaagaagcctaatgctgattcaatgtcaccttttaggcagtgtccattaattattgcaccaattgtaatagcgtctgggaatagaaatatttcctcaaaatgtgatataagctccagtgctttctcagttaacccgtagttacaataaccacttattagcaagttgtaaacacgtgtagtgggtttgatacccttggtggacattttctgaaacaactcatgagcgtcatccaaaaaaccttctctgcacaaagcagctataagtatagagtaagttaccagtgtcggaagcacttcactgctttctaggtagtcaaatagccggaatgcttcagtaaggcatccctgctggcacaaaccattcagaacagagttatggatgacaatgtttggctgaatcccttcttctttcatgctttcgcataggtctaatgccttctcaagataaccacttttacaaaggccttccactaatatggagtacatggcaagatccactgaataaccattttgttcagcttccttcaaaaagttgcatgcatccagaattctaccttccctctttagtgtgtatacagcttctcttagaacactgacaggaacacggccattgttcatgtaattggaaaacccaatagcttcaccaacactgttcttgctgaggtggcaagatagcatattaatcattctaggttcatccaggccatgaattttaatgaactgacttaataatggctggatggtctgttcatgaccatttcggagcaagcatttgagtagcctgtagcatgttttgctagttacagtaaatgatttcatttttagaagcttgtaaacatccaatgctccttggtagcaatctcttgtgcttaagaaagcgtaaggcatatttacatagaaatgaaaataagtcattttcagatccatccactttaggaatgaatttcagcacgccatgttcaccgccttctttaaagtggtgtatggatcaacttcttgtaagtacaggaatcagtgccttaaatttctttggataagatcattaaaaatctgctcagccatgtttacctttcgtccattacacaatgctataatcaggcaattgtgtactattgtagaggagaacaagatgtcttctttgtaatcatcaaacaactgcagtgccctgtcagtttctccaagtttacacatcatgtcaataactgtatgatatgtgacaatattaggccttaatctcatctcgggcattctaagaaacaagctgcaggcatcatccaccttcttaatcataaataatgctttgataagtacattgcatgtgacaacatcaattgtaacaccgctgctctcaagcctaccttttattgccattacaccagttgcatcttctaccttaatgtgaccatgtaacagcgtgctatatgtgaagttatcagcagcaataccttcatatatttcaacagccttcttggtgtgaccaaccttacatagaccatttattactgaattgtatgttacgattccaatctttatcccctttttatccatctcttcaagcaaagagaaagccctatccaaatatccctttttgcacaaattgtcaatcaaaattgagtaaacatattcatccaccaccactcctgtctgttccagtttcctcactatagaaaaagcatcatccaacctgtttctcttgcagaaaccaccaatcaatgatgtataagtgatcaaattcggcttagcatcccttcggttcatctcatccaagaatcccatcactttttccacactacgttctctgcaaagtccatcaataacagtagtataactaactacatcagctgcaatgcccttatctaacatcacccgatgctcacggagccctttcatcaataacccgctactcatgtattcatgaaccaagctgccatattaaacagcatcaccaaccaacccctttcctttcatctcccttaccaattgtgctgcctcagtagttctccctacacggccaagcacatcgacaaaagcggttaatgtgatcaagcctggctcaaatccattgaactctctcctcaccctcctatagaattccagcccatccccagccttcccgaccttggagaagcctgaaatgatcacgctgcaaacacgatcatccacctgacaccccgctgcagccattacgtcgaacaccttgagcgcggtctccatgtcaccgcgggcacacagcatcgtcagggccacacgatacgtggacggagaaaacacgagcccgcactcctctacgccggcggagagcacctccagcgcgcggcgagcatcgccgcgcaccgcgcaggcccggcggagcagcgcgtcccagaggcggcgcgcggaggaggttgccgggccggcgagcgcaaggcgcgctgccgcgtcgcgcggacggaaagaatctagaagcgccgaggcgaccaggaggtgggtgcgcgcggtggggcgcacggagttggcgaccgcctgcgaggcgagcgcgccgacgaggcggtgcctccgccggcggaggagcgccgccagtaggatgtccacgcggcgcggcgtgacggcccttccgagcttgaccagcgacgggagcggcggtggtggtcggggctcgccgccggcgagcggcatggcggagggtggtggtggtggcgcccgccgccgcgtgggaagcgaagcgcaaacgttcgaaacgttggaagccgatggcgtgggccgaatttggatacgagcttgtttggatctgggcctgaatagatatgggcttgtattggttctgggcctgtttggatatgggcttatttaagtgaggcgttttttagtccgaagcgagaaggggagaagaggaagatgcagcaagcgcaggcgtcggcggtggtggccgcgccggtggcggctgcggctgcggcggcggcgggggccacggggcaccagcactagggggcgaggggtgacgccccgccgaagcaggtggcgcaggcgatggagcggctggggcgggcggggcggctcatcgcggacatccggctgggcgcggaccgtctgctcgaggcgctcttcgtcgccggcgacgcgcccccgcacagcgccccgcagcacgttgagaagaccgcgctcgccgtcgcccaggaggaggccgccatgcaccgccacttggacgacctccgcgcgctcgggaggtaaacccatctccgccccgtgcccccacactctccgattcagaagtttttcatcgattccttaacctttgactgttacgtcgcaaaatacaactaattccctccgagaagaaccattcccgtcatgattccacggttgcagtctcaaaatgaaaaaggaacattcccgtcatgataccacggttgcagtctcaaaatgaaaaagaaatattcccgtcatgataccacggttgcagtctcaagaagaaaaaggaaaacccttgtctagataatttctggaaattggtggctgggatattgatttaacttctttggattgtatgattggactttttttaaagtaataatctccttcccagtttaggcatggcagcacattttttttccactaaattgttctgtaataatggttaatcaccataaactgatgccacactcttctttggtgttatccaattgcttgtatcttgtgaaacccttctacctatgaaaccttgctacgagagatgcacggacaggcttaactgctcaactttggtatatgaactttagcattctagaatattggctgggtgcctgggtctatcagattgggatgcatttctggaactcgtgttccttggcttgtaatagagcaatatttaaccttaattgaacagcttcagcttgaacttgttttggggctgtttggatcagggactaaaattttagtcccggtcacatcagatgtttaacactaattagaagtattaaacgtagattaatgaaaaaatccatttcataaccttgaattaattcgcgagacaaatctattgagcctaattaatccatgattagcctatgtgatgctacagtacacatgtgctaattatggattaattaggtttaaaaaaattgtctcgcgaattagctctcatttatgcaattaattttattattagtctacgttaaatacttctaattagtatccaaacatgcgatgtgacagggactaaaatttagtccctggatccaaacaccaccttagtgccactcagggctcgaactagttttagtatcactcgtggatggtaaggatgtagggtaggtgctcactctataatattgtctcagcagagcagttatgtgttgggtacaattgtttacatgtgaccacttgaccagtcgtttgttgaagaagtctgcaggcatttggaaaatccatgtttcatggcaacatggtactattctgtctgatgaataaaatgtccaagcaatatgaactgcttgttaaacgatggtttttgagtctttctgcaacctgaagttgctagataaacggaagatgaaatttgcaggtgatatagttatgattttagacagaatagttagtttgtgaaaatcctgaagttaggagtactagataagcttaagccatgtgactgagatttttttaagtcaaaggatattaggagccatcttcaataaagttaggtatgtgaacaggatggattcactcgattttgctggtgctttcttattgttctttcacagtattcttgttatagtgtttgggttagttgtgcttgttgctattcatgatgtttttactttgtgatgaaccatcaatcattgcttacacagttctcctggtaagttccaattatttttattgaacttcaagtttcaagttccactatttcttcataagtgttggcctagccaactgaaagtaaagatctagtttttaaactgtagcctaataaatatcttgtatccattgctgttaggaaggcaattggaagagtctggagttctaaatggagcccttaaagccagaggcaattcatggggcttgcacatgccacttgtttgtccagatggtgcagttgtggcatatgcttggaagcgtcagctggctggtcaggctggtgcatcagctgttgacagaactaggtaatttcattaccatcattgttgtgttgtatgtttgctgccacaatatgatgtgcttatttgtcttatttatattctgttgatgtgtgagatttcatcaaccgtgcattgcagaatgcagattaaatatttataccatgttatttcttcctgcgatatacgataattttcttggccgataaatttgtactgttgtttccctctttcccctttaaatttgtactgttgtttccctctttcccctttttcccttatttctcctttttccctcttttgtttcttcttttgcactttgctttctctaatccttctactatgataattacattcttccaaggtgtggagtgcttttgtaggaattgaagtattagatcagttcttgttttcgttgcatccatattttattttgattttacacagaatgcatcggaaatattccaacgcccttcattcatgtgcttctttagatgtatgtacttatgttgaaggcttcaagccttcggatcatcccctagtccccatgacaagatacccgaagtttattactatttacaaaaatgggttactatactaaacttaacagctatcagccacatgcgattgtacctagtggcctggcctcaccttttttaaatttaaaatttaaaatgtatgccgctgcttaatgcacaaattatttggcttgtgaacaggcaaggacatatggaatttttattatccatttatcatgtgtttataatgttcagaggtatatcaatttcaggtttatgctaacatatagatgtttccaggttagctctcaaggccttcactgaccagaaaagaaggttctttcctcatctagatgatgaagggtttaaccatctgcatgatggtgaacctggtctcgctaaaaagccaaggctgcctgctagcaatggggagcttgaagaaagaactttatctgagatactaaagaatctagaaaatgaagttcctaacatgaaaatattcacataccggcgtctggattggtcaaaaagagctgcatcattagcaacccttatgaatgatgactttgtggatccatctaaggagctgaacctgcaaaacatgagcaaatcgggatctggtgatacaactccaatagatcaggttgcgataattgagttgctagctccttctatatttagagctatagtatcactgcatcctgcaggatctactgatcctgatgctgtggctttcttctctcctactgaggtaatcatgttttccaaaagctaacttgttaattagtggtcatggatgcacaataccttttcttaatgttgacacatgaagtgaatcttatattagggaggaagttacctacatgcaagaggcctatcggtgcatcatgtttttaagcatgtatcggtaaatgcttcttctgtgttctcttttaatattgttttcaataagagggcattacggtgtaacgaatacactgttttttattatatgtaggagcatgcagataaagcattgcaatactttgtcagtgtggaaccaactaaatcactttctctgttgctggtaagtttcaacaagaattggtaaattgttcagaatagtaatccagtttttttcaaaggttcattaaaattatttttactcatcgttatttcctttattttgaacaatcctattgcaataacgtcacattgtaatgctaattatttaacatgttaacttcttgcagcgttggattgccagctatcagactctatttacaaaagtttgcaggtacacacacatattatatatctaacagatgtctcttgtactatcgtcacaattttacattccactacataagtaacactcttcattactttgcgtgcagtaaatgcggacggcttctgctgatggacaagtctttggctctgcttttaccccctgtccagcgcccataccatcatcagacttctagtgttggttcagatcctcaggatgcctatcacattggatgttcttcctatgatgcctgactcttctaatgaactctcgacttttagctaggatgtttcaattctgaggatatattgcctgacaaacatgtgcaagactaatttgtaatggcagttctagattctttttttccatggggttcctgcagtgtagctgttaattttctacatagaaaaaggcgtggttatttgatgagttactgtagttgcagtttcatcttggtagcatgcatttcaggaacagatggtgtaaaacttggaaaggtgctttgagtcattttttgtgaatttcaattatcattttggccctctttggaatgtggcattttccttttggtaacattttgtgaattttctaccaaattccaaagcatgttcttaataagtgatgcctgccgattaggccggtcatactgctgatccatggacttgaaacttcagtactgactttaacgtattgtactcaaattgcccagtaaactagtctcttggttggaacaaagaatttaagagtattttttccttttggaagagaaaatgcatccagtttttttctacatctttcctttactatgaaacttttatggaatacatgtgcttaaatgagtcttgctggggtctggggatcatttgatctgcataattttagtcacggggacaatgaaaggctagtgacagggaaagagctgaacggcaagaatcttactccctccgatcgtaatttgttcagttcgctggtactccctaatacgggatatgtaaagattctccctccgatcgtaatttgttcagttcgctggtactccctaatacgggatatgtaaatgttcaaactaagggtgtagctatatttatggcgccatatttttcattaaaaaatagtcggcatgtatttacattgtaagtccctaaattacatatgtaattttagtgtatttacaatgtaagtatcaaaattacatatgtaagtactaaaattacatatgtaaattcgaaaattacatactaattacatatataagtggggtgtaaatgaggtgtaactactgtgcaagtggctgaaaaaaaatcgactgtagcatatggcgccatatttctagcaaatccgatgttttatctcgagatggagggaatactttttaactctaggggtaataacgacttggcattgtcattctactcatttttaaaagttcttctaatgaaaatgtggattttaacaataccaaatttttgaaaggtgaattttggtaataaattgtacaggtccttcatatttatggcaagtttccagtcatatttttaaggaagttccagtcatgtttaggctgtgttctttactcctatctttccaactttcactctctcatttttcacacgcatgtttttcaaaaagaaaaactaatttgtttttataaaaaacttatataggaaagttctaaaaaaatatattaatctgtttttttattttttactaacaactcataattaatcatatatcactccatcgctcaatgttgcactagagatgaaagattctcaacccctgcaaaaccatgcagccaggtccctgtgttctctcccacgataacttacatccttatttttcgcttgtacgctttttaaagtgctaaacggaatatttttttaagtttctataaaaaattgttttaaaaaatcataataatttatttttttaagttttctttagctaatacttaattagttatgtgttaatgcatcactccgttttatgctcgaaggaaagaggtttctaacaccacatccaatagaacaccaccttcaagagaacccagcccaaaaggcctatcattcacggcccacgtagtaggacaaaagctcggaaaggcccacgtggcgcaccgcctcacgtcggcaccgtcccaccgacttgtgatttccaatccctcaaatactgtaacgccacgtcgcccaacttttagtaacggcaccaatctttggcatgggcagcactccaacagcccataaaaatgaaaaacgtccgatcctggctattcgcaaggatgtacgtactgatctcgcgacgcacggtgaatcaggaaatgtgtaccacgatcttatcaaaaccatgctcttattcatgacactattcgccaacttcgcttgtatctatcacagcttcgcataattgggacttgcctttacactctttggagtcactgnctttgtctgatttgggctggctgatcggcatgctttgactcataaatggttattggatgggctctccttcccaggacccctggatgagctgctgagcaacattaacgttggccggaacctttgtcaggcttgtaagattatttaatctcgaggcggcctcaagttcgtgtggagaattggacttgggaacaacttggtcaatcttttgttcgaaattgagccccccttgggagctgcatttggtaaacgtttg

SEQ ID NO: 34313 - DNA, 9459 bp, Oryza sativa
  unsure (1)..(9459): unsure at all n locations
aatgggatgcatttttttttttccagaaccccccaacctccaaaatcctaaataacaccgtcaacggctcgccgccgggatggtgttcctccgcgcgccgaaaggcacgacgcgccacgtcgacctcgaccccaccaccgccacgctcgccgacctcacagcatccgcctccctggtctctacctctcccaccgcagcctcctcccggccgtgccgtcccctctcctggcgtcccttcgggtctcgccctcctcctcgctgctcgtccacctccccctcctcggaggcggcgggatggcctccccgaccgcgaccaccccctcggcgcctccgccaccaccaccgccacccgcagcgtgcgccgcgcgctacgacttcctcaactccaagccgccccccaactacgtggcgagactgggacgcggcgccgccgggttcaccacccgctcggatatcgggcccgccatggggcgcggccgtgggaagccgcctggggacgacggcgacggcgatggcggtggcgacgaggaggagaaggggtacgacgagaaccagaagttcgacgagttcgagggcaacgacgccggcctcttctccaacgccggccacgacgacgacgacgacgaccgcgaggcggacgcggtctgggagggcatcgaccggaggatggactcgcgccgcaaggactggcgagaggcgcggctgaagcaggagatcgagaggtaccgcgcgtccaaccctaaaatcaccgagcaattcgccgatctgaagcggaaattggtcgatttgtcagcgcaggagtgggagagcataccggagattggggattattcgcttcgtcgcaacaagaagaggcgatttgagagctttgtcccggtgcctgacaccctgctcgagaaggcccggcaggagcaggggcatgtcaccgcattggaccccaagagccgtgcagccgccgctggcgcagagacgccatgggcgcagactccggttactgatctgacagccgtcggcgaaggccgtggcaccgtgctttctttgaagctggacaggttatccgattcggtatccggtgttactattgttgatccaaggggttacctgactaacctgaagagtatgaagattactagtgatgctgaaatttctgacataaagaaggccaggttgttgctcaagtcagtgatacagacgaacccaaagcatccaccaggatggattgctgctgctaggcttgaagaggttgccggcaagcttcaggttgctcagcagctcatccagcgtggctgcgaggagtgccccacgaatgaggatgtttggctcaaggcatgccggttggccagcccagatgaggcaaaggccgtgattgccaggggtgtgaaggaaattcccaattctgtgaagctgtggttgcaggcagcgaagttggaaactagtgacttgaataagagcagggttttgagaaaagggttggaacacattcctgattcagtcaggctgtggaaatcagtagtagagcttgcaaatgaggaggatgcaaggctgttgcttcacagggctgtggagtgctgcccattccatttggaactgtggcttgcactagcgaggctggagacgtatgaccaagcaaagaaggtacttaacaaggcaaaagaaaagctccctaaggagcctgccatctggattatggctgcaaagctggaggaagctaatggaaacaccgagtcagtaaacgaggtgattgagagaagtataaaaactttacagggaaaaggattgggtattgacagggaggcatggctaaaggaagcagaagctgctgagcatgctggatctgtgatgacttgccaggctattgtgaagaacactattggcgttggtgttgatgatgaagacagaaaacgcacatgggttgctgatgctgaggaatgcaagaagcgtggttcagttgagacagcccctgccatctatgcacatgtgctcagtgtcttcaaattcaagaagagtatttggttgaaagcggctcagcttgagaagagacatgggactgaggagtctctttatattctcctcagtaaggctacaacatacaatcgacatgcagaagtgctatggcttatgtatgcaaaggagaaatggctggctggagatgtccctgctgcccaaaccattcttcaggaagcttacgcttatcttcccaattcagaggagatctggctagctgccttcaagcttgagtttgagaacaatgaaccagagagagcaagaattcttttgtcaaaggccagggaaagaggaggcactgagagggtctggatgaaatctgccattgttgaaagggagttagggaatgtagacgaggaaagaaagctgttggaggaaggtctgaagttattcccctcattcttcaaattgtggttaatgcttgggcaaatggaagaccggcttggtcatgtagccaaggcaaaggaggctaatgagaacgcactgaaacactgcccgaactaatctagaggagaagataaatggcttgaggaagtcacgtgctgttctcaccatggcaagaaagaagaacccagctacacctgaactctggcttgcagcagttcgagctgaattgaggcataggaacaagaaggaagctgatgctttactagccaaggcattgcaggagtgcccaacaagtggtatcttgtgggctgcagctatagagatggtgccacgtccccaacgtaaagcaaagagctcggatgctataaaacgatgtgaccatgatccccatgtcattgcagccgtggctaaacttttctggcatgataggaagtttgataaagctaggagttggttgaacagagctgttactcttgctccagacattggagatttttgggccttgtactacaaattcgaactacaacatggaaacgctgatacacataaggatgttgtacaacgatgtgttgcatcagaaccaaagcatggagagagatggcaagcaatagcgaaggctgttgagaactcacacctgtcgattgaggcccttctgaagaaagctgtggtggctcttggccaggatgaaaatccaaatgctgtagatccctagtctgtatcacttttaactttaaattaaggtatttggtgcaatctgttctcagacttctctcatagagaactttgctattgtgtcctttattgccatactttatgaggtcatattgtaatgcttttcgctgtgttctattttactgttcagctataagatatacagtatttattatttaagaaatatcatgaccagtttttaagatttgacctccaagtaatttgtttgagacaagcagtgttatcatttattttgttggtatcattaagtagctctaccttaaaatctagctaggttgtgtgtcaaggtagtcggaaaactcaattataagcactacgactatgaaaatctgttgatgctgtattatgctctgtgcacaaatgcagcaaaatccatggtaattatacaattgtgtttattcttggcatggccttaaggttctgaaagaatatacttatcaccttctcatctacttaattatatttcggttgaagattgattttgttttactccttaggttgactatgttacctcaactgaagtttttggggaatgtggtgtggcaattctaggtcaaaatttgtcaatcttactacttccgtgccataatatagcaacctagtatatgttcagattcatagtattaggatatgttacatcctatactagcaagattatgggacgaagggagtaacaatgtaacattgattactgagcaatctgactaaaaactcaccagggggctgctccaaccatttgtgatttttgaatgtgcattttagccagtataatggtcaagctatctaattttgcgagaaaacagaataattatcctcttccaattctaactgttggagcagtgggttgataaaatgtctaggacaatataccactttcaggagcataatttaatttctttttgttaccaaatttatattttgtaagaaatcaagcataactatgttacctgttctgctcacaggtcttcttctgcaggtcgataaagaaatatgtagagaaagaaatacaactagacagtgaactgggatgcactcaagcaactgcttctgctacgacctcgcattctctacccaccgaactgattgctgcagtcccccaaccgtgaagcttacctgaagaagcaccaggcatgccattgctccaatgtgattggctatctctagttaatggttagcaatattcttgaactaccatgaccatgtagacaatattcttgaactaccagcaccaggtatattgtttttatgtccttaatggttagcaatattcttgaactaccatgaccatgtagacattgtccttgagatacctaccacaaattcttagcttggtgtatttgctagtcgtcactagattctcaggaatgatgcaatgtttcttggggctctatttattatctgtgcactagcgactttttctatggttataatagctctgtttgccagttagccacattgttcgtggattagtttgtgattgacgaaatacatgtttgcaagtgttctaactttatttgagattagttttctaatttaattccgtagcaaagaattgcttgcaagtaacaaattagttctaaatctgaggttcccagtacagccagttttcttatttggcaggtcattcaaaacttcttttgcaaaggcacaaacgtagtgctgatcgtttacagatataatttagataaaattagtacacatatatcgtgcatctttgtttttgttagtttatttttatgtttgttgaaaccacaccttctggccaagccttaaagagtcatatgaaggacttatcttgttgcaaaatgctaccgcattgtatgaatcataattgaaccttcttaatagatcttccttctatataatcccagtacatgccttccttgttttacctgcatctggctgtaaaccatcatatcgattaaataaagattttagttttacttatttaaatttctgttggaaaatctctggcagaccaggagcatgaagcattacaagatcaactttcagggaaggatcattttcaaacagttttgtgtataaatgggacagtcccactgctgccttccttggcgtcggcagaagagctttgttctacatgtaaggtatagtgttatacagatatcatgccatcaaatgaatgtttctttcggcaaagctcttctccatttcatgtgactaaattatacaattctgaagaaacttcatttcacctagaattttcatgtattccatttcatactatacttaaacaagaaagtgttagtgcttgcatttgatatgggcatccaatgcaatgcttaaaatattataatacttaagcaagaaagctatagaggcattaattgggacggacatccggcagcagtgtatggacgatctaaaattttgaatcatctaactaaatttcttttttttcaaattgtaactaattttctcttattgtcttttaggtaattatcattgtgaaaatactattgtatgtggctgaggctaagatcaatttttttccttcatatattgtcggagggtgaacccctcaagcgggggaccgtgggaccccctttccggttcggaccggggacgcgggtgaaggatcgagaatcgttggggaaagagtgagagggggtcgggcccctcaggagcgatgaaagatactaggggtttagacaggttcgggccgccacagaagcataataccctactcccatgtgtggttgatttcggtgggagaatataagtgcttcctgtttttgggatttgtcccccctccactggggcatagacctccttttatatctcaaggggttaccacaaaggcccaagacctagcttcaagggtaaggaaaacattctttacagacaattaatgcttgtcttgtcttccgacgagcggagccacgcgcgccttaccgcggcgtgggtccatcccatcacgccgagcgacacaggtggacacccgtgtcattccttcttaattaacgacgatttccggccgcccgttcccaccgttgggcggggatttctcgaacggaccggtataagaagatttggtatgggttcaaatgagaggcaaaaagcccctcattaatggcgactagacggggtggtgtaggccacgtcccgtgccagcagcaggcgcacgcgcagggcgccctgcccaccgtcacatcagtcactccggtcttgagtggccggttagtgcgcctgcacgccgcatttaatgcgacgtgccacgttgacacccctcaataaatgccgtaggtgggcgctgagagtgcccgcccaagccgcacacacgaggcgcaacatggagggggttggggcggcccgacccctgccgtggcaggtagccaacacatcaaccctaggcatagggatggcaacggggctgcacccgacgggttttgccatcccgtccccgcccccgtggctaaataattttcccgttcccatccccatccccgcacacgggggagggttttcccccgtccccgcccccgtccaggtaggaagcacccgacaggtgcccacacccgacgatgaattctcagatattggaggagcagcaggcagagagtctaatttgtggtagagaataaaaaatcacccagagaaaaaactatttgaaataagcatagacatccacaaacgtcttttgaagatacacatgcatagatctatttgattcatccccaacagagagctatagaagcatagagtccaaagaaatacaagaaaataaaaagggcaagtaaatgctagtaagagtttgatgtgcgatggagctcttgctttgtcgcacaggacaagcaagactagaacacctcgctgctgcagtgcagctagcatccgatggttggaagcttggatgtggtaacggcggagcgagagcgacgcagacgcttgtgtaatgttgcctttgatccggcgacgacggcgcggcacttctgctgcttggcgtggctcgtgcaggcgtgctaccttgaggacggcgacggcatggatgcgtcagtgcagtgcggaggaagggactggaggagtgcgtatttggatctgagaggaggggtgtgctagggtttcactagaatatatatgtggaccttcgaattgggccgtgtaactgagcttttagcttctatctgggctgcggccttgggggatatctacctgtccctgataactcttggccccatggggattcagggccggggtgtgtagaacacccccggcccatgcccacccgacgggtggctcatttggccgacaacacacccatggggagtgatatgctcccatttacagaccctaatagaggttttccccgcgggggatcgggggtcgggtcccattgccatccctacccaggcacaaccctcctcgaggggggggagcgtcacgtgggcttgaggcggccttctctctttgtacgtggtacccccgggcccatatcaccgacagtagcccccggcgttagctctgaccggcgctctttgcagatggctagggttgacgccactcctctcggtcaatggcttgtgggcccggtcttcgtcccacgtggacggattcaacgagtgtggcccccacgcctaggcggggctagagccacgagataacctcgaaaacgtggaatccgggcgaagtgggattgcctcccttgtaatgatgggccatcacttcgtgattactgcatcttacgggggccgtgaagataatgatgggtgcacgaaacgaaaagggtagttcttcgcggtaaccgtgcgcaattagggtagtcgtggccccacccgcattctgaccgaaacggccgcgcgcgtgcatggcgcgcgcgctggaaacaggtgcgtggtgaatcgagggggcggaggaagtggccgcgagaaacgaggagccgaggtgcatagggaggataaagggcgcatgaaggggttttctttccctcctttcgccactttgcttctgccgctctcctgcgccccaactcaactcgcatcttgctctttcttcgccacactctcgctccccgttccccctcttgatgacgtcatgacgcggagctcagcgccgctcgatggcagcatccttcccccctctcgcattacaaacgagaggttcgcggggttgccgaggaagttcgtgccaatgccgtccgggcgggcaacggtgatctacggcgaggctcgtccagcgccgcagtaccccgagcgatctgtgttcttcctctcctatgcgatggtgggactgatcccgcccttctcttccttctacgacatgctggatttctatgggatccaaatggcgcatctcaccccgaacgccgtgctgactctggccatcttcgtacatctatgtgagatgttcatcggggtgagaccatgcctccagctcttccggtggttcttcaccatgcagctagtgtcctccgacggaggccgggggctgctacttccagccgcggccaaacacgcagcagcgctacatcgggcagacgctgtgcaagaagtggaacgactagttctacaccgtccaccccgaccaccctcgtcagtgcacacggcgaactggcaggaggcgccggtgctgggggacgcgttcgacacggccctcgattacctcgtcgggctgcggtccctggggctaaacgacactatggtcttcggtgattacactcgccggcggctcgcgcctctccaggagcaggcccggggcgagtggacgtacaccggcccgaacgactccacccggacccaccgggaggagacctaggactggagtttgggcgacctgaaggcagtggtctagagggtgctcaacctcggcaatgtcgagccgtcgctggtccccgagggcatcctccctctctgctgtgacccggtgcgggactccattttggccattatgcagacggtggctgccgacgcggggcgtggtggtggtggcggcccaggtggcagccgcgttcatggggagcacgccctttcggccgggggagtcaacacggaggacccgcggccgggagttcaggctacgctcgtccctccgacttgagaggaaagcggaagcagagggattcctctcctcccccctcctcggcccccgtcccactagggcggcacggagcgcgtcgctggcgggcacttagcgggtgccacgtcgacggcccacaaccgccgcaccgctagaggccggaagaagaagaggctgcggaagatggggaagaccgagccatgccggggggagttcatcaagcccccggaatggagcttcaaacgttgcccctagaggttcgatctcgtgatganctacttgcagtagntcgtacactacgcg

SEQ ID NO: 34314 - DNA, 1869 bp, Oryza sativa
ggtggatgaatgcactcggttgacccaccaccttgctttggcggaggccgcccggggggcctctgccgctgacgccgccaggagcgcatctggcgttggcgggggcggtgcccaggacaatgggggcaacgcattcctcccggtgctgcggatgctacggcctcacgcgcgcagtgcggggaccggctccccttccaccccctggaccggggccccgaccaccggcgggtcgtcaagagggcgcggtctcctttttcctcaccgactccaacgggctcggagcctcttctgcaggtgatggcgacgacaaacagcaccgtcatcgaggggctcaacgcccaactgcaatccctacacgatgagcgagccgcgctgcaggaggagtgggagcgagtggcaaaggggcagtgtgccgtggaggccttggtggccgcaaggcgcactagctccgcctggcggagttgaaaacgcgggccaaggcgatggaggaggtgatgcgggagacggagcaggagagggttgcggccctcatcgccactgacaccatggaggaggcagtgggcgacatccggcttgccgacgacgcgtactcggctgcgctctaggagaggagcgacgccgtggcagttcgggagctccgggcctcgcaggccgacgcgtccctacacctaagcgaggaggtcgtggaggcccgagctgaacgagcgggccttatccctgctgggggcggaagccgctgagcgccggcgcgaggaagtcgtcgagctccagtctcgggagatggagcggcgggcttgggagatggagcggcgggcttgggagatggaggatcgggcccgggctttggacgcacgggaggagacgctagcagtgcacgagtccgcggcggtagagcggaggaggcgaacgccgagtggggtcgcgccctcgcggacgccgaggtggccgcgcggcgcctggaggagagcctgcgccttcgggaggaaagctggcggaggcgcgacgggaagatctcggagcgcgagtccaaggtctcccgccgggaggcggtggcacggcggctcgccaagcgcgaggatgcatggcgggtcgcgagagccggcacctggagcacgctagcatggagcgggccgacctggaccagcgttcagccgagctcaacgctcgggagaggagcttggccttgtcggctcggggcggcatgacacttgagggcgggggagacgccgcacgggagtgccttgccgcggcggagcgcactatcttggatagatcgaggccctccgcttcgagatccacgctgggcctcaaatgcttagggatgccgttctcctgctaactctcacaggacgctggtcggggattttggtcgaccagaacgccaagctccccgccggtctgaccgggctcgcccgtcggctggaggaggtggccgtcgagttggagcatatccccaaggaggtggacgacacggtgaagttgtcgtcggcagcgctggcacaggaggcggtcgagctggtgctagcgagccactgggcctgcgacccagacttctcgcccttcctcacgctggatgactccccccccccccaacaaggaggcggcacatgccgcggtttgggaggccgtggacgtcatcgtgggccagttcgaggggacagccttcccgttcacctttgtttgtgcctgcggtgactaggaatacgagggcgaattcaatgacgccaaagcctatgataagcccggggatggcgacacggccgatgctccaggtccttcggggggagcggggaaagctagccccgactgagccgtatgccttccccctagccccacaaccccttgcctcttttatctagctgatgtaca

SEQ ID NO: 34315 - DNA, 4242 bp, Oryza sativa
  unsure (1)..(4242): unsure at all n locations
ttttcaagcaggtgggcccaaaactcggggcacattctcacaatatggtgagccccccggtttcattttccataggcaaccgttgcataataaaggaggttgaagctggtacttctacctcgcgggggcttcgaaccgatatctgtccaccattactaatagtggattgcctcccanccccgccaccaaaaagcctgcacattcagcggtatggaagcccgtgcatgtcatcgtgggcctgttcgaggggacagcctccccgttctctcttagattctccctccaatcacgaggaaggcgagggcggatccaagcccgccaaaccttagtagaagcccggcgatgagacccgacccatcttccaggtcttctggggggagcgggtaaagctagcccgcggtgagcggtagcaagtccccctggcgcacccagccctccctcctttatttgcttgatgtacatagctctttatctttaaagcacttttgttttaccttaaaaccgcgtgttaagcttttttaagtgaacgactgcctttgctcgccgtatgtcttatccacgtttgatgtctttcatgtgcctgcatcgagatatccatatgtttgtgagttttgcgattgacgaagggtgccaacccacttcttgctaccaccaagcctacttgactggggtctgggctcgagctgcgttctcatgcgatatgggccggtgctagaaccgtaggggagatccactagcaggctgaccaggccgagggtgttgcgacctagggtcggggacgacctgatctcggccctttcgaagcctcctgctttcgcaacacctcagggcacgactcgcgtctgggcccctcttggcgtatagacggctcgagtcaccaagagcaacgcgaatgccgagagcgtcccagttcgagtaagcgctcgagagaggaaggcaaaagtgggcgtaccggataaggtagagaacaaaaaaaaaagtttgctatttaataggtacaataatacaagtggtggcagcccccggccaacgcggcacgacgcgaaggtcgtgcggggttggcccaagcccaaggtacaaacacttgttgtcttcacgggtagaacttgcagaggtgctcaatgttccacaggttaggcagctctatgccgtcctccatgggcagtcggacagagcccggccaggggaccgatcactttgaatggtccctcccacatgggggagagcttgctcaagcccgcgcgcgcgtttggacgcggcacaagactaggtcatttacttgtaatgatcaggtccggatatggcgctggtgatagcgccgcaagctctgctggtagcgggcaagcccgaagggctgcgcgtcacctttgttcctcgaggtagttgaggtcgtcacgccggagctgatcttgatcggcctcggcatacatcgtggcccggggggagcccagggtcagctcaaatggcaggacagccttgcaccgtacacaaggaataaaggggtttctcccgttgcacggctcggagtggtccggttggtccagagcaccgctggtagctcctcaatccatgagtccccgtgcttcttgaggacattgtacgtcttggtttcgagtcccttgaagatctccgcgtttgcgcgctccacttgaccgttgcttttggagtgggcaggtgaggtgaagcagagcttgatgcccatgtcgtcacagttgttgccaaagagctcactagtgaactgggtgccgttgtttgtgacgatgcggttaggcaccccgaagcgggcagtgatgcccccgatgaacttaagggccgagtgcttatcgattttcacgacagggtaagcctcgggccacttggtgaacttgtcgatggcgacgtagatgtactcgtaccctcggcgggccttcttgaaggggcctaggatgtccagcccccagactgcgaacggccaggagagcagtattgtctgcaaagcctgggccggctgatgagcatgcttggcatggaactggcatgctcggcactaccgaaccaagtcggcggtgtcctggagcgcggttggccagtagaaatcttggcagaaagctttgctgaccaaggagcgcgaggaggcgtgggcgccgcactcgccttcgtgaacattggtaaggagctcgatgccctgtttctgagggatgcacttcaggaggactccattggcgccgcgtcggaagagggtctcttccaccaacacattccttttggagactcgagtgattcgctcgcccccttcgcgatcctctggtagagtcgcgtcttggaggaatgcttggatctccatcatccaagcaacctgtcgaggggcatcaatgctggcctttgcaggccccggggcctggactccatcgggctcctggggctgcatggtcgcgtcgggctcccacgcggggggattgagacgcgcagatggatgggcgagcctttcttcaaaggcgtcgggtggggttggggctcgcgaaaatgcaagcctcgatagctcatcaacgacgtgttctcccatctgggcatgtgacgaagttctaacccatcaaagtggctcttcatacgtcgcacttccgggatgtaggcctccatttgagggtagaagcattggtactccttagagacttggttgacgaccagctgagagtcgcccaacaccaggaggcggcggatccccattttggccgccgccctaagtccgcaaggagtccttcatattccgccatgttgttggttgcccgaaaatctaggcgaaccagatacttgaggatgtcgccggtcggtgagttcaaagtgaccccggcaccggcgccctgcaaggtgagggagccattgaagttcatcacccagtgcatggtcgattggctatgactgggggcatctccgagctcgggggcggaaggcccgagcgttgggtcgggattgaccgatggggtccattctgccatgaagtcggcgagggcctggctcttgattgtgtagcgtagctcaaagtggagatcgaactccgaaagctcgatggcccacttgaccaccccgccccgtaccctctcggttgcgcagtatctgaccgagagggtaggacgtcaccactctgacccgatgcgcctggaagtagtgacgcaatttcctcgacgtcgctagaactgcgtacaacatcttctgggcttgagaataacgggcctggaggttagtgtagtcgatgcacatcctgagcttgtcattggccttagggacgacgtccgggttcaccagccactctggatggaccacctcccggatgaaactggccttcaggagatgcgccacctcttcgcggatgaaggcctggcgctccgaggcctgccgccgcaccttctgccggacgggcctcgcgtctggtcgtacggcaaggcggtgctcgatccccttcctagggaccccaggcatatccgatggcttccgtgcaaaacacattggcatttgcccgcaggaacgagacgagcatgtcttactatttgacgtccaagttaccactaatcttggcggtcttggacgagtcgttgccaagctagacttacttgatgggcacctcatcgctcgaagtcctctgtttcttcgggacgcgtgaggttgaggcctcgtgccttccgccgccgtcctcgacttcgaaggctgctcgcgtgcaactccacgcaagccagcgcgatcttgacatcgccgtggacggtgatggggcagcccaggcccagcatcttcaactgaagataggcatagtgggccgccaccataaacttcaccaacgcgggcctcccgagcaccgcgttgtagggcagattgagatccgccacatcgaagtcgatccgctcagtgcggaaattggagggcccaccaaaggtgacggggagcgagatgtgccccagcggctaggtgtggcatctgacattgcatatggtgggtgaaagcaccagagctagttgaccccccctggcggcgcttgcggggtggtcgatttggtcgaaggtgagcttcacctccgaccagcgcgaccaccgtgcagcctcgtgggtggggacagtggccagaagctcgtgcttcatggccttgaagcttcgacgggaggcgtgggcacatgcccctccgtcgatggtggtgatgacgtgttgcggctcctggaagccgaggtctgcgtcatcgggttcctcgataggggccttttccttggcctcactttgccgg

SEQ ID NO: 34316 - DNA, 31262 bp, Oryza sativa
  unsure (1)..(31262): unsure at all n locations
gtgtaaatggctgacagctgctagnacnnaccaaaacctttggcgcaagacatggccctcgtcgttggagcgggccgacctcttctttctccgcttcttccgccgctcgttgcgagcggcaagctcgggcgtggctgccgctgcgccggagccggaggagttccaggtccaggccttctccttgcaagccacacggtccgcgagctcaaagagctctgcggtattctggggctccttggaggctattttcttgagcatgcggttgtgccgcacgcccctcccccccccctgcgcgaatgtatagatgaccgcatgggcgggtatgcaggggatggtgttgcgcacctggcaaaaacattggatgtactaccggagggactcatcgtcccgctgccatactgcgtgtaggtccacttcctctcctgggcgcggatacgtgccctggaaattaacaacgactaccggcggcctgttcacaccgttgggcgggatttctcgaacggaccggtataagaagatttggtctgggttcaaatgagaggcaaagagcccctcatcaattgacctgtaccgctctgtgccaggtgaaattagtgtgatacacatcaaattaacagggcttcgttaattttaatgatgggtcagatgggtactgactactttcgcattattttcagagagaactagtgtccatcacgtcacatgcagtacttgattatctgaaattattctatgaaacaaaagccgaactgtttgcttcttttgagtaattgtctaaagttaaatttcttggcagcggatatggattttaataattcttatagatgcttaatatatgtacggaaaaatgaaggtttttgtgttgacatgctctgctatcttaatcctacttaaccattttatccaagtttttctggaatcattgctcttgtatgtcttgaaatttgtttgtaatgttttgctatcagtgcataacaactgataatttgaggtctatttcaataacttctgtttctatcaaagattgtgtgttattctgtacggatggatagctttcagcaacttcctcttaaatactgataaacatggaagtccacaatcgaagtactggttgaaggaaaaggtcggaacatggatgtatgaacgtgatatctgcatctaattgtatactgtgaattcatgggtgataacttgatcagcgtatttacaaattaagactacttttaagataatgaaagtgatgttcatggatgaccaccttttagggaatcaagctttgtttttcatgcaccagtaaaatttctcgttcatttcttcacttctatttagatttttaggataatatgatttgaaaacacttatgattggttgttttgaattgcattggtattttggggtacggtttgcttgctcaatttgatgcatatccttttgttcttttgccgtttccagagcctacgttcgaaggaccttcagcttcatgttattacctccaatatgatgattgacgctttgctcaaaggaggcagataggaatatgccatggatatgtttagtccagaataatgtggcctacaatttatttaatgattattttcattggagcttctactgcttcccagctacctctttttctcaaagaggaaatatatgcagcatgtgcagtccctccctgagaaataccgttttcaagtatcacatgcagtatttgataatcgaaattctggtctgacaataagaccaaattgctacttcctccgtttcatattataagactttctagtattgcccacatttctttgtaggactcatctgaatccttagtttttataatcgaagtattgtttaaagtcaaagatgtcagaacatggatgtataaacctgatatttagatcagttatgtaatgtgatcatattcttgggagataacaagatcagtttttcagttgttatgtgcttatgagttaagactgccatttcgggaattaattatgctgttctatgaacagatatattttcttaatcccttattcgtttcttctaagcgttctttatgttggttgtttttgagtctgctagctcaatttgattcatctttttggcctgtgtcatgaggtggtgccattgggagcagaacaagctgtgtgaagattgatttcccagagaacattggaaatgacatatagattcttacgcatggcatttaatctttttcaacttactcttgctgattattgtcataatttaacaaatacggttaatgatggtcctattgacggaaccatcaatatcctgtatatccattcagatgctgttcatattcatcttttgtccattactgcacccaactaaaaatctgtgccatatgaatcaaatcaagtgtggttagattgattaatctgaatcttttgcactccttttttttcttcaaaaacaaagatagacataccaatgtagtataatatactaggagagctaaaccaggtgagtgtattttcctgacttaacctagatgtacacaaccagtttgtcaagtatttacaatacatatacatctcgatgtagtttctcatgaaagccctttgcaactcctatccacctcaagttagtggctgcacaaaaagctctctcctgatccttctgaataccgcaaaacctctactgctatacacattttacagtacacacactgtgctgacaaaaactataggaaattcaacaggtaaagagtcaagaagtctcctggaacgactgcgaccgcgacaatgcagctgggtttgccttaagagcacgagcaggacgagtctctgatgctgcttggcctttgctctcacctttggactggaacggcttgaagatgccagggtctccaggcttgatccccagggtggcccagatggagctcttcgccgcctcgtcgggatcgtcgatgcggagcgtcttgggaacccacagtgatttctcctccttgtcctccttcagtgggagagaggagtccctggaatgcttccccagaggggagccattgcctgaacagctgctgttgctcgacgacgatggagacatgcagccgccattcgttctgatccacggtatgttccatgccgtggccggccagctggataagcaaccccatagtgcaggtggcactagagggtatggaaatggtggtgcaaaaagcctcgaggcaaccggcatcatgggggagttcatgttcatccatggagctgaactggtgctgcagctctcagattgggaagcagactctggcatgcttgtacctggcaccatcataggaacgttgttccatcctatgttccatgggtacatgtaaggagctccaaggtagtactgcggcactgggccgactccgttgcaatacaccggcgtgctgttcttgtcaacttgggctgcattttcaggtaacacgttgtgtgatgtgattgaagagatgcaagagttatcttcctgattttcacccgttggtactgctgcagcattggttccattctgctcctgaatgttcagcactgatgccatcgattcacagagtggcacctcaggcccaaatttgagaactgtttcgtttctgccaattggttgtataggggtcgaatgcgcagatgcgaaagcttcagggttcattgacttggatatttccactctagaccccatcatgcaatcaggggccatcagtaagtgacggtagtgcaacgatgagctcttgcttttgcgcctcccagcaccaacaggtacatttctcatggttcccccggcagtccaatacctttggcagttcttacagaagtgcctgggttgattaacattgtagttgttgtaataacaaaactttgtgtccatactgttgcaccgagggcaagggagaatcttatctggcttcttaagtactttgtcctggcctgattcatcatttgctgtcttttcattttcatcttttgagtctgatgctgctttctcttcaacgttgttcatctgaccctgatcttcttttttattgtccaaggtagatctgctgactggctctatgctttctattgactctgatgcatcaaccctcatttcatcatttcccttctcttctggcacatcagccgtcacttcattatcctttttctcttgtggtgcatcgaccttcatttcgttatcttcctcctcttgtggcacatcaaccttcatttcatcatattttctttcttctgtttccttgtgatgatcctaaaatattgccgtagtggatattagcaaggtacttcagttcaaacttcaaagaaacctctaataatgaaaccctttttgaaaaaaaatcactttagcaggaagtttggaaattaaagaaatgtaataggatcacaagtctatggcatggcaaaagataaataatatcatgaatgaatctttcaagcaaatgatatgcaactataatcacctttattcagctttgtgtttcttttcttccaaagaagagacatgttagcaagcagatattctacctttatgggcctaacacttattgtgttgctccaaacattgaaaattgggagcatgaaactatgaggtgtacaccggtatgtaaattcataagttgggtatctgaacaatttggacatgctaatccaagcccagttgcacagatcctaattcaatcgactttagcttcatccatccacagaacatgctgcagagagatatgccaagatgatccgaaggacaacggccaatcatcactaaaaataaaatcatgcaggtattctactcttatctattcaccgtctcgttctgcctcagtacaatcggctacgcggattaattgcttttactgaaaccagaacacatcctaattactagctgagaaaaaaagctgaccactctttcgctaaatgaaagcgaaaagccatggtgtagaaagagaaagaccaccacatgctcaaaagaaccttagattttgcatggatgtcctactttacactcctaaccactttttgaggaggcaaggatgattacacccaaagtacccaaccaaccaattatgctaattgccctctctcacctgcaaatacccccaatcacaattagcaataacacagaacaattatgggcaattctctacttaactgccgcctaagtcgaagacaaggacaaaacatggtgtacggacaggtaggatcatcctaattcttggccttatccacacacctaaaatccaaactgaaccttttttttttcatacacaccaactgatcagggaaagtgcaccgtaactttcacccatgacccatagttcgaattcctcaccttaatctgatcaagaagagctcaatttcacagaaacacataaataacagcctaaattaagccgatcatatcaatcttttcctttctcttccccacaaagcaacaaaaccctccaaactcgaatgaaaagcaacaaaatgcgcacgcgattattctcacctcatcctgcgccgccggctcaaccttcgccgccgccgccgtcgccgcctccggctggtcggagccgtccgccgccgcagcagcctcagcctctggagccagcgggatcacccgcccgaagagctttatgcccggatccttgtcacacatcctcgatcccccctcacccaccaacaacccgacaaccaccgtgatcctccgccgccgccgccgcagccgctgaccggagcggcgagagaagagaagacgagaggggctaatttggaaataaaactagctaagctagtctcctctacgcatgggacgaaatgggaacaaaaaagagcacgagaaatttcatttcagaggggattgctcttgctatattaaagaaggggattaaccctcttatacccttccaaaacccactattctcaaacacacccctataaaagttcggagcaacatcggttagcataataagccaaagcaaaagccaaaatttgaatttttaaacttgattttgaagttaagatgttttcgatgtaatttcttgatagtattggcttttaaatcgctacgaacaaatatatacctataaataacttttatttcctaataagctgctttgtcatatccgagaatatgagcaatcgatgaggctcttgcatactccctctatcccataaaaaatcaatatagtagtacttaatatgacacatcataatacaacgaatttagatatgtctctgtctaaattcgttgtattaagatgtgtcatatactctctccgtcccataatataagggattttgattttttccttgcactgtttgaccactcatcttattaaaaaaaaattatgcaaatataaaaaaggaaaagttgtgcttaaagtactttgtataataaagtaagttacaaataaaataaataataatttcaaaaaaattaaataagacgaatggtcaaatagtgcaagaaaaaaaaccaaaatccctaatattagggagtacttggtttttttggacggagggagcgtaggtaaagcctgtactgacagggagtgtttatgtaaatatcggttcatataggggcgtggaggcgaattgtccgaggctcgggatggcgacgcggggggcaccaggggcggacagctggcgtccaggtcagcggcgcggggggctcgtcagccacgagttctcgtggctgggaggcgcccggggtgacgtcagctgctgcgggcggaaggcaagcgatcgaatctcgcgaaaaagcggagccaaaaaggggcggtccaggcggccaccccgccccccgctttttctcttctcctttctttttccttctctttttttctttctttctcctcttcctttatcctacgtggcacgtgctggacggaggtgggccacgcgtgtcagtgggacggcgcgtggtggggggcctagcgcaagtggggagttggtaggggttctagccttctaggggagctgacggtgggcccggttggcgctgattggctgataatttttgtcactcttgagctgaactggcgtgggaaatacaagataaataaaatcaccaagaattgtagtataaaatccgaaccccaaatacccaaaattggggtaaagtgacaccaacgtgaattatatttttttaagaaaattaaaataaccaagcgttttagtataaaatattgaaccccaaataccggaaaattggggtaaaatggcaccaattgttttttttaaaaaaaaacaagattagtactctcccgttttacaatgtaaatcattctaaaattttccatattcatattgacgttaattaatctagacatataaatctatctagattcattaacatcaacataaatataagaaatcctagaataacttatattatgaaacggaggaagtataaaacaccgaaccccaaataccataaaattggggtaaaaatgtcaccaagcgtgaattgtttttttatataaaaattagtatcaccaataattttagtagtataaaataccgaaccccacgtccccacgctttactaaaaaaaccagctgcagatcaaaatccgttagctcatgagaatggtcccgtcgtgctcgtaggccacgtggctagagatctttccctggagacaatcccatccacaagttttgttttgagtaaattttttgaaaaaaaatagtgggattccaacatttattcgtggcacttgttactcgctctcggtctaagcaaatcatggatttgggttggttttgtgtgcacatgtggggccctgggttgctctcgtccacgtggtgttgcggataaaatggtggtgagaaaaggacgtccatttggtggaatcaatgtgtcaaaattttggatttagaagtacgtgtttacatatgcaaggtcgcaagaaacttgtttgagctacggcttataagtagaaatggtaaaaggtttaaatagtggactaatttttttcctcatctaaaaatatatgagagcaagatgataaagttgtataagaacatcccctgcagctcatctaaattttatcctccatactcccatttggatggccatccaaaaaaattcccactctatataacttttcacttcaacagatcatccatattacatcctacatataccaacatcctatattttactaatatttttcaattaccacacatttttactcctattgctctcacctttcaccacttaaaaaaaatcttgggaagtgggtagttgaggatagagtgaggagagagaacctccatatttggcttgggaagggctaggtttggaggacctccaaaaatggagtacgtgatagagactctgttggagcactgtttttctcctccatactccaaatatcagatggatgactagatagagaagctgctggggatgctctaagtacccatagctcatgacccattaccacccctatttataagccacaaacaattttggactttaaactcaattctctcattttaaaacataggggttcacaatgtgcacaatcaccgttgtaaatacccacgcccaacttttataaacacatcgagaagactgacatctgaaaaaaaaactcaaccttaaagttagtttagtgtgttgttttatcccttcctaatcttttaactctaaatttagactgctagaatttgaagtacaaaaatcttatccaaaattttctactccatttgctacgtactccatctcgtcttggtttatatataattcacagtcgtagttatacgagcaaatgccagtggtgtgtgctagcgaaattacccagaattgatacgcatgttgagtatcatgttgatggcttgtttggagagtttaagattaagagaagcagctgataggtagctagcttctaagaatctgaaaaggctgggtttccgagcttctgacttctagtttatttctgaattctataactacaacttaagctgaactatttgaaagaacttttgattgtaagaaaaactgcggcagctataagctccccaaatagccttaggctacgctcaggaggagggttggcacgtaaaacgaagcacatattattgcatgattaattaagtattaattatttttttcaaaaatagattaatatgatttttttaatataactttcgtacagatttttttttaaaaaagcatactccctccgttctaaaatataagcatttttagcatagtgttaagtcaaatatttttaactttgactattaataaaaaaataaaaaatcaatcatataaaattgatgttactagatatatcattaaacaaactatcataatatacaactctttttatttaaaacatcttacttttatatatattattagttaaagtagtatgtcgtaaaccatatcaaacttaaaagtgtttatattttgggacaaagagagtatccttcagcagtttaaaaagcgtgtgcgtgaaaaaaaaaaaaaagttgagttggccaaacttgggggaggaacgcggcgcacgaagcggaagcgttcgaggctgcgaccgagcgaagcgtccttggccacaagcaggcgggcaaccttttttctcttggaatccttttccagtttgaggatcagaacgggcccacccccatctgccgctgtccaaccagcagcaatccaccatctactagcagcggggaaaagggaaaatggctcgcggcgcgggggccactttcctttccacccgcgggccgcggccacgtccacttgtcacgtcttcttctctccgccgtccacggttcggtctcccggcgcacgaacgacggcgcgaacacataaaaataccgcggcgcgccgcgcgtcgcgtactcgagtccaccaccgctgtgggccccggcacctttttcctccaaagcgggtggtgtgggaccaggagaagtacggctacgtcgcctgctatgctgtctactagtatatgtttgtgaggcccacctgtaggtggctgtggctcggagtcggagtgaggtttgtggtgggagtgctttttgtaggtttgtggtgcgggttgcgtccaccgtacgcgcggcggctcatgggccgtgccaagtggcgctggtggggcccgcaggttgcagagaaggattctccggtgaaccacactgttcgtggctgccgcctgcagggattttgcctccggcgaaaggcataccaaccggctttgcttcgtttgtctgactataacaaagatcatgcttgtgagacatgaataaataaataaataaatagaatgaaattttctggatcccaagcaaatatttcatttgcatttttttccaatcatggaaagtacattcattataactgttttttcttatccttcctcgtgtcctgtcgaaacagcctagctacgatatttttactctcttgaccctcttcctccttaattttggtggccttgctgctgctagcgggagagagagaggtcaaactcctcccaatcgttagtactaataccgtagttgagttagtctcgcagtcgagccattctcgttgatgggttctcattttaattttcttcttgctacgacttaaattacttcatttttcccgtgtttcaatcaaatgctagttttgaaactttcatgtgttttaaaaattttataagaatctaatgagcatgacattccattcctatattttctctatccctatgttttgagtcttgcatttcaaatggggccttaatctctaactcttgctcaatggattgggcctggttgtagttttacaaatttacaatacaataatgtagaagggaaagtctatttttttctcccttgattataagtcgagtctgattggcatccactaatcgcacaaccagatatagagagtccttaaactatcaaaccggcttgttttgactcctcatgtggttctgatggtggttttgtcctatataacatttgcatggctttacagacaattgttttatctaagagttggtatactcatgccaacatggggcttagtggcaattctagcatgagaaatttacaaaaacctatgtgggcctacaagtcaatcacatgaaaaaggaaaaaaacctagtgccaccatcccacccctcccttctcttctcgatacggcctcgatcccaacacagtcaacggctacggtgaagggctcctagatgaggtagagtgttccttgacaatgtttgtacctttgctattgctagatctggcgatgccctggatgtccttggccatgagcctatgcaacatgctctaggcgtagttgaggtcgacaaacgaccaccgccggcgacaagctagagctagagctcgcctggtagagatggtagtggcaatggtggccaatgagcccatccattgttgctaggcacatcacccccaactatgcgtccatctgctaccattgatcacgttggctctggtagtcgagcttgcttcaatcgcacaaagtcgttagcgtcaaggactatgttacggagctcaaacatatgctataggtggtcgagacagagcttgcaagtgtgcaagtggagttggagatggagaggaccaagaagaatgccaccgtgcctcccccaccacgcctcgctgctcggctgcttgcgtcctcgacgaggtcggacgttgcagctgcccgtatgagctcgagatcgatgaagccacaccttcctttcttttcctcgggtgttgccgcctttctgcttgtgtccctcaataaggttcactactttcatcaccaccgcaacaagctcgagctcgacatggtgcgccatgcccaatgaagagaggatgggagaggtggaggaagaaggcacttatatatgggtcacatgacaattgtttttctaattgtgatgccatgtagacaccagtacgcgacacgtcagatgaaaccactgataaaaccactatatgagaaaaattgatcttgttttgatacttgagggatgtgctatacttggtattacggttgagggaggcgaatcaaactcggcctatacttgagggaagaaatgtagacttttcctatgttgaggttggcagctatatgtgcagcccaggctcaatattgactctttgtttgaaggaataagttcactttggatccctttatttgtcacccagtctgattttcgtcccttgatcgcaaaaccggatacgacaggttccccaacttacaaaaccgtttaaataaatttgaccctggttttaactgaggtggcgcctacgtggctaatttgactcggtcttcatctgacatggcattgacgtgacgcttacgtggcaatttgatccgaataataataaaacctataggacccacatgtcagtttcaattgtgaggcccacgtggaccccacctgtcatcctcactacccttttctctatccccctctctctatcctctctctctctccctcttctctctcctgccggagcagcgggccgagcggtgcccgcggcggagcaccggggaggagtggcggcggccggagtggggcaaggaaggagcgtcggcggccggagtggggcgggaaggagcgggccaggcaccccgacgaggaggccaaagaacaggaggtgcgcggccacggcgtctgaggcagccgccgcggcgccgcacgccatgacgaggcatgcccgagagaccttcctgatggccctcaccaccttcagcttcctcgccaccttcccgtggctcgacttgatggcgtggagaatggacgagtacctgtcgtggatccgcccgaagctgctccgtgtcgccgcgtcgctgaacgggacaacgggttgctccgcacggcggcgagcggcgccacggtgccatcggtagcggcgacgctgtcggagatggtggccaggaagctgtccgtggacaggtagtttctctgcgcgttcttgatgttcgtcagcagctgcttgcagatctccgacgcctcgtcgttggcgtcgaagtagcccgccatcgccagcttgatctccgacgacgtcctccggtgcatcattcgctgcaattccgcggggacgacgccttcggtgcagcgtgctgatgtactcctcaatgctcatggattccatggctgtgttccaatacaaaccagaatttctcaccattattgatggcaaaatgaactgacacacaagaacatataaacagatgacgaaaagctcaatgttctatctcttttttttcttctctctactgatctcaccttggtgtgatgggcacatgaattgccccgattccaaaactcaatttcttcgagtttcttgatcttttgggacaagcaaaaccggagtcaaatactgccgaaggatcttatttaaacggtttcgtaagttaggggacctgtcttatccggttttgcgaccgagcgacgaaaatcagactggacaacaaatagagggacccaaagtgaacttattccttgtttgaagcctagctctttccagatgggtagaattcggcccagttcgaaaaatgaaattcaaaattagggcgcaatttcattttgtttagaagaaaacagaatccatccatgtattgcagtactgggaaggtcgttccaatcacagttctaacttctaatcatctagccatctagacgcagtattacaatttgcgagagaattccggctggttccatttgattccacacgagatgcattttgttctgcccaagcaaaaatcaatcaagcagagccctaaacaaaaacaaaacaaagggtgaattctttttttcctttaaccatagtccaactccatccccatttccaccgcttcgagaaaaaaaggtaaaaaaaaaagaagcgacaggtgaggtgacagcctgacaccaccctccatgttccgtggtctcggtccacaagaccagtgtgctccccgcccctttctccccgtgtgcggaacccgtagaccacgaccacggtccacggggcctcgtgccggaagcgagaggaagacgaatcaacaaacaaaaagcaacgccacgccacgccacgccactgcagcgtccgcggggtttagggagggttcatggccttctcgtcggaggcgtggaaatcctccgccactgccggccacggcgacggtgacggcgacggcgaccggacccctcctcagacgcccccgctgcagacgccgttgctgcctcatacgctcgctccactgcagcgttcgctggtttttgggagggttgagggcgaggcgatgtcgtcggaggcgcgggaatcttccgccaccgccgtcgaccgtacccctcctccgacgccaccgtcgccgccgccgccgccgccgcctcctcctacgaacgggacgctcacgccgccaccgtcatcggcaccaagcggcggtcgtgctacctcgtcggaggcgcgcgaatctccccacgccaccagcgtcgacgacggcggccgcgctcctcctccgccgccgctacctcgtcctacaagcgctcgtgctacgcctgcgaccactcccagcgcggacggctcctcctcctcctcctcgtcgacgtcgggcgggtcgcttccccgcggtgaaatggcgcacgccgtggagtccatggagaagcttcgagccgccgtgtccaagctcgacgagatgaggcgagttcgatctctcctttttcccggtctcctccctcgaatcgatcgttccgatcctctttcctcttgcaacttacatgcttatctctggcttttcccctgtgcagtgacgaagacaaggactccttcatgcacctcgtctctcgctacctgatcaggtagatggagattatagtagattcgattcggcatgatttctctccattttttagtttctcgtttcgatttgttgagtttttttgggtgcatttgtagggaggagaaagagatgatcgactggaacaaagttgagcgacccacccctgagatggtggtgccgtacgactcactggtgcaggctccccgaggtacgcacgttgttctggatgcctccttcgatttcagcttgatgatccgatgttgttgtgctggtttcgtttgtaagtgctgtgagattcacatgctgtttctgcgattgaaactggatcgtgtttggcgctgcagatatccctgagattagaaatctgcttaataaacttgctgtgctcaagcttaatggaggacttgggacgaccatggagtgcgttgctcccaagtaagcatataaatattcgaattggtgcattttacctctgaattgatttgtctggtcagcttctgctgactgttgttagactcttcctcagtggaacgggtgtacggctgtagtcccaaagcaaagcaattagatggttcttcctccgtagggtgtttatgatgatgcactgacgtggaagatcacattatcatattatagcctgatgatgctttttcttgttattttgcttgtaactcttttgttttaacaaatgtatgttcacatcatattttaatgtgcttggtaagatgtataattggttatagcatactagaaatctgccttgatatgtcttgattttactgccatgtttcttttctggacactgcatgctgaaaagaacatatttcttgctcagcgtgtatctatgatatctgaatggtgtcctaaatgttcttttgagtgctttatgtttctattccttttaatttcctacactgcagctcaaatgacagatcgttcctttccttgaatggatgacattgatcttggttatgcatgttcattgtcattaagtgtcctgatatccacatatatgaattatcttaggtactacattcttacaggcatattcatcgtttcggttgagctatatctgaatgctctaccactgtgcttaatttttctgtattcaaacattcaaatcattacaggctcactgccaacatgttttttctaacatatttgatgcaatgcatcgatattgggtggactaggaatcattatgttctccttgcaccatctttgagattttgccttctgaaacaagtaattgtgcaggtgtacgattgaagtccgcagcggccttacctttcttgaccttgctataatgcagactgaggtattcttaacatatattggtgttttttctttaatgactggatataacatgtaattgtttgtgccttacaagtttcacccatctgcagtttctgaacaagaagtatggatgcagcgttcctatccttctaatgaactcattcaacaccagccttgtgaataaggttgatattcccttcactcatcatttaagatatccttttagcatcttgattatgaccttttatttttgaagatcgtggagaagtacacaaacattgaaattcacactttcaatcaggtataacattcttttcataatattttcttcattttttcttgatgaatatcacatatttacacaattatgggttcaacttacaagaatcatattctatacagaataagtaccctcgtatcattactgaaaagttcttgccactttcaagcgaaggaagtacagggtcccattgctggttagttttctccaataattctaaagttatcacattccgagtgaattgtctgcttaatgaatacatttcaaatacacagtcgtttggcctgtgctatattttgaaatgtttatatttaactcatcccatttccttaaacctgaacattccaatactgtgatcttttgatgaaggtatcccccaggccacggtgatgtgtttttctcattgtgcaaaagtggaatacttgataccatgttgtcacaggtaagaaaaagtctgaagtcttacccttttatataggcaacagcattagcacctagcactattcgttggtttacaatgattgtgtaaaatatattgtattgttttccagaaatatgtaacttgatttttgatatgctcatggtgtttttcatatctttgtaacatggaatgttaatgtcttgcggtaatcttatcatccttgagaaggtaacatattttctagtgtaaaatttagtacctcgaggtactttttcaaggattataaaatttctctaatgtttctccataagaaaagaaacatggtagatttttttttcttttgcattttatataagtgatacacaattatgctttagtcataaatcatgtccaatgatgaagtccaagtatctgtcgtgtaaggggaactttcagagtttgctaaaaacaatattgttgctcagaatagttgaggcataaaaaatgtgttagggtgggaaacaaaagagggggtagccaaaagaaattgaatgcaacccctaaaattattttagggactagattttttaccatacatgattgataaaaaaatgactataaatatatctttttagtaatttattgcatattgatattcctgtgcttagtttcttttccaaatcttctttcagggcaaggaatatgtcttcatagcgagttcagagaacttgggcgctacagtcgatattggtatccaaatatgagtacaacatccttattaatgtctcatggcttgcatcagaaattgaatccttaaccagcacagaaatcctaaaccacttgatccataacaaaaatgagtactgcatggaggtatgcaagtgtgcaacaagaactaattcccattgaatttggataatacaaaagtcaactcaagtatttatgccaggttactccaaaaacatcggctgatgttaaaggtggttctctcatatgttatgaagggttaaggtatacttatttaatcttaactttgttgccggcgcttaattacatactgctagttcaggagaaaagactatgatttacatgcaagttgcaatgttaaatttgtagcaaatcatcatgttgcttgtttctactaattgcacattgcgatataaaaccgtaaataattttctctgttgttatatacttgtatgcagctgttggagatttttcaggtcccttatgagaatgtaggtaacctctactaaattattttgttccaactcgtcaattttaaggtctgatggatgcttttcttcttttcttttgggggggggggtggccttcaggtagatgaattccagtcaattgagaacttcaatatgctcaacactaataacctgtaagaaacccaggttgtctgtctcttattaagagtttgaacccttgctaacagcttttggatataggcgggtgaacttgaaggccatcaagaggctggtaaaagctgaagcactaaagatggaaatcattccaaacctaaaggtgcaccatccgggtgaatttgttctctacttctcatttgcactacatttatctaagcattgtttttttgtgttacaggaagttgatggtgtgaaagtcttgcaacttgaaaaggaagctggttcagcaatacaggtgcaagacactttcttagtcttgaacttatgatatgttgctccttctttctgttcatcttcaaaataatatgccctaatgcttttcattctatttatctagtgctttgaaaaggccattggtgttactgttcctcgctcaaggttccttgcagtaaaaaatacatccgatctgttcctcatcctggtatatttgaatcttttccatgttcttgttggtctagaatcataaatgattggttctaagtttattttttttgttccagtctgatttatatattgtgatggatggcactgtaacccgtaacccagctagagataattcaacaaaccccttgattgatcttggacctgagttcagaaaggtatggcagttgtatttaaaacatctgagatattttaaatttgaagatcaagaagggtcattgaagaaatcaagaaatcagtgaataaatctggaatttgactgtaatttcccttctttttcctcacaaaactgtaggttgacagtttccttgaccgatttaaatcaatccctagtattgttgcgcttgatagcttgaaaatctctggggatgtttggttcggttcaagaattactctcaaggtaaacctcacaagtcacagtaacatattgttatttttttttactccttggttgccattctgtggtgcttggtatgcctcctaattgcagttttttttctgcccatttcaagattttacatgcttttgggctgtgtacgtccattgtggatgtagaggccggattttaatccattttctaaaaaaaaaagattttacatacttcacaattcaatgcctctttttgaacgcatctcttgcggaaaaatggctttaatgatgctactcttattacagggtgaggtgacgattgctgcccagttagggttaaagctggatattcttgatggcagtgtttttgataacaaggtaaaagttcatctctggataattatctgttttgtggttattttggaaactgtactattatttcaatgatgttggcctttttatctcacagcattcaacacatagttctggagccatcaaatatacaatgaaattggatgagggagcggactgtgcatctattgattctgcgctcaatcggctgaacccaggatcaactttgatcctaaagaaagatgatttctatcgatacattgacccaattcaggcacggaaccgggcaatgttccattcagaaagcagtaagccctcatccagcaacaacgagttactccaagacaatggaactcccttcactccaaatgataatagtgacaggatacaacccctaccccttgctcccttctcttcttcacttggctcttcatcactgcttcccttatatcactctagagcccgtcgagcgccttactggtatacacgatttattttcgtgaatccgcgaggggcactgcattcacaatttaggtggctgtgggggcgtataaagtttagcagtgcgaaagatcttgccatattttatggtatttatcatatcgtactgtatggaatagattgcattatcacagcaactttgaaggacaattggtttgccaaactggtgcaaggaaagctgtggcttataatattggtctttcatcagttcaagttgcttagccgccggcgcctccgctggggtgagaggaggaggaggacgctcagatctattcatcaggatatccagagttacttggacaattactctgactccgacatgtggcatttgattgtacacagtgttgctagagtgatatccaatgtgctggaagatgtaaaccgcaaatatatgaagaatcactacctaggctttcttgccatacattcaacggtgtttgccatcgaagtgataggttcatacgctgttgaacttaattacgacattgagcactatgcagaaccgccagagttataggtatgcaaattttctcttatctcattatttgttcccatcttgctctatctcattacttattcccatctttgaacataaggtgaacttcacatatctttgataagtagatggttaatgtcgttggaacagcaatagatattggctttatctgagtaatatattgcttctactttgttacttataatttataagacaactaaaacaatatttaataaatatcattggccggaagttccattatctaaaaaaaattgatagtggaatgattctgtagccatatgaggggctttggttagtgtttaatccagttgcaacacttgctaaatatgattggtatgcttgttggtctgtgagcaaaagctctcaatcgtaaacattttgtcaagaattactcatcagcatttagtatcattatcatgatgctaattcattaaggatcatgtcatgttcaatacataacgtatgccattggtagtgctctgcgcactgtgcccatgttcaattagattgatttgtactctcttcaaaagggcatatctgttagttttttgccatgttttacttgacttgcttcatcatgttaccagtaaacatgggatttcctttgttaatcctatgcactgttgtcagcttatttgttgtttcatttactaatcatcaccagatcatccttgctagaattatgtatgactgatagcttctaacttctctggtagacaggtactcaaggtcccctttttacaaggggaacccaaaatcaagttcaagatcatgatgcctgcacagctcaatccagtacctgatcctgatcccacgcaaggtatcaagaagccacaagaggttttaagccaattgctaatgctacgtatgatgccatctatcacttactaactcatgatgatattgttactgtaatcacacaacatgttcctgatgcgtttctgtggttaactccgtatcatgttctgaatgcgtttttttgtggttcatggtatccatatatgcttacactagcatgactctgtcgtatgtcgtatatctcgtatgtactatgtgcttgactgtggcgtatgtcttagtatgtaattatgtgcaaataagtacttcctttgtttcatattatgagacttctagcattgcctatattcatatatatgtcaatgaatctagacatatatgtgtgcttagattcattaacatctatatgaataatataggcaatgctagaaagtcttataacctgaaacggagggagtactttatagtactttatcttattatctgcattatagggttttgttgaacggggacagctgtttgtatagactagttgtgccagctgaatactataaaacataagtataatggccataaaacataagtatgcgtaaataatgtattcccttgcaatgctactatcccaacaaactgaaaaaaaaaacacacacatactccacgtagaagatgatctgaagaactaggaacagagtacagactggcagtgtgaaactgtgaataatcaggcagcgggtggcttgggcttcttgttcggtttgaggatgagatcggctagaggataccaaattattggtcgcttgtaggcttgtgcgccggcagcgaagaagaggagcagggcgcattcccacatcacggcctggtacaccctcggcaaggggaggaggctcatcaccacgagcagcacgccgcacgagagcgagaagcccatccccaccgccgccgtctggaagtccgacgatctcatcgccgcgcgcgaggccgccgacgccagatccccccctccgcccgacgccgagagaattcctttttttttttttgctgatcgatcgattccgccgccgccgtcgtccgtccctatcaactttctctttcaatctgttgtgtttaggttatctgattggggttggggtatatatgaaccggaaaaatatatatactcatgtaatccgtgtcctaaaacatctccgtctccgatctgtttggttatctgatgcggattggctcgcacgcgcgcgcgggtcacgaggctggtttcggtcaagcaaaagttgcaaaacggatgtggattttcatctctgcacttaggccctgtttctttcaacttaggattattataatccagattattaggagtaagctgaaagaaacagataatttattgaagtagcttattataatctgataagctcatttaggtgagctttttccagattattgggtgaaaaattacccaccatgccaccccactccctttttagacttgcaaacccaataatttaggctctaataatccgaaaagaaacaactaaccgcttattatactacagattataacaatctagcttatagtaatctaactcaataatctagattataataatcccaagctgaaagaaatagggccttagttcatggatggaaagatggatctatgtgttcttgctgaattttttttataatgctattcaaatattcaagctatttttgatggtgtgtcaattatatataatatttgttattgctgaattgatgattatcttgtatttttttctgattggagagagatactacctaatgcgaggcctcggaggggttgtggacggggcttgatttgaccccacatctccagtcggggccaggggcaagggcgaagtcgagggcgggggcgttctagcccaacccggccccgcactgccccggtgctatctttactaagatgtataataccacactaaaggcccttctcaactgtatgtatatgcggcatctaacgggattctacgctttctaaaatatcccacatggtaatcagaactaggggtgggcattcggtctaaccgagaaattcggttcggttcttcagtcttttagaaaattcggtcttcaaaatcacaagaccgatcggtcttcaagaaaactcaatatcgagagcttggctcttcagttatttcggttcggtctcagtcaaaccgaactaaccttagcagcgatttgaagttttgaacaacaaaataaaaccgaacaagatcgacgaatcaaaggaactcaagtcagatgaaagacacaatatgctgccactagtgaatagagcatgattcaggaaagaaaaaaaaaaagcaaattgagcaaatctatcctaccacgacttggatccccgtcgatctccaccactccaccacaagctccagatcccatccatctcgtctcccaccgtgggctcacagccggcctcctctggcatcgaaatccccagctaacggcatcttcctccaccggggtgtgactggccggcagaagcagccggtaggggtcgctactcaccagagggcggaagggtggtgcggcgccagagacggtctcttccactgcgaaaggcggaagggcggcgcggaatggcggaagggcagcgcggtgcggcgtggaagggcggcgcgacaccgtgcaggtcgcgctagcgtggagatgggagaggataaggttgcgcctcagagaggccgaaggagcgatttttttgtcgctaaacttggagtcacgggatcacgggatggggagctaaactttagccgatggggagttagttttactctagatgattttactctagatgatgaggcggtattgggtctagtgggctgagatatcacatgtgttattgggccatttatatatttcggttttttcggttaattcggttacccgagacccaagaccgaattaaccgaactaaattcggttagttgaaattgcagatcgaatttgtgaccgaatctctcggtctcggttatttcggtttctgtctcggttatttcggttcggtctttttctgcccacccctaatcagaaccattttcctcaaaccaaaaccaatcatatgcatcctcgctgtcactcgcgtttgtccccgtcatccagtgactgacaaactcaagaagaaaatcatctcctgtggaaaagcccatttgcgccgcttagagcaagtttaatagtatagccaactaatagctctaaatcatttatagctaatttaatagtcaattcatacaatagttatctataaacaaatactacaatatcaatacctggtctggcctatcatacacacattatgtcttgaaatctatgctgcagctacctgcaaatctatagcccactatttttctctcttttcttttatctcgttaaaatatgtttatagctagcttaattatagtctgctattgtacctgcttttgctgggtttcctggatagaacgaaggtagcaccaccaaagactcttgaagtcaccaacaaatacaagactttgacgatgatctccaataatgagtactagtatgtaacttgggaggctcgagaccagtaggtcttgggcggttgggctatcttttctcctcgctttctcgcaaggtgctcataagtcataacagccgctgcactgaagacgtctgccaaggtgtggtagacgattgaggacatgtttgcatgtcagtctcaaacttgtgttctcaacacgcgtattttctctcgtggccactcacaaagagtttgagtatgttaaatatggagtacaggtggtatttgaatcttctgaagatgaagataaagattaaggacctgtttgttagagctccaacgcctaaatttagctctagaagttgggtctggagtggagttgtgtagttgcctaaacccagctccatctctctagtttattttgtgcgctccacccaactccactcccactttagtggagctgaaactatttgatccactcccactttaggtgagagctgaaactatttgattgagctccagctccaggagaagtagaggtgaaactgtgccaaagtgccaaacatgccctaagtgttttacgcaaaacgagcaaaacgaggtagtaataacgcatgcttaattgagctttaattattacaaacttgaaaaatggattaatctgatattttagaacaactttcatatagaaagctttgaaacgcaccgtttagcggtttgaaaagtgtgccacgagtatcgaaaagtttatccaatttttattggagaaaagaacatagcatgtcaacaagatgaaattaaaggccttgctgacgagatggagtccgcaggaaagcatcttgacgatgatgatctcgtctcctacatcgttgctagtatggatgttgattttaatcccgttgtgacgtacgctagttgcaaaccggactgaagctatcaccgtcggtgaactctttgctcaacttgttagcttcgaaactcgtatggagattctgtaaggtggctccaactatgattcgttggccttcactgtagcttgcgaaggcttcgaccgcaggcaaggtggtgactgcatgcggccacgtacgtcggcgcgaaaacaatattcatcccatagaaacaaatattaattgttagatttgtcactataattgcttccaaattatttctcttcctccatttcatattacaagatactttaaatttttttcaaaattttaagtttaaccaagttaacaggaaaaaaagcaacatctataaaattaaattaaattagtttcattaaatctaacactaaatatatatttaaataatatatttttaaaaatatcgttacatttcttttatgaatttaatcaaacttaaaagaatttaatttaaaaataagtcaaaatacgatatgaaatggagggacgaatattctttaaaatttagggtcataagtaacaaataatagtcataatagttgtttatcgaagaccgtcttataatatataaacaagccagttagtttttttgccatgttttacttgactcactttgtcatggtatcaatcgattctgttttttctgtacatcttttccctaccagtaaacatggggtttccttttgctaatccttctgcactgttgtctgcctatgttgttgttttcttttactaatcactaatcatccttgctagtacaactatgcatgactgtgatagcttcttactttcaggtactcaaggtcggaaggtcccctttatactcaagatgatgatcctgatcccaggcgaggatatcaagaatccacgagaggttttaagagcatcctagcagatgctccattcggtactccatctgagatttagcgcacgaaagtgaaaatcggagctccagcagacacaccatcgaatcatccaaaaatagaggatacgcaaaaacggagagaggaaggccaaatatagcgtttctctctccaaacgtcatatcgcaacggccgcagctcccgcccctatctgaagttccgcaaccttctgatgaaccctgagttcctctcaacactcaaggctgatgttggcccgatctttcggtgagttgtgataactacgatttgggagaaacgttgacgatccgactacaaccgtacgagacgttgtgttgcgccttagcgatcgatacacctctccgtgggttgttgatcttgccggtgcagatcaaccctattcctgcaagcaaatcgaagaaacaagcaagaacaagaataaagcaatctgatattgcaaataggaatttaatacaaatgataagttggggtttcgaatacaagcagacggacggtctggccgacacgcgcgctgcaagcgaagtagcaatggctaaactttcatctaaacaaaacccgagaaaccctgaaggggtaactagctatatataggggtgggaggacgacctaggggtgcctagggtcgtgctccaccagcttggggcgcaccccacatgggccccacctgggccggggtcccaattgaagttacaagcccataggcccattataggtgatgcaacaccttgttcctgtgattctggccacacgagatagaattcagagaagaggctggatccgttagaaagagggctccgagagctttccatcaagtactcacgggccgaaaacggaggtcgtatgcagattcggtggccgtttgaagtcagcagtgtagtaggtggccgaatcggattccagcacttggagtacttgatctcgatatcttcttgttcatccatgatgtgagcaatggttgcatccgtggtagccatggtcacatcatcctccccttcttcacggaaaaccgtcctcggtttttccatatggtgctctttgcgtagtccatttacaacaacctgtttcttccaatcaaaacaaggcaaactcgagacaatttggttagcaataacatttttctctagcttgcatattttatccacatgtacaggaggttctaaatccgagcagatgtaaactctatgcacaaaatatattccaagatcattatattcaccaaagatgtgaaatataacattggttggatatggcaaatcagacttagcaaataatttctccttgaaattatcgagctcacaaaaatcatcaaactgaacatagcccaaagtatttaaagaagatctcaattcacgctcctctacttcattagcaatgtgaacaacatgcttaaaatcagtgcagtatgaattaacagtaggaatagcatgttcattcacaagttgtggcatggatataagtgaagcattatcgcataactcttctttatcacaaggaacagcaaacaaatcaatttgtgacaaaggaatctcagcagttggttccactaatggttgctctgctatagcatgaaaagtggacaaattcaattcattaacaacacactcacctttattaatttcagcaccattaagtttacctttgatgccctcttcagataatggaggtgcctcgactttgagtgtgatcaatgggactggcggctctttcatgtctctctcctccttttcatgattatgcacttcctgcaaatggttagtaatagaagacaaaaacatagcatgttgcttcttcatgtcctcctctattttactttcagcattgcaagcaagttgtgacaaatgagaaagagatgtatatctttgacaatcaagcatgtcctgaatttctttggtaagcccacataaaaacctcaattctttagcttcttcgcattcatctaaaccacaacgtaataaacaagcttgcatatcatgatagtatgaagtaacagttctggtatcttgttttaaacattgcagtttattgaacaaaatgtcagcataatacatgggaacataaacatctctgaaatatcgtttcaggtctttccaagattgtggtattttgttatgcctacaaagatgtttccaatcattagaagcatgtttaattaaaacactagaggcacacataaccttttgtttctccgacaagacatgcttttgaaattcactatcaaccgctagctcccaattaatgtaagcacgaggatcatagtctccctcgaaataaggcagtgcagatttgatcttacctagaacatcatcacttacctcataatggtcatgttgatccctcctcatgtctcgacgaagatatcgatgttgagcgcagctatccccaattatcttgcgtatccctgccattgttagtagaaaacaagaaacatacacaaaaatatgcgcgttcctattaactactaggtagtggcagctcaaaaatcgcacacactcaagcttttaaccaagctcttacaagatcttaccaatgcaagtggaatggtgacatacaccgactcaaccaagcaccccaatgaaggttggatgtatcgatgccttggcaaacacttgcggtacagctgtaatcaaatatgtggagctctgggtaggcttaaatatgtagcaaaggaatagcaaatgctcaaatcagataatgcaaagttgaataattgttcaaagtcaagtatcgtgctggtcctaggctagaacgtactagagacgcgagcctagacacaaacgataccacaagatagcactaggaacaactcatgcacaactctgatatatgaagttcagctcaaacataacagaattttctcttttctttctttcttctttcttcttttctttttttttctttccttttcttttctgttttttttggtgcggctttttttttctttttttttttgcacctttctaccttttttttcacttttttcttgatttttttttaacaaaaactgactcaaggaccttaatgtaagattacagggactcaaacataaatataaaatttacagggactcaaatgtaaaagtctaaacctaaaattaaaattatacaaaaaatggaatgctgaatttatgccggttccgtttttccaaacagatctcgaaaccgacaccaaacaaaaattcgccaaggtgtttgacacaactcggaaccgtggaagagagggagggagtcggactcggccaaaggggcgagtgggactcggccaggaggtggagtggatggcagccgaatttggtgtatgggataaaaaggaaactgatttttaaccaatccaatctactatatctttccaaaataatcttgactacttccaaaatcagatatggtaattcaccttcctcctctcgtgcacgacagaggcacggccaaaacaaacacacacaaggatcggcaaactctagatgcaactcaagaactctaaaactaaccgacagaaacttctgaaaactacaaaaatagaactgtggcagcgagtcgattccgttttcgtaggtcccgacaacaatagagacacggtggcagcgacgactgtggtacaaaacatgaccagaactcgaaactctaaacgaactagacgctaagaccagcaacacgacgtgacgatgcaacacaaaattcaacaaagcaaaaactgaaaagaacaatgcaatggcacaatatggctaggtaaatgatacgattttttttgtatggctattttctggttataggaagataaaaactcaccgagcaacgaaagctctgataccacctgatgaaccctgagttcctctcaacactcaaggctgatgttggcccgatctttcggtgagttgtgataactacgatttgggagaaacgttgacgatccgactacaaccgtacgagacgttgtgttgcgccttagcgatcgatacacctctccgtgggttgttgatcttgccggtgcagatcaaccctattcctgcaagcaaatcgaagaaacaagcaagaacaagaataaagcaatctgatattgcaaataggaatttaatacaaatgataagttggggtttcgaatacaagcagacggacggtctggccgacacgcgcgctgcaagcgaagtagcaatggctaaactttcatctaaacaaaacccgagaaaccctgaaggggtaactagctatatataggggtgggaggacgacctaggggtgcctagggtcgtgctccaccagcttggggcgcaccccacatgggccccacttgagccggggtcccaaatgaagttacaagcccataggcccattataggtgatgcaacaccttgttcctgtgattctggccacacgagatagaattcagagaagaggctggatccgttagaaagagggctccgagagctttccatcaagtactcacgggccgaaaacggaggtcgtatgcagattcggtgtccgtttcaagtcagcagtgtagtaggtggccgaatcggattccagcacttggagtacttgatctcgatatcttcttgttcatccatgatgtgagcaatggttgcatccgtggtagccatggtcncntctccttcccctccgtcgccgactggtcgtccccgnctgtnntnnngtngtngcgtagancgtacntcatctgactggggnggggganggggnaaaaagagacaattgacctaaacgatgttaacnagcaagtatatcgaaactgtngtggctaccaaaaatagaagtaaagtgagtattatgatatntttttctagcggt

SEQ ID NO: 34317 - DNA, 6394 bp, Oryza sativa
  unsure (1)..(6394): unsure at all n locations
gcggtttgtgctcctactagatggtacagnagttcatcaggcgcgggggactactcgacggccatcgcgttccaggagcgcatccgcctccccgacgaggccatggcctactacgacgacctcgccgagatgtacgtcggcggcgacgtctccccggacttctacggctgggtcttccccaagtgcgaccacgtcgccgtcgggacgggcacggtggccgccaagccggagatcaagaggctccagtcgggcatccgcgcgcgcgcggcgggcaaggtcgccggcggccgcgtggtcagggtggaggcgcacccgatcccggagcacccgcgcccccgccgcgtggtggggcgcgtggcgctcgtcggcgacgcggcgggctacgtcacccggtgctccggcgagggcatctacttcgcggccaggtcggggcgcctctgcggccgcgccatggccgacgagtggcggctcaccggcgcggtgacggaggccgggatacgggcgggatacctccggcggtgggacgacgagttccgccccacgttccggttcctggacctgctgcagcgggtgttctacggcgggaacgccgggagggaggcgctggtggagatgtgcgccgacgagcacgtgcagcgccggacgttcgacagctacctgcacaagcggatggcgcccgccgagccgtggggggacctccgcctgttgtggcgcacgtcggcggccatggtgcgctgcggcgtgctcggcagggaggtcgagcgcatccgccgtctcgagcagcagaccgccgaccaggtgctcctccgccattgaagatgtgtgtactgctctgctctctctctttctcatgttttgtagtagcaactctgcatttgcaaattgcaatagtatcttacataaagatgctgctgctagtaataagcatggtaatttttgggatgctttaacttctaagcaataatatgacatttttattcagtttagtggaaatcccagttgtcatgaattcgtgatgattgttatgtgtaccagtactcaacacatagggaatttagtgggcattagcaacgattaattgaggaaaagaactgcattactcgggtatatcgtatatgaatatatgatatagttcaagctgacaattagtctcttaataataccggaaggggttgtagagagtagctaggtaacataacaaaccagatctgaaaagcctaacgaagaaatacaatatattcaacgaacactccagtgaaataataatccaaatctcagtatcaaaatgaccatctcctccgttctccagaaaatgcaactgctatgtaatgtggtattctggtcatccaatcaggcctgcagtcaattgaaagatgagagcgtgacagatactgtaaaaagaacaaaaccaccaatcaaattttatcaatataacaaaactttggaaaaagagttggcatagctgtgttcgggaggaggggttggtcaccggcacgcaaaacaaagctcgtattgttgcatgattaatcaagtattaacttttttttttgaaaaatagattaatcatatagaaagtttttccataaatcacaccgtttagcagtttgaaaagcgtgcgcgcagaaaacgaaagaggtgggttgggaaaatggggggaagaacacagtaagcttcaaaccatgtaccaccatctttcaaacaccctcatggtacaattgcatgacagagtaatgtggtaatggcacataggaactaccttgtttgcaatgttgctcgagagccagtcaaggccctcatataaaccctctcctgttgtggcgcatgtactctggatatacctaaatgacagcaaaatccaacaggttatgatatgtaaaaatagcataatattttcaaggaaaaaaacgaaagttattgatccattgttaaggtgattctattcatcatgtaataatgagccacataattgtataggtgaacatcactaaaaagttttatagatctaggatggttcttggtgaaaatatgtaaatggcataagatacatacggagtaacacagttattcaccccctatgactatttagttgataaaaaagagttgaaccacaaagtggagtaaggtaaaccaaaaggctgattcattaaaatattaaaacataaagtttaaaattgaaagatagaaatcgacaaaccagaatacaagaccatcaaacttagaacaaaaataggaatggatgagatgagaagtagacagcctacaagtgacaacaaaagcaaccatatattaccagtggcgttggcgcagggaatggagaccaagcttatctgtgatctcagcagcattcattgcattaggaagatcttgcttgttagcaaaaaccagcaacaccgcatccctcaactcatcctgcaaatgccatatgactgaatgcttaaagcagtgattgaaaagaatttgtatatgtatgtaacatagtccaagtgtatctgaaagcaaaattcaggattctaattgcctaagaggatagattccttaaccatatggaactaatacctagcaacattttgcataggcatgtcttatcttttaagctctgaaaagcatatgctatgtgtgtaatagtgtgtattagcataccatggcatattttggacagcatatatttatttttaaaattctgggcaaacggtatagtaacaaaaaattatgaggatatgtcggaagtgtaggaacatgcccaatatctctattgatgagttaataagtattgcaagcttaggaaaaaaacttaaacctactaccacttatgaggttatctgaaaaaaaaagggtacttgtgtatgaatatgacgaactaacaataaaatatgtgacatcagaaaatgagtattttatgatggtatatccaatttactcattttactaaatgtcatggaatggtgccatactatgttgtcttgtgaggaaaaattggctgcacttaaactaaaatcagtatgcgttattctgacatttataaatcaagtcactgatgatgcatcctgctgcacaaactatttggaggtggttatatgcttaacaagaaataggatgaagttaacaaaaccaaaaggcatgttcagcatacatcttatatgacagaacaaagttatccatgtaacaggttaagccagaaacatgaacatgatccttaaacaaagtttacctcattaagcatcctgtggagttcatcccttgcctcaaccacacgatctctgtcgttgctatcaacaacaaagatgagaccttgagtgttctggaaatagtgcctccacaaaggtctgatctgtagtttagaaaacataatgttatgagaaaaaaagtttctaaaaccctagagctgtggccatatattagtatgaagttcatatattccctactgtctgatgtgtttaaaatagtccaatacagcacaatggaaaatctactgctgattgcagaaataccttctgaagcgaaaagtgattttggttacaaaaagcaagaacgaattggtttttaccttgtcttgacccccgacatcccagacagtgaagctaatgttcttgtattcaacagtctccacattaaaccctagacatcaaagaaaaacagtaacttgatttgctctctttacaagcattatttcaaaaatgaaaaactatctctcatctgtctaacagtaatattttgcacttgcacatagagccatacaagcgtgcaaccatgtttgttcatatttccaacattatcaggttgcaatatgaaaatggatacaaaataatgcaagtgagccactaaatacaattgtaaactaagacatccaccaagccaccaatggaaggaatccagccctttttcatacaagggaccttacttctatgtgatctgtttttctttttgactacactatagtttgaacccaacttaccgacaacaaagtaggagtatttgaatgtacttaacagacacatccagtcaaaacatataaaatatcaaataggtttttacctattgttggaatggtggtgacaatctctccaagcttgagcttgtagagaattgtggttttaccagctgcgtcgagaccgaccatgaggatcctcatctccttcttggagaagaggcggctgaaaagcttcgtgaaagtgaggcccatcttgccgcagttgtgcaagaccttaaacaatcaagaatcaatatgagatatgatacaaaagcacatgcagcaaagttcttaaatctcagctcagataatgtaagaccaaaaccaaaatgggctccatagttcagttagttaaatcacaattcattcaaacgaaccagatcttttgcaaacgagaaaagtatataaggatatcgacattaagaagtactcccgtcatgccgttgtcttttaacatgacgtttgacatcttactaaaaaaattatataaataccataattttgttgtaacttgttttatcataaaaaaactataatattaacttagtacttttacatatttatactaaatttttaaataagacgttatgcgaaaagtcaagagcgtgcgttatacataaaaacctgaggtattatttgaaacggcaccgtgatccctcaggcaatgcaaagaaaacagcatctacagactatgatttcacatcccacgagtaaacaaaattcacagaccagtctgctgtgcgaaggatctatgcaatgcaacgcaacgcaacacgatgccactggaattaaaatgaacaatatacaagtctaacacgtgaaaaggggtcggcaatggaaacggataggcgatcacctcagccaaagcaaacaacggatcgccgaccagaagctcatctacggactaacaattccgcaccccacgcacgaacgaattccgcggacttgtagaggcctcccaaggatctacgcaacggaacacaacacacagcaccacgccattttctcgaggaaaaaaaattctggatcgaaccgaacgagatctacacacgcgcgacgccattggaagtttacgcaccacacgctacgaactcactcggctacacagatctacgcctccactccacggatctgggcctgggcagcagcagcagcatcgccgattcgccgccagcgccagcgccaccgcatccctccccagcaatgccccgagggcgaggcggagatcgtagaggacaggagagagggaaaggagttgggcgtaccaaccttgctggagatcgatctcgtgcgcgcgcgtggcctctctcatctcctccccacctcgtcgagccgaagaaaaaggagacgacgcctcgacgcgcggtggttgcagcggagggaggcttcgagccgccgcggtgggtggacgcggtctacgtgagccgggtgtggtggactggtggtggtggtggtctaggtagagtgcggtgcacgtgagacgggtgcaggagagagcggtgcttctcatttgaagcttcaacgtgcaaccgacgctttctctaagtttcattttttaaaccattttaaaattgagggagcttctaacttctcccagctgtcccaaatagtctagattttcatttagatttcaagaatttgtaattgtacaatccagaaaatgaactaaaattctcataagttgactaccaaccagttgtttcttagaatttttaacttttcaatcaggaccaaaaccaaaaagtctacaatgtcctcactttatcaaattctaatataattattcatctgcaattatttctcattttttatttccaatacaattattctttatgttcacaaactccgatgcaatgattattttaaaaataaacttattatggaacggagagagcatataagcatgtgtacatgtataaagtcgtataaaattcaaatgtttaaagtcagggtggaacccttggccatgataccaataggaaaattcgattgggctgtgtacccaaaacgttggggcagagctgcaaatttattgtgaagatgctgttgttccgctagtttgcagtcacaattcattcagacgacccagatcttttgctcgagtatacaagatgtacacatataaagtcgtgcagaattcaaatgtttaaggtcagggtacttgggatgtaaagtgttctctagcacaaaatatatttggcatgtgcgcgttgtaaatacaaaatattcactctgctcataagataaaattaaatcaatcaatacctaaacacatgagaaaatagttcaattctccaacatcacttccccacaccttgaaaactaggaaaataaatacatacgatctcctaaatatcaaaaagaaaaatagagacattctcctctccataaactgtagttcactcttttcatttcatctcctatatn

SEQ ID NO: 34318 - DNA, 4608 bp, Oryza sativa
  unsure (1)..(4608): unsure at all n locations
cgtggaatagatgctgtagcaatnnnnnnnnnnnnnnnnnnnnnnnnnnnnnnnnnnnnnnnnnnnnnnnnnnnnnnnnnnacgctgaactttttgtctgaaaatttttctgacgctgtaacgaacaattttggcgaggtgatgtggtcgtgtatccttcagcttaagagagcccggaggctttggatcagccgatttttagagcataaattagtgcaggtgctgctgtactatgatgtaccatttctgagatgatacgaggctgctaattcatttggtcgatgatgaggatttgccctattgaattatctatctatttgtactagtagtgttttggtttatcagaactgagaatcgtgctaattgaactaaaattatatttttatatgatggtattgtagtagtcgttaaaaattatattttttatatgatggttggaaaaggatatataaactttacgataccactcacatcctaaggttgtttaagatagtggttttgcatatttgaaagcttaaatcagcaattttgaatggctaatatagcatgtttacatatcgtcgatcattgatcattaaattttaaattatactctagtgatgtcatattagtattataatattgtcaactgtttgtaaatgagagcaaaaatatgttgttaaaacgaaagatttaggtggagattttaacttatctaatgcatatgtcacctagcaaaacttattcaacatagataaaaaccactttgtaaaactatattaaggtgttatataaaaggtatgtttgggggttggatgtctgggcttcaaagttcagaggtgctagatgaactttcaatcaaagttttgggggtataccttttattgctatattataaaagaaattaacgatcaaagataacatgaagaccgtgtaaaagtctaatactctccatatcattctactccaggtaacacaaccatcagtttttaaaagcctggagtttagaaacatgtaaattatatgtaaattatatattataaaagtagtgctcatggtaaatctaaaaataaaatataaatcgtacgatgttaaattattgtaaaattataggaatcgatggtcaaagattaaaatgtttaacttggaacaaactagcaatttaaaacggactgagtatgttttatattttataatttagaagggatatcttagaactgatggatgctttaaaatgtagccacttaaaaaacttcagatgcaacatggacgagagcagatcattgactgcaatcaaacatggtgagcatgatacgatttatttactatatacatcttcaccactgattgacatggatcagttaaataaggttcccctactaactgtaaaaatctatgaaaacgaaacaagcgcaaaagtctaacgtgccagccacatctgcttattcattcggagatagaatttgtatgatccggtgtaatatttattacttctacttctggtcactgtatcgcatgatgccgtacacatcaacaatacccggaggaaacactggatcagttgctgctcttacagcgaccttcgccacggaggcaacactcactggaggggtcaacagtgggccaaccagcggcaatctcgtcaacggcttcgcactttggagaacctgcagtgcacagggagatcttcaaattaagtcttaaaaacaactttacatttggaataagagcaaaaataactgtgttgcaaggcttgcaaaaacagaatgaagagacttttaccatttgcataggagaaccaacaagtccaagaggtatttttacgctaccgacacggcgagttccatgaataaaaccaggcctcaaaatcactcctgaaaaatatgtaaaaaattgatataaaacttgggctagaaatacttattgagaggataattgtgtccaaagtcatctcaagtgccattgaattaaaatccaaattgaaatgataaataaacttctcacaaagtcacaattcttctggttatgccttctctttagtttttctactcttattacatgataataataatggaatagttggaatcagcagaattctcaaactacagaaccagccgctttcacacagggggaacaagattggagcaagggccctaagaatttagaagacaactcgagaaaaaggttttagaacccagtccctcatatatgtactccagttatccaaagtattccagcaatgtaagaccaacaaatacttgctccgtcccataatataaggaattttgggtggatgtgacacatgaatctggatagaccgtctgtccagattcattgtactaggatgtgtcacatccacctaaaatcccttatattacgggacggacataagtggctcacgagtaatggagtggtagctatgaacttgctcacactaatatagtgatttcaatacatgctgattcaaggctatcatcgcacatagcatcagaaataattttagcaaaatcaaattggtttttactggttactccaagtttggctatttgaagccaatattctaacacatttccattgatgtcctagtatggacatataatatgtacacataaccgattagcactggaaaccttctcaaaaacagtatagagaaaattaggtatattccatttcttatagacaagcaaactggaacaacccatggcttcaagcaatatatatgagagaaacactaaggcatgagacagttgcaatatatatgagagaaacactaaggcatgagacagttgcccattgcggtgtgcacagccaagttatctagcttacgccttgatattatggtcctgtcctttccactagaagggctgtaatggtgcttcctaatgtgcttgagggcgatgcatcacctgagtgtttaaagttaattagctgcaacaatcattggccattgttctcttgttgcgaagaaatttggtgatttgtcctctttatcgtggaatcgtgttgtcagctatgctgcaacaagaaccatggaatactggcaaccacttgaaatgatggagtataaaattgattgcagagatggagtatcaatggcaccatcaagaactatccacacaattggcagcctatatgcacctcatggcatagggtgcttgagcagcaatcaataagaatccaataaaaacaattaggagttgaggacaaggaaacacaggccccgcacgagcaggggccattgccagagcctctgaactggtatttctttgttaagtacagccatattgccgcttactccatggtatatgtggtgttatatcaggtccgatactggttactgatcacgaatttttgaaacttaagtttaagataaacctctacacctcccatttccaaatctgaatgtatttggctatttgcaattccgttatagctggtgctacagggcaatactgtcatgttgggaagagatcatggcgttgcaaagatttggccacgccactcgcaatgatgtggagcatggcagcaccaaatttctactcaaaaagggtacatagagaacattgtgtaaatgaagtgtgaagctattattcaattctaatggatgttctccaattgcttcaacttcagcctcaactccatttgccactctaatgcatctttctcctcttgttagcatcctcctcgtatggaatctctgtaatgaatttgcaacatgaatgatcgcacctgaatcaacccaccaagtggattttaaataacttatgtacagggattcatcttcaaatgtaataatgtcctcacccttctttatgagatgctttaggaaatcagggcaatctttctgatagtgccccttcttcttgcaccacttgcaagtgtccttgtccacttctacattgcttggtcgtgatgtggatcactttgtggtgccttaggagaggcagcattctggttgtagttgttcctcttcttgttgtgcttcacatagttggcggaatcaccacgagccttgggtctatcctcttcttgcacacatatggcaatgagcttctcaatgtcccagttttctagctgtgagttgtagttgacaacaaaagcctcaaaatctgaaagcaaggaggcaaaaataaggtgaactagaaacttatcagggagtaccaagtccatcttcttgagctttgaagtgatatcactcatcttcaaaatgtgctctctaacccctctgccagtgtatttaatggttactaagctcttaatgagggtgctggcataggcctttgaagaaccagtaaattgattctccactctctgaaggtactcagtgggtggtacaagctgagattgctccccttattgcctccacaatggagctcttaatcaccatcaagcacttgcggtttgatgactcccacttcgcacgacttcaatcttattgccgcatggtctagcattctctgtttgaagtcaccttcactctcaccttctgccctcactggagtaacaagctcagtgggacgaagctcggtgagagctacagcgcaagtgctatctctatcttctctcggcatgagccatagttgggtaccgagctcgnnttcgcctgtatatgaagtccaccctttgcag

SEQ ID NO: 34319 - DNA, 22104 bp, Oryza sativa
cggtgccttgatttcaattgcaatccactgggaacccacaagattgaagtatgatgttgatcgtgcgaagtgggagtcatcaaaccgcaagtgcttgatggtgattaagagctccattgtggaggcaataaggggagcaatcccagcttgtaccacccactgagtaccttcagagagtggagaatcaatttactggttcttcaaaggcctatgccagcaccctcattaagagcttagtaaccatgaagtacactggcagaggggttagagagcacattttgaagatgagtgatatcacttcaaagctcaagaagatggacttggtgctccctgataagtttctagttcaccttatttttgcctccttgccttcagattttgaggcttttgttgtcaactacaactcacagccagaaaactgggacattgagaagctcattgccatatgtgtgcaagaagaggatagacccaaggctcgtggtgattccgccaactatgtgaagcacaacaagaagaggaacaactacaaccagaatgttgcctctcctaaggcacaaggaaaggcaccacaaagtgatccacatccacgaccaagcaatgtagaagtggacaaggacacttgcaagtggtgcaagaagaaggggcactattagaaagattgccctgatttcctaaagcatctcataaagaaaggtgaggacattattacatttgaagatgaatcactgtacataagttatttaaaatccacttggtgggttgattcaggtgcgatcattcatgttgcaaattcattacagcgattccatatgaggaggatgctaacaagaggagaaagatgcattagagtggcaaatggagtcgaggctgaagttgaagcaattggagaacatccattagaattgaataatagcttcacacttcatttgcacaatgttctctatgtaccctttttgagtagaaatttggtttatgtttcatgtttagcggatgatggatataattgctttttcgatcaacaattatgttcaattatattcaagaataagtgtgtgggtcttgccatataacaaggccagctttatatgttgcctaaacatgagaatgagaatgttgtatgcaatggagagaatgttgcgtgcaatagtatgtcttccccgtctacgaatgtaagaaataagcgcaaacgatgcaatgacgaaacatctgcgaaattgtggcactgtcatttaggccacatttcgaaggggataattgaacgattaattaaagaagaaattttgtatccgttagactttatggattccgaatattgcatcgattgtattaaaggaaagtatgttaaacaaataaagaaaggagccatacgaagtctaggatccatggcttacgggaaagcctatgatccttggcttaaaagggcctagtgtttatttcgaaatagggaggtattgtagttgttgcgtctgatggctcagtggtgactgtcatgatgaagcgtgctctatacatcaatctatttagaagtgaatattgagtatgagaagtaagaaaggcggagatcaaaggggagaatgttagttgcaatctcctggggaatcaggaaaccgattccccactccgcactcacacgccctgatctggggcgccagccgtacgatggctgtggtccctctcacgcagtgccaaataaaaaggggggagtggccggcacactaaaagaaacgtttgacggcgcacacgcactccccacaaaaccctagaaccctccgatccgggaaggcgttgaagtggggggattcctcacagccgcaccaccaccaccgccatcgtccacaccgacgccgccacaccgtcgccatggccgcatcaagctcaaagaccgacgccggtatgtctctctctctccccttccccgttcactccctaagtcaatcatctttatctccatgaggtagttcaacccctagatccgcaccgaatgatattagaatcctaacaacagttgcccattacggtgtgcacagtcaagttatctagcttacgccttgacattatggacctgtactttccactggaagggctgtaacagtgcttcctaatgtgcttgagggcaatgcatcaactacctgagtgtttaaagttaattagctgcaacaatcattggccattgtcctcttgttgcgaagaaatttggtggtttggcctctttatcgtggaatcgtgtgctgcaacaagaaccatgaatactggcaaccacttgaaatgatggacaataaaatcgattgcagagatggagtatcaatggcaccatcaagaaccatccacacaattggcagcctatatgcacctcatggcatagggtccttgagcagcaatcagcaagaatccagtaaaaacaattaggagttgaggacaaggaaacacaggccccgcatgagcaggggccattgccagagcctctgaactggtatttctttgttaaggacagccatattgctgcttactccatggtatatgtggtgttatatcaagtccgatactggttactgatcacgaatttttgaaacctaagttcaagataaacctctacacctcccatttccaaatctgaatgtatttggctatttgcaattccgttatagctggtgctacagggcaatactgtcatgttgggaagagatcatggtgttgcaaagatttggccacgccactcgcaatgatgtggagcatggcagcacacgattgccatgccaccttgtgtggtgtaggaagaaggttcatttagaaaaggatacccccgtaactttattttagaaaaatgatttcaaaaggtatagaaataatttcttacaataaaagaagggcaagaacacattggcatgaaaataaaaaggttacatgtgaaagagaactcaccgccataggtaaattttgatagcagttcagcttcagttgccctcttcaaaggataaatgaaaccaatcaaatttatatcaataacgattacttatagggtcagaaaaacaagcaacactatggaactatgaccttgccctcataacatggaaaaacttaccttgccctcataataaccttgcaacaagtagttcacaaaaccaaagtccgctgctgacacatacacaaatctcttaatacctgcaggtagagcatgatgtggaagcagttaagtcccaaccaaaaataatgtgcatcagcatagacttaattttactttgccatatcatatgaaataattgatcaaaaatgaaagatttggagtgattcctgccttcggcctaagcaagcaccgggcagtatatgcaactctagtgactagatgtcatgcatcgtcactgtccaagcagtccaagctacagtacatggctgaatggtacctctccactttttgtgtacgacagacaagcccaatatgcaaggaagtaaagtgcatgtttctagataattattcttccagagataactttgtgaagtactagtaagaaattgtatttatttatttttttggaaattatgacacaagagttagtattctgacatttacccttttgctttaattgatctgatcataagaactacacactatactgactaaaggagattacaaactagtggggagaatcatatcaatacatgtgaaaaagagcatattgatgaattgacagaaactgcaaacataacatagaaaatgaatatggtgctgcaacaatatgttctcaaacataaatacctttctcagctgcaacactgatggcattgatgtttgcagttccattaattttgtacatgtaagaatttgagccaaagcctccaacacatgatacctatagcaatttctctcatatgagtaatgtttcaagattcataaattcatgttagcataaagcagttactacttatatgttataccttattagagtatcggtgcataataaatttaaaaggtatcaacggtgttccagggatgatgataaaaggtttaacacgaagtggaaatatttccatcatactaattaatccagtgctcatagaacctagatagtatgacccaataatccaaaattatctgcaggcaagggaagtggcagggatggatttgaaaacctaagtgataacaatttaaaaagatggcctgtaaaaaaccatttccacctagatcaaccaagagttatgagcaatttgagccaagggagtgcaacggatggagcttggaaactaaatgatattaattgagaaggatggattttagaaactaaaagatattaacctacaagactgtacagatccaccagatactcattggtgccgacatgtatggagtaaaggcatcagatacctcttggtagtttcaagtctagtagtctaatgaatggtacctttaattagatttccatgacaataacagcagaaaacagtcataataatgcgcatacaaaataacaaaaaccctaaccccaacccaatcactaataaggatttgaacaaagaaggtagcaataagttagtatttgatgcttgaggtgcccaatatatcatttcagaatcatatattaacttagtacaatatcctgcagttgtttcggcatcatgtaaagaccagacaagtgagtctgtttcaactttcaagagacttgccaaagatccaggaaagtacaagggtaaaaaaaaaaaaaaaagaggaaagcataaatgcaagaatgcagttttcagtacaaaaatgtgcaccaagttaacaaattcgaaaataaaagtgtaaacataccacagcagaaacaccttccataatatccttcagggaatcaggttcaagtagattgcctgcccaataaaagagacattaagcaacataatcatttataagcacaataaatttatctcactagcaaataacctttgttccatataactttgtcagcccaagattcacttattgatggctttccagatctgttaaagtcaaaaatcaagagaatggtaagtcattgattgaaaataaagattgatgattttgaagtatataaagtctgatatttgtttgtctgataatacatcagatgtgtcaataaggaaattatgaattcaataaagcttcaattatctaaaaataataaaaatttaggaaattcaatgcaagactacagctactgaacagcaataagtacattcataaattacatgagtattgctctcagaatacaccattgacacccccttgaaaacactcacagaagaataagatgaaaaagaaaagatcaaactaactctgattatatttttacattgttaacaaacttctagaatcgaaatctaatatgagtagaaacagcttcacacagttctgttcagtgaccacaatagaggaacaaaaggagaatgagagtctcccatgaattttttctaaagctaaaggcatcaacacaaacttaagagaaccatataaagttatctacagttagattagaggattcagagtatccattgctcttccatatcagatatcagggcaaaaacgtgtttaagtttcaatagacatacagcctctgtagcaatagtttatttatgattttggctagttacaaaaaaaaataaaaaaatatatctcaaaatcaaacagtctgacaacaaaatgagaatgaacatgtcaacagatacagcttacagaaatacctattaagactagcaacagtaaatcctttgtccaaagcctccttgcaaacatgtgaaccaacaaaaccatttccacctagcacaagaagctatgtcgacatatatgtcagtagcaattcagtaatcttcaccaaatggaaagcataaagaataactccatagaaaaatgtacataatttatctaaaagctcgaataacacgtagttagctgttaatattaaacaatacatttccaaaaatatattaattgctgttaaacctgcaggaacaccattcaaaacagaatacttgttataatatttttatcggtctgtaatatattgctcaggataatgaagataagaaaacattggaaataggctaagcacttgtctacatgaatattttagttatatatgacctttctgttggaaatgaagaattgctttcccttgaagataagcacactatagagatttaaatatcataaagcaggatgtatccgtgacatattcagggaaatattttgggaaatgcttaatgcaaaaacacaatatgctgcacaaagggaaaaaagaggtttccatatcaaatcaatctgaagatctggtaaaataacattgtcggtgtagtgaacttacagggcttatgtagataacatttcaagtctaactgtttcaacattgagagcaatgacaatgaaatagttccgataaaacagcacaaaagaaaggcgagatgaaagaaaagggaatatgttagcattcgaatcaaactagcacgtttatgtttcctctaatgcattttcagttcgaaggactacatcgagattatcgaattcattttgcaacttttcagttacgtaactgatggctgcactggatatctccccaacagccaacatgtccattctatgacaataatctacatcagatacaaccgcataaaccaaaattcatcccgctgatagtttaaaatgaatacactaggtcactagcccactatgatagattgctcattcagaaaaaaaaaaaagaaagggaacaatgcaccttataatatatgggtaagaaaaggataaaacgactgctaccaagaatgactgccaaacaagctaaacacaagaaaaagtcttaaactagtgcattttacgcaaactagtaataatcacattaattataattaccttgtccggggaaggcggtggcaccttcacggtttctgcttcctccaccttgaaaggctcctccacacgcttggaagcatcctcgctcaagaaagccttcccattattgttctttaacaagtttgcggcgctgttggcatcatcggtcacacaaggtagaacagaacaccactaatttagcatcataataaaatccacaataatcataacaaaatccccctattgtggtggataagccaacgaggaggtaaatgcggctcctaattccccatcctaacgaagcacgcgcacctttgcacgccatctcatctcatctcatctgaatttaagggtttattgtttatctcttcccaaaaacttgggggatgtttcgacggcgggcgcgcgcggggaggggctcacctgagacgggagggcgagactacgggggacgaggaacggatcaggcgggtcatggccgacctcatcgccgccgacgatgccgccgccgccgccgtactactcctttcctcgcgatctatcgagagcggaagcaaagaatacgcacgcgacgcgaatggtctttttttcctcttgcgagtttgtttgtaggcgagaaaaaggtgaaaagcggtggcagatggcaccgctacgtgttaaggctggcaggctgccacgtgatagggttggcaatggggcgggccgggtgcggccctggccctggccccgcttttctacgggctcgctcggccctagtccagcacaaagaacaatctcgcaccggccctagcccccgcaggactcgtcaccggatcggggcctcacacgaggtgactcttgtctccgagaatgtgaacggcgactagcgctcccgacgtgggtggtggcatgggaatagcgactagcgccaatggcacgattggagaagaggatggtaggtggtgcatcgttgtagcagacagttgaggaatcgccaaagctacagcgacaataacaatgtggattggatggagtcgtaggagcggttaagcggagagacatgatgagaacatattgtgtgtttctcaatgcatcttcctctattaggtttattgaacagtttttagaaagaaaaaatctcaattctcctctcacctctatttatctatgaaaatcatatgtggcacctattctcattcttatgccattatttatgctcttacttatctcaattgaaacatgactatatgggaaggcatatatggttcacatgcatacaaacaaaacgaataccttatcccctctcccacatgttcccctcgctcccatggcatcacagcaccactacccttatagtgcctttgcttaatgccacaagtaaaaaccacgcccttatctattttcctcctccaacgagctctccactcctactctgttcctattttcccaggagtagatggtacgtacaatggtgaggcaaggtgggcttggttgaggtcacgagtgaggcgatgattaggctggtggcgacaactccaatgtgcatgaggggccttcttcatcctccctgacaaggcaacgcgtggccaaaatctcatttttcttcctcccctaattatgtgtcgggccactagtgagtggtggttagaagtttatgatttgaaatagaaaggttcacatatccggttggaaaaaaaaatctatttttgagcaaacaattccaaagattgttgaaagttaatgattttgaatagaaagttttggcgttttttagttcatttgaaatttcatgtgcacaactttctatattgacaagttctttttatgtataaagcttatagactgaaagttcatatgtacaaaaaaagtttataaatcaaaagttcctcaatgtattacatttatacattggaagtttatgtaaagtttatagattgaaaacctctggattgaactcgaacatccatctattccatgcataaataaataccaggaaaggtgtttaggtgcgtcaaaaagagaggacaaccaattggcactccgagcacatgtgactgaacgttcactcattagggtttttgatagctccaagcttccactaacaagcgaaataggttttttgccacttatttgcaaggcggaagtaaatggcttcgctctataattaagtggggtattatccttatatatttttgtattttttaaacgtggtctatttatataaaaaagatgaaaaggataactacaatagaagacaaaaaaatactttagtagtaaacatttctagaactaaatacataggagaaaatggttgtatgttaataccagaaccattatgtgggaacaaaattttcttactgctttgaaaccgagaacttcgtataaaccacaatattaaccacaatattaagtaccacaattgatggggtcgccgaacaactttggcgtcagaatcttcacgcacactaagggggtgtttagattcataggtgtaaaattttggcgtgttacatcgtatatactgacacatatttgaaatattaaacgtaaactaatcacaaaacaaattacatattccgcctgtaaactattagatgaagttattaaacataattaatccgtcattagcaaatatttaatatagcatcacattgtcaaatcatagagcaattagacttaaaaaattcgtcttgcaaattagtcacaatctatacaattaattattttttaaaacttatatttaatattccatacatgtgtccaaacattcgacgtgagggtgaaaaattttatcaggtgatcagccctaatagaaaggccagcaatgaatggattttgtgctacactcggtacgacttcgaatatttctatgtaaattatcctttccaattcctattatttggcatgaacgtctccaagattactctttctaccattttatttcgtgtctaaccggagtgttttgtcgaatagtttgcaagaattgaggaatgtgcctctgtttgaaagcgtcggaaatgggtgtgtgcgcaggaaatcagttcagacatttgtcatccaggcttatcaagccttccctggctgcttcgatcaattcattcagccaattcgtcagaattgtcacccagcctcttactaaaattcctgcaaaatactgaactcatactacaaattcaggtcctaacattcaggtattatgctaaattcatactaaaattcagttaaaggatgtgtttagttcctaaaagaagttgaaagtttgaaaaaaattgggagtttggaaaaaaaaagttgaaaattcatgtgtaggaaagtttttttatgtgatatgatgtgatgaaaagttaagaatagtgggatactaaacatggcctaagttctaaatactagtaaaattaaatccaggagaggtcctagtccacatgttaaatccaggagaggtcctagttcacacgcaggttcttcacgttgataggaatcatttggcaaagtagccaggtatgaggtatcccccgaatctgctttaggcgatgactgcttttggcaatgacaactgttctgtaattgtttggcaatgacaactattctgtaattattcattaaagttcgcaattatttcacaggttgtatttagcagttttataccatgcaccagaaaaggataaattcagacattacacgcagctaccggactgaaacgaaaccaaaaagaaactgttttagaatggaggatttgtgggacaaagaaccatcagcggcaattagatttgacctcaaggaaatattcagtccgcatcatggttggatcgccaaatggcaaacccacatcatttggttcttcccattatttttatccacaatgcacaaaacagaaaatgcaggagaacaggaaaacaatcgtccctgctcatccaagaacaagagaacaagaaacagaaaaggcagcaattttgtttcttcaggtgaatgagatgaacaggctcagattgataatgggtagtaagtctgcttgtcagcaagaacaggagagagatctctcccgagttcagagtggtgcatgactagttcctcatcatcgccatctcgaatctcgatccaagaaaaacaacatccacaaattgaaaggaaaagaaaaacagccaagcaggatgaatcgaaaaccccccaagaacccaaaaccagacgagacgcgagatcgaatcaaaccgcaggaagcgtaagaacgagagggatcctcggatccacgaagcggaggagggagagggggagagattcgtcgcggcggcggaggcatcgcaggaggggttcgactatttatgggcaaatcctcctctagctagggtttccttctcataattcggaccgacgagaggctgacaggcctggcccaacaacccgagcctttctcagctagctttgcccggcccggttgcaggagatgggccgagctatacaaatggcccatgtgccaagcccatctagcccatgattcccttttattattatttttttttgaaaaaagagggagcccacgccaaccatgtgggactgacacgtgagcctagctactcgttaagagaatttaggcggtcttcggcaccatttttcccaacctccaggcgtgtacgtttttcaaacggcaaaatagtgtgttttttgcaaaaaaaaaaaaaacttctatacgaaagttactttaaaaaaattaaattaatccatttcaaaaaaatagctaatacttaattaattacgcattaatagactgttccgttttccatgattaccggttgggaaccagcatgcccgaacacagccttaagccggtttggacgcatatgcccttctcctcccttcttccttcagcattgcgtgagtttctttgtttttttgaaagctatttatataataggctttttgtttgatcttttcttttcctcctaggtcaaggtgttctagttcttatccaattaattatttattgtgtttaatttcaaagtaatatattaggccaacacacattagatgatgacgctaacgtatacgtcgtacttgtagtgttggttataaatatttttttctcctaccttcttactaagaacaactttgggtttgttcgggggtccagtctgcggcaacgctgtgactgggttgtagcagtaaaagacaaaaaaaaaagttcatgctggttttctgctgcagcccgcccagccgcaaggtagccgaacggagccttttgcatccaaagctatgggttttttttgtgccatttaaaggccatcatcggtcatattactatatacctccaatcacttgccataagatgccaattgatgaagtgaaagagagaagtgaggagagagagaagaatgcacccattatgaagggacaagatctatataaactctaatataattatgagagtattagagttatttggatttatatgttagagataactatttatgtgttgttgtctcttagtctataagtagatgagataaataaaattagatgtagtagtcatggtaacatggtgttcatctatatatgatcttcgatatggtataaaagtttgagtactcatacactatggattttcattgttgttaatataaattatatatttatgtataaataactatgaaaataaaaggtttatatataggtaccacacaaaatggaggttttcatataggttttgataatgcctccattttgcatgagaaataaatgttagataaaatagattatcccttatttatcaaattccaatgcaattatttcttattttatctactctcaatgcatttattttctactctcacaaacttcaatttaataactacttaaaaataaacttattttgggagaaactggataagctaaaaatgaactcgtttcaggaaggagggagtatatttttagcatcacatttttttaatttctttttacgttgtaaattgtaagtagttatattgtaattacaccatacttactacaaattttaataggtgtaattctttaattactttgttatatgagatatggaactaaaaaataattataattgtgtagtagtatcagtatcctaagattgggtttttttttaatacggagggagtagttatactatctatgcagattaacaaataaagtaaaaaaacaaaagcaaaaacaggagagagaggccaaggcgcccggcccgtgcacacgatgttcaatcaagggcatttgaaccgttaagatctgactagtcccaaaatgtagcgacacctttttagcaaatccatttgatcaaatagactaatttaaagctgatgacatcaattattgttttcacacagagctaacgctgacgatgagaacgcgtccattgaatcttttcagtttctcgacgtcctttctcttaggaaaaatccggcaagcagttacgggttgacccctacagttattagtacaaaatgagactaaagatcattttctacatggagcttattctaaatttccaatctaggcgacaatagaccaacatcagttacccttaggcaggaagatagagctagtactccctccgtttctaaatatttgacgccgttaacttttttaaatatgtttgatcattcgttttatttaaaaaaattaagttattattaattcttttcctatcatttgattcattgttaaacatatttatatgtatacatatagttttacatatttcacagaagtttttgaataaaacgaacggtcaaatatttagaaacggatggagtagctttttatcctcctgaaaagcttacaaagacattgcagccaacaatccaacataagctgaagtttcaccaaacagggttctacttttcctttggaacggaggaattttgttggagaaattttgaagaaaacgaattacttgaaaaatccaataaaattccatgtgtgaaatgtattcattggcatagtgataggtgcatgtgtgcgattttaaccccaagatccccgtgttcagctcttaacacgctcacactgtattcttaattattcgacaccaaaattctccttggttaccaaacgttctcagttgctgtgatataaaatccacatgtgtttgcccttaattgattctccagtagcgtgtttggaactgggaaataacaacatgtgttcccttggttagatggatatcactgtcttggccagattctgacgtcttgttcttggttagttaggaccatccactgatccgtggtgacaaattgacaaactgaccacttctcacgtcaagaaacccccttccttttacttctacgtgtcgctgcaggcaagagatttcagagtaagcagcagcacgcgcgtcagagaaggagaagaggacaggtcaaaggaaagggagcagttgggaacagatgcatgcagaaaaacctgagctatctcttgatttcctgcaccctcaggtaagcaaaagcaaagcgaagcaaaggagttttgaactctttttttttttttgcctacctccatctggaagcaaagtaagacctgttccgttaatcaacatcatgcatgcccacaaaatataatcttttcatgttcatactcaccatacacatacacaacattgtctttctttggccttaaaaaaaattaacatatgccaattgatggtggctatactgttatagtagtgttttttttttttttggataatggaattcaatccggtctctgcatcgaagatgtacacggccacataatagagcaataactctggatagttggtgtttcagagatttccatggaatagtattcttcatgcttcacctaaaacattggatggctcactttggttgcaggtaaccttcaaactattaggcctactggttgaatcgtagtcaaatcaagattcctcctctcttttcttttcttttcttttttctgtcctggtttttgtgtgctgtgctgtgttgtgtctgccttttcaccacattcacttactcgcttatgtagtaaccttctttgtaagcttcattttagcagtttacctaaagcaatttcagattcagtcatcccttgggtgcaaaggcactgcacattttttttgcttcaggtccaaccaaactcttcccagttgatcagttgggtttggtgaacgtcagagcttctcctgcttgtgtatatggtagccaatctacattggaagtacaggaaaagaacctctgtttcttttagttttcttttctgttcatgtctactcttccattcacctgtaccaagaaaatgtcccttgttgatcatacattactgaattatcatccagaatgattgagtagaagtagtatgtagtacagttctgcttgttcttcagttgtgtacatctctgtcagagttgcacaccaactctgtctttgcatataacataagtaaggtcacacctgaagcaaaaggaatgttaagagagtgagtgagatgaaatgaaaacacgcatgcgaccaaaggaagacaaatggaaacaactgaacaacccttattcagacaggactgtgtcttaggtttgtagtaggatttttgggactgattgctccctacatatgcactcacctttttgcaggccaaggattaatatcctgtgaattaaattaatgtgattggttgcgtgcatcttagttatgtagaggttgagaaacgctcaggggtcttccggctagctccacaaggtggtgggctagccggcctaggttcgaagccttacccccttctatttatttgatactagatccttccctaatacctgtgttttcttttttagttatgtagaggttaagagtgttcttagtacggttgtatcaccttgatgtaaattggctaagttcaataaagcttccttatcttaaaaaacaataaattaatgtgatctgttccaaaaactagtgacaaggaccaggtctccaacagttcctgcaggaacttgtcaaacaaggggttgttcttctggtcacagctctcctgccaaatctataagttgctctctctctttgcctaggtttggagctctcatcatcttttgctgtcaagccatgcattccattgcctcctgagaacctccttgataaacatctcatctttctttgtacataaaccctctctgcaagtgtgttgtctcccttgcttcttgctgttcagctgttctatctctcaaaaacagttcaaattttcgactcgatatcgagctaccagagttgatataggaggaagataggaagatttatcaatcttcagagtttacggaaagtggaggtttatcagcaaagttcttcagagagctgggccacctgaagaagggtgattacatactaggattcaatttggagtagtgttttttttttgcataaaaggatgagaggttttgcttgtgctcatcatgcagagaagaggcaccgtcttgacagaactctgtgagtcttttcttccctccagtagttatagcaaacttgcttcctctgcatatttttgctaaatatttagcaaacccagctaaaatctagataaacctggctaaaatttacatatttagaatctcaggttcccagtgaaaactcaatgttatcttcacccgagcatcatgcataacggcgccaatgattccttgagcaccgaacattttgaattccatccatgcatctatccagtatttaatcttgtccatgtaaacttgttttacatcgttgcatattcatcatcgacaatgatacgcttggtgataaatactatgcatgatcttaagtttacctgctatcaagttttaatcctgtttaaatacggttcttagcgtgttttcgtggtcatgttcctgagcccatggaaaaggttacatgaccacgtatgttagcaatgcaaaatggtcgttttgaagtcaatatttgcgagtatttttataacatagagtagttattaactaccaacaaaattgcagttttttccaatcacagtacaaaagtacgtcatcctggtgactttagcagagaaaaattactccctgaagtagttttttttttccaccaatagaaaccagaagtgatgtgcccaacaaaccaatttgaattaatcctcctaatttcgtgtgctctgaaccaagagagcccaattctccaaagtttggcgagctctgctaatcaaaattcctacctttaggtgagctaacagtccaataaaagattaatttatagtaaatcacgtcgtaggaagttacatatatagctagcaacctgcagtttcaccaactccgtttgcaacttctgaagaagaaaaagtcacaatggcgtcacgagttctgaagaagtctctcttcaatctgcatgccaaattgccaatttggatggaagaaaagaaaactgtgttctgaaattaacagaatggtgaaaacaaataggttcatgtaagaatagagtcaaaggtagaaaaaaagaaaaataataaggaacaaagctattagggattaaagcgataatgaagagggaattggcacgatgatggagacgatgactagttgtagatgtaagcctggaccgttgaagcatggaactgactgttcttgatgacttcttacaagaggagatgaagaaagagagccattcctttaaaaaaaacaagaagaaagaaagaaagctatgacacatatgactttctggtcttggtctgaaagtaatagaggagatgttatgaaattggtcgtttgaagaaaagtagaaaatgaccaaatgcagaaatagtgattgctgatcacatattggtaaaagccaaagaaaacttaacacctaagttttttttaaaaaaaaccaacaccttagtaaagactgacaagtaattttagttacaggtaatgatttggtcacaaggggcaatcttgttcagttcaaccatatgatttgtgacctttgttagaacttttgaagccctcaactgcacatgctatcgttttctacatatggtctaaatagttatgcaatattctgaagaaaatcgcaaccggattatgaactaattgtgattatttacccgtgttaatttcagcaacagcctgagcaagaggggatacataggaagctaccactacgagaaggatgccaagtacaggccattcagtgcactgctccctgagggttcaaaccccaagatgctctatgtcaagctcgtcctcatcatcctcatgtgtggctccttcgtcagcctcctcaactcgccatctatccatcacaacgatgatcaccacacagagtaagaaaaaaaaaccatacaaaattcatgtttttattcgcaagatttttttaaaaagcaataagttgtaacaaatatttcttttgaaaagataaaggttacgatcattaccacaaagctaccaaattatgtaacataaaatgtagtaccgtttggtgtcttgtaccaggagataccatatttcacaataaaatgtagcacatctttgtatctcctcaaatattataaaattactctttgaaaaaatgattttaatgtcgttgaggaggtagtgaaatgtaccaattttttaagccaagggtcataaaatccgtcttgcagccccattgtttggctgataagaggaaataacgaaacaacacatttgcaaacgaaaaataatttgtgaataaaatttttatatgcgtgttcttaataatctaaaaacaaaggttgaaaaataaactacgatgggaaaaaaatcccaaaatcaactctaaatttaagcataaacgaaaagatgaggccgttgatacgatggtcagtgattaatcctttgcttcgtctgaacttgaaacgcgcaggtcatcagctggagtgccgagagtgagctacgagccggatgataccaggtacgtgtcggacgtgacggtggactggccaaagatctccaaggcgatgcagctggtcgccggagcggaacacggcggcggcgcgagggtggcgctgctcaacttcgacgacggcgaggtgcagcaatggaggacggcgctgccacagacggccgccgcggtggcgcgcctcgagcgcgccgggagcaacgtgacgtgggagcacctgtacccggagtggatcgacgaggaggagttgtaccacgcgccgacgtgccccgacctgccggagccggcggtggacgccgacggcgacggcgaggaggtggccgtgttcgacgtcgtcgcggtgaagctgccgtgccggcgcgggggtggctggtccaaggacgtggcccggctgcacctgcagctcgccgcggcgcgcctcgccggcacgcgcgggcgcgggggcgccgccgcgcacgtgctcgtggtgagcgcgagccggtgcttcccgatcccgaacctgttccggtgcagggacgaggtggcgccgcgcgacggcgacgtgtggctgtaccggccggacgccgacgcgctccggcgggatctcgccctccccgtcggctcctgcaggctcgccatgccgttcagcgcgctggcggcgccgcacgtcgcggcggcgtcggcgccgccgccgcggcgggaggcgtacgcgacgatcctccactcggaggagctgtacgcgtgcggcgcgctagtggcggcgcagagcatccggatggcctccgcctccggggcgccgtcggagccggagcgcgacatggtggcgctcgtggacgagacgatcagcgcgcgccaccgcggcgcgctggaggcggccgggtggaaggtgcgcgcgatccggcgcgtacgcaacccgcgcgcggcggcggacgcgtacaacgagtggaactacagcaagttctggctgtggtcgctgacggagtacgaccgcgtcgtcttcctcgacgccgacctgctggtgcagcgccccatgtcgccgctcttcggcatgcccgaggtgagcgcgacggcgaaccacggcacgcttgtcaactccggcgtgatggtggtggagccgtgcggctgcacgctccgcctgctcatggaccacatcgccgacatcgactcctacaacggcggcgaccaggggtacctcaacgaggtcttctcgtggtggcaccgcctcccgtcgcacgccaacttcatgaagcacttctgggagggggactccggcgagcggctcgccgccgccaggcgcgccgtgctcgccgcggagcccgccgtggccctcgccgtccacttcgtcgggatgaagccgtggttctgcttccgcgactacgactgcaactggaactcgccgcagctcaggcagttcgccagcgacgaggcgcacgcgcggtggtggcgcgcgcacgacgccatgccggcggcgctccaggggttctgcctgctcgacgagcgccagaaggcgctgctccggtgggacgccgccgaggcgagggcggccaacttctccgacggccactggagggtccccatcgccgaccctcgccggaacatctgcgccaccgccgccggcgacggcaaggcggcggcggcgtgcgtcgagagggagatcgagaacaggcgggtggaagggaatagggtgaccacgtcgtacgccaagctcatcgacaacttctgacgtgggtgcatccggagccgttggattttgagatcggacggtgagatcgaggccgttagggatgggtgacgtgttcaccaatttttggtctctcgtgcattgcattgctatgcaatgcaagcgtgccaccggggatgttgcgtggtagcgtatggccgaaatttctttattacaatgatgagaaaagtagctgtgaataatttaggtatttgctttcgtaaaatacttagaatttttttgaagagtctatgttttccaaccgtaacattgcaaatatgtcatgtttgctatgttaatcctttaaatatgatgatactagtgcataacaacaaaattcattttaaaaatggattgtcataaatcattgacacatggagccttaggttagtttcttcgtttctcatgctcactcggtcacttccttagttccttacatgtccaagcaaaaattcacgcttagcttgcccttttgtatataccactcacatccttacatgggctcttttttattgatcaaatatacattgtaatgtgtgtttttttagaaaaaaaagaacaccttacttacatgggccttcttttggttctagataaaagaaacaccttcctttccagaggagttatgtgcacatgatttcgtcgaaatgcaaatcttacactattacaaaataattttcgtggctcttggtattatttttcactgacagaccaaaaggaataatatctatgaaaacgtttgaggccgtcttggggtaacaaaccacgaaaacctattttccgggtgggtccttaaggaaaatcgcatgtgaaaatatatctaatttcgtatgcggttttcctaaagagccatatgtgcaaatcatgaatttatgaggtggtttgttaagaaaatgaccacatgtaaaaatggggtaatttttaccggcgattctcttagaaaaaatacatgtaaaaaatacaatttcatgggcgattctcttaatgaaccacccttagaaatatgagcactactatttcaaaaaaaataaaacgcacccttccatataaaatcagatgacaacgaactctatatgaaacttagagcatcctcattgtctaaacccctccaacggtactaaccaagtctacatagaaataaaggctgagagatactctccccgtccaaaaaaatataagggattttggatgaatgagataattttaacccttatattttagacagatggagtttacgtgcagtgtgtaaagagtacttcaacactatagtgggaccacaaccatgtagaatttatgtttctctctcccgtattggctcttggccaactgttgctgccatttttgtaaaatgtgatatttattttatttggagtgttcgctcccatgggaagagtcgatttgctatatgcttggaagagacatgttgcctgcaatgtgtagtgccgcgaaaatattcctttaggccatgttcggttatacaaggatttaatccggaccgggaatgataagtatagtaagaaatttatgatagatacaacgagagaccgggattcattctgggccgggaaccaatttactcatgatagggacaataagagactggaaatcaatccactagtcaagaggtgtggaactaatctggatgttttgttgtacctaatatgagtaaactggttcccgacccgaaataaatcccggtctgttcgattcgagttgcattcaagggacag

SEQ ID NO: 34320 - DNA, 4807 bp, Oryza sativa
  unsure (1)..(4807): unsure at all n locations
atgttaatgaattgcaattctnatnnnnnnnnnnnnnnnnnnnnnnnnnnnnnnnnnnnnnnnnnnnnnnnnnnnnnnnnnatgttttagatccatgttgttcacctattatttatatcggatctttgcacttgagcttgcatacgagtatatgacacttgtgatgttaatgaattctcaacaaacatatccatatcttttatatgcaaccggttggtcatcaagtgaaggatgataatcgatttgttgagactaatgttctccttttagatgtgaaaaggaataggtcccactacgatgaggctaatgaatgacaccatggattaatggtaaccaagccaatgacatcgtcatgttggcaagaatgaagtcaagcttgtgatgagaataaagtcttgacaaaggatggtaaagacctcggcataaacatggttcaatcggatggtcacaagtgttgatcttggctcaagcattgaccccaagttggatggcgcaaggcaaaggtataatagagctaagaatattttcttagtcttttcccggtcttggtgtttggtgtagaccggatttgctagatagacgccgtactatcaagaagagtctatgaagcgagcatgtggatgatcttgcgccatattagttcatatgcatgtaggtgtatttggtgggcttgtctagccaagtgtgttgagttttctcaagtcctaaacaaagagagaagtaggcaaatcctataggtttgggtagcctcatgtggttatgtccggtggagtatcctttggggtgtgagccctttctccctgagaaaagttgtgtttcttggatggatttttcatgggttggatggccctttgaataagctttccatagagtccaagaacgtcaaattctgagatccgagtcaagagatatcgccgttttactaacggttggttgtgctgaaaagtgacctgcagtctgaccgtaggccttaggacggtctgaccggatctattagccggtctgaccggcgtggtaaggccggtctgaccggccccactggtctgttgcactggtatgatttttggtggcgatacagagccgccagagccgcaaccggtcagaccgagccgacggcggtctgaccgagccatggacggtctgaccggctactacactgcggtcagaccggctaggttgagtgggctcaatgattgccctgtaacggctagttttctagtcgttacaaagtagtccggtttgaccggccactctattgcggtctgactggtagagcacatagttggggatttcgactccaacggctagttttgatggttgggggtatatatacccactccccagcagcaagggtaaggttttggcactccattgcattatcttgaacccttgcaagagctctcacactcttgtgcacttagtttatttagtgaggtgttggagagtgagttaagccaatccaagtgcattgcttcattgttagagctagcgtggcacttgatcatcctcggcaagcatcctagacttgttactcttggaggttgccgcctcctaaacggcttgtggaggtgttgcccggtgacctctccgaggagattgtggaggaggcctgacgctgattgtgagtggtttggagttcaccaccttcggagtgaaggaaaaactaccctagtgatcgaggcttgggtagtcctttccgtgggccggctcccaccttgcccaccccttgacgaagggggcgtgcggtggcttcatgattgagcggtggagttgtgctcgcctcaacagggattaggaaaccggcgagtttccgaacctcggtgaaaaatcccttgtctcttgtctcatttatttgttgcatttacatttgagcaagtttacatactagcttatttgtgcacttaacatttgagcaagtctattatcaccctaggcttgcaaaccttaacataggctagcttctttatgcacttacttgagactagttgatttaggttttgaattgtgtaaaaccgttttgatttatgcttccgcatacaaatttcggttttagccaaaagttttaaaaccgcgtattcaccccctctagtcggcctccttgatcctataacaggaagatgcccttcaattataacaggaagatgtccagattcataagtattaagatgtgtcatatccagcgtttacaactccgagatgcccttccgtttcgggctctggcagaataacggttttcgcgaaatccggtagatcccgaacaaattttataaaccaaaatttaaatacaaattctctgagtttaccaataagctcgcgaaaactagtcggctttggagaaattccaagcgaaaacattgaaatttcaaccggtaactaggaaaagaggtaaattgaaagtgttttcttttttttcattcgctattattttctttcctactataaagttcagttagtacacggaatacatcaactttttcaaaatttatatcctaatatgtactatgaatatcatactatttgtaagattttatttgattttcttccttattatcaatttaaatttgaatttagatgaaactaatcaaaatctcagatggtttctactttcgaggctcgtcgaaaccttaaaatttaacggaattcgatcgattttcgttggaattgttaatcctagtcatatccacctaaaaatccattatattttgggatgggaagctggacgaaacgcgaccctagcacgaatctgaacgggaagctgacgacggagatcgcgcatgcgggtgccacacggcccttgccctgggctgcctagtccagataaaaaatacggcacgatacgtacacgtataccgtatatacgaacctacttatacggtacacgcgtcaattaataggagacgaggagagataaacccccccgtattcgcaggctcatcgacttctcgtcttcctctcctctctctcgtttcgattcccccgcgagagattcgatccaaccaaacccacccgctaccagcgtcttctccttcgcgagcaagtaattctctttcctcctcctcctcttcctctctgccgtatttttttttgttttttagtttttttttcttcttcgcttccttcgccgccgtcgcgggttcgtctaaaagtccgcaagattcgtcgtcgtcctatcgccggtgggtagggatttcgtcggcgctgctccggtctgctgctttcgttcgttcgttcgatccgatcgatttatttgttcctggtttgggtctcgttcgattgactctagtaaagtctattctttttttcttggtttcctggtttaggttatatggagagcagtatttaggcgtttaggcttcagagatttgtttgatattaggctgatgtcgtgattcatgaatcatgagtagtttcctgcgtttaggggtagcatcactatgcggtactgctgattggttttcctgcgtttgtaggatgagattggcccccttgcagtctgtaggataattgcatgctaatgatatttccacccctaaaatcttcacttcattccaattcaactaccaagtttttttaattgttctcatgaattgcatgctcatggcttgaagacgtcgagtctttcctccttgtttttctttaattgcgactccacctaatctaaaagattcaatcttcaatgcttgctttacttgatggtttgaaattttactgtgctttgtggcgcaaagcggttgactttttagaggtttgttttacctattgcctattcaatctactgtgaaaaaaaaatctagctttatatccatgttgtgattttcttggggtttgagttgttcaatatagggagaggtgcttaatttggtttttttaaaaaaaagtttattgtgtttcctagacaatttagtgcaaggttacagactggtagcttgtaccctagccttggtaggagttacggtttaatcctctaaataatttctcatcgatgtacttgtggactgtctatgattggatgtatcaaggttttaccttttgtgtattatgcaatatgctggtctggttttcttgagcttgtgagttgtgattgtggcttacaacgagtcccttcacatatgtaagatctgtgatggaatgttttagccgcactagcggatagaagaacgggaataaaaataacaaacaagttgggacattatgcatcttatattatatgtttgagtcttttgtgtggagcattcactcaccatagtaagtattctaaacaattaaattcaacctatattaaagaaagaaaatattttagtaaattagtaaatatttattatttataaagcttttcacatgtatgcattaatcttctaaacaggttttttgagagtttgcaatgggaggaagcgaatacgatgatgactgggagttgcctagcgctgacatcactgtagttctttgcggcaaacttggctgtggcaagagcgcaactggcaatagcatcgttggaagagaagcatttgtatcagagtactcccatgctagtgtgaccagtacttgtcaattggccagcaccgcgctaaaggatggccgtaccctcaatgttattgatacgccaggtaagcatgcatcaatttattctgttctgaccttttgttttctgtgatgactattcattgttgttactacatattcatacttgttaatcttgtggatgttttgaatttgcgttatctatnnnnnnnnnnnnnnnnnnnnnnnnnnnnnnnnnnnnnnnnnnnnnnnnnnnnnnnttctngattgacaatcaaaaagcacagcg

SEQ ID NO: 34321 - DNA, 1903 bp, Oryza sativa
  unsure (1)..(1903): unsure at all n locations
atggccttgattgatgatcgcccnnnnnnnnnnnnnnnnnnnnnnnnnnnnnnnnnnnnnnnnnnnnnnnnnnnnnnnnnnnnnnnnnntgatgagtcgcacaagctcaggctgctctttctctcacgcatttgcccccaaaatgtgcaacgcaaagcattcctgaccactcagctcacgaaaatggacccccgtgctccagaatccagcattcggaaatcctcgcatcgctcaaaatccccccattctctcaccccccccccccaccacaagaaatcccctcacccaagccgccttcagaatccagacaacaatcccctcgccgccgcccaccacggcgaaacctcccgcgcccgtcctggcatcgctcgagggtggcgtgaacccgaccacctcaccccgcgtcgcaaccaaccacgaacccccccaaccacagctcgtacgaggaaaccaaaacaacaggaagaactagggctcccggatctcaccgacgacaggtcaggcagggcgggggcacacgccgacacggcacggcacggcacgggaacgagcgggggggtcgccggggagcccgcgaggcggccgctgcggcggcggaggcgaacggatcggcgcgggtggcgcgaggcgttggggaaatgggcgttcgatttgtttggcgctctcgctttcgagttggtttttgaggaaggggaggcgaggagaagattggagagagagcgcgaaataagaaaaaaaaaatggagggaaatttttacggcggtgcgtcgatttgttctcttttcgcgcctttgttttgatggaaattcatgtttggtttgaactttcaaaggttcgatggatcaaaccatacccttttttaaaaaaaaaattaccatgggagtagtactattttgtttgccgtcaaacatttttggctttaccagcagtgatgttgacggtcacatgatattcgaatattcgaccggtgcaaattgtaaataatatattttgtaggtaatgaaaattcgaaatcttttcaaaaaccaaaaaaagggaaagggaaaaacacaaaaaagaagaattgattttttttttgcgtagcacgaactcctacttttgtgctttccttggtgtgccggtctctccacgtggcaagaaacgtgacacgtggggcactcacctgtacgttcgtggtcgtgcgacacccacgtcgcggcctcgcgggtgacctggtccagtcagtcagtcaccggcttgtatgcaaatgcaatgctttttctttatctcagaaaaaatgcaatgcaaatatgcgattaggtttcaattttcagaagtctcgggttccattttaaaatggcaacccatatattttgattggtataaaatactagtcattttattattaccgtgacaatttgtcatcttaaactattttgcacacccctagagcaaccacaatgtataaaaaatgtgaccttaagacgatgtttgcacttgtaaagtgggccatatacattgtggaaaatagcattagtttagggtgtacctcatgcttaagatctaccataagcaaaaagaaatatttttttctctctaattcactttatgaataagagatgaaacaattctttttccattgtatgtggacttatcttatggctaaattctaagagcaaccgcaatgtatactaccaaagtggataataacgtgggcccggggttcaggtggtaacagttattccaaagctcacaatgtgctatgcttattttgaaaattaagccccgggtccaccttaaaaataatcattgtaaaaccatctcctatagccatgctcgtgggaaaagattctcatatctacagaaaatattattctttattgtcttgtgngggtnccaagcgangtgtcattcaatgcacatg

SEQ ID NO: 34322 - DNA, 758 bp, Oryza sativa
  unsure (1)..(758): unsure at all n locations
tgtgcctttgaatgctctnnnnnnnnnnnnnnnnnnnnnnnnnnnnnnnnnnnnnnnnnnnnnnnnnnnnnnnnnnnnnnnnnnnnnnatcatggatgttatgattggagattggatggttggcttgtgacggcgcatgtacactgtagtcgtatctctctggtagcaccacgtacaattaattagttaattaattgcatagagttttttttttgttcatttttgtttgcttgttttgggaagcctttgattgatgtagcagtagcagtagtatagtactgtagttaccgagccacacgctgctgataggaggaaggggggcgcgtggcctatctggaccgtcggatggagatcggacggaagggagtgctccacgtggcatcgagattccaatcggggaggcgccgacgcccgccgcacctgcggaaagcggattccctttttgggaaagcgtaaagcgcgcgtggctggctgcctggcctcctctcgcgcagcggattgggcccgcctgtcggtgacaggtgccccaccgggccacgtggctggctgaccaccagtggtagttgactactccgcaattaactactcctacctggataaaagcaattatgtgccaatcagaaatcagaaatgtgaattcctcttaccagttgacttgagaccatgtggattaccaaggcaaagatgatttggtctatcaccctgctgattaatctaccctccgttcaaaaaaaaaatcaaaccctatatttaaattn

SEQ ID NO: 34323 - DNA, 754 bp, Oryza sativa
  unsure (1)..(754): unsure at all n locations
gcgtaatgattctcnannnnnnnnnnnnnnnnnnnnnnnnnnnnnnnnnnnnnnnnnnnnnnnnnnnnnnnnnnnnnnnnnatatgtgtgcaagaagaggatagacccaaggctcgtggtgattccgccaactatgtgaagcacaacaagaagaggaacaactacaaccagaatgctgcctctcctaaggcaccacaaagtgatccacatcacgaccaagcaatgtagaagtggacaaggacacttgcaagtggtgcaagaagaaggggcactatcagaaagattgccctgatttcctaaagcatctcataaagaagggtgaggacattattacatttgaagatgaatccctgtacataagttatttaaaatccacttggtgggttgattcaggtgcgatcattcatgttgcaaattcattacagagattccatacgaggaggatgctaacaagaggagaaagatgcattagagtggcaaatggagttgaggctgaagttgaagcaattggagaacatccattagaattgaataatagcttcacacttcatttacacaatgttctctatgtaccctttttgagtagaaatttggtgctgccatgctccacatcattgcgagtggcgtggccaaatctttgcaacgccatgatctcttccaacatgacagaattgccctgtagcaccagctataacggaattgcaaatagccaaatacattcagatttgaaaatggangtgtagaggttcatctt

SEQ ID NO: 34324 - DNA, 3795 bp, Oryza sativa
  unsure (1)..(3795): unsure at all n locations
ctgtgatgagtgaacaactctnnnnnnnnnnnnnnnnnnnnnnnnnnnnnnnnnnnnnnnnnnnnnnnnnnnnnnnnnnnnnnttgagagttattcatgatttatatttccaaggtttgacttaaacattgtcctaaacgacttcctttacgagtatggagagagtattcagttagatgactactaaatgctttctgtggtctcagtgaggttttaatgatgcttctacacaaccaaacaagcaaaaccccgggaagaacgaaaatataactgcatacatgtttagccatgccaaagtccgcaagtttgacttcaccattagggcccacaagtatgtttgctcctttaatgtctctgtccacaaaaataaaatttacaaagtgatcattgtattcagtgcctaccatgaaaatcactaacagtgtaggataatttacattacctgtgtacagtattcctaccatgcaagtaggcaagccctgaaagaatctgccgagtataattacgaatcacaggttccttaaatggaccgtactctctaagtaatttatgaattgaacctccagaaacatattccagatagatggacagagcttcatcagcctgctcaaaattgtttaaattaggcaagccaaagcttaatgagaactttcagaaaataagtgaacaatcacacaaaattagtaaaactgatggtgtctcctttcttggtggaaactggaaccagggcgtataccctctgattttagaaaagaggaaaaggacaaagcatgcacgattaagcattagaaccaaaattgatgcataaatttatgctctgtgcaccagagagtgagtctatgcatcatcagattagttcccaccaaaaaaaatgttataattttccctcacagatccatcttgtaatgagcaacgcacaatacaaatatgctaagatgagaaagaataaaattatgtggctgcatgacatgcttattgaacaattagtcaataatcatattgaacctaccagttcacttccataatattgcacgatattttggtgcgagagctgcttaagcatatctatttcctgtcattacaagatggacaagttaataaaccaaaacaggatgtagtcagagacaggttggaaaagtgtttgtgttacaataaaaataaattgttcaaaatgacacacagcctatcaattgtatagggcaatcaaatgacctgattcaattgcctaaggcgttcctttgaatgtgaatcgtccaaaaaaacctgcacctccttgattgcacaaaactgcccattttcactgtacaacgccaattaagatcaatcacaagatggcaacaataagagtcaagagtgaaatagattcatagaaatagttctaagattttctttcatgctctcatgtgatgccaaaaaagtgtgttgtgtagcaacttttgtttaaggaaattaaatagaaccatgtatacatgtgataattatgacttcacataccccctctcctcctttttctatgttctagcctaccgaattgaacatgtgggtccacataaatatcaaacttttgtgcatgtacgtaatcaaattacacatagcaacattttgggtatacagccttagacagaaaaacaaaggatttagctgcgatctagccatagaactaaaattctatataaacttcaaagatgaacctgcatggatgcaaagtacatgaaaaaatgagtcacattcatagtaacttctttgggtgaacttcgaaaccatattattcttttaatgttctataagataaacctccatacctgttgaaaccaagataaacctgaccaaatgtgccgctacctaatagcttcccccttttccactgtgattggaattgactagaagtaatggaagatgaaggaatggatgagctagcaacaggaactggagggagaggcaagggttgagatggactcctaggatcatccatccttttcactggtgaccttggggtaaacccaaaatctcttgcgcagcaagcagaataagcatgccctctcggaccaggggaatgacttcttggtcttacagcaaatgtatcctcaggcaacattctgccccgagaataactagattcacttgttgaaggttcaaagatttgcatgtgatgaacttcgttcacatttgcaataggaacctcaaagaatttttgatgctcctggagaataccacatgatacaaaacgcttctcttctaccatgccattatgaccatcaggtagcacagtccttccgctagtgtggacaactggatctgtatacctacagattccaacaacaaacaggaaatatcagaggacttccaggactgtaggaacagattgtcgaaaaacaaaataggtcatctttcaatagaaaacaaaatagagccaaacagggacactatcagaaagggcaaaggcatgaaacacgcactataactacaggcagaaagaaaagaaccatcaatgtgttgaaatttagcttgacgccataaaaagatgcattcttttatgctctggcatcattcttgaaggaacagataatgctactcctagcatagaaacacctcggcgtcatttccatagaatgatcgtgaggaaaacagtagatattctatttatctataagtagccaccgtatttgttctacgccaagaaattcccacgctaatcaaagatgagaaagatttgcgtctccaagtggaacaaagcattcatttccatagaatgattgttaggaatacattagacattctatctatctataagtagccgccatgtttgttctatgcctaaaaaatttccacgttaacgaaagatgagaaagatttgcgctgttttagattacaacggtgcagatttattgataaaggtttacataagacaaacttgttcttatcaaagcaggaatagttgtatatcaaatccaattctatctgggcaaaattgcgcgggaattccacgcaaacaaattacgcgggaaattctgttagttaacaatatcataaatatcctagcataaaatatcttaaatacaattgaatgaataaaaaagaaggatgggttgaacttttgacgcgctttggtagcctgactccccaagtccaccgaattatactagtaataaacaaaggaatacggttttgtacgctataggcggtgagagaagagacgaggtcaacggccgtatggcagttgttgcgaagcctcagtctccacacagtttggtcttttagaagtcaactcaagacccctaaatcacactatcactcggcacacttcgtgattactactaacgaactggaaaaagggtaatcgcgtcgaattcgttgcgatcacggtttggagttgtagcagctacgcccataattggagtacccgaccaaaccgaaacaaaaacaaaaacaaaaatgaaaaaaaaatagcaggtcggtagctgtaaaacggagcagccagtacgaagcaaatcacctgtaattccggtgatccgcctcgtcgtccgacgagctcccgcccgagaccgactcggccgccgacgcgcacgccggcggcgacagcgacggcggcgccgcggcgggggacgccaggggcatcggcgccgacttggacaccggccgcgggagcggcagcccgtggtgctggtcctgtggccccgggcatcgcgggggcacggggctggcgccggcgccccaccgcgtctgcgtcggcgtggtggaggatggaaacccgcaagcggacgggtacgcggacgttccccccaggtcgacggagtc

SEQ ID NO: 34325 - DNA, 5443 bp, Oryza sativa
  unsure (1)..(5443): unsure at all n locations
cgcgcccttggagtgccntattgaatgccacntagcannnnnnnnnnnnnnnnnnnnnnnnnnnnnnnnnnnnnnnnnnnnnnnnnnnnnnnnnnnnttcctccctattaccgaacgagcctttcccccctcctccgccgccggagcagcagcagcagccgccgccgccgcagccgcacgagacgaggcgcggcgaggcgaagcgcgcgtgaggtggagctggaggagaaggccgctttctttttttttacttccttttttttctttttttttttgttttggttctctcctgctgcttgcgctgccgctaggagaagtactactagtaataaaagcgcgggggtgcgggacagctagctgccttgcctacgtgctgcgtgcgtcgcaacccgcggccaggtgcggcgcgggccccgcggatcggggggtggggcccacgcgacagcgagcggggacgatctcgggtggggcccacgtgacagtgacacgggttgggcgtggcctggacggtgggtatgtgtgtgtgttgggggccgtacggattggcgggttgtggggcccagggggggaatgtgtgtgcgggagagggagagagagaggaatcttcgcgaggcgagccgtgtgcgaggggacgcttggagtttggtggtggagtgggggcccacaaaacagcctaccggtgacgtcgaggggggtgatgacgtactccgtagtggagtactccgatctgttcgtcaaggaaaaggagatgttttggactgatacgagtgctacaaatgttttgcagttttcttttttttctttttaatactatatttaatttcacacaagtacatgcattcctcgtgattatgggcctgttcacttttgatgtcatttttaacattaccaagtttttggtaaagttgtaaaaaaagtggctatatttagtttgctgccaaattttgataactatatcaaatttttggcattggtaaggtttttttttttttcatcaaagtgaacaggccctatgccttccaacgcaagcttactcgtattccctctgtcaaaaaaaatcaacctaaaaagggatgggagacctctcaggacaatgaatctgaacaaaaggtagttcagattcgttgtcctagaaggggtaggttgagctttttgggatggagggaatatgcaagtatttggaccaaagcataaataatactagtatataggtggtgttcttttctcttgaagatgaagattgatttttttacgcaaaacgaggtggtattaacgtttaattgattgagttttaattattacaaacttaaaaaatagattaatatgatattttagagcaactttcatatagaaagtttccgcacgcaacgtaccatttagcagtttgaaaaacgtgccacgaaaatcttaattttcatccaaccttgttggagaaaagaacgggaccatagttagaaattgctatattttaaattagaggtattaagcatcacttgaaagttaaaatggacaccaaggttgtaactctatacacgcacggtttttaagtcactaatttgtactagctttagctggattttcgaaaactttgattagttcatatgaatggtttaaaatcatttttcttctatttaaacactaaatatttccgttgttttaatctgccgatgctttgattgtttttattactgcaccaccttctctacatttttaggggtctaggcaaactctacactacgtgcttaaatattttcttacttgtaaaaatatattttattaaccattaaccttgtaaagtgacaaataaattgtacgagtaaaagtcaatttgcaaaatggtcctaattattattccatcgcatcctcattgacacaaatttctacgtcgtcgtcctatgtggtgtgctagaacaccgcatacagatctagtccataagtacgtactcctatagtatggccctgtttagtaccaaagttttttttcaaacttccaacttttcaatttccatcacatcaaatttttcatacacacataactttgctatcacatcataccaatttcaaccaaactttcaaacttcagtgtgaacttaacacagcctatactccacaaaagattgagcaaagaagagtctaccgtacaggatgtctgatgattagccggagtcatctgaaacgacgacagccgaagattcaacggagagtactacaagaaggatccttcgcagcgaattcagaaagaatggtgcgtagagaggaggtatatagaggttgacaatggactttgagcatgttcttggatgattaatataatagtactgtaatagattatagataatagcttatatagataagttatatattataaattttatggcttcatcacatttggtttttagtttatcagtcacagcgaaaatttgaattaaagcttaattttagagttgattagatattatagatgttaattactttttaaaaaaaattggttaaacttagagaacttttgtttttggagaagattgaaacacctgacaactaatatatgttgaatggaggaagtgtgtgtttcgattggtgcagagtgaatggagaaatttagagaacgtatgggttttcacttatttaataattttcattagatatatcgtaccttttatatgtactcttgctatatgcatttactccctccgtccaagaaacagtttgttcagttttataatgtgtcatattatatattaattaggttaatttattttgaaatggagagagtatgtttagttggatatgccatgcacaatggcgagttgtcgagcgagaatcgtagatgtaaacgctgacgatgctccagtatatagtcgcatgagagggcgacagtcgaagagctaaatagctggctattaagcctagcgtttgctgtcatagtcgatggctagctaccttttcgtttttaacaaacgcaacggtctgactgtgtctgtccgtgcaaggggttgagtcaaagattagggatgattagcttaggcctcaagcaattaattcggttcttaattaactaaggctgtgtttatatctaaaatttggatccaaacttcagtccttttccatcacatcaacctatcatacacacacaacttttcagtcatatcatctctaatttcaaccaaaatctaaactttgcgctgaaataaacagcgcctggtactagtaacaggaacagaaaagacgaaagtactctacacgctacgtacttttgagttttgtctgcctgaaaatttcgtggcatttgagagaagcgcagtttggcggcgtcatcgctgatgtcacgtcaattatctgtactgatgacaactgtgttggttgctctagtcaatttactggtcttaattgcacgtttctttttaacatcattatatttcaggatgaaggtatgtttttctcttccttaactctgaatcgagcttgttgcagacaacgacatacactgatacatcctccgttttattaaagaaaaatccaactttgatataaatatagtctatatctatattcgtaatgagattttctttttaacaaacgaagtatacaatagaaggatagtagtatatgctatatatcagtactaccagtaagtttgatgctaacgtatggtggtagaatggagagtggaagactgaacgagtaaaccggctggaattaattacacacatgtttggaattctcacaaatgaaaaatctcttccctgcaatgaccacaaattttaacaatttaactctttaaaaaaaactatttttaaaaataaaccgttgctaaaacttactccctccatatatttttgatagtcatattttcaaatctgaaaaaattatttttgataggcatatttcaatccaacaacttatcctcttaatgactttctcggatttaatgtgtaactctatattcttccacacaagattggctgcatgggcatcgagaaatgtaaatattaataaatcgcttgtttatgaggaatgactagtaacatgtttaaatggatgataagtagaattaattatccttggtttgtatgaaaaatgaaatatgactatcaaaagtagatggagggagtatttcaaaaatgaccattttgttcagcgccaaatcgtgtagcgctgaacttagatacctcagcgccaaatagcgtggcgctgaatgtgcgttggtacgctgacttagccttccatccatccacggtggcacggcattcagcgtcagttgacgtgacgctgaagtgtctaagtttagcgccagatgatttggcgctgaacaaaagggtcaattttgaaataagttttggcgtcggtttatttgtaaaattagttttttcaaaaggtcaaattgtcaaaatttgtgtgcaatgacaatatgaagtcaacaagcagcgtccatgcatgatctgaacaagccgtacatgggctgattgggctgtagcagagggagggaacggcccgggcgtctggccttgacgaggcggttgccaattgtcaccgcattttggccttttactctgatagtagcatgcacgactctaaacatcttattattttatggtataatatactccatcggttcaaaaaagccaaatatagtactagatgtcccatccggattcgtagtactaggaaatgtcctatctggtcctaggttttaatatattgggatggagtgagtatgtctagattcgttgtattaggatatgtcacattcagtattaaattgaatttttacgtgacagagggagtatgtaggagtggtatttcttctcttgggcttcttatggcatgtaaaagcataggtccagattagttgtagatcccgtcgagggttataagggagacactaaggccttgttcggttacacaaggattcgttccaggccgggaatgataggtataacaagaaatttataatagatacaataagagaccgggatttatttcgggtcgggaaccagtttactcatattaggtacaacaaaacatccagattagttccacacctcttgactagtggattgatttccagtctcttattgtccctatcatgagtaaattggttcccggcccagaatgaatcccggtctctcgttgtatctatcataaatttcttactatacttatcattcccggtccggattaaatccttgtataaccgaacatggcctaaaggaatattttcgcggcactacacattgcaggcaacatgtctcttccaagcatatagcaaatcgactcttcccatgggagcgaacactccaaataaaataaatatcacattttacaaaaatggcagcaacagttggccaagagnnnnnnnnnnnnnnnnnnnnnnnnnnnnnnnnnnnnnnnnnnnnnnnnnnnnnnnnnnnnnnnnagactggnggtcgaatctacaatcacc

SEQ ID NO: 34326 - DNA, 10293 bp, Oryza sativa
  unsure (1)..(10293): unsure at all n locations
gtgttattgatggctnnnnnnnnnnnnnnnnnnnnnnnnnnnnnnnnnnnnnnnnnnnnnnnnnnnnnnnnnnnnnnnnnnnnnnnntgtcagtatcaggtttgtttttgaaagttcaattcagtttcatctcgttttggtcaaaatttcggattgattaaactatcggtctgttcgtgccgggcagcccgggcagccgacaggcccataaatttcgcgagcgtattaaatgcggtatagaatttttttaaaaaaaatcggattaattcaaatttttcggatttttcctgcgtattaaatgtggtcaagaaatatcttctttttatttttcttctgacctgaattggttgtgggcgaagccgacggtgtacgtggcggagagcgccatcagctcgggggcggcgggcgcggcggcggacgggtcggagaacacggcggcgatcgccggcggcctcgccctcgtcttcgtcgccggcgtgtcgtccatcctcatccaggtcggcaagaaccagccgccgccgcaggccaccgtctactccggcccgccgctcagctactacgtcgccaagttccagccgtccctcgccgcggtcgcgctccagcagcagcccgccgtcgacgcgcccgccacagaggacgcctcgtcgccggcgccggcgtcccccgccgccgccgccgcagaggaccagctctcctcctgaactgctgctgctgcagatagagaagaagaagagaagatcagaaatgtctgtgacttcagacatgatgcttgtatacgtatcatcacagttcacaaagattcaaatgtactgatgaaggatatgcacgtatacactacatggtagattgatgaaaccatttttaagtttcgtatatatacaagcatagatttgatcacacgtatgaacaccaccacacacgcacacattgttcaggatttcagatacaagcatagtacagtaccatctcttttatttattcacacaaagcagcagggcattgctcacgtaccaatctaccatctgccttgccactactaacaagtaaacaagacgagatcttcggttcttcacacgaacgcttagcggttcagattgctcaaacgacgccgttttcactagcttttccaccatgaatcacaccaagtgattgtaccaagggccgtggacctgctgtgaaatggacgcggccctgatgaggatttcggccgatctcaccacccggtcggtgagcttcgtcgcgccgatgcgcctcagggcggcgtcggcgagcttccgtcccctggcaccgctgccaccgagggtgatcgcgcggaacgcacagtagacggaccgggagaccttcttgaagacggggtcatcggtctggaggctcttgaggaagaccctggccagtatctgcttcctgctctcggttctttcatctgatggagagccggttgtcgagcctgatgacgacgacgacgacgaacggagcatcacctccatgatcttggcggtgctaacgtcggggaagttgtccagtagctctgcgagagtgttgaacagttgtgatgtcgcgctttccagctctgtgggagtgatgtttgggtcgtcggtcgccaaaacttgacgctgcacaagcatgctgcgaggaaaaaaaagaggcgtaattgggtttggttataccattctagctaactgctgatactcagagcagtgaagtgaataaagtgaaaaaattgagtaatgtttcaccttgttgcaattacaatcacttgctggaattgactctgtacagacctcagcctcaaccaattgagcttgaaggtctcagttactgactgcatttgcacaccctctatgccactgatgagctgtaacaacccaatccttattagctggtcaagcctttgccccgtgcactctggtagccccgtatcatctgcttatcatgacactaaatgattaaggagttcagaacaatggccatacaaggggaaaaaagaataaatacctgacacaggtattgtagactgtcgctgatctggaactccatgacctgatcggagggtggcaacaaatggctgagcctgttacgagggatgtgtaagtaaaatcaacagcaggtgaaaataatagatacttgaactactattgctacaaacagcggttgtgtactgctgtgactactgcataaaattaattcatagacttaacatgatcggtttctggcagagctgaaaaagagctgacatgctcattccattctacttccacggtatcttttgatgtggaaatccactgagcagttgaacggagagcaactgatgcattggacgggaatccatagcgatcagcaaaagccttctgcaggtattccactccacctgagccctttataattggttctaatagttggatacgtgctctactgacttctgtcttcagagcctgtttattttacaaaaaaaataaaaaaaatggaggctgttataggttcacaatgtatattccatgaagtttatttaagaactcaaggagttcacaaacctttagttcttccatggtgaagcgcaaacctttgataacagcaattacaaatgaatttgaaccactgttattacactcagagtgttcagttaattcacccaataatttgtcatggcttctcttcatttcgtcttcctttgcaggagaggatagttttcgcagcatacccagagagtactgcaaaatctgtcccaaatattgcatgtcctgggtgcccgattcaagtacctttcaaccaaaaaacaacaaaactggtatcagatatattctgtagattcatgataaaatcactcaagctcttcttacctgcaacaaaatttcaaggtcaatattgttgattatttcttctttccaacctttaggaaccatctcatacaatgtatccctgacttcctttaccagctgaaccagatagctgtagtctggcatgtctcctctaagtgaatccacaaccacatcccagaaagctttctccattgtttcccttactttttcctgagaaaaaaaagagtgactggatgcaaaaaagttcatatttaagctgatagacgtaccacattaatagaatctagaccctaaatcacagcatgtgagcccctctaaaagcttcccaaattctttctcatgttatacatttttggttattattgtctgcaccccagcaatatgaaaacttacaatataatcctagtataaatgtaacataggatctaaccttgaaaccaccctcaacagtcccaatattactagagctgtcagctagaaaaccatgaagaatctcattgaccatctgctcgttctctgttggccgtttttctgacagagtgctgctcactgtcattggattactcatggtgatgcctgctgtgttactttcagatggtgaagagggaactctgaacatagattggacagcctgacttggccttttatcattaatgttggaattctccttcatgtcagaaataggagattctccagaagaacatgtagctgctacattttttatagttgttgccaaggggctcctgtttccctttgcttcaaaaaactttgtccttgcttctgataaagcaacttccatccgctcaataccagcttcaccacccaagtgccgaaccttctcccttagaagtgtctggtctaccataacctgggtgatgaacagaaacaatttcaacagatagtaaagttttgactagacaaaagaaaactataatcaaaataaataaactaagtgcaaagttgtaggaatggactgcttcctgcaatagctgaatagcgggattttatgcacttaaaatacttctcaattactaatgtcagggaaataggtaaaagaaaaaaacaaaggaaaaggcaccaggtatataaccatacctctttctggatggcctttaaattatcattaaggttctctggttggccttcagcggtaaatttacatgtttgcatcattgatagctcaagtttgcatgcagctctgacaagatcttcctctagtgactttgcatcttttgctttccacaccacgaagtggtaaagataggcacaccaagctttgtcaaaagaagccaactgagatctgaatttcttccgatcagcaacaacggcagaagattcctgataattagaagatccaggagacagatcatctagtattggctgtttcagtatgcatgcaccacttgacccatcaagtattgtcttaatcagcagttcgaattccttcacaaagttttctgctgactccacaagtagtttctctcgctcacctcgttcattaaaaacaacacttgggtgacctagtatcatgtaagcacaaagaactatcctcggtgaatatctaggtaacttgctaacatctgaatttctagctgcctttgttggtgtcactctagttcttcccccactttttgatagagtcctctttggtgatcccagatgcttgagcagatgatcaatattttctggtgatgatggacttgatgactgagataaagtaaaacgactctccaagcgatcaagaaatgcccttgtggtctgaagaactgtgggagattcaatgcaaagagctagtttttcaaatggcataggcttaacagattcctcatttattcttagcatgtcaaaggccctagccaacaccactgttgtcttcctagatgttatgaatcttctccagcatctgaagcatcaaatcgaatagaataatcaataaaatttaaagtatacacacaagccaaacaattgcgagaaagttgactgtataagtctaccataccttgccagatttcttgaaagaaaatcaccgtgtttaactgaagcggtgtatgtaaagctgtgagtacttcctcgctgcttcaaatactcagctctctgccgctttgcctgttttgcataaatagtttgcaatgtaagtcaaagagctactaaaacaattataccaactctgcagcataaaaaggaataccctctgaagtttgtcttctagttgttcttttaacttgctcctgtcagcttctctctggcaagataaagtcctggcagcaagttggacctgtgaaaacctaccctgggctctccttttctcaccttccaatagccccgtccttctcttctcagctgcagtgcgcttctgcaggatcgctgaatgtacacgctccctgtacttgttttcccacgccactctctgcacaaggtactttgttgttctttcctccagtgcagccctcctctgcgaacgagcatgcatgagttgtgtacgtttctcctccgcttgccgaactctagattcaactttcatgccaagttcctccctctccttcttgaacctcaactccgcatcattcttagcagcctgacgcagctcgtccaacttagcaagccgactttgttccttagccaggaggcttaacctgcaatcagaaatcacttctcactgttccctatcttaatatccgatcagataaatatgctctgctaggtgactaggtccctctttctgttaccttttctgctcggcagccacaagctttgcttcaaggcgcttcttaggatcctcctcctgagatggacacgaagggtatctgactgtgcacctcgctttgcacgataacgcttcatgaaattgctggaggaatagaatacacatgagttaacaagccacagtgatcgtacttttttctgccagtccttcaaatgaacttggcaacaacaccaattttaattgttgtttgtagaacccattttacaggctgacagcaaaattggaagccttcaaatatcaatcatcctaaaatgaatctgggctcccattttgacatggttgagataaaccccaagttatattgtggctcccgggtttgatcaagaacagcgttaccttgataatcaactcccagcaaatcatgtgatggccaattgcttctaacacaaaccattcagtaatccagctacgtgactaaaatctgcactccggaatgctactcccaattcactaactaccaacctgatgaaacgtatattgacatgaattgcacagatgcccctaatccaccgaccaaaaccacaaccaaatcacccagaaacacgaaaaaaaaaaccataaaactaaatctcgaaagcgccgcgccgggtgcgccgagagatcacagcgacccacctgcctccggaggtccgcatcgcggagcttggcctcgatctcctccgcggtggccggcgctcccccgcggtgccggaggaggagccgcctcctgatccgcggcggcaccctggccaccacgggaggcgaaggcgacccctcctcctcctcaacctcctcttcggcctccgccgccgcaggtatctccagcgccaccgcctccggcacccccattccgccgctagccgccagcccaacccaccgccggcgatcgccgctcgtcggcggcggctcggctgctgcttctggagacggggagagtgggtgggaagtcgggcttcttcgcccgacgagacgagatgaatgtttcgaggcgcggatctggggagagagagagagaggaggcgtggggcccacgtgtcagtgagggagggggcgtgcgggggtaagggtgtttcggtgattttgagttttgggggtgggcaacgggtggatggatggaagtttggccgttggattccgcggctggggcggtgatcggacggccgttacggtccttccttggttctgaagtattgttgtcgattcctttttttttttcaaaaaaagaaaattgatgccatttcttcttttttaaaagtaaattattctcaattttttagcaacacagtacacatgcatacactcgcattgcgtactcatccacatgcacacacaagacatatatatactcacccatatgaatacggacacacatctagagatggcaacgggtgcatacccatcgggttcccttgccccatacccacacccacgtagggctgtcaaaaaagtttggagctcgcaagctgctcgagtttgattcgttacaggcttgattcgagctcggctcgaatactagacaagccaagctcaagcgtaggctgaggctcgcaagcctagcaagctcgagctcgaatagctcgacaaggcttgattagtataatatgcattgcatgtaggaagatatttttgatgggccaatatatacttgtcattgtgcttgacctgctcaagtctcaagaccccatcaatgcttatcaataaagtaattattcggctgctagtaatagtactactattcctattagatgtagtagctagcttttgttaattgcaacgtttcaaagccatgtattcatgagaaaagctgcagaggcttcattcaagacaaatagcacccattaattttgactaccgataatttacattaatatctcttatataagagtaagttctttggagtttcaccaagttaagctaccaagctcgagtaggctcgaagctcgctcgagcttaaactcgagctcattcccaagctcgatcagtatccaggctggcaggctcggcttgagctcggctcgagttcatgtcaagctcaagcctacatagtcaaactcgctcgagcttggctcgttcacagccctacacccatgatgttaaaatattcctacttaaatacccacacccgtcgcgggtacaaaatcgtccccatacccatacccatgcgggtaacgggtatctaacgggtacccatacccatataattgacttgtagcatttatagttttgtactctaattagccatattagagttctaaactatcaatattttctctagcaacaatgctattaatattagtgttcaaaggcgagtaaaaaaattatacaaccacaatacataatcaataaatctaataataatttcacataactagtatagaacaatgcttaagatgtgaaagaagttttatgctatgatttagtagtcgttgaaacttatattgctcatagttttaggttcaatcaacgggttttttttacccacgggttggtgggtacgggtgggtaaagaacagacccatacccacgtacccaatgggtaagagttttcgcccgttagtagacccatgggtataacagtaagaacacgattagctcctaatagagtaaaaacccgtcgggtctcgggttatgggtccccattgccatctctacacacatcctatccctatgagcacatccggaaaattggaccggccacaaatgtctcgctattgataggtatatcgcttacaactaaatgaataattagccataaatacgaaactcatgttaagtacttaagtttagggtttaaactcagacaggctggtttcaccacaagtttagggtttaaactcagacaggctggtttcaccacaagagacaaaaccaattgagctatgcatacttctttctatttttttttatgttttttaaatatatgtgtacctggaaaatgtgtagatttataggttatgttctggtttttataagggtcatgattcatatacctaaggcttttagacgatgcactaatactcacattaaaagttaaaaaggctagaatagttgttgtgcatcaagtagaaaacactgcactatggagctaccgtttagtactacatcaacaagaatttactggtttgatttgatggctaagtggtcgttgaaaaaacactgcattatggtttgatttgatggagtagtattttagaagtgaccaattctttgatgcgatgtgccaacaataattacaggtattttgcaccaaacagaactgtacgatgcttcacatattatttgtaaataaacttattagagcatttgtagcaactgaaaaaagtaggatattgatgttgaaaggtgtcaacccataatacatcagtatatggataaaatcacgcttgtccctatttgtatatccttataaaagtataatgttagacagaaatattttctaatattctagtctgatgcttcaatttcaaaataaaggggcatggttttatggattaagcgtttacaactaaggccatattctattcttcaactccagacttcaacttcatcgttttctgctagcacacttttcaaactgttaattggtgctttttaaaatagtttctatatagaagttgttttaaaaagtaaatacaaatattttttaaatttataatagttaatacttaattaattatgtgctaatgaggtttcttgttttgcgtgcaacaaaaattgcgtgctaaattgagggatagggctgatcaattgccctggtattgttttggtatgcttctaattcctgaattgtaaaatcatagaatttctaggttaaattataatttttaatgtctcacctcaacaactccaacttcaagaatttacagagttagaaaaacccatgattcaagcatccgtttctctacttcaagttgaaaactgcaacactcctccttgtaaaaagaggaaatctcattgtaaaagtgagaaaaccgttcattcgtgacgatgggtcaggggatacacttgcatttacaaccatattttctgccttaaaaacccccatagaaaatcttatttggcttttatataaaaataaatgcatattatatactccgacgcaactacgcaaagtgttgtgtaaggccccattcgaatcttctaaggatgaagattaaaagcgggcacacaaaatgagaaagccacgcgattaattaagttttaattattaaaaacttagaaaaataaatttatctgatatttcaaaacaatttttatgtagaaaattttcgtataagataaccatttattagtttgaaaacgaggaaagttttgtatgtttacgaagttattagaacaggccatgttgaaatttttttttccttttcactgaaccagtgaacctgcgtgaatttttttcattttttaatttttttcttttaatatttacagaaataatctattggcgaaaaaaattacaaaaatagaccataccgccctaatggagggcggcaagctgacgtggtagacggcggctcgacggcgccgtccgccgccgtctgtgaaaattgcatttagccctttgctgccctctgggctaaatgcaattttcgcagccctaaagagcatttggctggtactttttgcatctgggcccaggtggcaaggnnnnnnnnnnnnnnnnnnnnnnnnnnnnnnnnnnnnnnnnnnnnnnnnnnnnnnnnnnnnnnnnnnggaagtgcctccaaaaccacg

SEQ ID NO: 34327 - DNA, 10286 bp, Oryza sativa
  unsure (1)..(10286): unsure at all n locations
ncgtcaagaacgccggcaagaaggggcagacctccatcggcttcaccaccgagaatttcaagatgcgccgccagccggggttagcatcccctctgcccttgctgtcgcttggttccgctgttagttcgtctacgatgttgttggcaatcagaaatgtgtatatcctcgttttgagaaaatgccacagttttatggtagcaaccgagttttagctggttgagtttcctgcctaagaacctaagataatgtgtggggatcacaaattcatttaaaattactacgaggaaacctaagtacatgtagtgcactggttgaattggactatttgttgcataggctaggtttatcatgctaaagaggtaggatgccatttcagtttgtttcaatgcatcgaagtttctaatattggccctattgaggaagatttcctggctaacttgtggtaatgttggctgaagttatcttaatttctataaattagccggataccctgacatttccacgggtaaatttacttcagtctaccttagtttttattctgaatcgtagttttgtagggatttacattgaaacttgtatggaatcaaatcgccagtttgattttatgttttaattgagatttaggtttttatatattgtattacacgtggactctttatcttatatctgtcactccaaatttcagttgtttcaaaatggtgtttttctgtagactcttttcttttagtccatgcctttaaaacccaaacccacaatataatcaacagtgtaaatatttttctttgtctcaaataccctgacacttgcacaggtacatttgcttcaggcaactttagttttattccgagttgtagttatatagggatttgacatttaacattggaatttgtatggaatcaaactatcagtttgattttatgtttcaatggagattcagtttttctagattgtatttcatatggactctttatcttatatttttcaatccaaatttcagttgtttctaaatggtgttttggtgtaggctcattattttagaccatgcctttataaaccaaacccatatagaatcaatggtgcagatctttttctttgtctgggaccaacgtggcactttctaggtttttggcaaacatggagactccttttcacctaattttaataatttaatagacagacattcagagaaatagttagcaaatagtatggcccaccatttctttctttgagtggacttcaaattttaccactaaagtatattattttttttccttttgatgacatttttaaatttatcatgtttgttctatattcattccagctgggagtctaacagctgtggatatcatggcgatgatggctatctttaccgtggtcctgggaaaagtgagtcatttggtcccaaattcacttctggtgacacaattggtgctggcatcaactatttctcacaagaatttttcttcacgtaagttctgtcattctttctaaattggcatggcagcgtctgcttctccgattagctattctatattagccttttagtcgtcatattttagactttcttaaagttcatagctttcatcctttgtcttgtgagtttttttcttgacttgagatgaatgctgtgctttgttgctgctttcattaatattttgaaattcgcaagagttgtcttcactacagctgttggctgttaaatattgaatttggaaatcagttgcatttgcatctgccactacgcctctggtactggcttaactttccatgtgcttgtttctttttctccttcagaagccttgaccatgcttattcatctcaggatatcattctgcactttaatctaattacatgtaccattttgcaggaaaaatggatctctagttggatcctttcaaaaagaaattaaaggcccactatatcctaccattgcagtccatagtcaagatgaagagtaagatacccgttcctaagacttagttcttttcttcaactccaaacttcaacttcctggttttccatttgcacgcttttcaaactgtcaaatgatgtatcttttacaaaaaaaaaattctatatagaagctgtttaaaaaattcaaatgaattcatttttcaagtttacaataattaatacttaattaatccatgctaatgagctttctcgttttgcgtgcgctgaaaaactctctccaacctaacagcaagaatgctgcctaagtgattatttcaatgaaaatagacattccaaatatggaaaattgcattttaaccaagacagttaaacctaagttgctgaaaaatggtgttaagtgaaattatttgcttgtgttaatatattatttaggcttggaattgcatgcgttatgtgccataactcataaattattatattaattttcagcttttcaatggatctgattgttcatttttgcaaatcagggtgacagtaaactttggaaaagaaccattctgttttgacattgaggtgagccaatagatctagatattcctattcacctattaaggacctcacacaaaaatgtaatattgtcatgatttccttatggagtattatttcaaattccatgttttccattccacagtttgctgcatcaattaaacatatatcataatgtcttatagattatccatcttagttttccaaattcagatgcattgcatcttaagcgcagctcctttcatataattgaaagaacttttggttgcatgcatccttttaggtagtaatcaggccaccaaaatatggtgtatggtgccataagaaccaattggttttcattatggaattatagcctacaattatcactcagctcattcttttcatgtatatttacctatttggtgtttagttcatgcacacatgatataacactaagtatgattcttattggcagggctatatttttgaagagaaaatgaagcaacaatctgtcagcgacaaattggatttgcaaccagacatcagtcattggtatgctttctcatgttaagaatccatcactgtttcatcttgagatcattctgtatcttgtgagataggttagcgagttatgtttgataatcactgacttgtgctgtcaattatttgtctgctcctgttatgtttatgtgaaatttaccatattacgtaatctacatttgataccatattcactccgcccttcattcctaccttgtctcaatctttaattgtacctatattgacattaaatcttttatactttgccgccttatgtacatgtactgtgcacttgtaacaggattgttcgttcatatctcctacattacggctaccaagatacattaaattcttttgatatggcaagtgaaactgatcctccatccaatcatcaaaatggttatggggaacctcctgaaatgtatggtcttagccacagaaaattgctgcgtcaggtgagctaaggaaaacttatttgaaactgaattgttattgctgttgaaccatttttctaatctactaataagcaacactggggagtcaattgttagtatttataagatttttacaagatcatacatattctcttgaaaccagggctttacagtagttaatcagttaaataccagttactacccactgatgattagagcatctttgtgccaagtatccatattgatttttgttgtggtcaccacctgtagactgtagtgttgtgagtggactaacctgacatttgttttcagtcttaaaggctccagctcacgtccactattttttagtgtttatgtttttttttagatttcattaaccttttgagatgttacgatttattaatgcaagcttcataggcagatatctttttccctgaagtaaaacaaggttttatcacagctcggctgtatttggactgcactgcacttaatctcttccatatttttggttgcacaccgttgtgtgcagctattccatttgtctgctatactgtgcagatactacataattcatagaattggcccctttcgattttccccccttttggtgtggtttctgccttctgaaaacagtttgtttgatttcgtgaagcttatcatgagtggagatattgattctgcattcaaaaaacttggagaatggtatccacaggtgataaaggtacagtcttctatctgataattaattattcatttactcattgcagtttccacaaacttctaatgtgaattgataggtgcagactccaatttcgtccctgaacttgcattttactttgtaatacaagtttatgaggtggctccactttcatccctgaacttgcattttactttgtaacacaagttttgggaggaaagttgtacgctttgcaagtttaataacctgcttgcattacgattagtcaaatactatgtttatcctagcattttcagttgccatgatgtactttccgcaaagagttagttcaccactaagaaatcatttcttttttgcaggatgaaacatcaattatttgcttcttactccattcccaaagattcattgaatttatcggggtaattatctgaactcctaacattcagctatttggttaaatatgtatattatactctagagatcgaagctacaaaattgcatgcaaataagcatatcatcaactgacaaactacttatacacacatgaaaaataatacactacgtactttaataaaataaaatacaacacacatgtaagattatgataaattgtccaatctaaaaaaaacagtagtaaatggagtttggctgatgcaccccaaaacacacatttgtttttgactggagggagcatatgtgagatcaacttattttgacatctggtcaaattggcatgtggttctgtttgatgttgcccacctagggctttcgtttgcatgctcactggtggtgatgggcacttggacatgttgcattattacactatatcctgtttcataatgatataatctcagtttctcttgcattaggctggacaactggaggatgctgtaaaatatgctcgctctaacctggccaacttcttgacacataaagcttttgatgggttgctaaaggtaatgcaatggctttttagatgttgatgggtcatttgtaatgcgtccaattttacttgcaatagcaaagtgttttaaggcttcacatctatataagctttgcaatttctgagctaaaaagtgaacaaatctacttgcaggagagcgtggccctgcttgcatatgaaaagcctgccgaatcgtgcattggatatctgctagactctccacagcgggaatttgtagcggatgcagtgaatgcagctgtcctgtcaacgaacccgaacatgaaggaccctgagagttgcctttactcatgtctcgagaaactactgaggcagctcacagtatgcagcttcgagcgacgtgcattcagcggagaccaaggggatgcattcttactacataaagaagtgcagtcctgcgatagatccaggtgttcctaggcatcaaagcattcaagttgcacctgcatctgagcagtgaactcagagatgagactttgtgcccctcttggaaggaaagggattcacctcggagcggagatgtagaccatgatccatgcgcaatcacagatactttgattcttgaagtttcgcagtatactctccacaaggtgaacgcctaactgctgggaaatttggcagcagctccttccctgtaatctgaaaacttacattcacacatggccttaaacatctctgtttccataaactcggaagctttgagctggtagacattctgaatgtgaaatgagaagagaaaaacaataagatttgtgtaaatgaaatcgagttgccctttaaccttgtggttcattctaattcattgatacattcaattgcaatgtcttggttgcgctcgagtatatgtttacttgaaatgataaaccatttgcaagaaccagtccatctctggagttaatggcactctgccctttctttgttttgaaatctcgtcctctgcttctgcctattggtgaattttcactcatggatcattcatgtattcctagtcaatctgtctgttttcggtcttaattgcttcattgtagttttagtaaatagtgaaaagaagctgctggagaataatgaatttattctaaaaaagaaaaaaaatcaaagcagcttcttttgaattttagatcattagagaagttaaccggctaagaaaaaaaggggtacgctagtgctactataactgtacgagaaattcacctgtatttttagggtctgtttggtctgaatggtttgaagtcaaattttaccttaccaattacttatttggtaacttcaatagtatacactagctatttggattgataccaatttttatcaaagtcaatagagttgatactactctttcctataaaaaggaaaaatgatagtactcaaacttgctcaaggtttgacactacaaatattttggtagtgctttcaaccaaacatgcccttagaaagggctactccgtactagctataggcttatagcaaatgcaatcctacatggcctgcaatttgcgtgggaaatactgctagaacgttttaaaccacatctatttcaccgcacctctttatggaactcttcatgaaaacaaaacaactaaaggggatgtagctcaaatggtagagcgctcgctttgcatgcgagaggcacggggttcgatcccccgcatctccacatatataatttgtgaattagttttggttctttcacaaacagtattttaaattccacttgaagtatttttggttctttcacaaacagtacttttaaattcaaggagatcactgcattccttttggaagaggagaggcagggagcattttcacaatcaaggcccagcccattcacaatcaagcccatacattcgatgggccccacatgtcggccactgtccctcgggcggtttaagtaggttttcattttcttcgcagcttcgattccctcctctcccctcctctccgcccgctcgccgccgccgccgcccgcgtcgactcgccggagctgagcccggtagggccacacgccgagccgacaggatgtggtacctctgcgtcttctaccacaggctcctcgactaccggcggcccgaggtgcagtccctcgccgagctcttcggcgggcctggcgccggggacgccgtcgagtggcgcatgccggagaaccaccacgtcgactcccccttccacctcgtccgcctcccgggcgacgagcgcctcgccgcgcagatcgccaaccgcagtaaaagcgcctcgcctgatcgattgattcaccaccattcgctggctaagcttcttcttgcgggttaatcttggggggcgccgcgacgccatgtgtgtgtttgtaggcttgctggtgaaggggatctacgagctgtgggggcaaggcaccacctacgaggagctggagagggtggtcatggcgtaccccgaggagaggaagctgccgtacctgacgccggagagcaccttcaagatcgtcgtcgacagcttcggcaaggtcatcagcttccaggagcagaacgacatcatgaagagcctcacctacatccccttcaaggtaaattcatttttgagccataataagttcaattttagcctccccagtttgtcccaaaataagttcatttttgagtaaccactgcatcggagtttatgaaaatagaagataaatatgttaggagtagataaagtgaggaataattgcgttgggatttgataaagtaggtattatagtcttttttatgttgtattggtattggattggtgaaaaatgaacttattttgggacgaagggagttcatggagtagttcggatcacgaatttgtggatgtcagatgcatttattttctcttgtgtgtaattggtgctgttcctcatttccagggccgtgttaatttgaagaagcccgatcataagttctttgtcatggagactgatgactatggctgcaacaatggcctcccgccggttgctcagaggacggtattctttggccgcgaggttggagcggcggataggcatctcctgccgacatatcagctgaagagcaggaagtatattggcccgaccgcaatggatgctgaaatggcatttcttatggcgaatcaagggctggcgcgccccgggaagctcgtatatgacccttttgttgggactgggagtattttggttgcagccgcgcattttggagccatgacaatggtttgtgcttattgcacggataacgaataattttcattctgcttgtgagtatgtcttactgataaaggcctttcagggtgcagatattgatataagggttgtgcgggacggtcgtggtccagattgcaatatttggagcaactttgagcaggtgattgattgaagttagctattattttttgcttagattcttccatcctgttgtgatctgcttgattctgtgtgagctgcaattctcttatgacagttagttcttaaacgctgttcttgcctagtttttgacttggtatcatatagcttatgcagattatgtgtactaactatagtgacatttcggcatttatcacttgttagtaaaacacccgaggttcgtgtgaagtactaattatattgtcttcttcagtacaaattgccggaaccattatgtatactaagagcggataacaacgtcccaccttggcgtccaggattgaaggaggtaatactctgttgtgcggtttatacattgttgtatttttttgaattttacagttttgacagtgtaagcttgtactatatgcgcgactaaaaactgaaacaaatgtgaggaacgcataaagtgattcctgtacattcatgcaatattttagttgtgcttgaaatcttggatttgttatttacattcttgcattgctttatttggttgacattgcttgagaaaatggttgatgctgaagtaattgaattctcacgtagctttttaactgatgaaatatttcctacaactgaatttccatatgaagctattgtagcctacaagcgcatgggccttaatttccatagcttttttttttaataaaactttccataaccattggcttgatatatcttctgcttgtatgctacaagatactctggaaagttactgatttactccgttgtttcaattttttcgacaagatatgataaacacactattgatgcttgcgatcaatcaggttttcgatgccatcatctgtgatccaccatacggagtccgggctggaggccgcaagtccggtggccggaagctcataaagggcaccgtcgctccgtacacggttccggacgagaagagggacagccacatcccatccaccgcgccgtacagcctcgcggagtgcgtccacgacctcctccacctcgccgcgaggatgctggtcatgggtggccggctggtcttcttcttccccgtcgtccgcgaggacggcgtcgccaacccggccaagtacccggagcacccctgcttcaggctgcttgcctcctgcgagcagatcctgagcatgaggtacagccgggtcctgctgaccatggtgaaggtcgggccctacaccgaggaggtcgagaaggcggcggaggagcggcgccgcgagttcagggagaaccaccataagtggatggaggaggggaacctccactccgccgtgttcagccccgccgatcaggccgccgccgccgccgacgggaagccggccatagacagggactccaagcctaagtacagaggcaagtatgtgtaggtgtaggcaggtgagagacgctgaactttttgtctgaaaatttttctgacgctgtaacgaacaattttgtcgatgtcatgtggtcgtgtatccttcagcttaagagagcccggaggctttggatcagccgatttttagagcataaattagtgcaggtgctgctgtactatgatgtaccatttctgagatgatacgaggctgctaattcatttggtcgatgatgaggatttgccctattgaattatctatctatttgtactagtagtgttttggtttatcagaactgagaatcgtgctaattgaactaaaattatatttttatatgatggtattgtagtagtcgttaaaaattatattttttatatgatggttggaaaaggatatataaacttgataccactcacatnnnnnnnnnnnnnnnnnnnnnnnnnnnnnnnnnnnnnnnnnnnnnnnnnnnnnnnnngcttnctgattgaattacagtatnncacgc

SEQ ID NO: 34328 - DNA, 6626 bp, Oryza sativa
  unsure (1)..(6626): unsure at all n locations
tgttatgatggatcaaccttgtnnnnnnnnnnnnnnnnnnnnnnnnnnnnnnnnnnnnnnnnnnnnnnnnnnnnnnnnnnnnnnnncaaatccgtaaaaccttgttattaagtcgtgacattattcatttaaaagtaaagtaaattgcattgactgtacacgaacttatcatatggatgcaatctagtgtataaacttgtaaatgactcgttttgatggacgaacttgcttggtgtgtattccctccgtcctataatataagggattttggtgggatgggacacatcctagtactacaaatctagacagagagttatccagattcatagtactaggatatgtctcattccaccaaaatcggttatattatggaacggagggagtacaaaacaaggctataaaaggcacggtgtagctaaccttactaggtcagatattgattaaacatgatgtgtccatgtgaggaggacatgagacatgctatctttgcaaacaacgatgtactttgtttctaaatttatctttatccttctttgttctatccttcttttatatacatgcttatgttacatcctaatcaacaagattggtcatatagtacctttttatccttgggcactcgccgtacaagttggtgcaccaaaacgagcgcttattagtttatacaattttgctatatatttgtcgacaaattttctccaaaaaatttgacagatgtaattatagtataatcgtagtataattacactgtaacttgcatgtaattacactgtaactataatgtaacttgtacgtaactttcaaaaatttatctataacatgttatttcggtaaaatgaaggtcgtgggaacaaatcatttcacatatgtgtgtgctgtgatttttttcttcctcaccataacaaatcttgtaatagatctaacgattcaaaatttcatgaaacttacatacaagtgtaaagttacactgtagtacatgtaagttacagtgtaattacactacgattgtactataattatatctgtcaaatttttaggagaaaatttatcgacaaatgtataggtggttccagtttatatgtactacattatatgcacttgacacaagtcggataccgtcaattcaatttactttattaaaatttatctggacaccagaattaacttccctttagaaagcaaacgttgaaccaaactgtttagtagatagagctgggccagggtagatttaactctagccggacaggcattttaggcccggttacgtttctctcactccagttaagctgggcctaatcctactaaaaaagtaaataaataaataaataagtaaataaataaaaataagaataaaaagcttcctttttatcaataattgacaaaagagaaattttacggtccttaaaaaataataagaggtacttcctccgtttcacattataataatttctagcattgtccacattcatatatatatatatatatatatatatatatatatatatatatatatatatatatatatatatatatatatatatatgtatgtatgttaatgaatttatacatatatgtgtgtctaaattcattaacatctatatgaatatgagcaatgctagaaagtcttataacctgaaacggaggtagtaccaaatttttagttcaaatttgatatctcctcgtaccgaagataccaagagatatcaaattttacactggaaaatatagtacctcgtcaaggatcgtaaaatcgcacttgacaaaaacaaattaaacagccagcccctacattctctttgcggtaactggtaaattctccatctatcctacttgtcactcactcagtcagtcactctgcacttcagccgtagtgacaaagcccaaaggcaatggcatgcagaacaagccaaagaactgaaaaatttccgtctgaaattctgaaccttgaaattgtgtttgtttggaagcacctcaacgtggccattccttcatcacaagagagatcatgcaagaatgtctgcagactctgtccatggctccatgttgctgtctgggccttgaagcatgaagagggaacagccaccatcaatggcctcccgacagtcagcatcctacacatatctttggtggctagggccatttaattttcatgagttaatttcttgatgcaaattaagcagcccagcaaggacacacacaaaaaatgcagccaaatgcatatgccagtgaattaatatcgcctatagatagatattcagcaggaaagattgaaagaatcggttaacctgctgaattttcatgtcctttctttgtctgaaaaaaggtttcatgtcctaacgcacactttggtctgcttttgtatgtggaaactaactgaatttttctttctcttacacaattatttcatctatggctctttgcttgatctgtcgctgttgatgcacatgaaaatgttggtgcatccattgaggctgcaagctgagctgattgctgtgggtggttgcacttggggttgggcctagcaggaacagtgcacctaagcaccatttttggaaaatggcaagctcaggccatagctcctcaatgagggcaggcaaatgaccaaatcatggcaaggggagggaccttttgatgaggtgatggagatggcgatgggaggagcaaagaaagagaggaggaggtttaagtggtgttctgagacaaggcaatccacattccatagccccggtacctggcgtggcaccgtgtcatcccccattgtctgcccatcgtacacgctacaaagtttatttttcatggaccatcggctacatgagtcctagaagattctaaaaatttaactagatttctataaaatcatatctgaaaattatgatggtatatatctttttgctgatgttcctttttagtattctttagctccatcttttgcttgttcagctgaaaccaaaatttgaattgtgaaacttaattttagggttgaggtttttttattgtagttcattttctagtattagctttcaaatcgataagaacacacctattaattatttttagttatgttgttcatttttttttcacggctgataagccgtgataattgtgctggtgttttttctgaattttatataattttagtatttttcttggtggggttagatcaattatgttgacttgatggaagtggacaagtggtaaaaggaaaaggagcatgagtggagtaaagtaaaagagggaactgcaatcttgtagtgatagaagagaaaacagggttttcaatatgttttttcctctatggcaataaggttttatcaattctaatttgcctccaaagttgaagttgtgatattcatgcttttgactttgatccaaattattttagaaatataaatttgtgaaacaaagaaatttcaacttcattcaggtttcaaatgaagcaaacctttcggcgaataaaaaccatataaactaaagcaacaattgagacgagtgacaaatccttaatctgaaaaaaaaggagaatgttctttcatcaattaaaaagaatatattaatcacgcacatcatcccgggagatatgaagaagagatagatccagtttgtccagatagtgtttttttttcatcttcttcgaaatatctaatcaatcactgaagcttatctgaacagttcataagtggatagtcatacaggggactgtccactgaagtgcatgtcactggagatggaattagaatccttcacatgatcacatccagacctggaccttactatacacaaaattctctgcaatgctgtttgatcagtcgatctgtttggaatctctcatcacaccaaacatgttctgctactcttgcttgcactagctggactggatctctcttgtttgttcctgcactagatcacagacatatccaatatgcttcccttttgttaaagaaaaacaaaaaataaaactgtggcacaaagttgaccagcaatcattttcagaggaattattcgatgggggtgagtgaatctttgccttatgtcagctatggaataatacttctggattgtgtccagacatttctcttttgtgaaggcaacagctaatagaatacaggagctttatagttttctgagatgctaatttgttaatagtgccatgcccactaacacaggtttgacaaaagggcatttttctcagaatgttttaatttgtgtgcccttttgtagttgtttgttccattttgacaccgtaccgtacacagccaatattaattgtgtgtccagcattgtaatgcttcatcacagttcacaaaagtatatgtattcggtgtactttgttgcttcattatttaggaaacctattgtacttaatgtgtgcataataaaaggaaattaaatgtctcccagtatttatttttccttggcacattcaaggggctatttggatggcatccccacctatctaaaaacaaatgagaaagtatggcatgtcacacattttgtggctcacactttattggtcacaattgtaacaagttatgacaaaaaaaaatgtgtgcataactagtaggctagctggctaaaaaagtatggcatgaacatatatggtattagcccagactttttttttgctatattgtgaaaattaggaacaaagatactgatatttagggaggggggagatagccaataagatatcgaggtttgactgtgctcatcctaaatcatctatttgtaaacacagagagtataatgttagagcggataaatatgtaactaaaaaattcaaataaatgtgattctaattttggatatgcttgaggtttatgatatcttatggtacgacccctccctctttagaagaaaatctacttttatatctaaacttcaatgttgatacaggtatccttcacacgcgtatattaatatactatgttttaatattcacaacttttaaaaatggtatattgaagcaaggtgccaaggtatacaggtttattgattctccagaatattgcatgctgaattaattgttctatgtatagtgagttcatgtgtaaacacttcaactgtataaatcatatgtgatatgttctttatcatgtgaaaatcatctagtggaaagccaaataaatggctacgacgtacttagctgtatccttgtaccaagccaagccactaacaatttgactacttgacatcgctcgtcaataccaatagatttatgcatctttcttactacatataatactatatggaacatcacaaattcatatgaacattcaagctatttgaatgattgaaatattggtgtttgcttcgtagatccataatcacaatataagcattaaaaaacaagtaattgcgtgccttgcaaaatttgaaatactatcacaacaaacactccaagctttgatatgctttttaacaaactatatcgtatctactctgagattagtatagaccacttttcgcatagtagcgatagctttagtgcatcttcatcaaaatccaacctaccaaccttgtaagcattgcttgtcacatagtacttttagctttgccttatctttcttaattataaccatacacaaaacatcacgaacatcttgatcacacaaactaatagtgcgttgttgtttataatcccagcaaatatgtagactatataacaaatatgtagaagtccccaattctcatgagactatataatcctagcggaagattactcatcggcattgtacgtttaggtaggtttacctcatttttcttataatcgtacatgaaacatcacgaattcacatgaagattttggccacacaaactgatagtttgttgtcgtttactagacaacccataatcgtaacaagcataataaaaaccataacatgcttaactataccttctaacaaactccacacaatcaacgccatgattacattgcacttgtcgtatgctatctagaattaccatacatggcctcccctcataattgtggggtgatattctagacttttcgagtactcacaagacctatagtcctagacaagggatgagagagagacgagggtataagagaacatcgtgagaatgcgcatgaacaatttatagtacgaacccatggtatgttaccgtttaccatccaagcaaccatgatcttaattaacatgcacaataaaaaacatgtgaataatgcacactttacaaatccgaaacaccagctagcgcaacaaccaccgcatgcttagttgtaccttctaacaaacgccacaccatcgactacatggctacttggcatcgcttgtcatacactatccgcatttacctctcacatgtgtctcgccactcggtctgactcccccccccccccacacacacacacagtcgccacggcgagcgctatcctggacttccccggtccgcgcgggactatataatcctcgacggaggaggggaagaggaaagggaaggtatcggggtatcatccaaagtgggggcatatgtggagaggcagtgtgagtccctttttccctgtcatctctcccctactaagcccatttgccctcttccccctccatccatncatgcattcatccatatttccttgcttttgccgtgcattattcttgatgtga

SEQ ID NO: 34329 - DNA, 4072 bp, Oryza sativa
  unsure (1)..(4072): unsure at all n locations
ngaagagaaaagggaaggtatggggtatcaatccaaagtgggggcatatgtgaaagggcagtgtgagtccttttttaaagtaatctctccctaataaggacattttggcttttccccgttccatccatcgatccattaatcaatatctcctttctttttgccgtccctttttcttgatttgattcttcttcctcccatggtctctcctcttctctccccttccttacactaacagagagctcttcttcttcttcttcttcttcttcttcttcttcttcttcttcttcttcttcttcttcctctcagctagccgtgctccggctgcgtgagatgtaagacgacgcgcgaatcaaaaatctcaaaatctcaagaagccaagaacagcagcagcaagtagaaggaaaaaggaggagagaattaagagggaatccaagaacagtggtaattaacgctttaccaatctctctctctttttctctcttaaattatttctctcctggattctttggtttgccttgtttgacggtagattagaatcgtgttgtttttcattttcatttttatgtttattagcgtcgaatgattgcagtcttcgtcaatcaggtgggccgacacaaccgacttgctgttcgtgtctctgtttctttccttcttcttcttttttttctgttctaagtatttttcaaaaaaacaaaacaaaaaaaaataaaaacagagagagttttgtcttggttcttggctggtttgcatcatgttgattgggaaagcaaaaatctctctttcgaagccccccatctgccctactgttgctgctgctgttactactactgcctccatcagccgtcggctgcagtcgccgaccggtgggccccactcgtccactttgttgcaaaatctctgtgtctttattgtttcttctggtcgcgatcagagggaggagagaattaattaattaattaattaattaaaggggaaagaaaatcatggatgttatgattggagattggatggttggcttgtgacggcgcatgtacactgtagtcgtatctctctggtagcaccacgtacaattaattagttaattaattgcatagagttttttttttgttcatttttgtttgcttgttttgggaagcctttgattgatgtagcagtagcagtagtatagtactgtagttaccgtgccacacgctgctgataggaggaaggggggcgcgtggcctatctggaccgtcggatggagatcggacggaagggagtgctccacgtggcatcgagattccaatcggggaggcgccgccgcccgccgcacctgcggaaagcggattccctttttgggaaagcgtaaagcgcgcgtggctggctgcctggcctcctctcgcgcagcggattgggcccgcctgtcggtgacaggtgccccaccgggccacgtggctggctgaccaccagtggtagttgactactccgcaattaactactcctacctggataaaaggcaattatgtgccaatcagaaattcagaaatgtgaattcctcttaccagttgacttgagaccatgtggattaccaaggcaaagatgatttggtctatcaccctgctgattaatctaccctccgttcaaaaaaaaaatcaaaccctatatttaaatttggacatatttgattttttttacagagtagtaggttaggtttaggtcttaggacatctctgtgattagtgattaatccccaattgtttcaagtacttgcttgcctatttgtaagtaactttatactctctgtttgtttcagaaaaacaacaaaaaaaaaggaacatttcacattagtatcttcatacaaaatcgttcacctaactacaaactatatacaatagtgaaccgatgacctttctcgcacttaaaaatcttgaacaagattacttgttttgttaaaaaaaactattcccttcatcatgtggatatagtaatctacaactgaaatggatgttttataatagatgtatcccatccgattctagattgttatattctgagacagagcgagtaaatctgatcattttgcatttaacttttcacgattatttgctctttaaactccatattgttcaaaactgggcaatgctccatctattttaaaatacaagacataactatccttagtccaaagaccaaaaaccaattattatcatttttcttgttcatatcatcataataaatacaatacatgcacccaataaaattagagatattgagaataaatgatttaaataataacatttaacttaaagttgccattttcgtattcaaacacgtgctactaactgacaggtgggccctaaccgcggcatgcaacgctggaaaaataagacctaatcaaccgaattttttatttatattaattaataagtcttgaattaaataagtggtaaatcttaaattgaatttgtaaaaataggatggacgttgtttcaaagggcgtccagatttggacgctgttccaagaagtgtccagaggtggacgctgtaccgaagcacgtccaggctcggtttggggcgcccatgccgccatgcggagaggcgccatcgtcgactctcctctcctcaggcccaatgttggtgcagggctcgggcaaggtgctgccatgcccgccgttcacctcgactctgggagactgcaacagccgccttccggcttccgtctccacaatgtcaggaatctgccattgcagttcacctcaactcacctcgaaggctctcgaatccggagaggacgccgccgctttttgccttcacaccgggaggtcgcagccgctatccacgttctggttgagtcatgctggaacaataacccactcgtgccggcttgtgttgcgtcgtctgtccgcccctcttggttcctaacagcaagtccaggcatcgcctcactccaggtggctggccgagcaagtatgctcagttcatagattttggtattcaggtgtatatgttctgcaatagaaagtttacaaagaatgcaaaattacgaagggtaggacgcaaacatcctccttctatcagatcatctgtcgcccgatgacttccaatctctggcttgttgcaaaaggaaaaaaagcatcgatcgaaaacctcgcatgcagttcatctggcggccgcttctcaagattcagtcagcagagagctcgatgcgtagtaaacaatggaccagaacaaaaaccaaactaatcaaatatctcaaaataaaagtggtggctgttcacatatgaccccgagtagagtgtccgtcatgcggaacagcggaagcattgaaggagagccgggggatggcgaccctgtctggcagatcaggtagagagcggtgcctactcggcaagcaagcaatcaacaagagacaatagtctgcataggagtaacgaggcagagttcgaccattgtgtgattggatccaaagtccaatcttagtccggtgaattggacggctctgtggggtcttcaactgcagcattatggacgcccttgtaagaagcgtccccatctggacgttgtctacaacagcatccacacctggacgtcctatgcaatagtgtccttcctattttcgtaaaaattgactttgctttattatatatttaatttctgcattattaattattatgaataaaaaattcggcctaatcaacatcacaacaagaacctctgaaataaaaaaaacacagtaataacaggtataagtaacaaaccacaacgaaccctaataagttcagataatagaaaaggtcttctcaagattcagtcatggcgatcgccgcaagcagggccaacgccaacgccaaccgaagccgccaccatcatcaaccgaggcggtgggaaaaaaattcctcccaatgctggcacgcacgcgcactcgctcgagaatccggcgggtgggactgaaaaaacaaaacaaaaaaaagcagatcgattttgtcatctgcggaaggnnnnnnnnnnnnnnnnnnnnnnnnnnnnnnnnnnnnnnnnnnnnnnnnnnnnnnnnnnnnnnnnnnnnnnagttgcatgtcaaacaaaagcgcac

SEQ ID NO: 34330 - DNA, 8299 bp, Oryza sativa
  unsure (1)..(8299): unsure at all n locations
atgtgncaactgangacctgatagtacaacttcgcaccctggagttacaaagtttacggcgtgagactctctttactaatcaatgctctaatcaactgtacaatgagtaggttttttccactctttatacagtgcaatccaatatatgcaaggttcggtgatgggcccaataaatacatttgggctaggtcttcatgggccaaacccaaaatttcttaacaagaacaatgctatcatggaaaaaataagtgcgggtatgcgtcacttaggttgagcctattttgacctagtgaaaattagctgaatttaaacatcttccaaatgaagaaccctagctttaatgactacatggatcatggatggaaaattaacgtggaatagaatcgaatcgaatccctgtggccatgtgaatatgtgatgcaaatgatggagccctgcaggacatggaggggacatgcatcatcccaggcagtgtaaagccatctcccatcacatgtgcacaacctttatagcttagcccttttggtccctgccttgcctctctcccaacaaactttgcccagtgctgcagcattgtgtgttgtgtgtgttgtgcttgaggggtttttatgtctgcatatttccaggggttggctggtccagggggttgctgcagtgtacactagttaatcaacatcaaggaagattcccacttagctctccagcagaaattaaaaaaaaaaactaaggtgaagtatattcaattgcattcattgggcatgttgcacttcatttttactaaagtaactaaaacatgcaacattgttaggatacgatacctttttttcctgccatggttaaattaaggatatgatacaactgatgaaataggaagctaatgtgattcatggtggctagctttgctgaacttgggtcggttttatttttaatatgaaaaacacaagaagcaaaaggatgttgtaaaatattggtacttattttttctaaaatatttaaaataataattaagtttttttttggatttgcccccaagacttttttttataacaggcattcataatacccggcttttaaacaaagccgaagataacggcacagaagtcttacacaacacaaagaaaaacaagtgacttaagggaacagactaacgctggagcataggtatcactggagaggcccaacaatcagaaaaaacacacccccggacaccctaaaacaaggcacctaacatgctaaaccaaaacccaaccccttagcctgttccaagacttccagatattaattctttttttaaaaaaaatcagagtttgtttttttttttaaaaaaagatgatctggttcatttacaagtttgtgggaaaaaaatacaaaaaatgtcatggcttactaacgactaggctttttacctgctcctacataaacaatgtggctaccacaagtccacaagtcgtaatcatgcacatccattcattaacaaactctaaagaatcccgcaaaaaaaaaaaacaaactctaaagaagaaagggaaaagcaaaaggcacaatcctttcatttaaaaaaggtctgcgggatctcaaaccgaagtgattaataacatgcaggagttagtatatatatattgacataagactgaatcaaatcaaagatacatctatataaataccaatttatgttactatatatatgtgtgcactattttgttggggtattactagatttcaagcacatggaaaattgcatattttcaatcacctgaaattgcacactcataagtctaaaattataatagtatgcaaggtgcatttttatttctatttaactgtaagtttgttgctatatggatttactttatttttatccatgtttaaatatttttcatgtaattttgtaaaaaattttgcatgtaattttgtaaaacttatgtataaatgtttttcaacgttttatacaagaaaaaaaaggactaggaatgataattattggattgacattaaagtaacgagataagttactggaaattttgaaaattctcagctaaattctagccactcccattttatcttatatggagtagctaactacaaatttgcacaaaacccctgtttcaaaagtttctctaaaaagaacacacctatattccgaaattttcaaattcctttttccccatccctcaaagctaatccttttatgtataaccctatcatggtcactattcactaacatgtcccggctatatagttctatgtgtttagtacgttcctctcattttacttataagtggagatgttgaatatataggttgtgggtctggtattaggggagaaagtaggtagtccgcaaaccccctttagggtgtgtttagttcacgctaaaattaaaagtttggttgaaattgaaataatttgatggaaaagttagaaatttatgtgtgtaggaaagttttgatgtgatagaaaagttaaaaatttgaagaaaaagtttggaattaaacgaggccttaggtcgcttaccctataaccctataagtgggctacgggctaggcacttacgcttaactgtggttccagtttcatacagtcacagactcatagtacatctctttcacaaacattaattaataacctgtttaaccaaaaggtaagggtataataatctactcacttcgtactattctaagtgtagttctggtttctatgtctaacgtttcaccgtctgtcttattttaaaaacataaaaaattaagtcatgtataaagtacttcctccgtcccaaaatataggtatttttaaggttggtacggacattaagaaagtaggtgagaatgattggagaaggtgtgtgattggttgaaaaaaaaagtaggtgaaggataatggttctgattggttgagaggaggaggtaggtagaaaaatagcttcattttgagacacggtactgtgctacaaatagctacattttaggacggaggtagcactactcatgttttgtcatctaacaacaataaaataataatcataaaaagcatttcaaataagaagtacggtaaaatgttgaacgcttaaatacacaaccgtacttgaaatgggatggagggagcagacgagtagtaaccatttaaaaatgcttgatttgattccccggggtccactgcccatttgcccccaaggaggaggaaatatagaaaaacaaaaggagaaataagtttcttttttcaaaaaaaagagaaagaaaaccgggcgacctgtgctgttctgccacctcgcgccgcgcggcgcatttgcgccatttgtttagctcgccatgtccgccaccaccttccctcaccagcatcgcctcgccgcccagctgctgccgctgcgcttgcgcgtcctcactggaaagatggcccccctctgctctggcccctctccactgcggtatgaatgaatgatgcgccttttctccctccccccgcccagatcgatcgccagacctgcactttccagttccccatccatgctctgtctgcttcatcctgtcccagcttcttcttcttcttcttcttgttgttgttgttgttcttggtgcgggagggtgttcttggggtagggagcagcatcggcggcggcggcggtcatggcgaaggagaccgagttctacgacgtgctcggcgtctgccccgccgcctccgacgacgagatccgcaaggcctactacatcaaggtcttgcttcttgcttgttatgccaactctgctcggagagtcggtgctgatttgtttttttttttcggtttttggtttcttgatgtccaggcgaggcaggtgcatcctgacaagaaccccaatgatccgcaagccgccgagaaattccaggttgtttcctgctactcagctcaagttggtttcttgcttggatggtttttttttaattaaattcagtttgctttgtctgaccagctgagctttcttgggtggattttttgcaggctctcggagaggcctaccaggtgctgagtgatcctcttcagaggaaggcctacgatggctatggcaagaccagcatttccaagtagccaaacaaacccatctgagatgattgattgactctctgcagtctgtggcaattcaagtttcaggttaacaaatgttttgttttgttttgttttgtttgttttttcagggagaacatgctggatggcactgtggtgttcacccttcttttcgggagtgagctgtttgaggactacattggccaccttgcaatggcaacaatggcttcctccgagatggccagcgacaatgacaaccctgaaaagcttcaggacaggctcaaggtcagtgagctcaatagccattgcagccatctgtgattatggatgctccaaagccagtttgatttttctctcctttctgatggaatgttggcactagactagttgatactaaccattctgttctatgtttattgtgacaaagggtgtgcaaagggaaagagaagagaagctagcaagattcctcaaggagttcctctcgcaatacgttcgtggtgaccaggaaggattcgcaagccgtgccgaatccgaggccaagaggctgtccagcacttgtcagtctgatcgatccccgcaattcatttcgatctctatgccaatctaagaaaagcttcttttaactgttctgaaatgccattgctcagcatctggactagacattcttcgcacaattggatatgtgtactcccggcaagctgcaaaggagcttggcaagaaggccatgtaccttggagtcccattcctggcagagtgggtgaggaacaagggtcacctatggaggtcacagatcaccgcggcgaaaggtgaaaatctcgcaaaccggggcttttggtgtgtattcattaaaattgctgactgattagaggacaaaaagaacaatgcaggagccttgcagttgctgcagctgcaagaggaggcctgccggcagagcggtaaggacggcttggccaccgagagggatgtcgatctgcagatgaggatgaacaaagacctgatgatgagctcactgtggaagctgaatattgttgatattgaagtgacccttctacacgtttgtgaaatggtatgcctcaagatatcatagaaatttgcagtgatatgattaatagttagttggtagtatctgaactgcgatcgccaagtagcacgacatgcctgtcttatcttccaggttaacatgtcaaaatgattagtacattaaattgaattgattctcttgtacttgtaaggtgttgcatgaaaacaatgtcaagaaagaagatctcaaggctcgtgcaatggcactgaaaattcttgggaagatattccaggtatatgttacttggccttttcattaggataattcataccgctacatgagatttattttatcataatttgcaaataccatattaattcaattggactacaaacagagggacaaggaggcattgccaggaccatcaaaaccgaccattctcgatgatgacagcagctctgatgaaagttcagatgacgacgtggctcggacagtgccttatcggactcctgcagttactcaggcaattactaaactaagcagcttttatgttgcatagcaaagcattgcataatcaagtgcctgctaatattagttcccatgttttgtggttcagggaattggcaggttattcagatgcttatgcaacccagcatatgatgttgacgatgactttgaaccacgcaaatgagtggtaaagtagcagagaggttgcaactatttaagagatccctgaatctttccagattatgtgcttctgaacagttggggatcatgcatcaccataatttgtctgggtgtgcattgtagattctactgcagcactggtgatcaggccattagctcaaaatcgttctttttctgtccatgaacagtagattctttcttggtttttgatatagattttatcgaattgtgtggtgtttatgtaattgtttggtttgggagttgtcaaaagaaagaaagcaagaacaagtgtaactggaagtccatttctctctgattttaaaatcacatgtaaaactctgacatgaaaaatcaacttttgatcctatcgtctgcctactgtcaccatcctctgctctaaagatcttctatctcatattgacatccctgattgctgacctgccagatgaatgctgtcaaactccaaaaagagtgatctactgaaatttctttgagcttctgctagaaagatgctgtacaaaagatgaacagatagctcaaaaagctcattcatgcaactcaagagcagtctgcattctgcaatctgcattgcacagaacagaaccaacaccatggatccagcatttttttctcatttcctacactggtaggtagagctccttatggtttatggactatacaacaacagcaatttctttttctgccatatgccacacgcagtttctcaccctcaccccctaaactctaaaatttcaactgaaatctccttctccttatggcgatttgcgcaacccgaaaaagggaccataattcttcagagattcaggtgaattatatcatgctctgagcttggcgaagaggttgccgaaggagaagaagctggtcctggacagggcgccggaggcaggctgccccggcgacttgccgttggcggcggcggcggcggcggcggaggaggaggagggggaggagggcaccttcttgacgttgagcatgacggtgtggccgacctggacgcggaggccctcgatggtcttcatgtccaccggctcgccggaggcgtcgcggacgtagaagacgttgatggcctggccgccgaccgtcgtgacgtcggccctcgtcaccgtcaggccgtgctccctgagcacccgcgtcacgtcggacagcagcccgaccctgtccctgccgcacagctccagggtgaatccctgcatcatcaaccaccagtgttagcacatattcaagctccagttcgagctgaaagagatcctctgacttaacgccatatcaaagtggaactcacatgtcagtgactcaattgtatgtgtatgcatgtgtagttaagtcagaggatttgcttctcggtgttcgagctattgtactggtcggtgcatgtaactcaatctgacttttatcttttttctttttcagaaatagaatcagaattcagtcaaaggtatatatgaaaatggagaaaagacaggtagaagggcagtatgttactactggttaatagaactaaatgatgaactgaaacagtgtactgaaaaaaatgaacagattaatgtggtaccaggtgctgtagcaaaaccgacatactagtaacagagttcagtgtgagtgtatcgatcaatcaatgtgactttactactaggagaactatacaccataatctgcaacatgtcctgattaatcccttgttccagatgcagccaagctcagaaattcttttgcaaaatactactaacagttactacttctactgatgcagtgatgctagttgcttgtacagacagtggcaaagaaggttcagacctcagatactcttctggagatggccgcttcaaggcacttgatcaccctccctgcttcgtccttctgtagcgtgcgcccatccttccgacgaatgtacagctcctgacaatattaaaataaaaaaaaggaagttcattgcaatgtcaaaagtcaacgttgaccgagtcgcggcgcagagctcctttgaaatgcaggaatattctttctacaaatcgaattatttcatgtgaaattcttagcattgtcgtggtaggagcttcgatatggtagtagcagctgttgacatgctagagtccagagtacacacctggatgccgtagatgccgtcggaggagacggaggcgtgggagacgacgtagtgcatgtcggtgagcgtgcacacgatgtcgaacagcagcttggacctgtccctgcacttgacgttcaccaccgagtagtccttctcctcgcagtgctccaccgtcaccaccggcctctcctccgccgccgccgcgttcccggcctcgcccgacacgatggcgcggctgtcgaggccgtcgtcgtcgtcggcgtccacgtcggcgtgcatcaactggtggagccgccggtcgacgtgggtgttcgacccggcgccgccggaggagaagaaattggcgtgcgccgggccgtcgtcgccgtcgccgtcgtcgcccccggcgtggccgccgaggacaaggcggatgcggtgctcgatcccggacaggcggcacgggtcggcgactgcctgg

SEQ ID NO: 34331 - DNA, 2632 bp, Oryza sativa
  unsure (1)..(2632): unsure at all n locations
gtgtacctacgaagtacattgatataagcngacttcgagctcggtacccgtccacacctcggcggcgagcacgttgcagccgagctcggcgagcacggcgaagacctcgaataggaggcccgtccggtcgggccccttgagctcgatggcggtgtggtcgccgatggagtgcatccccaccgacctcaccggcgacgacccgcccttcgcgccacccagcaggttgctgtctgggcctaacgcctgcaattttaaccaaattgatactgccacttcagttttcagtttttcacttcaactttaatttacacttcagtgtaaatctatagtcacaaaaaaattcttgatttcatggaaagttttcaaaggaattgttggctccatatctccactatccattccaaacacctcatgaaaaatagtactgcggtctaaatttgtaattcattaaaggaaaacctttaaaatgtttttcaaaaactgaaacacatactgacatgatgaacagatacgaaaatacttcacctaaactaccaatactttcaaaccaaacactatcaggatgcagttgcaccaaaaataattctgaaagcttgatatagaggataaaataggttttcaactttcaggtggtaaattttaagaccaattttcaggtggaaaaaaaattacaaaccttctcaatgtgcttaatggtcttctcatcagtcaccttctgcccttgcttgtccaccacatgaaacactgcatcaggttgtaacagacatcatgaataaaccggcaattgatgtccgcgaaccatacatgagtttgcatatatatgatataattgcatagcataggctgccttaccatccatgaaccatccaccatcagaggtgatgtacgccttcgagatggcgagatcgagatcgctcagaacttgcaccacctccaacaggatgccattcttgttcatgctgtcgacctacctccaaacgcaaacagacggtgctcgaagcaatcagtgaaacggttcttgaatattggaagcagtgttcagtaagattatccagtcaagttttgagagagagtagtaagtagttcttaccttcactaaggtgcagtcgctgcaggtgctgttgtcaatgcataccctgcagaaaattatcagcttgttagctacagaaagtagcggagcttccgacaatagcctgaaatgaaacaggataatgatatgaggagctctggaatttagatgtttaaattagagatccacctaggagggttgatgcgctgactgaagttctcatactccggatcaaagtaaggcagcatatcttccaaggttacgaatcttccctctgaaagaattacgagttgaaaaccagcactgtcatgatgcgaggtatgcagatatatataagcaaacagaagtacacagtttcgtcttgtgaaccatctgtgatagtttccaatcatgagggtagaaacttcgatcttaaaatcatcaccggaccaatgatgggctcctcataaagaagatctaaattactttagagagtagattagaccaacctttcagtagattcttctttcagcagggcctgaaagttcactggaaaattttcgatggcttcaatcaaaagctaacccccaacacttcacgctttagtatcctgaaaaagtcatgagcagtttcgagtcaatttctgtacaacgatacctgaaacctgaacgcacctgctcaccctgaaaactgcctgtcaaaaattcagacactgacatggaacacataaaaactcaagaatcgcaggcagaactggatcgaaatctggatcagaagttcagagcacatcgcttataaccataaaaaaaggcaaccaacttgaaccactgtgatcagaaaactaacaattgccaagaaaccatgggctactgcaaacacaacatatacacatctccctgaaagcaatccacccccattgatcaatcaatcaatcacctcacctcacagaagcaagatactcttttgcctggatgaacaaatcagagaggggcgcacagatctgcatactttattgagtgctcgtgatgcatgaatcaacagccacccacaaccgatggccaaaaattgcttgctgctgctggctggggatccaatccaatcatcccaactagagctagaataatcgcccggcctgaggaatcaagaaccacgtcacggtgactggatgtggggataaaagaaaagaaatgcacacccgctttgcgccgcatatgacaaaatcgatctgctttttttttgttttgtttttcaagcccacccgccggattctcgagcgagtgcgcgtgcgtgccaacattgggaggaatttttttcccaccgcctcggttgatgatggtggcggcttcngttggcgttggcgttggccctgcttgcggcgatcgccatgactgaatcttgagaagaccttttctattatctgaacttattagggttccgtgtggtttgttacttatacctgttattactgtgttttttttatttcagaggttcttggtgtgatgttgattaggccgaattttttatttataaataataataatgccgaaattaaatatataattaagcaaagtcaatttttacgaa

SEQ ID NO: 34332 - DNA, 757 bp, Oryza sativa
  unsure (1)..(757): unsure at all n locations
gtgtgccagtangactccactnnnnnnnnnnnnnnnnnnnnnnnnnnnnnnnnnnnnnnnnnnnnnnnnnnnnnnnnnnnnnnnnatccaagcaggaaattcagaacccagaacaacagattagcccattcgaatccaaccggccaatttccgatgtgcgaatcaacaaccatagcatttcacttaaatacatgatgagtcgcacaagctcaggctgctctttctctcacgcatttgcccccaaaatgtgcaacgcaaagcattcctgaccactcagctcacgaaaatggacccccgtgctccagaatccagcattcggaaatcctcgcatcgctcaaaatccccccattctctcaccccccccccccaccacaagaaatcccctcacccaagccgccttcagaatccagacaacaatcccctcgccgccgcccaccacggcgaaacctcccgcgcccgtcctggcatcgctcgagggtggcgtgaacccgaccacctcaccccgcgtcgcaaccaaccacgaacccccccaaccacagctcgtacgaggaaaccaaaacaacaggaagaactagggctcccggatctcaccgacgacaggtcaggcagggcgggggcacacgccgacacggcacggcacggcacgggaacgagcgggggggtcgccggggagcccgcnaggcggccgcggcggcggcggaggcaaacggattcgcgctggttgcccnagggcgtggggaaattggcgttcgattgt

SEQ ID NO: 34333 - DNA, 823 bp, Oryza sativa
  unsure (1)..(823): unsure at all n locations
aggtgcccattagatacgcctgtctnnnnnnnnnnnnnnnnnnnnnnnnnnnnnnnnnnnnnnnnnnnnnnnnnnnnnnnnnnnnnncttaggttcttaggcaggaaactcaaccagctaaaactcggttgctaccataaaactgtggcattttctcaaaacgaggatatacacatttctgattgccaacaacatcgtagacgaactaacagcggaaccaagcgacagcaagggcagaggggatgctaacccgggctggcggcgcatcttgaaattctcggtggtgaagccgatggaggtctgccccttctggccggcgttcttgacgcccatctcgaagtagtagacggcgcggcgcgtgggggcggggcggttggcctgcacgacgccgacgtcgtggccgtgctggttgacgccgaggtacctgacggacatccggtcggtagagacgacggcgaagaggcccgagctgttggtggtgttgagctcggacggcgccggctccgcctccatctcggccgccgcggccccccactccgccggcgaccggcaccgcgacgccagccttatcgggtcaaccgcccccgccgacgcgggcgccggttcttccaccaccgccgccgccgaaacaacttggttcgcaaccattcgccaattccaaaaccccccctggtagcagcagaaacggcaccaagttagggattcgattcgtccaaccaaaaccgaaacggcaatccattcgggaagcccttacacaagtggcggggaaggatcgccgggaacctaacgagtgcnggggaccaaccttgccgcggtggccgtg

SEQ ID NO: 34334 - DNA, 5230 bp, Oryza sativa
  unsure (1)..(5230): unsure at all n locations
cggtgcaatgatagccactcgtaccctgaagctctgtccatctatctggaatatgtttctggaggttcaattcataaattacttagagagtacggtccatttaaggaacctgtgattcgtaattatactcggcagattctttcagggcttgcctacttgcatggtaggaatactgtacacaggtaatgtaaattatcctacactgttagtgattttcatggtaggcactgaatacaatgatcactttgtaaattttatttttgtggacagagacattaaaggagcaaacatacttgtgggccctaatggtgaagtcaaacttgcggactttggcatggctaaacatgtatgcagttatattttcgttcttcccggggttttgcttgtttggttgtgtagaagcatcattaaaacctcactgagaccacagaaagcatttagtagtcatctaactgaatactctctccatactcgtaaaggaagtcgtttaggacaatgtttaagtcaaaccttggaaatataaatcatgaataactctcaagttgttgagtttgaaaatataaaaattatatgtatagatttgtcttgaaaaatactttcataaaagtatacatatatcacttttcaataaatatttttatagaaacaagaagtcaaaattgtattttggagaccgtgtcgctgtcctaaacgacttcctttacaagtacggagggagtattaagttcctcctctgacagaatgctagatgcaactcagtaaaatgtctttaacattgagcataaacactggcttcctctaagtttgagacttgggagtgataaagatctgtactatgtctataaacttccctttatgttgtgggctggtgatgtcatttctacatgatttaaaaaagatgtctctgatggctatggaagggcttcttcaattcaacaacaaaatgaattccttttgagctttggttgtctcttttatctcatttcaatgcttatgttgaaacaggtgacatctttcgccgaaatacgctctttcagaggaagcccatactggatggctcctgaggtatacggtttcctgtttacaacacttggagcactgtgtcatatgttatgtaatttacttcaccaagaacggtttgtccaactaaatgtaaaacgtgcaggttgtaatgaataacaaaggatataatcttgcggttgatatatggagccttggatgtacaattattgagatggcaaccgcgaagcatccctggtatccgtatgaagatgtatgctacttcgtttaatatttaccaaaatgctttgttccacttggagatgctattctgcctcttttagtgaaaataactggaggactcttgatacttcttttatagttggtgagcctcatgtcagattcttggtcttgcaggtggcagcaatatttaaaattgcaaacagtaaagatataccagaaattccagattgtttttccaaagaagggaaagatttcctaagtttgtgcttaaagcgtgatccagtacagaggccttctgcagcttcgttgctgggtcacccttttgtccatgaccatcaggctgtaagagcaccaacatgcaatggtactcagttgagaaatggaatttcttcccctgcagcaagtcatagaaaggtgagatttctgctcatttgtttttttcagagtcaatgtcgagctcttttactcttttgaagtaccaacaggacatagtagattatatatttctagatgtttacaagatnnnnnnnnnnnnnnnnnnnnnnnnnnnnnttgtatcatcgcatcagatgatggggggcagtagggctgattcatgtgttgcacataattctttttaggaagcttgctttacatatctgttgttgataaattaattacgtgaaaccaggtttaaagactggattacacgacgtaattcccatgtccggacatccttgtcatgtcttcaattttttccccttttgcagccaaacagagaatcctcgtcaaggagaaacattgctcctctgcatggtatcgcaggactaagcgcaagggaattcgctggattttccacagcctatccttctcctcacaatacctccaggtataccattctacctcctgcccatcctttgtttccaagttcatcttgtaacctacttctcaacatggccgtgcacgtgcagcagcccaactgcagtgagagcaaacatgtctttaccggtgtcgccatgctcaagcccgctgcggcagttcaagcaatcaaactggagctgcctcccttcaccaacgcatccggcgctctcccctggattatcagcagcagcctacccaaacaatcccttgcagaaccagtcgaggcgaagcgccgcagttccagatccctggctggagttgagccagccgagacctccaagcccatatggctctccaaagagattctaggccttctgacctgcagagtttcttgtagcatggctcctcaaaagagattctaggccgtctgatctgatctgcagagttgttgtagatgatatgtgttgatatctgacacaagatagagagggagtcgcatatgttttttgttgacagatcatttgtaactatatatggcttactctgatctgattcatcattcattgtataccataggaaaaaggagggcattaggatgatctctgatgttctgtaaatctgtaggactagaaatgtggagtggaggcttggaccagttgcagaacttgtaaatttttagaaaatggaataaaatatcccggccgctacacacccgaaggaagtttttctaaattgttataagcatattatatggatacttgcgatgttggctgatcgaaaagctaggtttaccctgaatttctaagggagatagagaggtaggagaatgccactgaacagcaagcggaagcagcgggccagtctgtttcgttagagtttcgaatggagagagatcgacaggaggttttcaaatttaaacagcatataagttaaacaaaaagatgtaaagggggccatagtttgaaagatgtattttattttcttaaaagatgagggatgaggctttcaaaccaattttaaacggcgcacaagtttaaaaaacaaaaatgtaccaaaaacattgcggtgagcgtggatcgaacacgcgaccttcagatcttcagtctgacgctctcccaactgagctatccccgctatgcgtgacaagggtctctgttccacctatagtgacgcataacttcataagttagctttggtttatgccaattgaactcagaatctttggattgaaaccacacgtccattgccattgcactatcaaatacatctcgatccatatattagtatccaactaccgaactacgcaagcatgaaggcaattcaacaagttcaaggccacaagggacgtacaccgccggtacacgcatacaggctatccatgtactacactagtacacacatacaacaaagttatccatccatgtacacaccgggtacacactacacgcatatggccagatgcgtgcagaactgcagatgcattagttagggccaaggggaaaaaaaacttatggctcgttaactcgtttagctcagctcagctcgacttttaactcgttaagataatgagtcaagtcaactggctcgacatcaattggtcgacgtcacaagttggtgtctcgatgtgagcaataattaattcattcggtttcctaagttgtacttaaatacaacattagttttggtattataagtgcacagaaagtattagtattgtgcgcgtttattggcttgtaagaggtaccacgctatgctttattgagttactttcttgatttattttgtattatttggtatgttcatattaaattcatttatgattttggatccaaacaatgctttcgttctattttagacaccagcctaggggtggtaatgggtcaagacccgtggatcctttcacaacacatctcaacccttagatatttttagcacaaaaaaatactaaatttcaactcaacctttttacccaacccttacattttgtaggtcaaaatgttaggccaattaccaccctacggcagcattgtcttatttcttttttatgttgcaccccttaaagttagtcctatatttgtcactaagcaagttatataacaaagataaataatgatagcaattccgttagttatatatataacaacgataataatatcgattcggctaactgtataataatgattgattaaattttgacattgtgtaatataactttatcaaaataaatgttatgaccttcaaattgttactaatatactactcaacaagactattagtcccgctctttcttaaaaaaattaatgattggtcaatctttatagcgttctaggctactgatgccctcatatagcttttggcaactatggcgaattttcttgaccgcaatactttacatagaactattacgcagccctcctgttacacgaagcagtacaaaagagtcccgtaattctatcgaaagtggagacacaaagtttacgggtgagactctctttactaatcaatgctctaatcaactgtacaatgagtaggcccctccactctttatacagtgcaatccaatatatgcaaggttcggtgatgggcccaataaatacatttgggctaggtcttcatgggccaaacccaaaatttcttaacaagaacaatgctatcatggaaaaaataagtgcgggtatgcgtcacttaggttgagcctattttgacctagtgaaaattagctgaatttaaacatcttccaaatgaagaaccctagctttaatgactacatggatcatggatggaaaattaacgtggaatagaatcgaatcgaatccctgtggccatgtgaatatgtgatgcaaatgatggagccctgcaggacatggaggggacatgcatcatcccaggcagtgtaaagccatctcccatcacatgtgcacaacctttatagcttagcccttttggtccctgccttgcctctctcccaacaaactttgcccagtgctgcagcattgtgtgttgtgtgtgttgtgcttgaggggtttttatgtctgcatatttccaggggttggctnnnnnnnnnnnnnnnnnnnnnnnnnnnnnnnnnnnnnnnnnnnnnnnnnnnnnnnnnnnnnnagactgagtgtccattcaagntcaaggccag

SEQ ID NO: 34335 - DNA, 1243 bp, Oryza sativa
  unsure (1)..(1243): unsure at all n locations
cgcctggtcaatcatagacccattgagcttaaaaaattgttttgccaactgggccccattcaaccctcttagtgtttgttaaaacttttattaantttcccagacagtcgcccaccctttcgacgtgagggtgaaaacttttttcaggtggtcaacccttaataaaaaggcagccaatgatgggtttttttgctccacctcggtcccggcttcgaatattttctatggaaatcatcctttccaattcctatttattgggcatgacctcctccaagatcactctttccaccattttatttcgtgtctaccggaggtgtttgccgaataagtttccacaaattgaggattgtcccttgttttaaagccgccggaattgcgtgtgtgcccggaaatccagttcagacattgttcttccggccttgccaaccttcccttgggggcctccgccctattccgtcgtgccaatttggccaaacttgccacctccccccgtcaataaacctccctccccgatactttaccccaggcgccacattcaggtcctaacattcgggtattatgctaaattcatactaaaattcagttaaagcatgtgtttagttcctaaaaggagttgaaagtttgcaaaaaattgggacgtttggaaaaaaaaagttgaaaattcatgtgtaggaaagtttttttatgtgatatcatgtgatgaaaagttaagaatagtgggatactaaacatggcctaagttctaaatactagtaaaattaaatccaggagaggtcctagtccacatgttaaatccaggagaggtcctagttcacacgcaggttcttcacgttgataggaatcatttggcaaagtagccaggtatgaggtatcccccgaatctgctttaggcgatgactgcttttggcaatgacaactgttctgtaattgtttggcaatgacaactattctgtaattattcattaaagttcgcaattatttcacaggttgtatttagcagttttataccatgcaccagaaaaggataaattcagacattacacgcagctaccggactgaaacgaaaccaaaaagaaactgttttagaatggaggatttgtgggacaaagaaccatcagcggcaattagatttgacaacaaggaaatattcagtccgcatcannnnnnnnnnnnnnnnnnnnnnnnnnnnnnnnnnnnnnnnnnnnnnnnnnnnnnnnnnnncacggactctagtttnaaaact

SEQ ID NO: 34336 - DNA, 7995 bp, Oryza sativa
  unsure (1)..(7995): unsure at all n locations
taatatggcgcaaggatcatccacatgctcgtttcatagactttttttgatagacggcgtctatctagcaaatccggtctacaccaaacaccaagacgggaaaagactaaaaaatattcttagctctattatacctttgccttgcgccatccaacttggggtcaatgcttgagccaagatcaacacttgtgaccatccgattgaacaatgtttatgccaaggtttttaccatcctttgtcaagactttattctcatcacaagcttgacttcattcttgccaacatgacgatgtcattggcttggttaccattaatccatggtgtcattcattagcctcatcgtagtgggacctattccttttcacatctaaaaggagaacattagtctcaacaaatcgattatcatccttcacttgatgaccaaccggttgcatataaaagatatggatatgtttgttgagaattcattaacatcacaagtgtcatatactcgtatgcaagctcaagtgcaaagatccgatataaataataggtgaacaacatggatctaaaacatgcacaataaatgtataagatttgctccccctaaatatatgcatacaaataaatatacaagagatgcaagtgtatgcataattagagaatgaccaatgggggtttatcctatacacatagagaaggcatatgtagtaatgatgtagaccaacataaaacatataccttcatgatctctatgttctcaatgtaaatgagactaaataagataaggctcgagtaaacattagtctcacacttatatatcaataacatggaaatcatatatatgaacctatcaaaaagtaggagataagaagtggtacatatcgttttatctccatgcatttcatccttgtcatgattaaggtccatcacaatagaatgcatgtcttccacatctcattatcgggaaataacctagtagacaacttatgcaaaagagaggttaatcccataaacattggtttatcatctatcacgaaagtaacaattacacaaattgtttaatccaagatctttcaatcttttctctcttgggtgatggataataacccgatataaacaatatagagagatgggatgaaagatgatttcaaatcaagatagaaatcttataataaataaaatatagaataagctccccctcaagatgtgcatacatatggatataaaggaacacatatgcacataatcaatcaagattaatgagggagctcacactatattttggatccacaagagagaccaagttagaatatgtgaagtttaatacatacatctcatcatttttattttcatatccaaatgagactagtcaaagaaaggctcataaaaacgttagtctcatataattagatttatcattaatcaccaatactaaattaaggtacttgaacttacacctgtccatattcgtagtagtacgatgtgtcatatccacccaagagtaattaagtatatttgtgccaaggtcgcgtccagtccgcagtcgttctaaaagaattagatattgtagtacttaatggaaggctgctaacggaactctagtggtgatagtatttcggacagagctattgtacgatgctattttataaaaacatgtatttatcaatggtatttctaaaatttggatatttgttaatgatatttcttggattttctcttaatttaaattttttataggaatcttgtaaagttacctaaattctaaactcaacgtataaagatgtcacattattgtccactaataattattatatcttaaacactatacaagcatactatattatcaataatttattaaatattagagctatgaaatgcaaatatgttaaattatcatctcacataattcatatatttaaacatatctctccatcattttttataatatcctatatatcctcacttggttaatgttatttctctcttttcttattaaaccgtagcacatcaattgtttctagcctttagatgattaatctatggtctaaattatcttccttatttttttttctctcattaagccatgtcatctcttttttttaaaccctcagatgattaatctatagcccaaattacatctctccttttcttctctcataaagcctgaaagccatatcaccttattatcattctatatactatttaaattatcataaaccatattaatttatgtaagcttatgtcgtctagttattttacacattatttatacttattgctatgatactaaactctcgcagcatcgcgtggggtttcatcatatttttcctataggataatccttcgaatttcctatatatttcaaacatattaaagagaccctataagtcgatttccatggggcttttggagggatacttatcagtgggagttttccttaacacgcctttcggatggaagaaattggttgtaggaaaaaatcaagggaaagtttccttccatgctgatttcacatgaaaaccacaggaaaaattccatccaccccaagctatttttttttcatttgctttgtataagaccgtggaaatcacgcaatcacatagttggtaatccattatcagagcaaaaaccatctcttaagaaaaacaaatcagcacaagaccagagaaacacccatggtcctatggtcggtgggagtttttaacaaggattcagaatttagaggagtggggctattaatattttgtttggttgggagatactccctccattcccccccaaaaaaaaagaggtccaattctaggtatgaatatgaatattagattcatctctagaattggattttttttttatagagggagtagaattggatctttttttttgacagagggagtatgagagtttcttttttgtgaaatatagataaaaaaaattgagggagaaactctctccttttcaatgcgcgggtagagtggtaatgcaacggaataactctatactttgcctaaataaattttagccaacccttttcatttaaagatccaaattcgaactaaacttcttatcagttactaccatctataccaacaaattagaccttaaaaaattaaatttccatattaatcattaattttctcgtctaaactttcaatcattttctctcgagttatctatcatcatcagctactacagctcacaggctgagctggtcacaagctcgagtttgtgttagccggccgccttgcccacgggctgctccactgttcacgccgccggagttcgccacagcccatcgccacgctgccgcttccccgagcgctggagctcatgtagggatgtaagtgggacgggtaagcggattttttagtccgcttatctcacttctagttaatttttttcttatatactactatgtaaaaaataaacaaacaaacggatttttatacgggtagcaggatatccctaacctcatgccgtccggttcgtgttggatttgggggagatgaaggtggtactattagtttgagtggatagcaacgatggggaagaaatcaattactgtgcatttcctttgagactttttcctgtgctctgattgttcttatcctttatattcctctagtttgtatttatttgtttttcattggattttctttcatattcttactttttcctatcttatgttccgaatgagccctcagttgtttaggagaaaagacattaaagaaaaggaagataactctggaatcaatacattttggaggattggcacaagattcctatggaatttttttcctttgaatcctatgaaacgaatacacgaatagtgtttattccagaggaattaagaattttggtgcatatcctccaaacctaaacgtgcatcagatcaaagcaatcgaatggtgaaataaattgccacaagtgtcatcgctgtgaatcaaagcatttccaacaaccatactcgtcaaaccatgcagagatatgattaaatcgcccccatatcctcctgagaagtttatttgactaataactactactagcatgttaactctccagaatcagtgtaatgatagagagtagcaagagctcatgacaaaccacatgtctgcaaacatatttagaccagttcagcacagctgcaagatgcaaatgcttggttcatgaagcaagtaaacatgtttacagcaagaaattgtatagcatctttttttttctgaatcatctactgccaaatgctctttcagaagatcattcaaacaaatggcatacatgggttaaaaaaaaaagaacagatgcttaattaataccttgtgaggcataatataaccctttctggcatgccttgacaaactcctgtatccacagaatcactcccatcctatattttacaagtcactggtatttatagaccttaaggtgcttacaaccatgatgcacattatgtaatttgcagtccaaccatcactcttttggtattctctaggttacaagaccagataaattagcagaacttggtcctgttttggtgagattaatcagaatatgaaaatgccaaggccaaatcagacatgttcttgtaccatgtaatatcatggtggcatgtctttacaatgcactcagcacttgctcacttccttcttttaagatcttcataacagagcttcatgagaatgcacacacttataatacaaatttaaaaagcattatattgtctaagcccatactaaactataaaactaaaagatagccactctctgtctctctgaatccactgtatagttgaatataacaactcaaacttcacgaattcatttacattccaatatatatctaacaactgtacgaaaaagttttcttaaagatgaaaaatgacagaagtaacaagcatggatttacatatcaaaactggatttgctagttgataattttccaagattgattccaagaggagaatattatttattttctttcatcctgaaatttccaacattacaggaaccaaaattaccttagtgcaataaaaaactgttctggaacaaaaagaaccacagcacattgtacctcacgccctcacggcatatgcttggcgtagaatcccaacgtcaagcatatgcctcttgctcatcaaagcgtatggcgtttgctcttgatggtaaggccagcaaaaatacagatgaactcatgagctaccgctttgtttaaacactaaatcatttcacacttctaatccttaatgcatcaatatgtaggtacaatgaaagctataaactcataataaaccaaaacttaatccaagtaaacatcaagaagaattaaccaatccagaacaataatccataataagagccgaaagcaaaccatcccaagcatcttaattatcatactctcgttcctgaacatctgaaatgtcaatggtctgcaaccgctcttcctccggaaccaaacaccaatttggcgactgcactgccctgagccacttaaagtcatcaacattcgcccaattaccggtctcctcctcgagccccgcatccctcaaatcctccccaatcccttcatacttgagagcatgcggcgcgaacctcacgccgcagcaatcctcaatgatcggcctgctcctcaccctcaggtagaaatccgtcgctgtcgcctcgtggatcctgatctggtgcgccgccatcacgaatgcgcagcgctcgacgtcctctatgagcaccgagccgaacacggcgcccacgaacacgcggcaatccttcagcttgtgaacgtgcagcgcccggcatttgcccttgaggtaaacctgacaggagacgagatcagcgagggtgaaatccccatccttctcgtcggagaccctcagatccttcaccaatgtggcgtccctccggccccggaacccgagtcctggcaggatcgcctcgacgctggggtttggctggtctggaggcggcggcaaggtgggaggaggatcttgcggtgggttcttgggggctttgctcttgttcctgaaggagaaggacttcttggggcggagatcggaggcggcgagcctgtgggcggcgcggaggtcggaggcggcggcgagggcggagcggagctcgtagggtgggagggagtgggaggcctcggcgacgaggcggtcgaggtcgtcgatggccgcggcggcggcggaaagcgagggctgcgcgtcgtcgggggaggagcggcaggcggagagggcggactcggcggcgagcttggcggcggcgaagcgggagaggaaggccgcgacgggggagtcctgggacggggcgggggcggcagcgcgcttggagaggcgctccagcatggccaggtgcttgcggtggccggcggcggcggcggaggtggagggtttggtgtggtcgggctccggctccatctcggcggcggcggcggcggcggtggatggcatcgggggagagcaaacagaagtggtttcgctactgagaaaatggtctgacttaatttagtagcaggtttaataaatttcgttgaattccaaattggaactttgacgaatttcgtgaaatttgagcggtttagagggagaattttcagaatataccacccaatacgcactgcttccagaatttatcacccaattcacattactttcggaatatacatcactagagtgtgaattttcttcgttctgtaccactccgtcccctggcgtcagtcgtgtcgtcgtcctccgtcctcccggcgccaccgtcgtcagtccgccgccgctcgcgcccgcatcagctgcgccgtcgcttatccattgccgctggcgtcagccccaccatcgcccgtccgtcgctgcccgcgttagccgcgccgtcgaccattcgtcgccaccatcggcgcacgcggtgaagggccggaggagaggggagcagcgggggagggcggagggcgtcgagctctggcggctcgaggctgcggtgccggaggttggactggcgatggctcggggcgccatggcggcagccggagcggcgacggctgagctcggggacgacacgagcgagctcgccagatgcgtgcgggcaaacggcgcgtgggggaggaggagctcgccggcgtgggggaggatgagcttgctagcggccagattgaaagcagtgcatattgggtggtatattatgaaaattctcgttcagaggagctacaaaatcccgaatattaggggacgaaattgtggaccctacctcggactcgtgtagtctgtttagcggggcacccgaaattttggctgtaaattaataacgtgaataaatcaaaattaaactataataccatcatttggaattatcgacgggttatatccgcagacggtatttgtatagtataagaatggttgaaaccagggtataagcagaggtaaccgagatgggagacatagatttttatataagtttggtttccttaactgacaggtaataaccctactcattttggccaaaatcggtgtcttttatatatcggtatcacacgagtagatgtttgaaatgacctaatctggactttgttgacttggcgtcatagaggtctcacacctagtcgacagctagtgtactcttattcctcgaacatgaactcggtgagattgaaggtagttatagatccctcatgtctagctatgtggctgctacattgggtttgtctagataggtatttgcctctgttggcgtgtcccctcttttttttaggaggtcttgtatttatagtgaagattatcttcctctcccagtagaactcggagaaatataacaagatacgaactaagaaaactttatctttcccgattaggactctaacaccttatattccgagaagataatttccttttttatccgtgtatactattaggtatgttattttcatataccgtgaacccacatatatagaggaggtatgctttatnnnnnnnnnnnnnnnnnnnnnnnnnnnnnnnnnnnnnnnnnnnnnnnnnnnnnnnnnnnggtagtcatcttcatttccagg

SEQ ID NO: 34337 - DNA, 8788 bp, Oryza sativa
  unsure (1)..(8788): unsure at all n locations
nttatctttgtactggtgatgaagcgaaacaagcatcatgtctaagtccaaacatttcggatctctcttcttctcctcaatcncaaccacaacagttcaggaggaaagatggtcatttcggcggcgacgccggggtaccccggcgccgctacaaggcgtcctctgtggcgggcgcgtcgacgcggggctgctgctggagcgcgaccgcggcgagggacggctgaaacttgccaacgtagtagttgaccgcggggccggagtagacggtggcctgcggcggcggctggttcttgccgacctggatgaggatggacgacacgccggcgacgaagacgagggcgaggccgccggcgatcgccgccgtgttctccgacccgtccgccgccgcgcccgccgcccccgagctgatggcgctctccgccacgtacaccgtcggcttcgcccacaaccaattcaggtcagaagaaaaataaaaagaagatatttcttgaccacatttaatacgcaggaaaaatccgaaaaatttgaattaatccgattttttttaaaaaaattctataccgcatttaatacgctcgcgaaatttatgggcctgtcggctgcccgggctgcccggcacgaacagaccgatagtttaatcaatccgaaattttgaacaaaacgagatgaaactgaattgaactttcaaaaacaaacctgatactagacacaccttaactagaatgaatttgaacagaggaacatgttcagattcgtgatgttacgatgtggagtactatgtatgtgagtacgtttttttatgggacataggaaaaatacaaaaaaaaagaaagaaagaaaaaggaaaatacctcgacggagtagatgttggtttggccggcggtgtccttctcgacgtagccggtccatcccttcttcttgggagggaaggtgccgaccaccttggtccgctcctccgccagccactccgcgctcaggctccccacctccttctccggcgcgcactcctcctcgttgcagtcctccgccgccggcgccggcggcggaggtgaagaaggcgacggcgacgacgacgacgacgaggcgttgcaggacagcaggaacagcctcccccctcgcgcgaggctcgccgccgccgacgccgcggcctgtggcttggcgggggcgctgctcctcaggaacgcgcagcagctggtggtgctcgccgacagcatcgactgcgccgggcaagccatctcgctgcgcgccctcctctctactctctccggaccaagaagaagaagaagaagaagaagaaggaggaggagaaagggatggcgtggctagctagctagctagttggtggaatggtggagtgagcggccgcagctagcggaggagggagacgagggagccttttatgccgtcgtgtcgcgtcgcgtgcgcggcgaggaggaggaggaggaggagaaagatctgtctggctgtgcgagggagaggatgggattacgtgggtggagcggggcgggggtgtggtgggtggatcctccacgtcgcctcagcttggtctgtgtgtactgtatcaacggccaaccggcaaccggtgaagccgtcaatactcaagacagagaccccaacgtgtctgcctctgtgcgcgccaatgcctggaggctgcccgccactgttcgtgtgcttgcagcttccccggccgtctctcaccggggaggcgtccaaatataatccttttagccactaaaatttatcgtaagagataataatttttcgcctatattttagttttaatcaattgtaacattttacaatttaaagttttttacatgcatccttttcttaaccaataacagcattcctccatttaattctaccaacctttttattatactcgtgtccaacactccgtactagctaaagtgcacctgtatttttgtaaaacacttttattagaaaattatgatgctcgtactatcatgccatgtttagaaaatgggtttggatatgatttcccacccctcaaagggcatgtttgaatcttcatccattcttctcaccccgttttatcctatacctccattcgtttttattttccaaacacaccatcagtgttttcttgcttgatgttccttactgacttctttggttccgaccttaggaggtatatttggatagcttttagatcatgagaaattgtgggtggaaatttgaccggagagaatctgaagaataaacttcttgtttttctcgattatacaactataacttctcacaatctagataaaaaagtagaattgtctacaagagcttccctcggaatcaaaagcaccctatacaggacttgtttttttactttctttccttcgttcaccggtacaaggcaaggcgaaggtttcttatgttaatatttcgcatatgtccctttgtttctaaatataaatatttttaggttgtttagaataaaagaaactttttatccttcattgtcttattggtcaaaacttgaaatttaatgttgagttaattgcggtttggactggatttctttatcaaagttgcataatggactaggtctcatctcatattttcactttaaaccagatggacttacaaattgttgcaatttggacctgattgatgcatgagccacttgatgagctcttctccatgtcctcaaactgaaacatggttgcacgaaggaaggatggagctaggcttgctcatcgtcaaccataaaccgtcgagatggccgcctcaaatcgacgcaagcgcagatccgctcaagcttaggggctatgtggtgcaggagcaatttgacgagatgcgaacaatgcgacggagggtggcacttcaaagtgctctgttagttattgcatgtttgagctttcacatcagcctagcgagctcaaggagagagagagcgcaagggaagagagggaaagatggagaagaagcaaagtgtcccaaagtgaaactatatgtaatctttcccggttcaaactaaaaatgttgtgctgctcctattccaacttgccacatgggtaaaaagaagtggccctatatgcaatttactcttttaagttgcttgattcttctcgtaagcacatgacttgggattctataacatatctcacacttcccttctaatccacctacctctttccatctcaaaactctcctcccctctcactctctccagctaagcttagctttccactttgagcgaccattatcacctctctcatttcactcggccatctatcaatcacactatcttacctcaacttcctcgccctttcttcttctcgttgaaatgcatgtaagctaatgaaaaatgtcctcatgccatcgccagttgaatgatatgctttctccattctaactccattctaaaataagtgggtttatttttatcctcttgtcatttgttcaaaaacaagttaatttctatctttggtccataaatcaatgaatttcattacttcaatactccttaactacccacccatatactttggtctttttctgttaacaagatgcactttattccctctctctccacgttattttgtacacccaaggttaaagttaagagttattttaggatatatggggtatgtaccaacattgtacggcacgcttgtttcaccagtgtctactgttgaccatggattacataacaattgctaaccagaatggcacacatatacaacattttactcgtcttgcgttgtgcagctaccaactagtaccaaattggatttgtccttgccactttttctgaaagtaaaatgtaaacctcaacgtaacatgtcacattgccaatttggcaatttccatagttcacgtaactggggctaatggtaatggtgctatgtgctgcaacaaacttacaaccacatgcatcagtgcatggcctcaaacaccattcagcagttctacatctaacaaggcacatctcaagtgaaaacaatataatgatagagaaatgtatcccttgcgactgataaatccaaaaccggcataacatcagcagcatatcagtttagcaactcatggttcctgaggctaataccatgtttacatgtaagataagttacactgggtatatagctccaaaaactagctctggtagcgctctatcagtccagtgtaaggctgtaaaccaacaggttaattggttttgctacctagtgatgattgctcaaagaacagccatgaggattggctaacaaataacataccacctcatcagaccttcatatatgttcctctgaaaacaaaaccctgtcatcgagtagctagctcagttcccccacctgcggacaagctgtcctcttggctacttagttatccttccatttgttgacatacttcaggaatgacatggatgggttatcccttggttgagcccggacacgtgtggaacggcgcaatacagcctcttcaagcaacaatttgtgtgtgatttcttttgatcgtttctccagagcattactgtgttacagaacaggaaatgattagttgaaaattgattggtgtagtaggaatcaaccaatatatttctaactacttatgatacgaataataaaatatagcaatggtaaacatcatagaattatacatgatagcagaaacaaataaaagtttcgatggtagtcttcttccagaatcaactagcaggtaatttataagagaactcttcaagtatcatcgatgagatgcagtaattattgagtaagaggacagcaaaaccagtatacacagtattcattttgcagaaaaatagtatgtgaagctacaaacaaaaatattatttttcacgttaagaacaagtgtaacgttagcccctttctacaatcaacagaaccaaaagttctaagttgaccaattgtaaggttcagaaagatctatgtaccttatcttactgtacaacttgtccagctgccgtttgagagctctctcccttaaaccttttacgttcagtgagctcattaacacatcgagctgtcattccaaaatatcaaaatatgatcacgactgtagcaacaataaataacaaaaagaaatcaactagagcaaaacagtcacctcttccttagtgctgtagtatccccattcttttgaatctgcactttcaacaaaaagccttccttcacgcctgaaaaaccaatacctgttatagtgtctgtcttttccaagggggctggaacggatggataatttttcaatctctgtttcgaggtgctgtacctacaaaaagtagggagtaagcataataatcaggctcactaccaattgtggtaaacaataacagaacatgggttaaatacagagaaaggtccatcacatgcaagtacatggattgagaacagatgctcaccccatggcgtttcccttctgtcttgcttcgagagatattgttcttatccttttcttctttccccttaccctgctcatcaacactctcattgtcatcttgcaatccatcaatgcttgagttctgctcatcctttgcctttctagtactctctcttttagtcgcagcgagcgcttgccgctggtccacccgttcacttagtttctctcttacaggagaagttgtaatagcttcttctactagttcccggagaatcttaagtttgatatcagtatcaataagactataataaccctttcttactgttgcaatgtttctggtgagttcttcagtttttgtcatttccaagaaatcacagagatattcagcccatgttactaaagtcacctgataaggaaataaaaaagggattaagaaacggtttcatcaatggagaaagagggagatcgagaaatgggcatgagaaaacctttagcttccgtttcttggtccgcagaatagtgaaatagtcaccttcatccttaataagcaagtggaatatagctgtatgtatttccacaagaagtgcattgctttctttgtggcaaattgcattctccaaatctaccagtgaaaatggggatagattcagaaccctcccgaaggacaagcagaagtcccataccataaggagatcgcccacagaatattttggtactctaaaatctgtagccagaggaggtctcttcaataaagcatgatcatctgcagaaggttgtactaagagatcatctattgggtacttaattggaacatttatgtgttcctcatctgcaaatcataccaaaaaaaaatcgataagtatcttggaagaatgccatagccaaaaggctgctaacagaacaattgcaacaaaggtgccagattcagatgaatcaccgttcttcatcttttttttgggatctcccataggtccatcctcacgtcttttcctccctttcttttgcaaaccttcaccaaactagacaaagaaagcaagtgttagtattgtaacatacccaaggaaataaaggacagatgaaaggggcacataaccaactcaccatcatgtcattcgggggctcaatgggtatgccatatcttttggcaagattttcatgtataacccatggggcattttgagaagttgcatctctaataaaaatcttcagcgtattcctactaacaggtggcctccggtgaatcaagtcttcacctttgatcactgacgtactgatgatagtcttgtccctaagaagccaaccaacttcatacatcttggtgccatcagaccctaaaatcttcaaaatcctgcaagcagcctctaaaccatcctgtttagcatataattctaatccttcaaatacagcttcctgcaggctagcatatatcttctcaacaagctcatataatccaagagtgcctgaaacaaaaggtaaaatgaagtattatttccaatctaattaagtgaaacgtacaaatgagaagcaatctatgatgcttcttgaatgaagcgcatatagtaggaaaaaggtacatggatactttagaattgcaaagcataacagtaagcatgcatgcctatttattacaggttgtcatgtcagcagcttagcagtccaagcagagaattcagagctataccttaatatcagtaaacatcaaaaccagatcactaatgcaaaagatacttagattagaaagaggttggtatactgtactctcttctagatattgttttagaacacatgcaataaaactattggaatattgataaagaaggtaagattgtcacactagaaataattactgatcattacaagttttactaacatataattagataagttatgatagtggaaattatgtcgctgaaactaataagtagaaaagaacggtaaaggatatacaaaagttcaaacaattaaaagaccaacagtttcacatgccctttttttaaaaaaagcaaattgagtattagtatgtctagtagctttgtctacagggaaaaaatgtaagaactgagaaatgttagaataacaaagaagaaaacaactgtaaccaatatactatcaagatccaggagcacaacggaatttcataaatattacatactgtattgaatcatccgaagaacaggagccatcagttctgtgggtaatttctgagcctttgacactgcatgatgctcggagaccaaagcttcttcaaaagtcaagtttgattttccggatatcttacatgaccaaaccctttgccgataaagattcaacctgtttatgtagtctctaattgagttgttaaggacacaagcattggagaaatattagtgcacatactgcactgcaaatgcaaaaggcatgaattcctgcaatgccacaattcagctgcattggcgtcatgaaagaggatactggtaatctcggaatatctcccttgtgaaccgaatttggaaaaccttctccttagaatccaagtccttggggggctcaagtaaggagaaaggtttcctcttgaaaagaggcattggacctccgatccaacctacataatagcaacgcacacggtttacatttaaatagttaaagagttaaccatgtgaactggataaagaatctataatactgccaagaacaattaggcaacagtgcatgaatatttagatgatcacgccacattttgcgaggcagagaggggaaaagaccagtctcaagccgcgcagatatgcaaaatgtgatgtaccaatcatccaagcaggaaattcagaacccagaacaacagattagcccattcgaatccaaccggccaatttccgatgtgcgaatcagcaaccatagcatttcacttaaatacatgatgagtcgcacaagctcaggctgctctttctctcacgcatttgcccccaaaatgtgcaacgcaaagcattcctgaccactcagctcacgaaaatggacccccgtgctccagaatccagcattcggaaatcctcgcatcgctcaaaatccccccattctctcaccccccccccccaccacaagaaatcccctcacccaagccgccttcagaatccagacaacaatcccctcgccggcgcccaccactgtgaaacctcccgctcccgtcctggcatcgctcgagggtggcgtgaacccgaccacctgaccccgcgtttgaaccaaccacgaacccccccaaccacagtttggtcgaggaaaccaaaacaacaggaaaaactagggcttcccgatctcaccgacgacaggtcatgcagggcgggggcacaacgccacactgtaccgtaccgcaccggaacaagcgtgggggtccccgggaagccctccaagcgcccccggcgccgccgaagacaaccgatctgccccggttgccccaagcgtttgg

SEQ ID NO: 34338 - DNA, 3687 bp, Oryza sativa
  unsure (1)..(3687): unsure at all n locations
agctcccagtangatgacnnnnnnnnnnnnnnnnnnnnnnnnnnnnnnnnnnnnnnnnnnnnnnnnnnnnnnnnnnnnnnnnnnnnnnnnntttttctttatctcagaaaaaatgcaatgcaaatatgcgattaggtttcaattttcagaagtctcgggttccattttaaaatggcaacccatatattttgattggtataaaatactagtcattttattattaccgtgacaatttgtcatcttaaactattttgcacacccctagagcaaccacaatgtataaaaaatgtgaccttaagacgatgtttgcacttgtaaagtgggccatatacattgtggaaaatagcattagtttagggtgtacctcatgcttaagatctaccataagcaaaaagaaatatttttttctctctaattcactttatgaataagagatgaaacaattctttttccattgtatgtggacttatcttatggctaaattctaagagcaaccgcaatgtatactaccaaagtggataataacgtgggcccggggttcaggtggtaacagttattacaaagctcacaatgtgctatgcctattctgcaaattaaggtggggtccaccttaaaaataatcattgtaaaaccatctcctatagccatgctcgtacgaaaagattctcatatctacagaaaatattattctttattgtcttgttaccggcagtagcacaatggcccggtagtagttattgtctctatccacaatgcttcttacctggctataagcttatattaattgcttgttactccctccattccaagttgatctacatatagttttttttaggttattactaaatgatctacatatttgtattcatttattagttctatttgttatttgtgcattggagtaaatggacattgatgcatgcatccatgcacacaagtatttataacccacatacaatatcttgatttgctattggctaggaaacagtggggatgatgcatgcatcgagtttgttgctagagtaaatatagcatgagagagttattagcttttcttggtcttggtgtacctatgaaatatgtagatcaatttggaatggagggagtacctgcttttgttcaacattgtggttgccctaaccataacattgtgggcatggctttaacaatggtccactattcatagggcccaccttaagattacactgcaccataaacattgaggatgcccatagtcacgtgaaatgactattttagttttgctcatggatctctatacactccctcggttcgttgctcgtcggctctagaaggggtttctgtagctgcaacatcaccgcccttcttcgggtctatttgggaagtttctgtagctgcaacttctcatataatcaaaaatcttaagctcccaaaacaaaacttccgcagcactgtaaccagaatatttatataactactttttcacgaagaacgacagtgatggctgaacatttgtcattgtgcgccatagacaaagccggagggcaccatgttaaagctagcacttcttgtagcaacacttatcaacatccagaaaggcatgcatcatccaaaggtgtcggttattgaagacggtgtgcatacggaaggatatattgggggcagttggcagtgtgtgacgtagcaattaccgtcgtagcttctccttctactttttttttatgtagatgccctaaagaggtagagctggggatggagggaacaaagagagggtaagccctgcacacgatgttagcccactgttttttcctcggcgaatgacaaaataggtggctaatcagtgtaaagcagttaaaatgaaaaaaaagcatcaatgtgcgcgacaaaataggtagtattatatctataacaagatacagagtgacatttatggatgcatatccttcgcattagcgtctgcgattacataggaacaacgctgtgcattacgctaatctgagttgtttatctgaaaggaatggatgtgatttcttattcctcatcatcttgctgctcctcatgtttatgggcatcatcttgaaatgctcttcgaccggtagctgaatggatgacactcatctgtctcgctccatgtttgattggtgtctctctaccctcgatgccccgccgctggcagggccatccattcagcgcttcgactttggtgttgtcgcatgccttacctcgacgaatgctggctagatctcgtgacgccgtcactacactcttaacaacccgactttggcttccctgtggcactgcctcggcgtcgttgtctcgactatcaaatatgactagagcatgacgaccgtgccgagagagcaagaagagatgaaaagtttcttttttgttttttattggaaaaaatctcaaagtaatcatgagcgcttgtttttcaatggatgtctcggatacatcataatccccaaaagttgcccctctgcggtcataacactaacactaatgcagaggatccgtgttcgacattcatcataaactaacgactcaagtggcaagcgacatgcagaggatctgtgtttagcttggcggcgacatcctgcgtttgggctctgccgtagttgttagttgtgtagcggtggttttcagccgtttttcctgtaataaaccgtgcaatggtatggtttttgggcccggttttccttataaactaggtcaattctcttcttctaaatataaaagtggaacaaacttccgccttaggtttaaaaaaaagactcaagtggcaagccatcaattttatcttctaactgtggattagatatgtttctcaccctatatggttagctcacattttgtcgtatttgtaacgtgtaaaaaatggtatataaacatcaatgttaaaaactttaatattattattcagttctgttacaaatcacaaatatttatatagggactagggaggtagtatattcatgtcagtgtaaggataaagcatacctcctctatatatgtgggttcacggtatatgaaaataacatacctaatagtatacacggataaaaaaggaaattatcttctcggaatataaggtgttagagtcctaatcgggaaagataaagttttcttagttcgtatcttgttatatttctccgagttctactgggagaggaagataatcttcactataaatacaagacctcctaaaaaaaagaggggacacgccaacagaggcaaatacctatctagacaaacccaatgtagcagccacatagctagacatgagggatctataactaccttcaatctcaccgagttcatgttcgaggaataagagtacactagctgtcgactaggtgtgagacctctatgacgccaagtcaacaaagtccagattaggtcatttcaaacatctactcgtgtgataccgatatataaaagacaccgattttggccaaaatgagtagggttattacctgtcagttaaggaaaccaaacttatataaaaatctatgtctcccatctcggttacctctgcttataccctggtttcaaccattcttatactatacaaataccgtctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34339 - DNA, 1751 bp, Oryza sativa
  unsure (1)..(1751): unsure at all n locations
cctccaccccaccgangcggcgagatatgttaaacngntgcggcgatacaacaccaaccgcgcggatntttaataactctccggttgtaaatataaacatcctccnttttctaaancanccccccccccccaggggcttgaaattgatggacaaccgactcggnacccccactattttattacatcatcatcagtcgattacctttatatcattatctacattggacgtatagccgattgctcaaaaccctatcgctaccggctggtatcggcatcggctatcggctggaactactccatcggcttgtcagccgatcggctgttttgatctactatttgtatatcttgtcagtgcaggatcaaactgactggtatgcctgcatctcatcaagatttggacctgcacaggagctaagcagatctctcaggccggtgtgttcgattttttcgtcaacacaaattgaaaattatgctctcgcataaaattataaaattagatttagttcccataaatatatgtttgttgcaaatcattgtcatcgagttggtatcgataccttgtatgcccgccgtcgtaaaatataaaggattttgcatagaggagatatttccaagaactataaatctactctaaaatttcacatctgtccaaactgaacggggggagtaagatataacccattatttttataaaataataacataaacatgtcacatcgttatctttagcgatttagcgatttgttcgataactgactgatatatggagcattatactccctccgtcccattttaattgcaaccataaatttacgtgtccaactttaatcgtccgtcttattttaagtttttttcataattagtatttttactgttatgaggtgataaaatatgaactttatatgtgacttatgttttttaaatttttcaaaaattttttaaataagatggacaatcaaagttgtacacaaaaaatcatggttgcatttaaaatgggacggcgggagtaaattactagcagcaagcagtagatcgagtgattaattaagcatttactccgtaatttattgatttaattaactaactaattaatcaagcacgtcatcgtaattaatcaactagcaacgagcgcacgcaccgtcatcctgatctccgtctttggtttggttttgctccgcggcgtgtggggcttgtcgtcggagaagacccacagccgcctcaccgttccgtcgaagctgtacctcgagctgttcttcacgtcgtacggccactgcagctggaagttcctctcgccaagcctcaccgccgtgaagccgtccgtcgggtcggccgccgccggcgacgacggcgccgccgccgccgccatggccaccgccaacaccaccagacaccaagcacaggaggaggaagaagccatattaatttgtagcttcagttgctttggaatttggtaggaggtttctgcagtttatatagagctcggatggtggggattaatttgtgatgccccttacgttcgagaggcccttttaaaattttctatttcctcgtttttcatgcgcccattaagactcatagtactaaatagtaagtgtgctttgttcaaataattattaaaaatattctgaaaaatcatagtattaatttattttaaagttatttaaagtaataattaattaatataagcccctggcagatggggaccctctagagtcgncatgcnggcngcnagtacagcantaattcccatg

SEQ ID NO: 34340 - DNA, 10096 bp, Oryza sativa
  unsure (1)..(10096): unsure at all n locations
gagggcattgattgcgagctcggcacccgaaaatttatacatatactttcaatagtattacatctacgtgcaaagtcgcatcttcaaattcattctacatagagaataacaaaaaagataaaattctgacaaaattgcaaccttaaaactgttagattttttgtttttttgttacagctaaaatataatgaatttgacgttaagattttaacactaggtataatacaattgaaagtatgtgtatagttttttttagattttttagtgatattttttagttggtgtgcacgtgtgtacacgtgagggcctgtgtgtataggatatgttgccagggttaggagttgataggtaccgcttttatacgaagccatatgcaattgggctcttccgtcacacacgtaagatggacaagttatgaataagtccaccttggtcccccaactatgactcgaattctatttacatctttttaactatactagcaaatatgcccgtgcgttgcaacgggtgaaaaaacgtaatgataatatacgtttttcatgcataaccatgtcgataacaatcagaaaattagaacaacgaaactttattttctagcgcgttttcttttgtgcttttttctgacatttttccctcacgtgtttttttaaaccgtttttattttctcgtgacattttatagttagattagattagattagagataaagaagatatataaatggactaaaaaacgacgaatataaatttgacttttttcctccgcgcttttttccgtctttttaattttttttctcgtacatttcttttacgaagggtttttttcaccactttcacatagtgtcaaacctttctagatataataggattcgattttttttaccgcatcacgtataattcctttttctttagaaacagacaattttttcgcccttttttatcgcgtcaacggagtcggaatcgttttgattttttcccttttattggatcggacagatttttttttgcccggtttatttcacccgatcgattttttttaccgcgtcacatataattccttttactttggatttttttcgccctttttttaccgcgtcgacggagtcggattcgttttgattttttttctccctttactttggaattttttcgccctgttttcaccacgtcgacggagtcggattcgttttgatttttcccctttttggctttttttggataggaccgatttgtttttttttcgccccgtttttttatcggacttttatcttttttttcgcctggtttttttattttttttaccgtgtcacatataattcctttttctttatcggaaagttttttttcgcctttttttaccgcatcgatggagtcagattcttttcagctttttccttttcttttatcggacaaatttttttttcgcccatttttttttctcctgtttttttcggatcggactatttttttcttttttcgcccggtcgatttttttaccacgatacatataattcatttttctttggaataagaccgttttctttttatttttttaaactctttttaccgcgtcgatgtagtcggattcgtttcggtattttttccttttttttcctttttttttgtcggacatatttgttttttttccgcccggttttttttccccaggtttttttatcggacttttctttttttttcgctcggtttttttctcccgttttttgacggacgatagaagcacctagagaagtgttaagcacctagagaagtgtttttttttcttttctccaatccaatacagatcggatcttttttagggaaatcagattttttttctccagggaatcggactcttttttttcgctttttttattcattaaacggtttgtctctgggactttttttccctttttaagggatcgggtgttttttttgccagggacgggtgtttttttcgcccgttttttttttcactttttttttggatcggactttttttttcgtccggttttttgatcggacaaacttggttttttctgcccggttttttttcacccggttttttttacggacgatagaagcacctcttattttttaagtagtagtagactagcaaaatacctgtgcgtgactgaagttagatattaatgatttaccaaaatatcatagtatgattataaacatcggctatatgtagagtgataaacaaaccatgtttgtttttcacaattaatctaatttatatttgcgtgatgtggatgacgcttctgacgcatgggcctaacgattatagcaagggaggaacaaatgatgaacaattaaagtgattgtttttgcatagaaagtgattgatgaaaatttgagcgatctatagaaaaatcaatatttttaaagtacataatcctaatgaaaaatgaatggaattgaccaaaggacacatctgaatataagtcatgcggaaattatattttcttgtaatccatataatgtaattgtgagaatatactcgattttctatgcattgtacttgtgagagctgaattttgttttaggttaaatatagtgtgcaacagaaatctgtaaaatcatattagtgggagcgctaaaaatagcagaaagaaaagcggggcagacccacactcctggacgaaaagggaaagaaaagctaactgaactcctgtactgcaaaacttttttttgtgtattttggttttctttttgtattttggaataaaaaaatatgaattataaaataaataatattggaagagagtaatattctccaatagaggctatagtccacataaaaaataattaatattatttattttagtccaaatttaaattctatatcatgaaaaatatacaattacattttttgttgactccatttagatataaataatttaacatgaagaaataaaaactatatcaaatctcatcaatttttaatggctcaaaataatgcttatattaagtttgttaatggagaaatagtttaaatcaactcagaatagataaaactcaattaggcccataaggatgggccgaatgtcttccacaacttggcctgttaagtgcacataacccatgtggcccaagtcggcttaaatacgctgagagccgtcggattcaatcgaacggttaggatcgctcgatatatatatatatatatatatataacattccatgttgaaaccctaaccctaaactcattatcctccctctccaaccgcgagtggcgcggcggcggtggcgacgcgtccaaggcgaggcggcggctacctgccctaccacgagcagcgacgacgatggtggcggcgacggcagtggctacctcccaaccacgagctacggcagctacctccctaccgcgagcagcggcagcgacggcggcgtcctcccccgtcgtgagcggccaggatggtgccctcctccattgctagcggcggcggcggcgaccggcgatctcgcggcggaggcggggcggcggctacttgccctaccgcgagcaacggcggcgacggcagcgatagcgatggctacctccctaccgcgatccccatcttcctcagcggcggccggtgatctcgcgactgacgcggggcagcggctaccttcctcatcacgagcagcggtggcgatggcgacgccctcccccatcgtgtgcggccacggcggtgccctctcccaccgctagcgacggcgacgacggccttctccaccgcgagcggccgcggcggcgtcctccgatgggtagatccggtggcagcggtgtcctgcgggtcggcggagcggcctcgacgacggcgcgtctcgaggcgctggcgctcgcctctcctccccatcttccttcgccaccaccgcccatcctctcgtcggatgacgagcttgtcgccatcgtcaaaacgataaatcgaggttgctttgtgattaatttgcttgattccattgatttcaaactttctatcccgttgatcatcccagctgattttattgagttcgattctgagtctgttggtttaatttgtagatgattttgtatcaaactcttgttttttttttctttggccattgtactgacctaactgcgctaggtcggattgacggacccaaaaatactgtgatgattggaaaaatacaaatatttatattagttatagatatactattgcgcgttgtaacagatgaagacaacttttataattgataaaaactcccaccaatttaaacgataaatgtcaaaactagattttggctaatctaaagtgggtagcgaacaagcagaaaagtggatgggttatgatacaaggaaatttttacaggttcaggcattctcgataagaaataataccctactcatgtctggggaaatattccgccgattgtgttatcgatctgatgatcttatgtgtgattatgccccaagaggcatctaacccttctttagatagtctgaagagctagcattacaatgcaagactatcccttacggttcagagtcctgttaatgccaaaatttggtaagccccgaagtcatcatcggcccagagtcagtatcggcttcagagttatggaatcggccgatgggatttgtcaagtcgccagcagtcggattcttgatatatccagttaagaaaatttatctagaagagaccaagttcaaggaggatgcggcatgacagtttatctattaattaggaagagtctgttagtttccttctatctttagaaaagtgtgtttagtatccgataaaaactttatgttttctttttaactttaggaaagtttttcttgtccaagaaggactagtgtctacccatgggtactttaggaaagtttttcttgtccaagaaggactagtgtttacccatgggtataaatatgtacacccggagttattgtaaactatctctatagatcaataaaattcggcgcatctccaccctttttacttttctactttttcgacaagttcctgcttcaagttagggcattggctttgatctccgacgatgagtaaaacttgctatggttgtttacatcggcagagctagggctttgacactttgatcttgtcaatgtatgcacctatttatcatatatcttagtttatctagtttagcatcttaatttgatcatatcggatgagattcgttttagggtttatgctggtatcggctaaattatcttgctagattagattaaataaggtatccaccaccctaaaaaccagttaaaggcttgattgtctacataatatgtttcttttcatactttgcactgcatcagccttagtcgtgcttagaaccataatctctagcatgctttttgattttcaataagggtttcatcggggtttcagccgatgagttatctggacgttgcatcggcttataaggattatatacaagatggatttagccgattgtgacaaagatttcattgtttatctaatcgtttggatttcatgacatcggtcctccagccgatgtatgctttaaccttcggatcattgtttattctatcatattattattagttgattgatttctactggattatattgttatttatcatcatcagtcgattgtctttatatcattatctatattggatatataaccgatagctcaaaacactattgatatcggttggcatcagcatggactgaactactccatcggctccttgctgctcctcgttgacctcctccccggcctcctgaacttgttctctaagttcctcttcctcctccttaacctcttcctcctcaatctcctcttcttcctcctccacaacctcttcctcctcaatatcctcctcttcctcaacttcttcctcctcctcctcctcctcttcctcctcctcgtcgctgtgaagctgctcgtcaagtgataaacaagcaaacttttctgacatgactatgtcttgtgcatcaagtagtgatttagttgtgttccctctgaaggaaatggaaggaaataggggatgactgggtgcggctgcacaactccggtggcgatggtggtagctcggttctaagtacgacattgtgttttgtttcaaagttttctagatctgtttttgtttaggtgataactttgattgatgttgtttgtttcgtggttggagctgatggtgattctaaaatccaaagcaggagctaccaaaatgctcaggtaactttctcttcaacaatccaatgctggcaagcgttgtggttcttgcttagcaattccccataattaaactcatctcactacctttagtttttttccttttaaattctgtggagaaaggtttagtctgcatcaccccatcctccagtacgaccgctgccaccatgcccgaagcgctcttccgcacagtacgacgaacacggggtgctcagcgaaatgtcccgtccgtctcctcacctgcaatgcatcatgaaggtgtgtatctgccgactatcgttgtttcgtcgaactattatgaatgatctttaggtgataaaatattgattgaattgtctactgctatcgctcagaatccatactccagcaatcttacatatatacatatttgttgcgtcaatcctaagcatgcttttcatatatccctgaacaattcagcctcacaactgctcttcatgtatctcattcagaattttttttctcaaattagttggactgatagcaaaatattgcttttcaagattgtaaaataaccaactagcatggacgttcataaatttttcccttctgtttggtgttattttatcagacatatataatgaaggcgtatatagcaaagggaggagctgttgagggaaaggacaatagctcaattttttttttttttgcggggaagacaatagctcaattgactgggaagttgatgtcaaatgtcgggagcaatctgctaaaatgttaaagaggtgcatgagtgaactggaaatatctatcttgtttttgattagtagtttctttggtttcaaagtaactcttgacatgagaattttattagcagaggaatgggacacattcttggaaaaatatatttcaccattgaaagggtcaattaggcctagagggggggtgaataggctaatttaacaaactaaacaaatgcggaagcaggaattttcgaaactttcgaaaataggcagaacagttgaacaatgcagtaaaagtctagatctagagggctaccacaagtaaatcaaggaacatacaacaactagacctatagcggctcaagcaaataaatctagaggatgggaaggaggaatatcacccaaaatgaagctcacgaagtttttaccggagttcaaatccttgagggattctactctccgttgaggagctcaaaaagagccgggtcttagctaactctttcctcaagaggttgcacaaagcactcctctttccactaaggggtatctctttccttgcggaggcgagatccggccttcacaaacttcccacggccaaccacaagtagatcggtggctcgggagtgacacctagctgtctaggagtcctcaatctccaagagtaaaagatgatgcgaagaactcttggagatgatgcaagtgctcacaaatcttcacgaaaaccacaagaagcattcacacaaactcgaatccacactcacacacacgccaaatccgaatcaaacccgggtggagagaggaatcgagaaagcaaggctcaaatgagtagagagagaagcaagccaagggctcaaataattgcaatgtcaccagcaacacttacaagaggggggatgggggctatttatagccacagcctcatatctgcccgttggtgcataataattgcgattttcagaacttctgaaaatcattttcggaacttccaaaaatttccagatctgaaaactcgaagtcaacgcacctttttggaacttccgaaaaatattttcagatatttccgaaaaatatccagaacccaaaacaaccttttgcaaattttcggaactttcgaaaattattttcggaaacttccaaaaatatccagaagtgaaattttagttatgtgaatttttggaacttccgaaaatccttttcgaaatttccgaaaatttccagaacacacggccaaggagaaaatgcttccaaaaattgattgtgagcacacacatcactccttatatgtctatgtctatgcatcatcccccttaatagtacgacattcctaagacgtaaagaaagtaagatatacaatataccatttgctcatgccataaattcatcgtgatgtcacattcaaaggggtatgcatcgcattacaacacatcgaggacgtaacatccttcacatttgctttcatgaaaattgttagtcatctctaatcgtattgtaatcaatcatcaaaacaattaggggcctagatgcactttcaatctccccctttttagtaattggtgacaatacaattagatcacaagagagaatgaatataatagattgatttggtgcaaaggtttagtgaaagctccccctaaaagtgtgcattaaggcaagtggagagctccccctaaatctttgcatccacattgaagctcaaaaagatatgaatcaattcatagtacattcatcacatttcatatctcattcatgacaagcacaattataaagggaataagaacattgcaagatcataatataaagcatataagtcattacatcccaatcatccataataaagcattaaagtctcacaatagtaatagctattacacaaatgacttaaaatcacacatagtctcatacactgaaacaccaacaatgttcgaccacaagctaaaatgaaaaagagatagatattctccccctttggcatcgaagcaccaaaaagagaggatgaagcgaagatggctcacacgaacggggcctgaggtggatcctcgggaggtggaggaggagggtagccatggccaaacccaccaaagaagtcgtactccggaggaagatcaacaaagggatcctcgatgtcatcctcaggcccatcgggctcagcctcatagcctggtggggacggtggagcacccaactgaaaccgagagtagaggtgcgcctgtgtttgctttgctcgccgggatgctttcttgattttgtttcgcgccctgcgattctgtttggcctctgcagagcaaagaccgaacaaacttcgcaagatgcgaaacaaagccgaaggctagcgatgagccccaggagagggttgcgcacgctcaggaggaggctgagtggaggaagacgggatgtcccgagtaggcggccaagaggatgaggtgggtatgtcaggagccgcagagcaagccttgggcactcgcagagtgagataggaatgggactcctcacaaataaactgggtttgagtgacatgctcgatcatccgcatcaggtgaggggcaaaaggaagcgccctcctgtactgaatcgaggccatgcggatctcctccaacacaaagttgtaagcatgaaagggattgccagtaggattaaacccgaggagcacattacgagagtgatggttgatgttgctagcattaccatctttgggagtgagggtccttctcaggatacggttgaggtagacatggaaaggcttgaaaccctcagttgtgcccaacttgccgccatcaagatacaggggatgccgctcatgatgcataggaatggaatagtcatggaggttagcaaagtacctcatccagttttcatcaaaaccccaaagagtggcaagagcctcataggtaatggagtaccactccccttgagtcatccaatgtatgccccgccggctgtcaaagaaaacggtggcataaaattgggcaataacctccttgcaccaaggttgatggagggtcataaaattgtggacacacatctcctcacacatggcaatcatagagttgagggtggggtcatcatgtgcctacaagtcctcccaattgatccattgcataggaacaatgggatcggttatgggaaagataacggtttcatagaaatcttgctgaaaagannnnnnnnnnnnnnnnnnnnnnnnnnnnnnnnnnnataaagaatttcaaantttccatca

SEQ ID NO: 34341 - DNA, 25331 bp, Oryza sativa
gaggaagccaaagatatgatgtacaagcaaatggatgcaagaattaggcgaaaccaaggttggagggctcaggcagggattttcagaacttttgaaaataattccgaaaattttcggaaacttccgaaaattcctggccgaaccctaaaactcagatcctgtacaaatccaccaaccaaaacttgtgaaactgaatctgcaagtcctagggcactagaggaacatctccaccgaagggaatcgcaagatttaactcgaggaatcactagatttgatttgaagaaatacctcaagaacgcgaagaacgagtgaagaacgcggtgaagatcaacgatgtaagtgcccacaaggtccccaaacgtgctcccacgaggatgaagtggaggagagcgtcggagagtcggcggagaggaggtggtcgccggggaggagtggatgggggagaggaacccgtggggaaaaggatagcaaagagagagaagaagagtccatgggttggaggagagttttatacccccgagaattttcggaagtttccgaaaattttcggatttacagaaccactgagcacgcttctggatattttcggaagttccgaattttttttcggaagtttccgaaaatatacagaaacacagggattgtttgtactaaggcagtaaattttcccctgcgagattatttacagcacagtgattgcgtgtgttcttttattttctggtttcctgctttacttgaaaaccctataaaccccattgaaattgataggttgtaatttttctgtgtgttgcaggttttattttttgacatagttcagctaaaatttcggattcttgcatgaggtaggtctaaggttactgccatcatggaattttgagtaaaacgctattttttttccctaggaaatcatttggaagacatgcataacaattgtcctcttttttttttttgtgacttcatgctttacttgaaagccctatgaatgccattgcctctttctactatcatatctctcgattatatatcaacctaatgaagtgccggttagttatttgatgttaacatgatgtgtggctccagctttcgtttccttcttaggagatggattatcaacctgtcgcatattacaccgttttgcttcaacatgtcaatttttaacttaagaagttaatttcccttttatattgtgtaggcagtgcatggctggccaaaaaaaaatcaactaatcatatgcaaaactatgagtatccatgcaactctgatgatctaaattttgttctgcacataccatgcaaaaataatcggaattgctagaaatatggcgccatatttctttccagtttacagtcgatttttcactgtgcaattagttcagagattcgtgcatgttcgagactctaatgccatcgtaactactattgctgatactaatctcaaatctctaattgttacggagtaaaaaccaagattccatgcacagatggcaggcaaaaggacaagaagggcctcatcattcggcatattggtggaataagccaaacggcatatttgcaaacgaaaattaatttgtaaataaaacttttacatatgtgttcttagcgatctaaaagcaaaggctgaaaataaactttaatgaaaaaaccccaaaatcagcttcaaatttaacgttgaaaattcaaacttaggctgattagcatatgaatatgccaaacgatgggaaccaaaaaggagaagccagggaagatagggagctcaccgtcaatgtttgtttttaattacactgcagttatatatataattagagtgtaattgtactatagttacacgtgtaattcctatgtaactatagtagttacacctcacttatataccacttacatatgtaattagtatgtaattttaggatttacatatgtaattttaggaattacattataaatacactaaaattacatatgtaatttagggacttacaatgtaaatacacgccgactatttttcggtgaaaaatatggcgccataaatatagctactcccaaaataataacccatagctcatgaacgaacagtacatgaccgttacaataaggtgctttaacacgtcataagcagaagttgctgggatgctagataatattgtcctcttttaaacatagcatgggaattatagtagaatcaagatgctttcctttgcttggtaaaaatattttggactgcatttcagaactcagaccatcatctatttcagtgtaattacattattctgcagaaagacacaaaactatcatggaatagatagttctatatttataaggcatgtagttcttaattcttttaatcaagccaagtgctattttgtgtggtccatggatctttgcgttacctgtaaaactgtggtttatatatttctttgggagctggattctcttggtaatataattgactggtagtaatacacatcctgtaaacaaattaatttttcctctttgtttcttttttttaccgtgccatcttcttccttagggtaacagaaagctcctaataacattgctagcaatccctactctataaagtaagcttttttttttttgcggggaacatagatgcattactcagctatagtcattacaaaccaagtgcgaaataaaattacaagaatcatctggccaaaaggccgttaaggattctcgacgacctctgctagctagagcacgactgacgctgttctgattacgattgattttcgtcagtacaacctctctgttcctgaacaagagacacttaatctctcttattataaactcaaattcagatctccctttttcccataagtatccttatgggtcactgcattggacaacataacactggacaacataaacaaattcaatagtatagtgatgtgtaattcgcgtgccttctctgtgtctataatatgccaatttttctattgcttacacccgtttcttattatgttacgggaagttggtgatttttgagaactggaggaagatcgtggattttgattgtaaaagcataaaaaacagccaccactaagatttaccagtcctaagtgcctgactttgcctgtaacaataatgttaggaagatattattttgaaacaatattgttgtttctggtatgttgctgctgccgccttgctcttgacgatttgctgtggatttacttctgctctgcgctgacatcctgctgatgtatgtgctgccatgtactactgctatggccagagaatagaagaattcagagggaacaaggaagaggaggaaagcattagagttctttggtgctcatgaactgctcgatgaaatgtcttgaggtactactaaaatccgagtacgtttctgtgaattatcgttttagtgggtctatatgcagaaacctccttccttggatttgttattatgtttccagtggaaagtaatttagatttaacaaatatttcagtgaatcattcaagtcaatcaactaaatcaataagaacatgcttagtttattcccattaagaggttgtatagaaagtaaaaaaaagcagaacagaagtttggtgcttgtatttacacgatttggtttttattgtgctttatgcaagtctctgaacttattttgcctgtggacatattacaggggctcatcacaagtatctatacgatctcttctattgattcacatgtgatgatttagtacctttctcaggattgcacacacatgagctctatgccaggttagtcaaggttgttaggtttgttaagactatccggaatgcatagtcatacttattataacttctctcactctgcatgaggaatgagcttctatataatcactgattggtgctgctcgcattgttataaacaacattttagtttgttgggatgggaattgagagaccctgtttccaaatgtttttttatggggtcaacaacaagcctgctataataacagcctggtgatacgccaatgttttgtttaggattattttagcaggatgcttactaggcaggcatgattcaggtagtgcacttttatgtagtgcagtatggatgtttgctaggcagacatgattcaggtagtctggggtcatttatagaagcaggttatctgaaacattacaagcaattgacatacatagtatctggtgggttagggcactatgcgacgctgtgatgagtgagctgtggccactgtgctgatcatagagcaacagagcagaaactacaggttaaggtgatgtcctctcttcctaaatcctcacataagaaagatttgaattgcagtgtgtgattatggttttgtgattggttagtgcgacatttgatactgatttgctccatgcataaagaggttcgaaattcagattaacctgcaaaacaatttgattaggaattcccaaatttagttaaaacttatttgagtggaaagtttcagtttgttagattagctctttttcatgcctgtgagaaggaattatgtgcattccctaatatcggtggccgcttgcgtccacggtcatcagactatttcctcttccttaacgccatcaactgaatatgcagttgctcgacgtctacgccatgcttatcttctcataagcgcctcccatttcatccctatcggcctctgagattactgaaggctcctgctacatgaagcatgaagtgggtgctggtctccatctgcttctctccctggtaccattttattttattttttgcaagctggccttcattgttaccctggtggttgatccatatgatgaattgactgtgtgatatggcttcggtgttgcttccatgcattctgacctatctcatgttctgtttcatttagtgcctcggttcgattcaacacaaaaaattaagtgctcaattgttaatagtcttttaaagtaattacgcaatcccttttcttttccagacgtgcaggaatttatggttggcttaaaaattatagctgaatgggcacaccattaatgttcactgtgtacaaaaaactgtggtggttttttgaattttgtacatgatccaccaaacaaacaaggtaatctgcattggttatttggtatacttgtggagcttattatagatcaagatatatgtgaactaatagcattttaattaaaattagaatttgtccagagcaccatatttttatgaatatttttttttcttgacctaaggcataactttagtgatctgatcttatgaattgctatactgtctaggttagctacctttattaactagaaaacaatagtccattctagccatattaattaagccacatttgagtcaggtgtataacctgaatcaaggtgaatgaaaacatttaactggagtgctgcgcaataatatatgcagaattgacacaatttagatggttggagtttaggcattctgtgaagtccccaatttcattgaccaggcctatttgaaacataaggggggggggggacatcttatggtacatcaagttggtccattttgttcacacaggataacactgcacttaaaatattttttttcatattatggttcaagtgcagatattgtggattgccataacactcaccttctaagtgcatattataacggagatttttgagttgatgaatcgttgtgagtatggaattttgattctacgttcttctatgattaccaggctctggaaggatctaatatgtggtttaggaaaggatgggagtgcttgaacctgaaagcatctcctgctcattatgctcttaggtgttttatttccgatgctgttactattgatacaacagggaaagtcacatattgtttaaaatatttattgtgcttaaaatactatactgtgtaatgtccgaaatttatattcatgcgttagatgtttcactttcacatgcacatgcacttctgttgaatgtgttgttaagttctcctatgaactgtttcgctgagtggtttacattacatttctttcacaggtggtgatcatagcatgatggcaatcgaattccaccgtgttggtagcatgcactatatattttccggttatacatcacagaagacagaaaagccaggtatgtttcttatgagcctgtatatatcactttactaaaagttttctggcctcaaattattgaggaacttagagctaccattgaacaaatgtgccctgtttcttgcagtgctttaatctgggtgcaacaacacatattctaactggttttgggctcaactttctgttattattaatttactagaaaaaatccccgtgcgttgcaacgggtaaaaacgttttttatactatacattatactcccttgtttttagaccgaatgctttcttgtttttggaccgaacgttcattctttccctcattttcagatttagtcctagagcagtccgctgcttctatctgcttggcctctctcttcggctcagcccacaagtggagctgtaggcccagctcgaacagtcctttgcttggcctatctcccttcggctcagcccacaagtgaagctgtaggcccagctcgaacagtcctgtgcctggcctacctctctttggctcagcccgcaagtggagctgtaggcccagctcgaacagtcctgtgcctggccttctcttcggctcagcctgtaacatctcgaacagtctcgtgcccgcatgacggagccgatcctcccaccaaatccggtaattgaccagctcgaacagtcctgtgcctgccctacctctctttggctcagcccgcaagtggagctgtaggcccagctcgaacagtcctgtgcttggcctacctctcttcggctcagcccgtaagtgtagctgtaggcccatctcgaacagtctcgtgcccgtaccgtaggggtgaaaacggtacggaaactttccggattccaggcctgtttttggaaacggaatcagccgatcgaaatttttttcggaatttctcgaaaacggaatcgaaaacggaaatattttctcggaaacggaatcgaatatgataatagcagtttccgtcggaactcggaatcggtcggaaaaattccggaaaatttgtcggaatttccgaagttaaaaaggcccatgaaatcaatagtctataattcgtggggagtttccagcccaacccaaatcgcggcatctacccaaatagtggtaaccctatagaggagagagacagacacacggcatcgcgagaccgcgagcggtggcagagcattacgctccacccaccgccagcgccccgcgccacccctggtccgccgtcctcggctcctcgcgaccttgcccccaccatcttcgttgtctcgtaccgccgccatctcgcggcgctgtccagccgtttcgcggcgccgtctcgcggcggcagcgccgtcccgccgtttcgccgccgctaccaccactgacgacgacgccacagccacaccgacgagccgacgacgcctcgcctttgcgactcgacagcagccagcagcccagcggcagcagccaacagcccagcggcagcagccagcagcccagcgacgagccgacgagcctaaaccattgatttgatttcttttgtgctgcagatttatgatggaatcatcaaatgcaagtagctattttgtgattgaactaagtactgtactaatggactgatgtgtgttgctgttttgtgatgactaatgattgatgaactatgtactgatgatggagtgatagctcatagcagattagcagtatagcactgaataatagtgtatactgtataccttataccatggtcttttgctgtattttttttagaatatttgttatgcaaattatatgaagttatagaagaatatattttgctgttgagacgatttcatataattgtgttttatgatgaattgttgactgttgagacttgagaattggacttggcaaaagttttaagctcagtttgaggggtttttgtattccgataaattttcgttaccgtatccgcgccggttcattttcgctccgttttcggtttcaataatattcgtttccgttttcgttttcggggtttccgattccgattccaaaaaaaaaaatgaaaacgaaaacgataaagattgtttccatccgtttccgtaccgttttcacccctacgtgcacgtacgatgacggagtcgatcctctgtcaaaagcggccgaatctttctcgatctccaaaattgttagagattttgattcactcgatctcctttttcgatttttttaatcaaagtcgaagcaatccgcaaaactcggaataaaaaatgacaaactaaagggatgaggaaacgcatggagaggcaaatcgatatagtggcggcgctagggttcggcccgacaaaaaaaaaccaccgaaaaaatagcgtgttggattttgttaaaactggaaaaacggtgaaagaaaaaaaagaaaaaaacaacgtaaagaaaataaaacggaaaaataaaataaaacggacaaaaaaaccaggaaaaacggtgaaaaaatagcgacaagaaaataaaacgaaaaaaaggaaacggataaaaattaatttgtccttttctatattttttcttgccgtgccgggctttttttttacaatcgttttacggacgaaaaaaccgggaaaaacggtgaaaaaaatagcgacaagaaaataaaacgaaaaaaggaaacggataaaaattaatttttgtccttttctatattttttcttgccgtgccgggcatttttttacaatcgttttttttctgcctttttttgtccgcttttttagcacggataggaatcggtcagttttttttttctgcgccttcttttttggggccggactttcttaattacaatcgaactttttttatcgcttttttttattaacggacgaaggaaacatcttatactttttaagtatttttaagtagtagtagtagatagtagatttgtacttgatagattctttgcataggctaagaatctaatctaaccattaatagaagtcatatagatagaacatcttatttcagtttcacacagggatgccacttttgaacagaaaaataaagatatatagttatcaatatgactatttccttttcctcagctagattccatcaaaatgtagctatttgcataagatatctgggatgcttcaggataatgaaggataggttgcagatattcccttatttgcttcagctatacttaaaattttcgcatctggctagaggtttgtcatttgatgttatcgcatttttctaagaggggttatcataccttttccctatatttcactaacaataacatatccatgtacatgcactgtctgttgggcctagaatgtgctaaaaaaattgggatatggcatttcttattgtacagttgcataaagtgaaaatagaaaaaaattgtgaaaaaattagcacaacacctcttcacaaggtaaatgttcccctactctgtttcaagcttaagatgtattttcgttacctatttaggtattcaccctcttgagatgagttctaaaatttgtttgtatattttttccttcgatgttacacatgatgccaatatagtatatatatgtaatcaataaaattatacatgatccaattttttatcttcctaggcatataaaatgattaaggctacatcttgaagatatggcagctttaatgtatatacttctccaaaacaagttttcagccttttgtacttagaatgaagtagcaccattaattttgatgttttgcaaagtaaattatgccttttggtaagcattttttatatggtcaagcaatctttgaaatgtaaagtgcaggtaatgctgcatacctaggacttgaaataaattcagattcaaagtattcacttttaggtccaagattagatttatccagattcaaattatccagtttcttttaatagtcacaggaaacggggtcggtggcagcgatcctcgacccgggaacgccgtccccgtcccgaaaacatggggtcattttcgtccccaccttgtaaaaaactctctcaagtagcgtatcacgttcctcgaccccgtttctcgatcccatcgacccaggaactttgttactatactgctgccataacaattaaaagaaaagagaaaattcaaatgtgttttcatcagttgacctagtgcttgaagaaaacttgttaaaaaagtaaggaaatcttcgggacagtcatctcatttagaaaattgtagtacatgagaaaactaatgttcaagaaacttgaaaaaagttctggagaaaaaagaacttacatacttttagaaaaatgttgtttgtgctgccataacaactaaaagaacagagaaaattcaaatgtattttcatcagttgaccagaagctggtaactttaattagcctaagatttgcaagccacatttcagtagattgggaacgtgaagggcgctctttatttttttttttcaaaaggggatgcctttacttaaaagctttaatacatgattgattaaatattgatgaattgttcgatatgatttattatagtgattcatgttattatgagtaatagttagttttgttctcatttttataggtttattgatttttctttttctttttacttaaatttcttcagttttcttttgaaaaaccgtgatagttgaagtaatttacttatggttgctataaacactaccgtagtacctagaccatagtggtcgacaccgtcaagtggacaagcgctggaaggaaggcctgatgagaagattgtaacgtcccgcctcccccagaccaggcccacttacatctgataatttttataggtcatagactgccctcacagggccaacatatgtcttttctgcacacttttgtcctcactcgtgaacatgtcttttctgcacacttttgtcctcactcgtgtgcacccgggaagaattttccggtcgatcacccatcccaaattgctccaggccaagcacgcttaaccctggagttctttggagattggcttccggaaaagaagttgcaacttgtttatatgagtattctattaatcctattaagccctaggccgggatgttacaaggatataattgctttgttgcagatatgaaagctacatagatgtgtaccattgggccaaaaaaatcccattaacaaaaaggtaagtgttgttctcttccaccttgctactaccaattgctgttgttgaatacaaacatttgctaccacaaaatattttttattcatgtgatctgatgttatggagcccacttgggttgatgctgaattgttgtacatgattttctagccttttctaataactagatatgcttgactataatttgttcttgttaattccatggtatcattcaacttgagttaatgtgtctgtgtctacatattattcaccgcaaaatgatttttagtcatcaaatcatgatttggtagtacatgtgatttgttatattgtacaaatctgcgtggttttgcagtcaattaacgtgttcaatacacgtggcttggaagctgaaactagattccatggcttacaacccagctttcttgccacaccatgtgaagcttgcctttacctctaaccatattgaattatcccagcatttatatcttagggtcaaaaatgcatttcaacatgaagggattatgatttttcacattatttttaatttccattcaatataccatggcataataatataacagttgaagtttttagatagttgtactgctcgaggacccgtgggagttgtttggttgggttcaaataagtacagtgtctaaattgatatgcaaaatcaatagaggggaaattcgtctaaacctttttgaaagtttttggtgtggaaactggattattttttcagggaagatataacatttttttagggaagatgttaggtgacaggttataaatatacgtcactcgaaggaatttcttgtgaatttatgctgttgtttcagattatcatagacgtgttgtgcgtattgtgttgattagttagctccttggctgcatttcagtgttcattccgagtgtttagttccagagcacattgcctgattcaaattaaacagaatgttgcacacctgttcatgaggtttccaaggaacaagtaaagatcttctaatcacgctaagagacttagagataatcatgcagaaatattaagttataattgtgtgatctcagagttaccatattcatgcatgcctttcagggggagtgtaggtattagcataggatatctgggatgcttcaagatggactttacaattgctccttatgaaaagaaaaatgaagtcaatcagtctagcaattaatttggagaaactgactcttttgcaagctatttgagaaggcatctatggaaaatataatgttttgctgaccggttgtcattttacttgtgtttggtcaaatggtcagggacactggctggcatgtagatggagggttcaaaaccgacaccatatgctttatcatcgatactcagggttttgtatctatatgattttggtttagcacacatttctgattattgcacgttattaaaccatgtaaacaatggattacaaaatttgtgtgcaggcccatcatctagaatatagtcattggtgagcagacacttacacttaggaaggaattaggataggtggatcacacacagacacagggacacgatgcatggatcttgcagcacaacacagacaggttgctacttgtgctcctcgtcgaacgcatagccatgtttgaggtactggtcgatgaggttctgctcgtaggcgttcatcttttcatcgatgaactttctgagtttgaggcagaacgttgggccagctcctcctcggtgtaggcgtactccgggtaggtgtaggggtagctcatcatttgtttgataacaacattaggcatcttgtacttgaccaccttcttcccagactccttcaaccagcactccatggaccccgggacattcctcgacacccagagaggccttcttcttgaggacctcactacccttacacgggatcgaagaagacttcctccttggtcctggccgccatcgcccgcgcgcgatggaggcagttctcttaagaagaagaaaacaggcaggcaacaatggcggcaagcggatcggaaggaacggccaacgacccaactcgtgtcagcccacaaccgttttcaagccttttcagcccatcccaccaatcttaaagcaaccggaaaagaattacaaatatactcccatgcaggcccttaatggcttaatccttgggggttttttttatcaataagccatataaacaatcaaatatatcgccttgatttcacacgactaaatgctgctattgcttcttcttgttggctgcgctgcttcaattccttcacagccgcatcatagaaagacaatcatagcaaattcatatgcagacttgtagcaagctcatgttagcaaatcatcagactcagttcaatttgtgctcgatcgtatcagagaatcagcatggcacacttgcttattctgtataatcatttatggtaatattaattatattcatgacttgacatgtgtgcatgtacaaaccatcccagcagttaagcttggtggtccaatagaaggatgcttaacagtaagcctaaattcatctcatttccccttggaagagatttcaaggtataataacgattactgagtggcacaattgccaactagtatattatgatgcttctcaactgaagattgcaagcatcatcggacacgacgtaagtactgttaccacaatacacgatataagtaagcactgttaccacaatacaatgtatagacaggaaaatagtaagcgcctcatctttagctgctatcgttcatgttgttaatagtttcaagggcttttggaggcaccatagaaaagggatatgaaattgaagcaatgaaactatgaaaagagttaagagtaaaactcagcaattgtacaaatgcactaggaatacaaagatgaatcaccatgcttgtttcagacaagtattttcactctaaaaaaaatcaacagcctattagtcaagttcttatgctccacaactaagaaatacagtatcttacagcacaaaaagcttaatcctctatagcttcaaattcccagctcatagtttttatacgcatatagtcagctaaagaacacaggaaaataatattcattcaacagttgacagctaaagagcacccagagaaaacatgtattgtgatacaggcatatagcttcataggcattcagaacagttaacaaaagatacaggcatatatagcttaaatgtgttataactaccatgtaaagagaaaaaaaaaataacagcaataatggagttgcgtcccataaacatgaaataaaactgtcaactgcagtcagatgtagcttttttctgctgacagaaattcaagcatgtgtagttttacagcgacaaaaaacacaggggatacatacaccctgggacatcatcaacctctaggggttcaggaaggaaactagaacagaagcaaaattaaccaaaagttaggccctagccagccaatcttcttgcattgaagttgcatcatgtccagcaatggcttgataaggacttccgctgcaaaatagagacgattttctgtatatcattccatgaaattaaatatactagacttttaggttccatagatgcggcaatgaacttacaaccagcaaaaatgcatctaaaaagtaggtgatagataaaaacagtaataacatagagacgattttgtgtatatcatttcatgaaactagactttagcgttccatagatgcggcaacgaacatataatcagcaaaaatgcaattaaaaagtaggtgattgataaaaacagtaatatacctcataaattgaggaacttggatagcttagaagttagaataaatgtcccaactgaagtgcctgcagttgacccctgttatacagctccaactgcagatacgggacaaccaatgggaaccggacatgacatgcatactctgagtccacagcattatagcccaaaatcaggctcctccatggatccatcctgtgagatgtcctatttctcagaaaatcaaagaagaacagagtttcaattaaggcgatctgatcaggggtaagcgatttctgtcctcgaataggagttagacccagtgcatgtaagaattccctctgacgtttgttgaggcatgtctgagatggtttgtcagctggtacaatacggccgtcagggttgaaatcataaggctttttgaggatacggttggtcttgactttactctcccaaacatcggcatatggaaggtttgttaggatagccctaagatcatctggtggcatcacaaatctgatatggtcatacattgacttgaaaaacagtgacacattagctagggataccaatgacccatgaaaatgaaatatctctctcttgtcaaactcatgaaggatcaagtttagcaggtgctgtatatcttcaggcacacttccgtcttcagatagaaagagattcctgataatctgatgagcacacaaatagttgtttcttagaaggtccatctctaactatacacgtgaaatgttcttgaacttaacttttcccgtgggactcacaaagatgtttgaaatgtttaaatccaaaaaacacaaatttctcaactcatttgtccttagtcctttcagcatagttctgattactttcttacatgactctgttgcaaccagataagtcacacttggattagtttccccaaatgaacgaaactgatacgaatcagaagtcaccattggtctaatattcagataagactccaatgggatgcaatcatcaaaatacacttcagaggtatctaacacatatctatcatatgacacgtaggataaggcagctgtgaaaaagaaaagaaagcaaacattacttcaatgttttgacaacctaaaaggacagggaaaatgcaaaggcaattaccattatgaatggggttgtccatgtcttcaggtgaaaaacctggaaccaagtcaaggggacctggattgtttgcagtggccatggaaaagctcaataatggcagaaaacctacaagcctgaaaagaaagcatggacatgaaaacaacagcactaaaatgcaacctagttgctacctatgaccgtccccatattttatgaaccaatagaagtgaaatgggaaaatcacagatagagaatatacactacagatattagctatctgtcactaaacaatccaacatgacttgcataggttatcttcttcctatcaacattagtcatgaatctattattaaaaaagcctaccgaaaggataaatcatgtattacctacaaaaacaactgctacttttaatagaagggataatttgtactatgtggtcatcagctacaaaaggctcacatatataagaaatcagctatcatgtagtatccagataaaccaacctgttgtaggccagtaagcagatgtcaaagcatagatacacaaattcaagatcaacacaaggaaaaaaaaactgaggcaacatcccaaggctcagccacttgatgactacatgatggggaagaaagcaaaacacataggaggctgggttaacttaaccaaacaactcagaacatagtgggagataagtccataaatgataaatctctgaaacgaaatgaagctttagatgtagaagaatgcaagttagaaacaaactaggggatcaatccaaatgcgttttgaaaacaatatgcttcagatgcagaagagctcagagacatgcagggagttatgttagttaaccaaataacagatacgaagtgatcagtactaacggatcagtccatgcatctctcaaacaaaatgcagcattgagatagagttgcaacagcgatttcctttctctattcaattcacaccagaatcccagcataaaaattatctgcagcttgccttccaaaatcagtctcagattgtaagaatcgtgcgtgtcaaatgaatttgtgcaattctctgttcccaaaattcagaaataatgccagttcaaacagatttacaattgtgcagaaattaataaggaacgcacaaagacagaacaggataaagcaacaggtgcaaccaacagcccataatttctcaaagcaacagccaacaggagccaagttcaggtattggtttgttgctaactcattaggatcaacactgaagaattcataacacgcacagagattttataaaccaaacaagacggcaggataccatcagcatgatccagaagaaaacataacgtgcagggaatcgggtttaattgaaccaaacatctcagaacgcactgggagaacagttcatacatctgtgaagcgaaatacttcagatgtgaaaagaaggtatatcagaaatacaaggaggatcagtcaacatgcatatatgagatgaaatgcttcaaatccaaaatatttcagccacatgcaggaagttcggcaattaatcaaccaaactacagacagcataccatgggatcagattcaaactaacatatcagcccattcatctctgaaatgaaatggagcattcaaataaagttacagacaccagaatcaaagcaaaatgcccaccgcaatgttgtcatgttcagggaggaagcaccatcgctacaacgggtgcttcgactctgttgaggacgctacgctctgggcagagagaatgaaaacacaggaacgacaggtggttacggtctggaaaagctgtttctctaatcccctttctatgatgtaatgatattatgttcgttgcatctgctccatccaatacaaattcatgaacaggaaaacatcccctatcgatcaagcactgaagtgttgcaaatctgcaaccgaatcccaccaatgaaccacatgccgagtaaagaacgccgcaatacacacatctgaacccgcggattctaaattcgtacgagaactcaaatcaccacaaaaaggctcatgcccatgctactgtacagattcatctttgctactctattgatccacgacactaggtgctccgttgccaaaaatcaacatataaaatgacaaaaaccaacatataaaatgagacagcacagtacacaccgagggattcaaaatagtgacataaaaaagcatgggaaaaaacctcgctcaaatggacgaagtggctccagaaaaagtgcggtggcgagtgagtggaatcagggcgacggagacggcgagtggaatccagcgatgacgacagaaatcgccctcctctccgcctggcacagacaaaacgagaaaatgaaaaaaaaaaaagaggaagatgtgggagggagggagggatgtttacctacacaggtaggtttggggatctcgatctacgaggaaggcttgtcgccggaccagggaaatggctgcgtaggcatcgggtcgacgaggtgaagataataaatctggaacgagaggttttgggaagtgacggcggaagcaggaccctaagctacggtttcccatcgtcgaatttatagacagggcgctagacgggccaggccgtgatgagtggtcacaggttgggccagcccggaaacttgctagggcagatataaatgtcgagtaagttcactttaggtccctcatcttgatgctgaggccctgtttagatgctggcaaaaattttacagcatgtcacattgaacgtttgaacacatgtatgaaatattaaatatagataaaaaataactaatacacagtttacgtgtaaattgcgagacgaattttttaagcctaattatttcatgatttgacaatgtggtgctacagtaaatatttgctaatgacggattaattagacttgataaattcgtctcatagtttaccggcggattttgtaatttgctttattattattagtatatgttttatactttaaatatgtgtccgtatatctgatacggcacgctaaaactttacacccttgatctaaacaccccatgagtttaaattacatcctaaatcgtaaaaccgagtatttcaaaacggatgctaatatagttctaaggcaggattgaatacggctttgactgatatggagctgacgtgacacaataatgaaaaaaaaacattggaagccacacgtaagtgaaattaaatagcatagcgagagaaaaatactgcataacgtgatactgtattgagccttaggtagggatgaaagcggagcggataaatactgcataacgtgatactgtattgagccttaggtagggatgaaagcggagcggataaatactgcataacgtgatactgtattgagccttaggtagggatgaaggccctttttgtttcaacttatgattattataatctagattaataagccagattactataagctggcatggaataagctgtgagttgtttatttgtctggattattgaagacatggattattgggtttgaatggctaaagtctataatgtcctcagctatctgttcggttgatggcataggtgggtaatttttctcaagtatttaggggtagtgggtctttagccacttaataatctgaaaaaagctcctctagagcagcttatcagattataataatctggcttatagattataataatctactataataatatacttgtttgtttcagcttactcctaataagctatattataataatcctaagctgaatcaaacagggccgaaagcggagcggatacgaacagataatgctcgtaccatattcatttcatgtttttttaccggataaaaaacaaatacggattatctcaaatacgaataagtatcgaatataatcggacatgaatacggaaacaagttttttttaatacgaaaactaactcaacttctaatagaaacaaatatgaacatatataattagcttattttatataaatgccgtataatttataaatattttttttaaaatttaaataatattaatcgtgtggactagtgttaagagataaactactattaaaatcaaaaaaaatatatattgaaggttatagagttataaagaaatagggtatgtctcatggcttctgcggatatccgaatagcactgctcatcgcatatccaaattattatccgtatcaatcgacatttgatatcgcgactacggtatttgcatagtatagggatcgttagtaccagatatatgcgagattgaggtaaaaagatagagacaaggatttttgtacaggttcggacctcttatcttatagttaatagccctactcctgttggccgaagtcagtgttactcttattcatcgtaatcacataagtacaatgtatggggataaactatgtagctgtcgtcgaactggcggcctgtaaaccaccactagtcagcggcggacaaacccctgaatgttaatgttaactttaatcgaatatcacgttaacatccaaatgaatatcttttactgtgattccaaacaaacaattaacttatatttctaagacatatattccaacgcaacatgtttaagtcgtaaattttgataccgagcaacttttataagataatggggtaggaacaatttgcacatgcctgcagcgaagttagggtctggcattcgttcctgccgcggcggaagaggacgttgcgcttgtggtccatggagtctcgcacggcgaccacgccgtagacgccgagcggccaccggaggccgccggtgatctgggtcaccttcaccgtgaagacctgcattgtttccataggctgcgcagaagggggcagcactggaatgtctgtgtttggcataggagggagatccgctgcccaatttttccccccacaaaacaaacaaaaaatcaatcaatttgctccacggttgaactaatcgcatcaagttttttttggaactaatcgcatcaagtcgccaagaaattcaattcaagcagagaattcaagaagaggcatactctcgtcctcgaaggtggcgccattggtgccgtaggaacgggcccagctctggcggtaggcgtccaagggattcggaaggggttcgtcgtagtactcgtcgtcgtcgtcgtcattctccatcgccatggcgcggcggcgggcactgtcgtggtgatcctccgacggcgtcttggcggcgtcgccgccgccgttagaagctctctcctcctccgtgggcttctccagatccgccctcttgtggccgagctcgccgctcgcaccctccgtttccatatccacctccattaccgccgccgccgcacgccgccggcgggtttagggtttgtctcgtcctcactcctcactctgcttccttggtttctctttctttttcttttttgggcctcctaaagttgacgggctttggcttaagcccacccagccgaagccgaatcaaagatttttggaacaagtttattttgcctccctctcttttgctccttgtcgaatcgcatccctcgaccacagaaccgggtataacgtctccctctcgtatatcaaaaccggtgaaaattgtctcatttattggattgggaagcggtttcgtccgacgtggcaaattgatacgctgaacccacttatgagcggcctctacctcatcccatcttctctcacacctctcccccctctctcatctctttcgtcctctctctcaccttccatcagcaatagaccgggcggcggcgacggtaccaagctttgcggcgcgagggagaggagcttgccagacagccgcacatggaaggaggagctcgtcggccggtcgtgcccgtggagaggacctggccggcaggggtgcacatgaggaggagatcgcaaccgtacgttcgcacacatgaaggagctcccagcgagtcgtgcgtggggagaagagtcgtcggctggccatgcgcagggaaggagcttgccatccagcaccgcgcggggagagaagctcccggccggccgtgcatatggagaggagtcgttgaccggttgcgcgcggcggagttgctcgcccgccggccacacgggggtggggaggggggggagctcgccgaccggccgtgtgctgaggaggaggtcccggccggccacgcgcgggagaggagctcgctggccagccgtgcacggggagatagttgttggccaaccatgcgtggggggagcagctcgattgccggtcacgcccggggagaggtgtcgtcggccggccacgcggcggggaaggagctcgccaactggcgccgcgcagggagatgatttcccagctagccgcgcacgcgaagaggagtcgtcggccggccaccgtgatccccctcggccgtggtaccgtttgcagcgcccaagcacgtggctgtccaccccagacctaccagagaaagagataaggaagaagagaaggttaagatggttgacaggtagggcctactgttttttatttctaccattatcacttacatgtgggaccgttttctattttcaactcctttaatgactaggtgccacgtcagcacacttagatcaaatcaacttgccacatcagcaaaagccggttcaaaaaccactaaaggagttaatttgtaccagtttttaaagttgggggacatgttatacccggttttgaggttgagggatgtgattcaaccaagagcaagagttgagggaggaaaaatagacttatttcaagatttttacaaaatttattaaggaataagttcattggaggtccctcaacaaaatttaattttttttacaaattttacaaattaggattttttgagtttacttaaccataaaacgagaaatgtatacctctaaactcatacaaaccgtacaatcaaggtcctatagcagtatatataggtggcttgactgacgtggcattctagtcgagaaaaaaaagtccacatgtaagtgtgatgaaaaaaaaaaagagatccacatatcttatttcttctcgttttttcccttttcttttctatcttctcttctcttttcctctccaatcttctcgacgctgaaccgcagccggcggctggcggcagatggcccggccactgcccactccactccgccggccacacgctcacccgccgccgtccgccacgtgctcgcccgcttgctccagccgcacgccgccgctccgctccgccgaccgcgcgctcgcccgccgcttgctcttgtttcagagtacagtctacatgtacttactgaatatccatgccagagtgttggctcatcatcgtttttcgtttcttgaaaacctgtgcagatggagaatcgatggcgatgacattccgatggaaacacatagtagcttaaagccttgtcttcagatggtgatccttgacccttcactttgaggtcaatctcaaataaggggttatccaatagaagaattgcacggctaggacctgtgagttccaatgctgtagttcatatgagtttgatcagtaaaatccaaaatgcaatgttaattaacacgtggataggaggaaatgggtaaatttgcttgcaatcgaatcactacacaattaggattagaacaccttgcagatgtgcgagtgcgagcaagatagagagtacttgagcattgaaatgttcattgcctgatgtttctgctttcaaatccgagtactcgagctcgtcggtcagcaggttcgcgtaagcgacccgccgatcgagtagacggccaagtggcaacccctctggttccaagcaacccaggaaaagagctgcaccgaggagcccgcaaactaggcaacccaagctgcaacaggcggccataacttactcggatactccttctgtcaaaaaaaaaaaaacttaacctctgtctagatttgttgtagattatgtctcatccacgtattaggttaagtttttttggacggggggattagtaggcaaccccaagctacgcaacccaacccaaccttggatgggaagcggcctctgtcccttgggattagggggtgtttggatccagggactgaactttagtccttgtcatatcggatgtttggacactaaccacaagcaatgggagtcctcaccgcacattgtacgcctacatgtatgcaaacaaaattagtggaggaaaacgatcatacgccccacccacctaacaaaaccattcctttagaaaaccggtgaaaattaggaaaaaataaaaaccaaaactttgtctaccaaaaaaaacatggctttaactttcatttttaatcccatatctccctccatttcaagatgtatggcgccgctgacttcttgcgtaacattcgaccattcgtcttattaaaaatatataaatattatttattttgttgttatcaaataaactataatcttaacttatacttttatatatttgtattcaatttttaaattaaacaaatgattaaacattatgaaaaaagtcaacgacatcatacatttaaaaaatgaggtagtatcatgactttgcggtttttctatagaacactgcacaagggaaatgcactttgtaaatcagctcatgaacactacacctatcctaatattcatttatgattgaatagtagagagaaaccgtgtgaaagttcggaaatacccctagactcacatgtcaagtctctcatctctctatttctctcgagttctatttctttgctcttctcgctatcgcaggaggccggcggggcgagtcggggtgtgatgagcttaaaggcggtgggctgtggttggcggtgattggggaaggaaatggggaggcttcgcctcgcctcgcttcccaaatctcacaaactaaaagctaacggcactaactcatggaccgaaaaggaagaaattaacgcgggtttgtgccgtgtagatgtttagtaccaaaaagactgagtggaggtcttctgcagtactgcactactcactgacatgtgggtcccatagaccgagcaatgctgcacttagtaagttcttgatcggttaatccccatgagggagggactaaaggagatttattcaacacctattatggtgtgaaattattccctcttaattccttccaatccttttcaattccctccaaaccgaaccagcctaaatgacggtattaagtatacattgaattttttttctaataaggaaaaagtatgcattgaattttctctatttttgaaacggaggaaataattgatataggagaaggtgaagaagcagatcctcggacacctcactccccttcccaaccggcaaaccctactttttctgcggcggccgcggtgatggattccggcccatcttgtgacggtgctagccacggccacaccagttctgc

SEQ ID NO: 34342 - DNA, 19201 bp, Oryza sativa
  unsure (1)..(19201): unsure at all n locations
cgcgtgacgataacgatagcngctgncncnnnccnnnnnannagatcccagattagatgaacacttttcaatgtattgggatgcccaaccacacaaacctagttggggcagtcatattttgcaatttgcatttctttcctgggtcttgggtttgaaggcttgaagggtggccatggacagttataagaacagagtgaattttgggaaccaggagccattggaaggaagcagattgtaaaaaaaaaaaagaagttaactcatatgtatattttcttactcacatttgtcatttggttgtcaatttctgctccagtccaataatcactcgatgaatttgtgtgtccagcggatgcttctccaatgaggaacacggataggccagtgccaccatattatctgccaattagcatgatgcaattcttctcagtgaaggtgatcgagatcatgggaggtctccaatggccactccacgtctatggtatcgttgctacgcgtgactcacaagataacaagaggaacttcttgtttcgttgtgatagagagcactgccagacccttgcctcaccacaggtatgtgcattgtgtagcccttcattatttctggtccatttcattttgttttagttttatttgtcgtcagtcatgaatcaagtgggtgcattatcattggtagttaaccaatttactgctaccaaaagctaaatagagggaacccatgttttccaaagctttcttactgttcctgttatgaaattttggggatgatctcatccttaacctagcacttagcagcaatgagttacagccatgagttattcttttttggaaagagatgcaatcattacttcagtccacattaacaactacagtttttactacccatcttgctgcatggtgacatgtttcttacaaaccgttggattgaagtcatgcgcagtatctttgcaggtgacacagcctatcaaagattatgaaacatgttgatctgattgcccctctttctgtcgcccatgcgtgcaggattcatgtttgagacttacacgtcctagtcgagctattgtaatagtgaaccctgtagttgttgaggttgacttgaaagtgaagggcagcagaggacccccatctgaagacaaggttttaagcgagcatgcttttgttcacaaccacactggtcataggattaaacctggctttcctcatagacagctggaatcaacagaggacagcacgatggagtttgtgtttgcacatctgcagagtgcagtggaggccaccatcacggttggagtcgttgaaggatcgcctgatttcagggctcgttttactgctcgaactgctgggattgatgaggatgtgttgcttcttgactttcaggatggtaagggcctctttagttcgcgaactgaaattttttgcgtgtcacatcggatatacggacacacatttgaattatttaacgtagactaataacaaaaacaaattacagatttcgcctggaaactgcgagacgaatttattaagcctaattaatccgtcattagcaaatgtttactgtagcaccacattgtcaaatcatggcgcaattaggcttaaaagattcgtctcgcaatttacacgcaatctgtgtaattattttttttctatatttaatactccatgtatatgtccaaatattcgatgtaactgggtgaaaattctttgtttgggaactaaacagggcctaaggtggtggtcgatgatgatgggttcgtcgtgctccggcgacgtgttgtttctgttgaagggacagggaagctgattctccggatggaggctacagatcacggtggcgatgacacggctgttgttaaggaagaaatcttctgtgctagaaagacatcaaggagccaaagttacttcatgcttgggttttgtaagctgtcgatcatcatcgcctggtcgttacttccatagatgtagcgccagtttaagtccttgcgtaattgtgtgtattgtgtactagtagtactgctttgactaagccagattggtgtgactctgggttcttactaaagagcatctccaaaagagcaaatcaggtgaagaaaaagataggagtcgatattcatctgatactatcttggtaaagaaaaagataggaataggagactatgcattcattataggcaattaaatgctaagaacaaatactcattcttattataaaaagacctgctagataaactccatagtaatgccttttggtctcacaaagccccagcaacatctcatgttctcatgaataaggtgttggctcctatcttgagaaaagatatgctagtatcttttgatgacattctaagaccatagaagaacatgtgatacatgcattttggacattttaaggtctaactagggtttttttttttgcataatcaagtaaatgtgtgttcagtcaacagcaagtagaataccggggctacattattagctattaatcgaagctgtataactttgaccagaactcactaatgtcactcagttgagaggctttctggtttagttggctattatagaagatttatcaaagttatggagtgatctaattgcatatctaccatcgcaaaagattggattcgcgaatgcgagcatcaggtggcggcggtggcgattcctgtactaggcaacaaaacgagcggcaagcgtaggcggcagttcctcttgggggcagacagaaggcaaccagagggaaagtttgctacatggaactcctctatttgttgctgacaatttgattcgtatgattgtatcatccggctggatcgatttttttctgtcatccctcctgagattgattcctctttcgccggaatcaatttccgttgattcatgccatgtaatttgcattcatcactgctaattgggacgatgacaaaggagattaatcttggatgattttgctattttttttaattgctggtgcccatgacgtgcagttgttgccgtccaccgatcgttgccgtcgagcatcttcggcgcatgaaggaggaagaagaggagccagggtattcttgcgaagtcgttttggttgagtgtggtattttctgaagcatacttaagttatggtaccgtagcgaatctttctttttcgatggtagaaatataattttttgattgtgagaaaacagaagcaatgtctgaacgtagtttcacagttagccgtgctcctcccaacaagctatttcagatttcttgtttcctgacagcattccgaaatgagaaggggaatcatttcaacatttgttcttgttttgcagaaacagaggtgcagagtgggaggtgctgcaataatataatgcacaccccaaattaaggagaaactaaatcacgatcacacacgtcaatggtccaaccttttcactatcaacaagagtccacatttcaccattcattatcatcacagtgctttcgctcaaaaaattaacacggtccaaaataagcatccgcagtgcacggtacagaagtacaaactgggtttagatcctatttaagagagtttctagctgctgcagcttctttcacagtcataaatttctctaaacagttcggtttttagttcagattctaaaaagctaaacaagtgacaatcacctctagcttaccttaattagttcggacttaatttagagcacatgataatgcccacacattcactaatattactaattaagaattcatttgctatttttattacgagtaaattgcattaacggtacataaacttgtcaggtgcgtgtaatttagtgtatgaatttgtaaaatgcttattttggtgcatgaacttgtttggtacgtgcaaactaagactaaaatggcacgataagattgatttttctatgttgaccattataaattacaaattagtagatgactaacgtgtacgtagtagaaatgttatatttgtaaacttagataccattttatctttctttatttctatcccttgcattattactcggtttttttatgcaatcattatgtcttattatatatttatccttcttagactaatgtttacacagagtttaaatcaacaacagaatcagcaaaattaaccttatagtgcgatgttgaccttgttcgcacgcaccaagttcatgcaccaaaacgagcgttttacaagttcatgtactagattacacccacctgacaaattcatgtaccgccgatgcaatttactcattaccataggaagttagtgtaacacatctatggaagggaagcaccgaccatgaagtgacctccaattatcaaggtgaggcatagccctgatgatgctcacctgcttgggtgcaatgcaagttgcgcgcgcagaggctacctcaacccaggttcacaatcccgatactagatcaaaatccgctcacgaccagtatcattggatccattgataaactaacaaaaaatcgatgaagtacggatagaatttgtcaaaaaataaagaataaaataaaattcggttgttgatttggacattttgatttgtgtacatatctcaaaaacttttcatcatcacattacatatctcaaattattatatatggacacatcacaaattgtgtacgtacatttaggtcgtatctcaaatttttctaatacacgttcaaatcatgtacgcattcttgagatattccaaattttatacacattcggaaactactactccttttttttcacattttctttatatgtagtttttctttagcccatcaaagacacatgctacaacagtcaggggtatatatcatttttttttaaaaaaaaacatacatgtctattgttcagaaagcaaaaggtgagagaaatttaaatagaagagaatactacctgttcttttttctcataaagataaagattttaccttggtttccatttggtttccattagcacgcttttccaactacaaaacatcgttttgtatgaaaactttctatataaaagttgttttaaaataacaacataacactttttcaaatttgtaataattaaaacttaattaatcatgtgataataactttctcgttttgcatgcctgcttttaatctttatctttagaagattagacgatcagtcccattcgtttcctctataaaaactggatacaaatttgatacttttggtacgcttttcaaactgcttaacggcacattttgtgtaaaaactttgtgtaaaaactttctatatgaaagttattctaaaatatcaaattaatctattttttaagtttgtcataattaaaactcaattaatcacacgttattatcacctcattttacgtgaaacaatctccatctggatgttggagatttaaacaccacccatgttggagatggatgcggggtccggacagcataacagaggaccatctgcccttgccgaggaagcatatccaccaagtgaaaaaatcaaactttcacacataaacttaggaaaaatgagatgcatattaatatgggcatgaagatgagatgggatcaaaggaacagatcaacagaacccgaatgcgaggcttgatagagcttataagggccagaccaatgtgaagcctgagaaaatctgggttaatttggcccgtgcaaacccattttacaagtatagccgaagacatgcaaacacacgatcagaagtttgctcctctaatacactaagtattttcctctttcatcatagggtataacagtacagtatattcgaccacaaaattttgcaaatttcaaccatggatacccggaagagaagacggccaagataaagctatactcctaacaacgcgctgttacatgtcacgcaagataacgctgcactcttaggaacttgggaagttaagtttgtgccctatcagaattctgaagactgccaatgctccagcaaaatgttgatgtggcagaagattctcaggtgttgcgctatactttttgccgtttcgactgcgactgtttcatccactcgatgcactcctccgtggttccccttggataagcaagctgccacttcaacagtcgttgttgctaccagaacgaaggaaaaatgtgttaaaatgtgttcaggaactagaacaattcagacatagtcgattagtgtcaggtatacccattttccgataagtggacctcccttgacctgcataatccccataatggccttcccatcaagcaacggtttcatcttccatacgccatcaagctctggagaagaggtagtaagatataaatcagaaaatcttaacaaggatatgaataagttggttttcacattgaggtgttcagacagtaatacaacatcatgtagaaagtcataaggaagtcggcagtcatcagttgattctttacccagttcagttattaaacgttcagctcttgtgtatttttctttcctttgatgtaattcgtctggctggccgagagaatcaccaccactgctaacctccgggtaggtaagagtgcagataaacagtgccacacgccaaaagtcctttatctcccgaagtataagccctgtaactctcgaagtcacaatttttagattactaggcaaattaaattcccaaattaagcaactggcacacaaaaatagacagtaaatactaaccaatataaattattttcaaattttaaaatcaaactctctgctgacctgccaaaacacgtttaactgagtctgttgggatctcaaggtattcatcatccaatttctctttcacagttgtcagattttcattcgactcaaggagattaattaattcagcaaacttttcacttgcagcatgtacgttgacaaccttcaagtgcagaacagattataagttgatttattttctcaccgtacaaagtaacgggaataatattcgaggaaaaaaatagcagtaataagctaaaaaggacgatgaggcctgctcaggaaattgtaccgtgtcagcatcactagcttttaacttcagagagtcacgaataatatagttagtgacaggaatctgtagatgatgcaacaatcttgtcaggatacttgctacaaaacaatacaatacaaaagaaagtggtgattaaatagttgtttggttagtaaaatggttcactgctaataattgttgtaggctctgttctgatcttctagcccattttttacattaagttgaatatagctgtggcagttaaaacaagcaccagctatttcctcacacaaagatattgtttaatagccacggttcgtcagcaaccaacctcaaaagaatttcaagcacagtaaagctaattaacagaaaactcagggatatgtggcatttgaaataagatctgattatctagatgctacaaaccagttaaatctacaatttgccaactggttttactggagaacataaattaacagtcataggtaaccaatgctggcattgtacaattgtacagaaattaatctaagaactactctacatattcagctcagtccgtagaaacaaaactatggctacatatgtatctaaatggtcacaatatactctcttcactctttgacagccacacaaacaacctgacatcttatcaaaacttaggatggacttccaggcaaatctaagcactacctcataatattcagcatctatacttctatactcctttaaaaagactccaatggtggtggcagtgaatctgccattccacctactcccattgaacttttacatattaccctttgaacttcttgatattatataacagctaaatctaaatggataaccacatataaattaaagtaaggccagtcttccctataaaaaaaggaaggtacgaaatttcatgaacaatatacttttatttattttataaaatattataaaatgttttcgattgtagcaaagcacaggcatttagctaatacctaaaaaaaatcttaaccatgatgcacaaaaactgctctcaagaaattctagtacttcacactgcaaaatacaagtgcacccacaagtaaactaaaagttgaaaaaaaattttgctagtacaaaaatgaacgaacttgatgaacttactgttcagtctgtacaaaaaaatatggccatgatgcatctagcctgcactcttctacaggggcagacaacccaggtcccaggccacctgggccatggcctgggtggcctaagtctaaagcccatggaagcctatgtaatttcaccatgtattcactgtgggggccaatatacaccatgggttgcccgaggcctggagaaatgctgggttcgccccatctctcctgctaacctagtaggaagcaagtctagctataacatccttgtagaaaagggagatgatttgtttaaccaaagtagattaagctgacataatttacctgcttaaaaagttaaaagcatttacataggagaaaagtgtggaggatgcatgagtaagaatttagacattaccttcttcgactttttatccaaatatattgtattccgaacaggagtgaatagtgcactataaaagcaaagccttcggtgctcatcctaaacacaatcacagatcttaatgttaggaaagcaaagatacaccaatgtatagcaaattgtttaattcggtttagccataacatggaaagtgtaacataggaaccaatcacagaaataagatgggactatagtgaaaagtttagtgtcataggtcctctgaataataataactattattttttactccaaaacttaatggttcaatcaggtgtacaaatttctgtaagttctctacgtcatttattccaccaaagattaagggtgactatggtttgttaattatttgcagtgaagttattgaagtaccattttgaccataaagcaatttttgtgtgtgtgtgtgtgtgtgtgtgtgagagagagagagagagagagagagagaggttgtttgacttaatggtgtgtgcttaacaaagaaaaggacacattctgaagtttctcacacctgtgacttggaatcagaaccaccactgaacacagagcagccaatagaatgagcaagattccatgcaacttcaatatgtgaaacacaaagcctgcatacaaatataagattaggagataaaactgtcaagtgaagcacacatgctaatggaaataactagaagaagctctacaggtacagatgtctgaaatgtaattgtgtggccctttagtagaatgaattcaaaacatatagtagatatatgttatagcaagaacacaccggtcacatttgtcaggaactggagggtcgggcttctcaggaaaagcaaagacaacataaaataaccccaaatcacgaatataacacattgcattaacaggatgtttgtctgacatcataagatctacctgcacgaaatacaagcagattaaattggtgataatgggcgttctattatgttactcaatacatattgaatgatgatgtctggttagttttacgttcatgaagaaagaaaagaggaattgtaggttggctataagtaggaccaaaaccaaacctcatgaccgatgcgctctttgctaatcttgctaccaagttcagacttcaccttttcatcagaagcagcatctttcaaatcttcagttaatgtaaagttgaatctagcagctgtgagagatatgcattagtatatgcaaaagaaatgcaatgttccatgcacgctattcaatgataaatctataaacaaggtatccagttcaattatcagtagacaattacatgtctactgatatcatgcctataattatcaagctcttatatgcaaagaaaattcaaatatcatgattcgtgcacatgataacataagcatataaagtgaatctaaactggctattgatgaacattcagcaaagagtatctaacttgaaacagaaaagcaattctggagttttcagcggccaatttgcccagtacgaatgcaattaaatatgagatgttatttacttttaggaaaataaacttgtcatgaataaatctgtaatctgaaagtatatttgtgatgataatgatgataacaccatcaagtcctaaaaagccaacaacaatggtatagcttagcataaaattagcaatggaaatattgtatatcaattaaaaggatgttttaccaaatcggattgctcgaagaactctaagggggtcatccaagaaggtagctttggcaggtaaaggagtaacaataagaccctttttcagatcttcaataccttcatggaatatgaaatcaacatgattacaaacagcatgaacatttgaaaaaggttatgtatatctaaaagcttctatgttaggatccaacaaccaagctcacctcttccggttaaatcttccactgtgttagtgttgatattgaagaataaactgtccaagtttgaatatagaaagagtttactagacaactcaacattgtagcaataaaagcattactttaaatgcagagcagaactgatctgaaaacaaatacctatttattgttaggtccctacggaatgcatcttctttggctgtaccaatctcctgcgtattgaaaaaaatgtcatagctaagagggagatcagagttaaaaacatgaataacagaataagcaagaaagaattatagattgctcccaaaaatgctaatggttatttaggacatctgagtcaacaaatgtaccattccctagtactatacccatataaagccacaccaaaaagacacatgtcaatgcaaatttaactaaaaactcagatagtcagtacatgcaaatatataatggaaatatgaacataacagcatatacacaattctggaaaaaaaaacaatgcttgatatgtgtgcataccacggtaggaatccgactgttttcagcatatttttcagacctcaagttgacaaagtcaatccaaatgtcgaatataagcatccttgcagtttccaagtgctttgattgatcaggattgctgaaagaaattacgaaacatcacgatcccatgacagcatgcatctggcattatacaaatgccaatatgacaaagcatgataaacttaaggtacagaaagtattcataattttcttgcactaaaggtcatgatactctatgagaaggttatttgtttcacaaattcaactgagaatattttgtaggactaactcaaaccaacatgaaacttataatggcaaaaaggtcgtggaatttatttgataaactgtgtgctgatgtgctctgtgatctcagtgaattaattgctgctgctgagcttgaccaaataagtgataaaaacaaactgagataacagtaataggatatactcgctgggaataaaattataaagattgcataccactgaataacgccaattcctttctgttcctcacccaataattctgaatactcatttactttctcgcagaaattctggcccgtcatattatcaagtgcaatatcaatgtcagtggagtctttccccaatagctgacgattatatgaaaagagaaaggttgagtcagcaaaactactcaacaatatattcttattagagatgagctgcaaatgacaacagtagtgcaaatccttgtttttcaaagcagggatctacctgcatctcctttgactgtttgtcatacaatgcagtatccaatatccatcatgcaaaccttgaatgtgtaatacaacattcacatagcacacatccaataagacccaaattatgcatatcaacaaggaaatattcacttctctgctcttaaaggaagatgcctgtaaattacactatgccatgtgcaggtgcactatttgcatctaaaatttccaactaaatgcagtggaagcacatgtctcccgcttacagactagaagaagccaagaccaacaaaacaagttgattgagccattccctgagcccatcagcctgacaatccccacaattcacaggcagtcacctaatttctcctgtcaggaaccctaaacatagccatacaaggaactctccacaggaaacactaatttgaaactataacagccaaaaatccactgatttttttttataaaaaaaatgtcaatgacatagcaaaacaatgtctttaaaatgcccaggaaaaaacccctaaaacttacatgacaaagcacacattccagtacctaaacaaactagtatcgagctcttcaaagttaaaattcaaagggccacaaaccccaaaagccctaaaccaagtttcccaagattttttttctccaaaatggtttgatacaatcactacttctcgtactgttctccatgtactctactgacaatgcggaaaaggagatgtgtccaccttttctcaaaaaaaaaaagggaaggggggggaactcaccttgtccctgacccagccgccggcgacgcggagctgggtgccgaggccgaagtggcggacgacatcgagcaggcgacggaagatccgctcctccttttccgtcagctccacgccctccctcacttccaccacgcaccgttgctgctgctgcggcggcgtcggcggagacaccgccgccatgcccgagaagccggaggaagcgcaggctcgggcgggtaagccggaggaaccgaaggctctagatgggatcgctgagacgagcggcggaggccaaccgcaaagaaggcggcggcggcgaagaaggagaggggagcagttcggcggcggaggacagggaggaggaggaggccccgcaggcgaaaagacatgggcggcgagcgatttgcggttgccagccgccgcctgttcggctttgcttcttgtgggccgtctgtgtttgggcccttttgtgtgggccggtcgttttctggtggctggttcgttgggccgtgattccagtgggcctactgcttgcgagctgtgcttatacgctttagggcatgttcggtaaatctccaactcgcttcaggagcttggactggagtagagtagcaacctaactccgctcgtgtttcatgtggaactgaaattttttggctgggctaattggagttgtaccaaatagacccaaactattcataactccactctatacctaactcctgtagttaaatttaggagttaaactctaccaaacaggccctaaccacctgagcccttattcgttttgtttaattgtttttgcagaagacggtagtacaggggttcgcatcctctgccattaggaggtaaatggcagaggggaacagtaaaacgtgagtagcgctacagtgttttgccattgctacagtaccgaacagtaaaaatcactgttcggttattttattggaattactgtatcgattgatctcgtacgtccacgcttgatccgacggatgtaagtggctaatggcatggatcactgtagccctatgccattccagttggaatggcagatgatacgaacccgtagtacaggctgaggtagcctatgaaacatgacaggaaagcttctggcgccaaaacggtatagcccatttctctgaatttctgaaccacgaaatgctgtacctgcctgtcgaacaatttctgaatattgtttttttaggaatacgcaaggagcgcattttttttcattaagagaaataaaagttatttacaatgaaaaatgaaaaacaagcacgggactgatactggagactagcgatctaacgggatatctcgcgctagatttggctaccacgacctcgcagagataatatggaagggacccctgcatttgccgacttccaaagtacggcttcttccaccattactttcgctacttcgatccaagacttggactgctgattgaagatccgtttatttcgctccttccaaatcgaccaggccaccagcgttgcaatggtgtcaaagccccggcgatgttgctctctcaatttcatccggcttccacagagccagaggtgaaaggatggttcgttgatgggtagacaatctgaatattgttttggtgttgatcagtcactgcaagttaggcacaggcaagaatgccaaaccttcatcatccttaacaattgtggttcgcaagcccggtgacgacggcccaggagcaggcagcgcttcatcagtggcagaactaccttattatactagtcagaaccccacgcgttgccgcggggagcttaagcaaaacaaaatatttaacatatgaacaaacataaagatttctgatgggaaaatttttctatacagaacacctataatttacatagacaaaagtgtattcgagaaatattccatcctataaacctagaagataaatacctaagtagaaaaaacatggaggtgacatgattttaattggaagtacaaacatgacaaagtatgacaaatacaggtgattggctgcaagtctatgatgaacaatggactatctatgctcaattggctgttaacctaggtagcttgattccatctatgattttattaccagtattgactctcttactatgtgacgttgagttaaaagacagatcagatttcttgcaaactcatcatcactgacatcaatttgtagccagcacactctgaataatcgacaaatataagaattaatcttaatgatttgtttttgatatggtgtataatacaaataaagagcatcttcacatgattcttcgtgaactaaagcatcagatgaatttagaataagaaatgtcatatatgaagggcaatatgtacttttatgaatgataatttcatccttgaatagagcaatagatcatttacaaacaaatagaatgtcaacatgtatatgagatgctctttttttttcatctgtggatcattgtggaaatggaaaccatgatattaaaggtaatattcatggcaaggatattgcttgtaagatttgactgtgtttaagaaggaatttaccttcggaagtaaagatggaataacacgtgcagagccgtaggatattgtatgatttgaatgtaaagtctgattaacttgtcagtaattttgcatagctggcatcacaaccatcaagctgcaacatttgtatcaagacataacttaacagttagcacatttgaatgttgcgatccaaaaagaaaaataatgcaaaagcttttgtatgagataaatatgagtaaatccaatgtataaattgcaacagagcatctcctatgtatgatttatgagcctttttaccattcaacatttggtatctcgaggtacgacaaagtgttggatggcaaaattgctcatgatttatggcacatgaaaatgaattgatgtatgtatgtatatatatatatatgtatatgtatatgtatatgtatatgtatatgtatatgtatatatatatatagataaattaactggtgctacatggagtataggctccaacagaatccaccgtgtacgatgctttgagatccgtgctacttgaaaccggagtgttagacatagtaacgggttaaacccgattagacctttgtatcctcatgatttgcatgcagcgtgtgcacgacacgatgagaatccctttccatataagagcaaacatgcatgtactacctctcaaaaaaaaaacatgcatgtactaattttctggtgattgcatgataatttgtttccatatgattgcgtgattatttatttccatatttgagataacattgaattgatccacaaatttcgatgtaaatccactaattgcgttgtaattgatttaattatttccatcataccgattagtactttccattttttgtgtacatataaaatgatggagatgacacactccagtcgactcaatgctactacaccgatggccggacgtcggcgagcttattcgtcgccaagctattgcaccaccggcctgacgtggccgacatcttcttaattcgtagcgggctgctggtcgtttgcgagattcgtcaacacacaaccaggtctccgacgccaatctgttgcttttttttttgcgccgccgatcgtccgtgactctcaagctcgttcctcgccatgaaaattttttaaggtaccttatgtatgtatcgatgatttttcgttttcaaaggtattttactgatctgggagcgtaacatatgttctgtcgcgcttccgtgttgtacgtagcttcgtcgccacgcgcggctcgccgccgccggtcgtctttgagattcgtcgtcaccgccgccggcatcggtcatccacgatcgcgcagccttgtcatcgtgtgcttcgtcgccatgcaccgccatcaccagtcgtcggcgaggttcgtcaccactgtcggcgccggtcgtccacgatatgatgttcgtcgttaaccccgttactttcaatttgaattatttgattcatatgtatgtatgtatatatatgtatatgtatatatatgtatatatgtatatgtatatgtatgtatatgtatatatatatatgtatatatatatacatatatatgtatatatatatatatacatatatatgtatatatatatatagtagtactcattttccaaaaatacagctagccaccgcgtgatgtgtacttacgagactttttaatttgaccaacactatatcttagcctctttgtttcaacttaaaaactactatagtttagattatttaatcaaattactataagttgtattataataagatatcgtataataagtatgaggtatttgtttctctggattattggagacatggattattgggttttgaaaagctaatgtctataatgacctcagctattttgaatgccttgatcatccttttgtcaccatatacaacaaatacataatttgaaatagctaaaaaatattaccatatattaataaataaaacattcatgcatattttttttacaataggctgaacacaaaattattatctcttagccaagagagtatagggttggagcttgggaaaggattcacgcgtggggtggggtggggtggggggcttggggaaggattcgcacgtgactggggagagaggaagcagatgtgcgtgcgcttgagggagagaggaagcggatgtgctcgacctgttgggtttgatggcgctagttggtaatttgtataaaatttttaggggtggtgggtctttaaccacccaataatctgaaaaaagcatgtttagaggagattgccagattatactaatctggcttatagattataataatctatcataataatctacatgtttatttctgattacggataataatatagactataataatccaagctaaaacaaatcaggctgacggttcataattaacaaataaaggatatactctagcataaaattataaaattagatttacttttcgtaaatatatgtttgctacaaataattatcattgggtcggtatctttaccacaagttgcaatctactacgtcatataaaaaaaattgttaacatgtcgtatcatcatttttgtgaagtgtacgtatttacgggctgacttttgaatttgaccaacattatcatttagacggtccataattgacaaattgttaacgaccaaatttgataaatttatgtcggatttggagttaaggccgaagcggatttgggaggaaatcgttaatggaaacagggtatgattcggcttcggaaccgcatctgctacagtgtgcatcggcagttactgaatcggataaggcaagccgatgtagttcattccggcaaggtgatattggaatcattgtcggattgagttgatatgcttcatgatgattgccacgtgcggatcgagtccgaagaaggcagttgtatctattaattaggaatagtttgttagtaggaaagtgtgtttagtgtcctataagtactttatgttttccttttatctttaagaaagtttctttcttgtccgataaagacttgtatcaacccatgtgtataaatatgtacacccggggtctatgtaatctatcttcacaatcaatacaattcggcgcatcgccaccttttaccttttctactttattttatcgtccgggggaacttggcacctgacgcgaggctgcatcggtgttcgatctccggctaaggggtaagtccaatgttccgccggcccaggcaatagtatcgtttacgtcggcgtcgttcaaggctgcatcagtacattcgacctcttggattgctctggtttggaatgatatattgcctacctatttatcatatgtctttgttaatctagtattagaatatcaatttagctctatcggctgcttctggttttagggtttctgccggtatcgactaaatcgcgttgctagattagattagattagacatctaccaccctgaaaactcagtcaacggctttattgtctagatattatgtttctttttatacttagtgctacatcagttaagtttgatctactaagtcatgcttagaacccataatatctagcctgcttcttgattgccaataagggtttcattggggtttcagccggtgagttatctggacgttgcatcggctcataaggattgcgtatacatataagttggatttagccgatgacaacaaaggtttcactgtttaatctaatcttgtgaatttcatgacatcggacctccagcctgtcggtgatatgggcccgggggtatcccagctagagggaggaggccgccctcaaacccacgtggctccccccgaggggggtcgagcccagggtgaagcggcggctgccccctccctgcttggggtcgagctgtcccgaccccctccacgtatcagcccacgtgtacagggttaggtgggtgcgcttaacgcccacctaaccacatttaaagcggtctatgcagccacgccatgccgcatttaatgcggtgtgctgcgcatctaaccggtcgaatgaccgatgggacggtgactatataccatcgccctgtcagtgtgtcaggcggcgcgcaacgtgctccatcctatcccatcattatgatgaggggcttcacagcctcttatcccggtcagagctggtccaaccactctgaactgacccgggtatctgtttcctggtgtgaacaggaacctggaagtcctcaaccattaaacggcgaatgacaaggacgccccgcatgatctgatagaccccacgcagcagccgacgcgcagatagcttctgggctaaggcacaagacatgtaattaagatagagattattttcccttctccctaggtagcactcgcagcatatgtgggatccc

SEQ ID NO: 34343 - DNA, 3462 bp, Oryza sativa
  unsure (1)..(3462): unsure at all n locations
agggncttganatgaatatccgctcgccnnnnnnnnnnnnnnnnnnnnnnnnnnnnnnnnagcgcatattaatttgtagcttcagttgctttggaatttggtaggaggtttctgcattttatatagagctcggatggtggggggtaatttgtgatgccccttacgttcgaaaggcccttttaaaattttctatttcctcgtttttcatgcgcccattaagactcatagtactaaatagtaagtgtgctttctcaaaataattataaaaaatattctgaaaaattatagtattaatttattttaaagttattttaactaataattaattaacctcagtccctggcagcttgggacatggtatgcaaacccaagaataaaggaggagttctgggagtcattgaccttgaataccaaaacattactcttctaatgaaacatcttgacaaattcttcaacaagcacgagctcctatgggtaaagcttatctggaccaaatattatctcaacgctgacctgccccctcatgcttgcaaagaaacagggtccttttgatggaaagatattttcagactaattcctatgttcagagcaatcacgacaataacaattcaaagtggagacacggctcttttctagaaagataactggaattggacaggcaactccttggaacaacaatttgccactcttttctcctttgttgcaaaagaagatatctcagtctttggttttctatcagaacaaaatttagaaaacctgctacacacacctttatctacccaagcaatgcaggaggggcaaacaatccagtccaatctcaattgggtttcccttaatagctcagaagacacttggacatacaaatggaacagtcccctttatcggacgaaagtggtttactccctgttctttgctcatatcacacctgatctgcctctctctctcattaggaagagcaagtgtaccctgaagctaaaggtgtttttaggctacttcttgtggatcgtctcaacacaaaggaacttctttacaggaaaaatctatttgtcagcactgggcccaactgtgttctatgccctctatcaatcattgaagatttcaaacatctcttcttcacttgcccctttgccatcaattgctagaactatcttggaatcaactggctcacaaaccaggacttcatgatcatgataatctctgcatgaagaagtttcggccacccctttttttatagaaaccattgttgtggatctttggaatatttggaaaagaagcaatgatttcatttacagcagctgtcagccttctttccacacttggaaatctctttttagagaagattttactctacttttgcatagagtaaaagctcaggaccgacccttctgactgttttcccgtaaaaaaaaagaaaaagagttaaaaccttgtgttagaacacaacctaaagttgtaatgttgtggcatctccgtaagtttataagcgaaagcccagcctatttaggcaccatggagttcaagttcgccgagatcgtcaatgcagtggaggcaaccatccaggttcgagtcaccgaaggatcaagggacttcagagcacggttcttcgttcgcacagcggagcatcgatgaagatttcgtgctacttaattgattctaaggacgagaagaatgtcatcgttgacgatgatgatgatggcctcatcttgtttcagcgatctgttgcagtggtggagaatagggggaattgaggctgttcatgatgaggttgaagaaggtggtggtgctactgctagctagtccggtgaccatggagtacccgttcaatcctaggacagctttgaggagcaagctagggtgggtttgaccttggtttttgcaagatggatatcacggttgctacttgattggtctatgcttccatagcttaatttaccatgcatgcagtgacgaaccctgaataaaaattaccgagggttcaatacatattaattatttaattattgattaatatattaattaatataatgtaatttagataggatttgaataatctatccagggtcctgtgactccgccgggtagtataacgtagacacgcccctgcgtgcatggctgatgctcgatgcaaagcgagttaggagtaacaggtcgaagtaattgatcgtgtgtgcttttgcatgtagtaacttaatgaaatgtatggacatcttgtgaccctaatgtgaatattaagtaatatgactttttgagttttggggcgtagtgattttgtgaactgtcgatgatggggcgtagtgtctattttgtttctcattttcccaatagttttgacgaccatgaaaaaaacttataaaaaaaactggataattagtttgttttaattatgcctacaactacaattacattatcataatcaaccgcagtataaaagtactcctaatcaattacaatatggcatgtaatctctatatttgctagattagcattcaaatcatgtgttgccttgtctacagataaacttcttctctccaacccattcctctatgggtctgtttggcccaactctaaacttcggcaaatagtttcagctccacctaaaatagaaacggagcagagtggagcgctctcacaaaataaattagggagatggagctgggctgggtttaaacagcttcacaactacactacagacttaactcctgaagctaaatttagaagttagagctagctttaccaaacagtccctatatatacccctcaagaatcaatagaaatccaccgaattcctccactgttttgaagaacctctctatatatatacccctcaagattcaataatacagcctcaggatttactcccggaagtgctaatgggcgatcgatcgcccgacgacaagggtagcgatcgatcccgcttccccctccctcccttcacctggtttccttttttggcaccgcattacttttctattttagtaaatttatgcacctaaagtttatacacctcaagtttacacatctaaagtttatacacctcaagtttacatatctaaagtttagagatcaaaagtttatatatccgattcaaatttgaatttgaattcaaatattttttttatatatagtatttctatacatctaaagtttatagacctgaagtttatagacccaaagtttataagtcaaaagtttacatacccgattcaaatttgaatttaaattatatcaggattcaaatttgaatttgaattcaaatattttctatatatagtatttttatgcatctaaagtttatacacttaaagtttatagacccaaagtttataagtcaaaagtttacatacccgattcaaatttgaatttgaattatatccattcaaatttgaatttgaattcaaatattttctatatatgggatttctatgcatctaaagtttatacacctaaagtttatagacccaa

SEQ ID NO: 34344 - DNA, 3688 bp, Oryza sativa
ttatgcatctaaagtttatacacttaaagtttatagacccaaagtttataagtcaaaagtttacatacccgattcaaatttgaatttgaattatatccattcaaatttgaatttgaattcaaatattttctatatatggtatttctatgcatctaaagtttatacacctaaagtttatagacccaaagtttataagtcaaaagtttacatacccgattcaaatttgaatttaaattcaaatattagtttatagacccaaagtttataggtcaaaagtttacatacccatttcaaatttgaatttgaatttgaatttgaatttaaatattagtttatagacccaaagtttataagtaaaaaattacatacccatttgaaatttgaattttaatttaaatttgtatggtgtagtagtaagaaaaaaaggggaggtaaattagtaagggggaggggcgggtgatcgcttggaagttgggagggaagggagcgatcacccgctcattaggagtactcatttaccccctccgtcccataaaaacccaacctaatatcagatgtgacatattttagtactacgaatctggacatacacatattcaaattcatcgtactaaaatatatcacatcagattctagattcgtttttaatgagacggcgggagtaggtagcaacatgggtggaagagaccacaacggcaaggaaaagaagacgaaagaggaggcgccaactcatgggtaaatcagttgtatacatttccatcacactcttgtccagaatcagaatgattattctattttcacctattaacattaaatgtttttaatttgtctgttgtttgtttgcaagaagacaatagcataggttgaggtagcttgtgaacatacaaagaaagcttgtggaagcaaaaatgtaagcccatttctttgaatttctgagccatggaatgttgtgcatgttgaacaatgtctgaatattgtcttggtgttgatcagtcagtgcagcgcaagttaggcacagggcaagaatgccaaaccttgatcttccgtaacaattgttgttcgcaagcccggtgacgacggcccaggtggcccaggagcaggcagcgctgcagcagtagcagaactacccaattgactgagtgatttgatgtggcatcgatcttagttagagagatccatgcacttatgaataagaactttatataaggattgtcgaaacaagatttcggtaagatttcggtaatactagaagggatggcaattaagttagaaaagtgaatggatcaggagacagagaatttatacaggttcagatcatctcaatgagaagtaatacctactcctgtccggaaaaatattccaccgagtttgttattaatctgatgatctgggagaaacgttatgcccctaagagcatccggacccctccttatataggggaaggagacgagattacaacatacaacctataacccttaattacttgatacacaaattaacataatacccgagtcatttcctaaacataatctatctacatgatatatcccttataaaccaatcggatatccatattatgcgggtatatgatacccataatctccacaagaattggattagttgaattgttaagaagaattggatgtgattttagatttgatgcaaagctacgtactggcctattactagtagtatgaggtatcaatttaatcccttgatatgctcgacatttaatagatcatgtctgaactttctaagggcaacgacaataatatagccgattgcctactataaaaatctccaactcaactagagtaagcactacagacaacgtttttaataattgtctctaccacttactcaaaaatattattattttatctatctttgtgggcctaatttttatctttgttccactgtatttatggtgagcctagggatgaagcatactgctggctgcatgagccttggcgcccgtgcatcatcgtcgattatttagtcgacgacttccttctctctcctgctttctctctcctccacctcatatttctctttctctgacgtatgcaggctaatagacggcttccctagccttattgcacttgccctaagtgaactctctggatgcgttgtggtacttgataattaaggtgtgtgttgatgtgattaattcccaagaaactaatgtaatttcctgttaggaatacacacacataaagacccaagaggtatgtagtgacaattgacaactgaccaatgatatgtaactgaataaaatgtaaaagtattatatttggttgagtgccaaattttatttttcatcacttgcggctaggttaacgaaagtgagccccatggcactctttattctaactcacttgacccgcttgacttacggtcaacaattcaccaaagtggaccatacttaactatattctttccaacaagggtcccttccaacaaagtatatataatgcggataaaacactctcacttaacactagttttattagaaaaaactccctttcgtttctaaattcttgaaaatagacactattcatatttaaataaccactcgtgctttttgctaaaagaaaaaaaatacaaatatctaaaaagatgatgtactttaaacgtaacttacgtaagaagttatgtttatatcgtagattaaccatttaaaaattattagtggccaaactcgtaatagtagcttgccaacaaaaaagatacttagatagaaagagtaagaatttatccatcggtcgttaaataagtataattttaactagtcaaagacattaaacaaaagatttaaaaaaactatgcactttattaatatggagagaaagtaaggagatggagaaaataataagagagattactattgattcaatggctaaaaacaagattaaaaagatgaattagtagtgttagaagagttctactccacattaaaactacatatttaaggataaatcttgagactaacattatatttattcaggaacatagggagtatattcttaacaatagatagtacacataaatgtattatcacataattaagtacttttcttaatgcaaagatatcatatatacgtacactcaatatatagatgaaacaaaattgacatacacaaccatacatataggcatgtgcatagtactccacgcatgtaagaacacaagtagagacatgcgtgtttacacaatgtccagttataatttactccaagtactatctccatcttaaaatataataactttatacccgatagatttgacacaatctaatattattgaatctagatagatttattcataacatcaatttatgtctaatttcgatactaggttactatgtcttgttgaggatgctgatgcctttccagcgagactccatgcggttggacgggttcgtctgcatgtacacgccgaacttgaagtagtgcgagtcgccacccttgccggcgacgcggagcctctcccggccatcaatgaagacggtgagctgggaggcggcgacgtcgtggatgacattgaggcggaaccagcggtcgtagatgttggtctccaccacctgctggtggtagtaccaaaggtcgccgccatagacgtggagcatgagggtggtggcggtcccgccaccgaacacctgcatgatggacaccccgtgggtgccgag

SEQ ID NO: 34345 - DNA, 13393 bp, Oryza sativa
  unsure (1)..(13393): unsure at all n locations
gctggattganccncatganaattactngcccatgcccgcaggncgactttagaggatccccagacttttgaatttgaccaacattatcttttagacacaaattaatgaaaacaatataaattatataattagatttatctccataaatacgtgttttcatgtcccatctcgtcatctctatcgatgtgttcgatgactggactgatttagagcattattattacataaattactgtagcagaaagtagtagactgagtgattattaatcattttattaatttattgaagctaactaattaattaatgaattaatcaagcacgccattatgataatacgcaccgtcatcctgatctccgtccttgggttggttccgctctgcggcttgaagggcttgtcgtcggagaagacccacagccgcctcaccgtgccgtcgaagctgtacctcgagctgctctccacgtcgtacggccactgcagctggaagttgccatcgcccaggctcaccgccgtgaacccgtccctcgggtcggccgccgccgccgccgccaacaccacgcacgccgttacaacccaccaagaagaagcagccatgtttgtagcttgtgtgtgtgtgtgtcggttgctttgggaattggggtgatttggaagaggtttatgtggtttatatagagctcggagggaagcagctcctatgacctggggcattattaaagaagcctcatcgagttcggatgggtggggattagagatcccatcgtttcgccaaataagtcaaagcaaaaaatttaaatttggtattgattttaagatattttctacgtaatttttttattattgatttttaagtcgctacgaaaaaatatatataaaagttttacatataaattattttttaatctctaataagccgttttggtttatcagggaatatgggcaactaatcaggctcttaatatatgacacaccttttttttaattatatggtacaacgcagacactcacaacgcacgcacacttacccctatgaacatacgcacgtaaaccctacctctataagcatctttgaagactaagccggcaaatccttgagattgacgaagtcaccacaggcgctcaccgtcgacgggtatgtcgcctaccactgaaagcacaacgccgttaaatcctacaaaattcgctcccatgaagagtcgaactagagtaattgaaataaataacacagtggagtctacttgttcacactttgatcaataataatttctaaactattttattttatatgttaaaaatcatatcgctatattcattttgtatcatgattttgtaattaatatgtagagtttagaggctatttctagaattctttgttggaaaatagtgataaaagcgtagatgtgcagtttagtcatacattttggattattaaaaccagtagtaatattgttaagtacggagaattgcttcttaaaaaagattatggagaattaccacaagtggtaaatatgtttagtccccagtgtccttttcatgacataaaaaagttctataccatattttaagctttaagttgtctatagtaagagaaaaaacatagacgattggttgtttccatcagttttagtgcattcttatactatattggcaatcaaaaccagtcaagcacgaaagtaggtcataattggtgataggttgttaaaatcatcatcctgaatcgaaatgagaaattctaaccatgatcacaattatataatcgtatatataaaaatcataaaattatatattttacttatgtagaatcttacaatcaaagcatcttaattagaatcgtaaaatcgtattaaagaattgagattggctagctaggtttctaattaggacagcttcatttttgctttgttttaccctgtctccatggatttggtctatggtcatgttttttaacacttcgttgtacgcttcgctaagcgcttgcttctgaacatcggaattaccttccgatctgaacatgctcgtcagtgacaacgaaccgtcgatcatctgtaccgtgcggacaacttcttgtttctttttggggtaaaagagctactagtatttttttgaaatctatttggcatggacagcatgtgtgtaactttaaaattaaatattttatttcaaaagtatgtactccctccgtccctaaatatttgacgctgttgacttttttaaatatgtttgaccgttcgtcttatttaaaaaatttaagtaattaataattcttttcttattatctgattcattgttaatactactactactcaagtttttaaataatattcacaaaagttcttgaataagacgaacggtcaaacatactttaaaaagtcaacggcatcaatatttagggacggagggagtatgtgccaacaaagacttttcgggtcaaatatatcggaacaatttatttatttatttatttatgcattagttccatccaaagttcacgggtgtcgcatacagagttgaagatgcaatttcagtgttgtctgaagttcacaagctgatgaaatgacgataataatggaggagaaatctctctgcttgactgcttctgttcggtaaccgacttcatcctacgctgagtttgaaagagagaatagtattgaggtttttctggcaccgaaatcaaggtgagtcattagcatatgattaattaagtattagctattataaatttaaaaatagatttatctattttagaaaataaaatacaccttttaataatttaaaaatcgtgctatcgaaaaaagatagagtagcgcgctccaacttatctttagaagtcaagccaagtaccaagcctctggctgtgttcggacagcttggttcccaatgttaacgcgcggaaaacgaaacggttcattagcgcgtgattaattaagtattaactatttttttaaaaaatagattaatttaatttttttaagcaacttttgtatagaaacttttttttaaaaaatacaccgcctaatagtttgagaagcgtgtgtgtataaaaaaaggaagaggggttgggaagaaggggtgcccaacacagcctagctccaaccaaacataacagtaactgatagctggatgcctggaaacatctgaaactgtgaaacatccacatcttgcatctgcagaatcacgagcacaagtcgccgcaagcttgtgtatgtacacacacacctagataaacttgaatttctaagcgataagacaagatcgcaattcgcaagccatattcaggccctattttgtttaggtttataagccaacttataagccgaaaagtctaagcctaaacaaacaagcagcttatttttgtttagtttttttaagccataagccactctaacactattaaaccaaaagctaggttggagaagcttttttggcttatgtgaggttgatgtatgactccactactaaacttaggacattaaatccaccggcttataaatcatataagccaataaacctaagcctaataaaagagtggcctcagtcagctgtcaattgagaaggatgatacaggtgtgttgaaaaattgtgcaggttggtcaatcatcatcaacccggctgctaacaatattcagcttacaaattagcagtcaatagtctcactagcaggcagagagatggcaaaggctccattttctagggtctatgtttgaactgctgtgtcactttgaagatgagatgagataattcatagatgaagatagtatcatggtattggttcagctaatattcagcttacggattttgcctgtgaagtgaaacggttgaaatttgatagctagtattcttcaagcgtatcatgatattgcttcctttctacgccctgtttgggaaacttggtttgtagcaaccagggtttacaattccgacaggcttttccgtttcgggcactggtggaattcggaatttcgcgaaatccggtggaaaaccggtaaattctgaacaaatttcataaaccaaaatttgaatacaaattccctaagtttaccgacaaattttcgaaaaccgatcagttttggcgaaattccgatcgaaatcatcgaaatttcgatcagtaatttgttttcctttttttaattctttattcttttcttttctgatgtaagtttcagtaaatacacataatacataatgtttttcgaaaatttatatctcaataagttatatgaatatcatagtatttataagattttatttgattttatttttttttatgaattcaaatttgaatttggatgaaacttctcgaaatcttaaacggtttatactttcgagcctcatcgaaacatcaaaatttcgcgaaatcctgtcggaaatgtaaaccctggtagcaacagaatctgaatgaaaatctaagcgtggaggaaaaagcctttcaggaagagcttcctcgttcagaattgctagggcttgcaggttcagaattcagaacgcttgggaagtgtgaactggggaaggaaggttttctttgctgaaattagaatcaggagaggagatgacacgatgacagaacccaagtgcacgcatgttctctataactgtttttttaaaaaattacatattacaacgcagacactcacaacacacacactcatccctataaatgcacgcaagcaaaccctacctctatgagcatcttcgaagactgggctgacaaatcctagagattgacgaagtcaccacagacgtctcactgtcgacaggtacatcgcttaccactgaaagcacaaagccgttaaatcctggaacctaggacctaaggtgtaactgtttttttagtgttaggctgtgtttagttccacaccaaaattgaaagttttgagaaattgaaataatgtgatggaaaagttgaaagtttgtgtggataagaaagttcgatgtgacggaaaagttaaaagtttaaagaaaaaagttgaaatctaaatagggccttacacgtatatgtacaactcatatacagctagagacacgccactatataaatcaatcaaaagagagcatatttatatgcactgcgaccgtttacaaccgttgatccgttgatcaaattcagtcgtacgtaagtaagacaattaagttatatgcatagcactttcctaattttttttatttcaggatgtttttgcgattgcagtcattccttgttttgtaattgtgatttcagaatcttaggacaaatctagcaacagacatggtcaggttctttcttttggaccttgcatttataaaatacaaaaaaaacacaccatcaccatgttgcatcgcacacgaccgttctttgatcgttttaaactcttacaataacgaaccagcacattttttagagcacccgcaatgataaagtaaggtgctatctataaaatatgtacatctcagcaatagactagattaatcgtataccacctcaatagtatatctacacatgggtttctatagctctctaatcaattgtctcgtttttctctatagattatttccaggttaatagatagttttgctctctctcttcatttaatctcttccaagtaggaaaatatgctgacatggatctcttgtagagagcctataaataaccattgtgggtgcccttaaggataaatgcccactgaaccccaaaaagcgcaagcaatataggaataaaatcctatatgtagtaaggatttcccacacttagcaaacaagtaagctgcaattttcttccataacaaaattaactgtgctacagtgaggatacagcaaaactatagtaatattctaagaaattgaaacatcaaaattgatggctgctggtgccagatgttttctggagaacttgtctgctcctttgagccccccttgtgagatgaacacgttttcgaggctttgtgttagcagggcttcctcagcatgcacagggagtttttctggtaagttttacgagccaccgaggtcaacttgtttctcgtgagtttcacaagctaccgaggtcaactttctggaagtgctaatttaaattgatgattcaagacctcttcttcttagactcagatttctctccatcatttcctttcctttttgatttcttcatttctttgcgcttctcttgcttgtcagcctttgtcttgttggatttcacactgataacaccgcttgcggaaatctttcctccgttcagcgccttctcaatctcatcgtcatcggcatcaattgcatacttttgcagaaactttgggtccacatcatcctcatctattgctcttctttgttcctatatttgcccaagataaggttagcaaagaaaccacaactttggcatgcaaatgcaacctttttttttattcgtgtttaaatgtgtcacgatattgtccacatctaataatggtgctcaaataatttaggtgttttctgtacgagacatatggccagttttaatattttaatcggggatcaactgcacttgaactcataaaatatttcaacatcctcattactcctcagtggacgactcaagattttaagtatgcaacgcattactgtatctaaactctaaagaaaacatacctttactttccctgcctgcttcatcaaggtcctcatccaatgatttaagaggagctgtatcaatctggaaatagtagtcagacatagcagctattatgagattatggccatgcacaaaattttatctaactacaccatgagcattgcttccatgcccaccaatgaacaatgccaaatctggaagtgcaactattacgtgtcaatactaagttgacaaaaggaaacaaaatatgggtgcttacttnctttagtcgnggtatgttgcttcaatttcttttcctgcaatattatgaaggtaaccgtataacttcttcattgtcttgatgaagtttgatagaacctgttccctctctatccccagttcttcctgtcaacagaaaacccaaaagaataagacgtgccatctcgatgaattttaattccaagtattttgaatttgcttgggatcaacttgagctaacctttgtagcacctatgtctttgtcttgtagtcccatacagaacaaaacagctgcttgggcaccatgtagtgtaacaggaagcttctctgaaaaatactggtgtgcaagaatagggacaaggtccagaatctacaaaaataacagaaaaaggtgaaaattggaagtgtttcaatgtagctttataacacaacttgtattcatataaaggcaaatgacaacatctgaacttctaacctgattgagaaaatgctttcatgagatggaatttaataaacgaaaaggagagaagataaccttctctgatcatagcaacaaaagctacatttgcagaagtgaacggtaataaaatcataaggaggcagtgatttgcagagtagctgtgcaggtattaaatatttccagaaatctgaaagttgctgagtgatctataacaatgtagaaccccaatttgcatccctaccaaacctgggcctagaaattttgccttgaacaagtggaatcaaactaaagatccttcataaatttcttaccagatgataatcgaccaaattgttagaatatgcttccagccgcttcatatcatgtggtgatagcatatctcccaatatctttgaggtaatattggtataatagtctgagggttcgtgatctgaaaaatcaatcttggaagccaatacactgggaatacacagccaataattagaacatcaccaaatttctttcccatgaaaaaaaatttgaaacttcaatatacctcattgcaagcttaaaattgagatgccggaaagatgttcctaagagacgcctgaatctttgtctgaaatctgggcacattgttccaaaatttagctaatgcaccaaaaaaatcaagcaaaaggcaaaatctgaaccgtaaaccttccgtcagatttgctgtgtacagttaagaaatcaagcagcttcagtttgaaatgcattagatgaggaaacagaactcatgattttgtaccttgataaaatggatccaaaaatccacatttgcttgactcattaacttcaatgtcatcgctatttaagggcctcaagaccatacaagtatgctcaccagtcacagcactctgaagaatagatggaggaaacataagaagctactacaaaagaagaactgcagaggtgaagaacaacaaatagatcagattagatcattacaggaatttggcccacatagaatggatagaagttgtgcttccgccaaaaacggaaaagctcttgtgtaagtccaaaagatacaccaagataatggagcttttcaggacgacgttcgcgaagatggacaaggagtggtgggagatttgccctaggctttacggtctcttctagtagagaagcctgcaatagtaatatacaaaactgtaaggtagagacttgtggtcaagcaaaataatattgtttggtcacaatatattaattcaaataatatggtaggcaaacagaggcttgcatcacaatgtacataataaaagctgctgtgctatgtgcagaaataaaaaagaactactatctaaaaatattacaccatgcttattttgttcaaagtttgcaaatttaaaactgttcatacattaaaatatgtagtatgaaaaccatacaatatagttctaattgtagagctatttcaaactgttgcacaataagatatcaaatgggcataataaatagttgttcaaatgaaccttctctgcagcctcagtgatcctgacttcaggctcttcattttcctcctcatcctcagcaaatagagtcatttgcccttcatagtacctttcaaaccaaataaataaatgtcagtaattgagtatgggtaaacaaatccttgtgaaaaaattactaattaaattgccagtaagattagacaagtccgttccctatatctaccatcattaatcatcaaataccagtttcagccaaaaaaaaaacagaagagcatcaacagatactacaatccacagcacccataacccctagttggggtaaagaagagaaatgcataccttgtcaaaaggtccacagcagctgaaccatatccaagctgcattgacaaaggagaatatttagagtgtggagagtgatgttaacacgtgcataacagagttctataaaggcaataaacctcaccctcacagcacttggatggacagcaattcgtacaatccgagctcctgagagacttggaaacacgttgtcttgaaactgttcacaaaatttccatggtatttgatcaccagaaggtgaccgaccctcacttaggcttttcatagctgattttcgagatatttgaccttccaaacagacctgaagatcacaaacaagtatatttacaagaaaggtcaacatcttgaaatgttgtggcggttgtattcagtaggaactaccctttaaattttcagtctagattgttcatatcatctgaagatgggcatcagtggaagtgaagtggagaagttaaattttaacaagagttaagtactgaatttaacaaccacgtgaataaattagttcaatcaaggaaaggttcagcttccagcaaagctaaaaatgtattcagcaaacaatgcatagtaagaacaatgagttgaagctaaagatatgaagtaatagattttttttgtagggaatgggaattagttttaaattaaaagaacttttaaaaaacataaagcctgagccctacagatcagtcgttaaaaagttgaaccagatttgcataatgtggtgtgcacatataatgagttattacaccagggccaacacatgaagcttgagcacattctgatgaggtaaaaaataaacaatgcaaaactcactaaaaggttcacaattgaaagtaaacagtaagctatgaaacattgcagtgtctttacattgtcaactaaaaactgaagttggatgttttccaaaatagcatagcaccggagtgttgccgcagatgacaaatacatatatgatgagataaaaaaataaaaatgcaaaaaaatcccttaaattaaaataagtatacagacgaccacatgagatcatttcaagcgggagcaggtgcagaacatactcactccattcttttttacttgtcatttagggcattggcatggtccaatgcatatcatttattttgccttttctaatgatatatccataaaaacatattgaaaatataactacagaataatatttcattaaaaaaatgctaatatcttatttacatatgaaaccttaatgttttttgtgtatattagtgagttaagattactaggtttgactgcatggatcctaagatgacatctatttctgaatgatgggagtaccatcaaactgaacttcccttttttataacagtatgggcagatatggtgattcctatggcaaattgactcaacaacatcaaatagattgataaacgctgaatagtacaatagcaaattaagatgtatgtaatttttgttactggtgcatggcattaggatgcatttctacaattatgtaagaaactttaatgttgttcggctacaccgcaattagagaatcatatatttcacacttttggctactgtgcaagccaggaatcagcatatggccatcattaagagaaaatttcaaaataaaatactaagaagatcaagcaggaagcagtttagaacctggacttcacataaaatatccgggagctggtttttagactcatcgactgggcctagaaaataaagaacataagttagtacttagtacagcctgacagtgttgccatggtgaacagttgggaatgctgggcaattagtccctaccaagcaatacaaataggtgatgagccggcgcatcagccattagttgcaagtcattgggtgaatttttgtaatgggaagcaacataaagtgccatcatccgctgaaatattaaggaattatgataagcatccattcatgaataaggaaaaaagagcatttctaatccatacctgtaaaaatatctcactctccttatgatatgagaaaagtgtgtctcggttgacataataaagatcacattcttttggatgaggtagcctaaagaaaaccataaattgtttcagacatgcaagtaacttggaagaatacaaaatgcaatttagatgatgctcacctactgatattggggatggagttcgcaagatccaaacaaagtaaatcattaagccagctctcaataggatcaccagatgcatacctaatggactcatttaattcaattttcttaaaaagcctacctacaaaccaaaacaaaacacaaaataagtgtaaaacatccaaaaatccaaggttcttcaaaagaagtgcattaaacataagaacctctgttttagatgaaagtaagaagactcttacttgaattgggtccattatttggagcagatggctggctttgggattccaactgctgtaggagcttcaaagacaaggatcgcccagttccttcgtaccttcaatacaaaaacatccagaatgattacaaccatgattttcagtgttatctcatttcgaaaggaaagcaaacatacccattgacagtggatgataggaaaacaaggtatggaccaagcaaggacttaacaattggcaatggaatagcagcagcttcatcaatgacaaggagctcaacttgagaaagcttcccatgatcatgtggtttcagatactgcaacattaaaaacagttgaactgggttgattgatatcaagcaaaatattgctcaatgtgggaataagctagtaaaaattatgtctgggaaacaacaaactataaatacaattttcaaggtatgaaccttaattgaatttatcaatgatcatcaaacacactttattgaatgatctacaaacaaagaacattatcacgaaaacaataatggtatattatatatatgttttatgaactacagaggatacagctcatgtgaagaagaccacccaacaatctacccagaataacgtaaactttgccattgtgagatttttacataaaatctcaggaaggaccagtatgcattaaaaaagtaccagtcctaattaaattttgtatcatatatgctgcgtttgtgtaccttcacaggcaagtaatagtaataacaaggacataagtttttcaatcttctgcagcatttaatagactggattattgaatgtgatatttatagcagataacaacatcagcctttggtcaaaggtaagttgggactaggctaaggatgaaacctaagtagaaacaaatgagctaaaaggggggaatagctaaaaaggcaaaagattaagctagttaacaaaaagcattccagctcatggttctagcatatgaatagctactttccacaaactcctacccaaagccagttctttcgacaccatgtcttcttttaactggttcctcccatgacagttttacataacccatgcctccttgtatttttgaaatggtttcgagtgcactacagactagttcttcagggggggctccatggtatgccaaaccaccacaagcgatgttggacaagcttctccccaatcagtgccactcctaccctaccatgtttacaataatttctaattcaatccgtccctgtatgaccacaaatccaccatagcatacaaatctctgctacaatcaacttctggatgtgttttcatattataaccagacataaggtaagcaaagaactatggtaagcaaaaatagcataatctcaaagtaccaagtcaactaccataatattggcatggccataagataatgtgcattttaaatccaccaaaagtttagtcctcccaaacaggatactaaaggtttctagggaagctaaaggatccctttgctcatacagtttgaactttgaagcccctttccaccaacatctgataagtgataagtctaaacagaacagaaagaacctttgggtggaagtagtaactgtctacctggatcgtctgacgatgctgcttgtagacatttatttgaatagttgccttcttgagttctggatctgcactcttcaccacatcataatgcaaatgctcctgaaaggggtgaaatgatacatacattaactgcataatacagaattaaactttttaactccaagactagactagacagacaccttgtactccagtgcattcattcccttgcacacaaaatcaaacagtgtttttaggttttctggacttggggttgtgacaaatatgtttgaatacttagaaagccaaagattagaatttattcccgaagaacgcaacagataattaactttnntnnnttgnnggtacnaagcctncatggccacgg

SEQ ID NO: 34346 - DNA, 753 bp, Oryza sativa
  unsure (1)..(753): unsure at all n locations
gatgggcattgannnncnntttgaaaattgatagtaccccattnnnnnnnnnnnnnnnnnnnnnnnnnnnnnnnnnnntacatgagttaaacattaaggacatgtcataaaagcacagactgcatactatatctccagctatataaatttgtgatacctgaccaacagaaccaaaacgatgcacggtattttctcctgttccatcagaattcggaggagaccaatacgaatcaaaagaaactccactgacctgtcaacataaaattgaccttgtcctcaattacaactattgacaggaaacatcgtggcattgacaattttttaggcaagttaagttgtacccaggaattatgcccttcgccccacgcgactatctttctgtcatccatgctccatacctgcacaagatcatcttcaccaccagtcaacagatatttgccatccgagctgtaaaaacagaccatgataaaataaggtaagaggaactaatttgtggaagataatccagtggtaaacacaaatagttgctgataattcaaagtcgcataaactagtgataaacaattagcagataaaatgccacggagcagaaacctgatgacatggtagagaccaggccagagatgtgcctcaacgtgtgccgtgctagaaactagtggcgccaaaaactgtgttgttaatttgttaccccaaatacaggggaataggcatagtacaccgtaatgttatgcaaaccaaaaaagtttctcacan

SEQ ID NO: 34347 - DNA, 6655 bp, Oryza sativa
  unsure (1)..(6655): unsure at all n locations
ccggccttttgattctattcnnnnnnnnnnnnnnnnnnnnnnnnnnnnnnnnncaaatatctgttgactggtggtgaagatgatcttgtgcaggtatggagcatggatgacagaaagatagtcgcgtggggcgaagggcataattcctgggtacaacttaacttgcctaaaaaattgtcaatgccacgatgtttcctgtcaatagttgtaattgaggacaaggtcaattttatgttgacaggtcagtggagtttcttttgattcgtattggtctcctccgaattctgatggaacaggagaaaataccgtgtatcgttttggttctgttggtcaggtatcacaaatttatatagctggagatatagtatgcagtctgtgcttttatgacatgtccttaatgtttaactcatgtagtatcaaagtttctttttgagaagtgtagtaatcaatgttaataagcaatcataagatgcttatttctccgtccactcttatgctgttgtttggctttaaactgatcaaactatgtatgtagcaggatgtgctaacttcttatcatactcgtgctattttctcgctgtacaatctatgacaatgttttctggttatgttaatcaacttggttagttattaatatcgattcttgctcatatggttagttatagtgatgagattcatttgggcaagttatttggcaattctttttacatgttctatcgctggcataacttttcactgtttcatgctcctaggacacacaactgcttctgtgggacctggcattggatgagattgctgtcccactacgacatccttccagtggctcaccaacttttagtagcggcagcccttctgcacattgggacaatgcatgtctcccaacaggtgttcttcaaccttctccaagaatgcgagatgtgccaaagctctcaccccttgttgcccaccgagtacatgtggatccactctcaggtctggtgttcactaacgaatcaattctcactatttgtcgtgagggactgatcaaaatctgggtaagacctgatcagaacgaaaacaatcatcagtcaaactcttcggagttagttttaggtaaccctgtttcaaaggatagggtgatcacaacttcaaataaagcaaccggttccagcttcaagcaatcttcagctgttgtcttcacatgacaaaagtgttctggtgggcacattgctctggtaatctggttaattgatcatcggtggtcatgtttcttactaacaccgtgattttgggaagggggtgggaggaactcttgctggtgatggagccgctcattttgcgtggccagatatgccagtgttgccatttgtgtggctcaatggaataatggggtattctcctgtacagagatacatatagtccaagataaaatgtacaatttcaccgtatgtgtttcgtacttttcagcgagccgactagtgatgggaggataatggatgccacttacctggtggtgttttcttgtgttttattagtatctaaaaagtctgtaaattatttattcatattattgttacagagcccttctaattatcgcctggtgtgaactgtgaactgctctctctctctctctctttgatctgttaacaatgtagtatcttcaaataaagcaagcggttcaagcaatcatcatctgttccttggagcaaaatattttggcaataggtacctggctttcgctcgtcattttttatttttcttgcactgagacttatgtggcggaatatgaatgggaagttgctgttgttggaatcgctcatttgtatgctgatatgttcggaaggcgctctcctctgctgctactccggagaaagcggccgggcaagcagacatctcagttctctcctttcgttagttctgggaagatgattatgcggtcttgctctgggctcatctcttatttctccttccttggttgttcttggttggtttgtgcgcttcgtttcttgattggaaagtgggagagagaagaaagatcgcacctttgtgtcactttttgattgtgcaaagaaaaattctctttttggctggtcatgtgacatgttgggcttgtggcaattggaaaggcagaagaatgtcgtgtgcttgcgagttgtatctctccgagtacaatcaaatgaatgtttctgacggaggattatatttgggaatgacgtccctttttcacacatttctgtcagtcagtcctgttcagatgaaactgggtggtactgtagtagatgtgcacattcgggaatgataggatctgaatttgggaaactatttataaatttgaacactgttcgacaatttaaaaatcgtagttgcccactttaagagtcaaatttagacgcatttccagactatgtatcgttttgggcctgggttttcaggttgggtaagtaaaattacctgatctcccccggccccccacccaccccccctcccccaaaaaaaaaaaaaaagaacagatgcatctgcatggaggatgtgttctaatagtgcatcagccacaggggaaattgtctttcctggatcagcatggaaacgacaggaagtgcaggttgcacatacctgctcctggtggaagcatgaacactactaatctgagttcttctaaattaagatggttttttagacaggttctgtaatgtttggtttacttgatttattgtcggtgttaattagcaaatagttgcaggttcatcagtggccactccagatacctattcagtccatatctcctcagaaacccacaggattgaggcccggttggcatctgatgaagctttagctaggcaattgcaagaggagaatgcgcatgatgtgatcgctacaagagaatttgctatggtgtaacaaacaagcttgcaaggtttcccaacctgtacaatataatctcaactgcatatggcagcagtcaaattatcctccgatatcaatagttggcgttctaataccatatcagtgttccccgcaaaataaaaataaaaataaaatatcagtgttattaatttttttgtacatttaaacccagacacattttgttaagaaagcagttgggcgaaccatgaattgataggactcacatgtaagaatttattgttcttctcgcttattgaatcttttccacaaatgacttgagcgattctcaacgtttacaagttctgtaaaatcatgtattttatacacaatactagtaactccgtacgtgccgcgcgtccacttctagtttacattagtcttatacaatcactgatacatgtataaatcctggtaaaaagatagataaaacaaattgtacaaaaggagacggcgacgcaccccatcgtctagtgattttaaggtccgggtgtttaagtctctgtttactgcgagctccatatataatgcaattaagatttgattaattatctgttgctggcattctgagcagcagcagcgcattggcatatactcctaaatttttagcagcagcaagccaattaattatccggccacgtaatgaaattctctcaagtggggacacgttacgcctatgcatgccactgaacgtgttgcaaatacatgaaaacggaacaaaattaaaaggggatttcacgtacaaacttggacaaaatgacactgttaaagattgtactaattaaataggtgaacacaccccaaactaccagcttatccgttcacacagcataaaagtagaccacaacatgaaatagctccttcaaccaatgtcgagaaacgacagaatcctctccaggaaccatagcatatttagaagaaagcaaaatggtagctgggcaggaagatgtactataagtaggatcgatgaagttgacagatgtgattcattccatattgttcctcgtcctgcaatacataaatcgtgaatttccttgcatacaatatctgaaatgtccaccaacacaaatgatttagatggatggtgttccaattaaacttgcgtccattagcaagataaggctagcatgcaaagatgctttgtaaactactccagttgtgctataattaattttagaaagaattggcaaaaacagccactacttaagaaataagcatacttcacttacaaatgctaaaagtttccaacaatatactccatccgtccctaaatatttgaccccgttgactttttagcacatatttaaccataaatcttattcaaaaaacttttgtgaaatatgtaaaactaatatgtacaaataaaagtatatttaacaataaatcaaatgataggaaaaaattaataattacttaaattttttgaataagacgaacactcaaacatgttttaaaaagtcaatggcgtcaaatatttaggtacggagggagtatatttaaatatttatgtttaaatgtttggaggaagaggctactgacaggaggctaacaattgcaggtacgcagcaatcaacatgcatataagtaggatatggatacataaaaactagcaatatatataccttgagaaagtgatgaacttggagaagtcagatgggaggaaggactgcggaaagcgcgactttgcacgggtcaggccagcgtcctcagtttgaaggtcctccttcccattgatatacagagaagatgactccacgatcttggtgttcatgtcaatggcgacgacccacatcttcttgatgacataccgtaattcaggggcaaggaagtgcactatatgtggcctgtcaatgtccacttgagggaacatgagtaaggtgcgtgggaggcagtcaaggctgttgatagaccagagctcattggaggtgatcttgtagtcctccctccactccatggttctcctgtgtttcttcttcttcttcttatgttctcccaacacgaggctgtagcaggtgacagtaaaaccagcatcacgcctgagagactcaaagccaagtccatcatcgcgggcgacgtcgatgaatttgagcacaccgctggcatcaaggacagacacaccacggtacaaccagaagcattccttgttgcgacgaggagtctcatgatccacagggaacggaaggaaagagacgacaatcgcggcagggtcataaaagaggatgcctcgcatgtagtcaatccagcacagctggttgtcgaaggggatcacagtgtcggtcttccaggagtagagctgatgcacatcatcggggttgccatggacgtggatcggcagacggatggtgcgccaaccgctgctcgctacctttgatatgtgcgaccgcagcaaacagagttgagctaggaccacctggggcctggataggtaaagattcagctctaccacctcgaactgatcttggttgcctaggtacaagaggcccgtggatcggagcatcaccatgcggcgatcattctcaggaggacattgtccagctcggtacaaggagggagcgtctgcaaggtggcagaggcgtcatagatgactaagtcctgcacgtcaatttgatctttgacggtggagatgagggaaaacaggacgaggtgacggtgggtcgccacgacggagaacggcaagacattccttgaatttggaaagcctggcaactgcacgtagatgcgagagatgcctgggggattggagaggcggaaggcgacgtggaagggattctcctgagaggtgaggcctgacgccctgatgacgtcgtcggggaactccttgtcgtcgtccacgcggaagatgaagcgctctagcatcacccagttggggaacgaccgggcggcgcacatggcgacctttaacacactagattggaaattatggcaccaaggggaatcgctcgctgtgagtacgaatcaggggatttgcaggtgagatgccttaccgaggagagagagccggcggccggcgcgtactgaagaagacgaatcggccgagaggacttggcgagaggcgtgcgggtgcggccgagcgattcaggaataaagagagagatttagggtcagggggagcgtatcctatgcacacatgctctcgcgtgtacaccaactaaaaattatcataaaaaattctaggaaaatttatacatatactttcaatagtattacatctacgtgcaaagtcgcatcttcaaattcattctacatagagaataacaaaaaagataaaattctgacaaaattgcaaccttaaaactgttagattttttgtttttttgttacagctaaaatataatgaatttgacgttaagattttaacactaggtataatacaattgaaagtatgtgtatagttttttttagattttttagtgatattttttagttggtgtgcacgtgtgtacacgtgagggcctgtgtgtataggatatgttgccagggttaggagttgataggtaccgcttttatacgaagccatatgcaattgggctcttccgtcacacacgtaagatggacaagttatgaataagtccaccttggtcccccaactatgactcgaattctatttacatctttttaactatactagcaaatatgcccgtgcgttgcaacgggtgaaaaaacgtaatgataatatacgtttttcatgcataaccatgtcgataannnnnnnnnnnnnnnnnnnnnnnnnnnnnnnnnnnnnnnnngttntacaatcgaantcaaannttccaca

SEQ ID NO: 34348 - DNA, 2309 bp, Oryza sativa
  unsure (1)..(2309): unsure at all n locations
aagatcttgatacgtcttgttgccnagagcactcatggaagaggcttcaagtcccaaagttcagtgtgtgttatttgtgtctgtaaagaacactgaaactttcagtatatgattagtcaaaagaaaccattatagaactncagcaagacatcgtcgaattcactgtggcaaaggtaaggttatgaaagaaccagtaaccagtgactctgctcctanccagaaatctgatatggnccgtatgtagtactgtggtggatgaggttcaaagatcggtacattaaaagaaatctttgtaggtgctcctcttgccttcttcattagtgtgaacaactctgaatgataaatagtatcattttcagaatcctggaaaataaaactgaatgttaccaacgcattttcctaaatcacttggtggtaaatacattaatgcatgacataaatatagatagagttctacaggatcaaattaaaaacatataaaagggaatatacatgcttcgtatatcctctaccacttaaaaacaagagttggtggtgataatactagcctctagcactctatactatcacccttctgtgaatttgtaggatcttttgcggggaaaaaggattgcattatctgtagatcctaagtgactacatctatagcgttttagtttctttcaaaataataattttgcatttcttacactcagaatttatgatacatttatttgatatttgtcgtggcccacaacactgtgttagcttttagtataaccgcatgagtgatacagttgatggacaaggttgctgaggaagatggtgagatttataactgtctctggagttactaatttgctatccacgaatcaatatcactgtccaatatagttggaatcctcaaaacattcatactaaaaaaagaggtgcattatccatagttccatacttcatacagtactgaacagagtcaacaaaaaaagcgatctctaacaagactataagagaatatttcatcgaagcaataagacaatcaaaatggtggaagatatgttatgctacaactctaaaatgatgtagcggcaggagcatcaaaataatatatgcaaagtaataaacctcaacaataatccaccatcgtagcgacatgccatgatgacgatctctccacaaaaattcaggagttataagaaggtccacctacaaagcaagagatgaaggcataaataatcaactaatttggtatttctttcagattaatcaattagcattagcccttacttattttgttaccaagaccacagtagaggaggcccccacagctagaaattttattaagaaaagaaataattacaggtcacagtagcccttactttaagaacagtcctggtgattgggctcacagtagcagataagttgacatatggaaagtatccaacatattgtttaaccaccttcagcaaaagaatgtaaatttcattagtcagtactcttcagcgattgcggtattcaaatcaaccttgcaagttacaggtaccacttcttaagtaagggcatacctttcctagatgagaaaaccgaataagagctccgatatcattttcttccatctcataaagacgatccagatcaacatgtttttcctcaagtcttttacatatctaattcagagaacacataaaaaatattagcaaacacataaaaatgtaaattattggtcagctgtagcagataacaaacctcatgagaaaggtctctgtcaaactgcctaagtggatgttgttcgggccatattttgcggtcaacacccttgcagaactctaataataaggatgtcatctgagaccaccctcggcgcagacaaatctcaaataatgccctcataatgcgagccaagctttgactaatgtattgagcatcagagtgcaaagaggagctatcaattggagcacgcgatatgtaaacctgcaaaattgataccagtgattggttaaagaaagttgttaggctcaagacattggaaaaacagtagttatccaatagatacctgtatgagaattgaaattttcccatgtttgtcagttggcccccccttaatatcatgtgggcatgcattcttaaaaagggattctaattcatcctgttcttcttctcttactacaatattctcaaactcagaggaatgggccaccatattaatcacctgaggcagtatccagaatgattagtacaacctcacaagcatcacccaaacaaaaagagataaaaccttacctcactctcattcatgggtaccgagctcgaatntcaatttgcattcatgccca

SEQ ID NO: 34349 - DNA, 981 bp, Oryza sativa
  unsure (1)..(981): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatccacaaccaagcccaatagcgcacgaatcttgacagaaatctaatggcccacaaatcggctgacggtgacggattgcaatttttcaggcaactgcaaaatagcaaagctgaaagaaaatctcccgtctcggctcctccgctccttgcgccatctcgcggctgaacaggggaggcggcgagcagagcaggggagaggaggggatcctgcaggtgagcatccacatatcctctttctcagaactcatctctctctcccaccgggactacttttgtctggaatttgcctgcgttcgttaaccctagcttctcttctagatctggaagaagctcttctcttaatttcagacccttaccttaatacaagtaacaacagtttattgtttgttccccccaaaagtttgggggttcaactgaacccccatgtcccaagttggattcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34350 - DNA, 666 bp, Oryza sativa
  unsure (1)..(666): unsure at all n locations
gatggaaattgatgaatcatcatnnnnnnnnnnnnnnnnnnnnnnnnnnnnnnnnnnnttctagcatatttcaatggatgtgattttagagtgtctagaaaataataattcattaaaacaaaagcttcccctccactataaatagatgaaacgcactatcaataacgataggcatgctagcaacaagcaaacagtgccaataccctgcataaagtcccttcagaccatgatctctccagatagaacaaccagcatggaacattccattatagtagttatacatcggagcccctggagtttgagaaatatttccttttggggcaggtaaaggccaagatttcttgggtggccttgggaaccttggcatttttccgcccttgggggtttttttttttcccaaatgacttcacatgcacatagataaagacccaagtgtatctcctgcaatgagcacaatgaagcggcataagaatttttctcgagttccatgcattccaatcagaaagcaaatttccagcagcgaaattccaatgagaatgcaaaattccatcagccagaaatgtttacattgcgtggaaaaaaagggcatacttctaaaaataaatattgatcacagttgataaaacctagtataaaaaaagttaggtaacgtcataaatatttacn

SEQ ID NO: 34351 - DNA, 624 bp, Oryza sativa
  unsure (1)..(624): unsure at all n locations
atgtaaanggtagatcttactcttgctgcacgccngcaggtcgactctagaggatcccctggcggcgctggcggcaacggcttcttctttttcgcggcgcgcacgctcttcggtttccttcttctcgcgttccgcacgctgttccgcttcaatgcgctggcgttcagccagctctgcacgtgctttctcttcagcttcacggcgcgctgcggcttcaatctccgctttgtgcttcgcttcggcatctcggcgggcttgttctgctgcttcgcgcttaatgcgctcttcgtgctcacgccgagcctgttccgccaggcggcgctgctcttcgcggtcacggtcgaaatccttgttcatcagcagagccatttcgtggtctgttcgaacttggccgccaactcctgatcgaacttgatgttcatttcagcgcttcggcgtgcagcgcgttcatggcttcttcagccttaatgcgttcctgctcggcttcccattcngtgagtgggcggcgggttgcgtcgcgaagctcgtcacatgcatcaacgaaacgcttaatttcggcctcagcaggtcgcacagcctctttcaggcgcttcaggtactctcggcccggcttttcaattgccg

SEQ ID NO: 34352 - DNA, 663 bp, Oryza sativa
  unsure (1)..(663): unsure at all n locations
atggnccttttgttgtacatcnnnnnnnnnnnnnnnnnnnnnnnnnnnnnnnnnnnnnnnnntcctcatcatcctgaacctgacagatctaaaagctgcatgtagtgtcgtttgatatgaaactttggggtttgcatattgccgacgccttacgttttcacgtgcattagacccacagtaatacgttgggaatgtcacagtttcaccctactcagcatggaggtgatagtgattttcaggtgtggcaacaacagatgatgtacaagcaattgcaagagtttcagagacagcagcaggtacaacagcttgatcatggagccaggatgcaaccctcttttggtgtcaagtttccaaaggcttccccttgtccaaaaaaaaaaaaacccccccaaaaaacctttttcaactgatcaactctcggcaatgacgaatgaaatgccaaacaatgaatctacagcttatgcatggtcacatcaactacatggtagtagtgacccagggttggcaagcaattctcaaatgttgaatcctagcagtaacacaaattgggagcaatatggtggtgctcctggtgtagccaattttgtaaacggttcaatgttttcaaacactccgattcagcccatgagaccgatgggattagctgcacaccaaatgaacccn

SEQ ID NO: 34353 - DNA, 791 bp, Oryza sativa
  unsure (1)..(791): unsure at all n locations
gtggcatttgtaatcatcactctnnnnnnnnnnnnnnnnnnnnnnnnnnnnnnnnnnnnaaaatttgctatattttgggatggagggagtattcgtttcagttaccggcaattgaaaaccaattcaacaatttatctctgaaaaataaatgcgagtgcttttggagtttaatctctttttgtcaactacagaatgcagctgtgtgcatgaagcttatctgcatttatgtgttttctctctttttctttgcagaccaaatgggagttctgaccatctcctgaaaaatatttcttcgcatattgggttacgaaccaagattggtgctactgagttgctgatattttcatccaagttacttacccaagaatatcaaagtatgttccatgatcctttttatgtcccatttcattataaaccatgtcatgtatccccccataactgacaatgcttggacttgttacacttgtatgcttaaacaaactgatgctgtgatgcatgcatatctcaaagttactatttggtaatcttatttgtatgaatatttttttaatttgattttttttgtgatacctgtttttgattcgtcgcagtagtttctcttgcaaccagatgaaatcacatggagtttgcatgagcatagctgtacagtccctgttaaatgtnttaaaaagtggtttgcatgtacaaatttatcatctaaccttttctggataattaccaanttaacacggaaatgtgataagttttacttttggggtggtttccgggccctgacaaaatcctataataaa

SEQ ID NO: 34354 - DNA, 1925 bp, Oryza sativa
  unsure (1)..(1925): unsure at all n locations
ccgcgtgttgactnctgcttgacgcctgcaggncgactctagaggatcccccctggaattcgcacaaagttaaactaaagcctagaatttacacgaaggtgaatcaaagttactgtgggattggcaaaattacctccttcctaatccgatcaagctcatctgcactgcagccaacaatcctctctgcctgatcattgaacagagaaagccaggcctcaccagtagggtcggagaccttgatgaccatgatgtacctgaagaaaggaaccagtgtagcattagctttggctttgtatcatctcaaattcaagcatgcacggtgtaattcagcccaaagttttacctcagtgagcactcagcatcattcttctggcacccttcacaccagtatcctgatccaattgcctcagtcaccttcttgttgcaggtcttgcaagctcggtaccacatggtttggtcaggcttgataaggctaatataggcattcagactgaagaacacaggctgcaaaacataacaagtaaatttaggacaatcacaactagaaagtgctaataaactaaacatcaagaacaattccattttctttcaaagattccaagattttaccttatcctgacccaagttggggtcacttgtgatgtgagacagaaaaactctatcactgtacatggatctcgcgccaccaacccttgatgcgcccatatctgaaccaattgatgccattgaagtacccttgccttcagagtcatacctgtttgccaaaataacgtcaaggaccaaagtagatagtttgaaagataataaaaggagtgtttgagattaggacaataccaagctctgagctgttctgcctcaggcaagtcaggattcactacaattgtacttctccccacagttgacagagacaaacctgtcgacattatagtagtaatgctgttagcacataatcgccaattcagatcctaccacatgcaggaaggtaacacaaacataccttggaagtcagatacttttaggctctttatcgcaatgataggcgcagagtctaccatgtccaagagctcctgaccagtagttgtggcaagatcattccaaagagatatggttacagttttgctcctgccatcagattaaatgtaagttatcagcacataaaacataaagagcattcacatcatcaaaagaaaggagttaacaagccaaatgatgcttacgagtcatccgctacaacgatgtcacgctttggaatcgtctcgttgtcaatcttcctcctaacactaagagtaggagatacgctctgaacaaccccaataacatctgcaagtagggtaaaactagtcagaacactacattcacaaagtaggaacaagaacacatcactgaactgaaagcactattgccttacctactagctccctgccaccaacatatggccctagctgatcaatcttgacaaagttgtactgaatctgtgggataaaagtttcgccctcagcttcctcaacaacagcattctcattcagggtcatctcgtagtcattatggacagtcttgaactgcttgttggcgactctgagagatcctttggagatgtagtacaccttccccagctcaaacatcggatagaacttcttggcagcctcgttgaacatggttgcctggatctgggtgccctgtacacagatccaacaaaattaactcatcaatcaacatacaagaattcagaattgctcatgaactgcaattacatcctacggaataaacatttcacggtaggttgcacttacatccacatcagtgagctccacattgaagacgcagccttcaccacgagcattcttgtcgtcctcaggttgcccttgcttgtgacacgcaccttgatgatccagttgccttgtaggggtcagggagaatcaaagatg

SEQ ID NO: 34355 - DNA, 1757 bp, Oryza sativa
  unsure (1)..(1757): unsure at all n locations
nttttggtcttgcaatcccttgccaaaaaatttcaacccacagaaaagatggtaggaactcttccctaagggagaacaagaacccacccagatctgggcgagtttttccgtggcgcggaatcgcaagaacgctcatcaaagaggaatcgcacacaagaaacactcacgtgaagcgggtgccgatgggcttgaggtcgacgacctggaggacgatctccggcaccggcacgccggtggccgcgtccggcgacgcgttctccaggacgaacgccaccgcccccggcgtcactgacggtgccgcgtcggaatccatccccgagccgagttgaaggcttcacgcgggaagattcagctgcggcggcggcggcgatggggaggaaatggtttggagttgaggagaatgggagtgggagaggattggatccgcgcgcctttataacgccgtggtttggcgaggcgaggcgagcgcgcgggcgggaagggggaggagatggcgtttcggtgggatttttgccgcggggtttcgcgttctcctcttcttccccgcgcgcgaacggccgcgtctggtttttctttttttggctcggtttttgagctgtggcgggagaaattttggagggttttcgcgccggtggcggaggcggagtgcgagccagagagatgggccgggccgctttatcatcacgttcgcctgaacgaggtagtgggccgagactaatacggcccaattagtgagatgggggagctgcctcctcggccaggttgggttttgaggcccataagcgtgctttccatgggggcccactattcagcgtgaaggaacgacactacggcggaatcccccctaccgccggtccgccgccgctcgccgtaacctgccttcggccggcgtcgtagttgcgtttcacggccgttatttcagtctcagatcaaattggattgataagccaagcatcccaaattctcaatgtcacaatgtacaaattggcttacggcacagcagcagtaagcaacctgagcttcggcgagatcctcacgaggccagggtggtggtggggcagttgtcgacgccgcaggcgaggatgtcgcggtagtcgcgggagacggtgaagctgtcgtgcacgctgccgtcgcggctccggacgtactcgaacagcagcgccgtgtggttgaaggccgtcagcttggcgaacccgtagtcccggtcctggacgtggctccaccgcgcccgtacgccggcgtagtccgccaggctcgccccgccgccgcccaccaccacgtgcgtcgtcgccgtgaacgcgccgctgtagtggctcgccgccttcgccacgcacacattctgaatgcacacatttcacacacagtaaaacacaagcagaaaatgagagccacagccataaattcacaagaaatacacatactttacactttagctgttctcacgttctatacttctaaaatagttgtccctgtgtgattcaaattttatctcaaaatagtaggattcaattttatttcaaaatagttatcacttcatattactccctccgtcccaaatataacaacttttagcactcagaatttgctccaaaatataataatttcttaactataattctcttcctaaccaatcacaactatccactatctacttttcccacctacctctttctgaaccaatcacaatatctttctnnnnnnnnnnnnnnnnnnnnnnnnnnnnnnnnnnnnnnnnnnnnnaatacaaantgcacata

SEQ ID NO: 34356 - DNA, 3062 bp, Oryza sativa
  unsure (1)..(3062): unsure at all n locations
nctcgataagtggtcacatgtatgagtggtacgccttaaaatatccagggttcgtatagtatttcacaaaattcaggggaaaaaatgtcctaccagaattgctcacggttctctgctggcacgtagaacatattctgagctggtacaccgcattcaccacctgaatccaaattcccatagaaggaacctgatccaggccaatctctttcatggttgccgctgcaagcacaaaacaatatcatcagaaacattgtttgaaatttccaccttgtctttggtttgtttctgtcgtcaagtcggagtaccttccaaccatgtaaggcacactggatgcaatgggttcaacttgtgcggtaaattgatcccattgtgacagataaccattggcatagcagatgtccccaatatgtattaccatatcaatattcttcaaatctttaattagctggtaggtcgtgttcagtgaaccaggctcgaagtcattgaactcatttgaaccatcggcctcagcctgtgcaaggagttcaaatgccaattaaggccagaggagaaaagcgaatttgtagcaaataatctctcttgttttagcatgagtagcaggtacttaagtatcttattctttgttagtttgactcgagatgatagaactcataaagagtacaaccttttctaacttgcataattgtcattaccaatttactactactaactaaagataaagacacactttggtggccttctgctaattgttccctatctaatcttttttatataattgagagattttatttaaagcacaagttgtactacatctcccatattaactttgaatagctatggagttccatatcgattcagtgatcagttacctaataatttattgcacttttgggagataaacgtggaaaaacaggcacattgtaagtggtatcatattcacaccttccccatatctccaaaaatgactacacgctgcaaagagtcttcccctggataaggaggtgcttggaagctatactcatgtccccaaataatagagccatctgatagccgatgcccaattctgtatgtatacctgaaatacaaactcacttgtaagacttgttggcacttgcatttgtacaaatgaatagttacaggaccacagagggcacagatgcagacaaagcaaggttgtgtaacactcatttacttgaaattaggccacagatccttgaggaaacttgtatgtatgaaaccaggatcgcgccatccaactgtcctagcaggaggacctgtggtaaaatcatcataaagcatgacaatgttatcatcttattaggttcgtcaaaagttacatgtcaatggttatttgatctacaactgctctgccattataccattattctaagatgtgtttcttttttagttgtcacttgtcagcactaatgggggattattactctgagcaagtaaaaacataatgaaaatttactcaccgcacatagtgctgcgactgaacgtaagggtgcctgcaggaaaaaggctttggatttgcccttgtaggccccatttgacaaatggtgtagcctcattggtgccatatccacttgtccaagtcactgtcatctagaatcacttaacatcagtcattattctgtaaacatggtatgatctgatttgcagaagcactttggtgcccatttgtttcataagcaacgcagacaagcaaacactatttcggaagaaaaaaatatcacttaaatggaacaatctgagatgtcttacattcctgtttttgttgctttgacattcgagctcataaacatattccattaaaaaaataggttacttgcattgaaaagtgctaaaggaccataaacgaaattttatttctgtccgcaatgatattttcttttgcagatcacaggctaggatgctcaattgagactcacttcattacttatggaatacttaacaagatgatacttacttcattccaggattttccttgcgctaggcgtgggtacacaggggcctttgggttcgtgaaggttactctctttgagtgtgcaatgagctttggctgtgaggttatataagacatggcataggcaagttagaccatataatagttcagtcacattgtattttaactagaaaagacaaaatatacaagaaatacccccatggtaactgaatcgttcaacaataagttttcacactaaataaatgaggagaatttggcacatacatttgagaggcctccagaaaacaatgcaaatgaaaaatcctccctctgattgattagctgaagcttcatggatccctttcctgtcttctcatagtcaagattcttgtagtttgcaaatataaactgccaaaaaattgtgcctccttcagcatatgttattggcaagttttctgaagtctcatctacagttcacatggaataaggctaactggatgtaacactaacctttatgggagctgtacatagaagtggtggttcaacccattggctctctgatggacaagtagaatcactggtaaattgccaaaaaggcaaaatataaataagatctcaacttctttcttgctgtcttaattaagcattcaattcaggcatccagcatcaggatgattggattgcaagtacctgaaattagcaggagagaacaccccaatccaatcatccttcgatggcttggggttgttataggtaagagtcacccattctctgtcctgtccctgcaacagataaggtagccaataatttgaatacagtgggtctatggaagttcaaaaaaaaaatcatgattgattctcctataaatcctaatgctgcaaaatgcaaatatatgcctcgaccgactaaattaaggcactattaactgggatcagaactctcgagctttggtaagtggtaatggctgactacatcgaactatataggtccgtacaagaacaaaaaacagcagcgagtgcttaattgaccagctagtagatacagtaggttgctgagaaagcttgagtacctcnaagcccangaggaagcgcnaggcgtctaccgaggcacccgg

SEQ ID NO: 34357 - DNA, 2113 bp, Oryza sativa
  unsure (1)..(2113): unsure at all n locations
atgcgccnttgagatacacctcggtacccttaatgcacataattgcgaagtcaaaatgggatcttatttatgtatcaacacatggttttgttgcattgatcttacaagtcaaggtcaccaaactaacaaaaccagcaacatacagcatccaagagaagctagcaaaaattggcttaagcatcatcagcactctgaatgtcgtgcagacaagtgcccttgccctgcctgatcacactagcttctacaggattatatgtcaaaagaaaaatgaccatcacgtcgacatttgaaccaccccaaaagaaaaggaactggatattgtacatagctcacactgagaacattgagcgatgaactgttagcgtaatggcattgagctgatgcatcaggtcaggcaacattctctacctgcactcaacttgcattggagtacagaacaaactaatttttcacacagcccaaaacggtttctgcccagaaatggaagttgggttccctccaagcacgctattcgtctcatcgatgttgtcctcttcatcgtcatctccataatccataagcttcagcagagtatctgcaaatgaatgccaaagaagttcagtaaagatggattggttctgtcactatgtagaaaacaacgatattatagtgttccaccattaccagaaacagatgccccaccaggtttgaccactctaggctcctttgaaggtaattgtgctgaatacaaatttggtggtgagactgaactcacgtccaaggatctcggaggtgccattggcttgtttaaatctgaacgcctatcctcatttcttgacatctcatttgaaggaaacttaggcggtggcggaggcatgctcttgggaggtgggggtggcatgctcttcggaggtgccattggcttgtttaaatctgcacacctatcctcatttcttgacatctcatttgaaggaaacttaggtggtggcggaggcatgctcttgggaggtgggggtagcatgttcctgggtggtggtggtggtggcggcagcatgttcttggatgcagatggatgtgcagaaacatgcggttgatcttgaagaagcatcccatttgatccaggctgaactttaattggaggttcaatcgatgaattggtcatgttacctaaaccgtctaaacctgtcttaacaaatttggacctctgttgtgagttctggaaaaatgaaacaaaaagacttctccatcaaattcctttgcattagagtaaatagtacacaatgaaatacaaataaaggatgaaatcaacaaaatttgtgcataaacagcacaaatccataaattgaaagcattatgactggtaagcatcatacatggatatcagttaaccatgcagagttatagagattaacttacatctttctaaagttcatataactaaagagcataacggaaacttcataaaaagtgtctacaaagaaataaagcaaaaggtactgcattaatactattgtttcattaggctaagaagtttctgcttttctaggactacttgtgaatgtcactgagtgagaactctttaacgtgcaaaactttaatggttgaacctatttctccaactgaaaaggaaggaaaaaacttgaccaaattgtacctaaacctattaagaaactaccaaatttcaaattcaaggaatggtaaaaatgcagtcctttacgaagtcttcttgtgggcatcaacagcttgaacacaaagggttagtaacaagatagtacaagcagtcatccactttagaagcagaagactgtgccttgctaattcaatttacgggttgaaaaactcatgtagtatcaaaaaatacaagcaataatccaattcagaagcagaagactctcgtcagttaaactccattggtgaaaactccagcttgtaacaagccctgtgaaaaattcacattctattaccaccctgtgagcttcagacaaggtcagagaaaatacctggaatgaaataaaacgtcagtagcagataaatcagtcttggaaaaagaaaaaacgtgccaatctggtaaacattgaaggaccactatgaaaagaaaatttcacatcacattttgaatcgtagattttctaga

SEQ ID NO: 34358 - DNA, 1789 bp, Oryza sativa
  unsure (1)..(1789): unsure at all n locations
ccaaaattttaaaaaaaaaaggggtttgaaaatgaatcaggggaaatgaattcatgggtggatggtttttttagtggtgaaaacataaagatgtccgagataggcaaatgaagtaacactggtgctcatttcaatcgaatattaattttgggcaatagcagtggtgcctattaaagtaaatgctacctgaacttctgtggttgcgccctgtgaaactggtaattcctggaatttcttcatttgtgagcgtttatatgattatgcgtgtgaaaaagggttaaccattgccacagtgattgttgatgtagacgtcgataaaacaacgtgggttgatgatgatgaagcatgcttaagtgttaatgcaacttgctgaaatggagttgcttggggataaatgccccaatagcaaccataaaatgtccaaccatttgatggttgactaggacatatcaggttactaggtggtgaaaccacagaataagacggggccccagattgagatgtcactgaaggagcaactaaggaagcattagctccagtagatgcaaaggaatgtgatgctccggttaacacattagggcctaaagtagggtgtacatctggtattgttcctgacgtttgtaaaaaatccaataattgctgcggaggtggaaaagaaccatatacttttgaagaagaaattctgccatacaaaagaaaatgaaaatatacttagaactttgtggtacgatacaatctctaagaacagaatcaatccatgttttactgatcaggcgagtgcaaatgggttagaaatgtctggatataagaccctctcaccctaatattcagcaagatagataatgcatttactagtactaatattcagcaagataaataaagcatttactggtacaactataatgataccaacaaaaaaggaatagttcgaggcaaatacgaaaagagaagatgaattagtgactaatcatagcataactgaagcatggtatttgtataactaaaatccaactgatcatgtaaaatttcaatttatatttttttataagggcagttataatgaacgatactaaagcaaaagaatccataatttcacaaaacaaaaattccaaacttacagacctggaagcaccaaattcagctgctatagtatctagaaggttttctgctaaaacttttgcagcttctaggttcttcacatgcatacttgagatgtagaggtgtagaggttgttgtgatgctgtagtatagcaatagacattacacaaaggaacagaagtaatatgcttcccaactcacgagtttccaagagctaccaaaataaactacagaccttcagcatgacaattgaccggagtccctgaaccttttcctctgagtacaacagtgacccctgtttcattcatgatgtgatttatgtactgatcctgcataaagaaatcagaagcaccagcagcacaaaaacagtttctcccatcccaattgggatgccagagaaagcttcaagattagttttcttttcttttccacgggtaaacagaactggactgaattcataaaacaatactgacagtaatagcaacaatggcatggttgaattatccaataacgcttaatattttacaaaatacgagaacatacatttggaccacgaacccaagctgcaacgttaagtgatggatctgcatgaaaacccaaaaatattgaggcactaaaaggatgaacggcctgnnnnnnnnnnnnnnnnnnnnnnnnnnnnnnnngagatgacgattgtacatcaagcgtg

SEQ ID NO: 34359 - DNA, 737 bp, Oryza sativa
  unsure (1)..(737): unsure at all n locations
gatttagnaccctgagtaacgccttgcagncgactctagaggatccnctggtgttctgctattctttcacagtgatatcatccatcattattgctgttgtaatttcaacaaaaaactacatggtccatgccatttatgttgcagcatgtttcagtgattgcttttagtatagtacaatacctgtagtacaaaagatcctttttatagcaagataatggtatgctaatattttcccccaactttagctaaaagatactgctgagcgtatcaaagcagttgatcgtgcggcttcaatgattgaggaaattttaaaacaaggcccaaacccagaaggcactatccagagcaacggacaggtcttcccttcatatctcagtctgtttaatatatgatatctaatggattaataggcaccaaaccaaatattataagtacacatgtcataatccatctctggtattcattaaatgtgttaatacatggtctggttagttcattcataattatgttgatgcaatcttgagaaggaaaataataatccacatatatgggtggtgcttgtattattgtttcctgattaatatggaaccagttacagtgtagttttttttttaaggggagcagattaataattactacttaacatatggcaattcttgttgagaaagctaacatctttcttttgatgttacaggccgttcatccttttagtgcctcaatatttttgggttttcatg

SEQ ID NO: 34360 - DNA, 711 bp, Oryza sativa
  unsure (1)..(711): unsure at all n locations
cgggcnnnnnnnccgccgtgtttgtnatgcacatcctcatcttgatgcctgcaggtgactctagaggatccccgaggcagaacttcttcctttgtttttttttttaaaaaaaaggaaattgaattgtaagtgtgtaactggttagttaattgagggagacgacactcacactatctgcctgtcaagccagcccttgtacttgtcttcaagggcctgggggaggtcccagtggtagagtgtcacatatggctgaattcctgaaagattgttatactttttcagcaaattcagaagctgtcaagatgacctgaatttatcactttcaaatctgtgtgctcaccttttgctagaagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34361 - DNA, 8018 bp, Oryza sativa
  unsure (1)..(8018): unsure at all n locations
ctcnnncncnnagaggttattgtaattgtantactgcatgcctgcaggccgactctagaggatccccattgatttgaactagtttttcagaaattttatttagtttataattaccccattagtcaaaagaccaactgtaaatctagtgtacatattagtttttccgatactctgatttggtaaaaagacaaaaaaatgtataacacacactaatgaatgaactgtgtaatttttgcaaatattcaatgaattaggtgtacatcaccatctttgatctactaccagtaagggtcgtctttttagtactgctgctgcttgctaaggaatgcaagccatgacccatgagcattggatacccatcagcaggagttcaactccaatggcgcaagagaaaaaataacataaagactagacccatgagtattgaatacccattttatgaagcatgaatatagcaagagtaccttctcttctccgtgttggctatgctagatgaggtaaccatataacagaagaatttaataactcgttagctgaaaattaagaaataataacatgtgctttttagagaatcacatatgcttgatacttttacagcatgcaatatatatgtttcatttttccctccgtccaaacagaaaaatcctaagtgatttgcacatcagtagtggcgcaaggcaaaagtgtcatgctaattctggccaggcaatggaaaatgcatctcgaggttgaggacccttaacaaagcctacgatgagatgttgcattgttctttttttttcatttttctttttgcttggatgggtgaagagatatcgtagtcatacttgttgcaatatgactggctagagcttgtggaagaaagacctgaccattgagggcggagctagaacgaaatggggaggggtgtcactgcttgctttactctgctttaggccgagtttagactgatatgagtaactgagtttggattgaagggggtgcatatatggtgaaaatatatgaactataactaaaaaccgggttcctgggcaccccccctcttcaatgtagctcccctctcttcacccacaagtccagctagcctagcaaagttcacatttttcttctatcttgcatcatcacacgaagtgaactgcgtgatcgtcggagacatcgaatcaaaggtaaggttctgtgatgatcagcaccatgtaccaccacttttcttttttgtttttgcttggagttatctttctcatgatctgactcaaatgcactttgtgttcttgaatttctagctctcgcccattctgcttgctgccctgatctccttcaaattctagcccaaagaatggaggaccagatggctaaccttcgcttgactgacttcgagttcttcaggatcatcctgcccggatcctccaaaacgaaactggtaaaccattttttttgttgattcttgggtttctagcttcagcctagtgtgtgtttgatcgatccgtggtggtgcagaagctgccttacaagttcgcgagggagcttggggaccgagagctccgggaggcgaggctgcgggtcgccggcgaggggcggcgcccgtgggacgtgaaggtgttcgacgacgacgtcagcggcgacgtgtacctgggccgcggctggcaggagttcgcccgcgcccacgacctgcgtgacggccacttcctcgtcttccgctacgacggcgccgccgcgttcaccgtcaccgtcttcgacgagaccatgtgccggcgggactacccgcggcaccacgacgccgncggcacgtaattgctcgccgccggggncggccgccgccgccctcgctctggcatgactgatacctgtgtgttccgcctgcagagagcggaagcagcagcagcagcgacagcagtgatgccgcggcggcggtggccacggcggcggcggaaggggtcggcgacgtggcgctgtcgcagttcgccgtgacgctgcggcagtgcaacctcgaagacaagcaggcgcagtacttggtgagctcgtgcccacttcttttgctgccatttcttgttgccgattgccatgtgctagctaagtagctaaccaatccgaccaccgcccgtcggcggcggcggcgcagaacgtgccgatggagttccaggaggcgcacgagtacgcgaggcgggagaaggtggtgctgcgaatgcgcggggaggcatggacggtgaggctgaagcacagcaggcgggagcgcggccagcgcacggcgttccggtacgggtggcaccggttctgcgtcgacaacggcctcgccgtcggcgacacctgcttcttccgcgtcctccgcgagggcgacctccgccgcggcggtgccgccgacgaccacgtgctcaaggtcgccgtgcgcaaggccgacggcaccaccctcgagtgatcgatcttactaattaactactgagattaataaattaattagcgcgctctcgtagtctcgtctcgtcgtgtgtgtgtgtgtttaggtgttggttagtcgttctaaatggcccgtatttgtcttacgttaaatcgtctggtacttgatcggatggtgtttgtgggtgtgccactggcagatcgacaggtggccgagctgtgtaccgaactgctttattactctctttcacgaacaaggccctgtgtttcgcattcacaacaatgggaaacaacccaatctcgtcataagactggatggattcgtatcgcaagtgctccctcagtgttaatgtaaaccaacttaatataaaacgtgatattttatatttaaatttattgtattataaaatatctcattctatctctgatttatttattttgagacggataaagtataagccaatgttcaaagctaaaactgataaatcttgtttccgaagtttgaaatatacggacacacatttgaagtattaaacgttgtctaataaaaaacaaactgcagattccgccaggaactgtgagacaaaattattaagcctgattaatccattattggtaaatgtttactgtagccccatattgtcaaatcatggtgcaattaggtttaaaagattcgtcttgcaatttacacgtaaactatgtaattagttttttttcacatttaatactccatacatgtgtcaaaacattcgatgtgatgggtgaaaagtttttgttttagataccaaacaaggcctaagcatctagtccattttctaatatgtgtaactgtatcttctaaaaatctgaatgaaaaactgaaccatccaaacagatccaaagtgtgagagtgacacagcttaaggaacgacactgaaccgttccactccatggcagaaatctgcagactaaaaggattttaaagcccatatagcccggcccaataaaaagcccatacatctgcctggaaacgagcctgctagaccaaggcccatatagttgggcccgcctgtcattttatgtacttttcgttgccgtgttgggatgtgcaccctgatacccggaatcagttgcataaatgaagcacacgatacgacacgtccaggtcaggagaggctccaacggtcacattatcctcgctgactccgccgcgcgccgggtgctcgcctttctcccccttgcgccaccaccggcgccggcgagtcctcgtcaccggagagcgagggggtctccgccgtggtcgcctgcgcgctacgcggcgacgctgccggcttccttccgccggagtcaaccttgggggtaagggtaaggtttcccccgagagagagagagagagagagagagagagagagagagagagagagagagagagagagatttaggggttttcttctgtagtttttgctgtgatttcgtcttgcggttcttctttacatccgtggatgacacgggcagtatctacgaaagcatatgcgagttatctatcagatctggctcccccgatccccttgtgtgctagggttgatgcgcgcgtgcgatggctttggttggtgcggatttaggtatccttagtttgataccaacaacttgataggttagagccccaatgacccatgttttttttattcaaatgcttcagcaactcatgtctaattacatagcagagaaaatgcaatagaagggtatatgttatcaagaacgcacttttttggatgttttggtaggagatagcacatctgtaccttcaaaagttgttattgccctttcccacagattggcattggacgatctggcgcattgcacatgatggtcaatcgaccagaattggacttttggtactcttttttttagataatggatagaaatccggcctctataaggtcttttggtactggaatgttgttgttgccctagttgtttttcacagaaatttactataactgtatcattgtgcttgtcatagtttgctgttcgtactttataaaatttcggaactgcgggtttcagaccaggtagtttgctgttcaagaagtcatggccttaggcttcttttactagttccttttcttatttacattacaaatgattgcttgtgttagggcaaattcttggcaatctcgtcttgcttacacctcgtatgctgttggataagctcatgtggaagaatgacagcatgtgtgcaagatgctaacgtgttgtcttttccaattaactgtggtttttcataaaatttatctcattcaattcactgttcttttccatagtaaatacatgttcttctggatggtgggttagcaatttagccttcattcattatttctattaaacacatttttctagtgtataatttcttttcacgaatgctaggcaataggcatcaccacctcacaaaggtgacatttcctgatgattcccttttcttctgtttccacaccagattgctgcaaacaactccagtttctgaataaagacagtgccgatattaatggataagaaacagacctcgttaggcactcctgtctacaggacaaatcccttcgattctgactctgattctgaagtgccctcaagaccgtcaagggcacaatctgtcccagtgcgacgcacagatcaatctatacaagagctggaggactatgctgttgataaagtagaagaaacatcacgcaaagtaaatgattgtgtcagagccgctgaagcaatcagagaagatgctacaaaaacactggttactttgcatcgtcaaggtgaacagatcacccgaactcatcgagtagccgcggatattgaacacgatcttagtatggtaagttatgttgtggaacccaagtatccttgatcttcttctcatgagtattgctcataaatatgggtagaagctccatagaactttttggatgtgttagtactaaatttcagtcatcatttcaatatttcatccaaacattagactaaatttctatgcacctcaacgataagttatgtgatgttttgcacatatctatccttatctcactatcttaactcccctctagtttatgtttctctatgtcgtgtcaattgctgggctaaaccatggaggatttactaagtactattattattccttttcttgcttgtctagataattgtgttttgcttggcttgtttttaagatataaattacatgatgtattttatttctgaagttatagagattctttgccttgttcttaatctcatcagaaaaaaaaaatctgaaatccaaatttatggtctcttcagagtgagaagcttttgggaagtctaggggggctgttttccaagacatggaagccaaagagaaaccaacagataaaaggaccgatttcacaaagtatgatggtttagattctgactaatttctgggactctcttttttttttgcttaactgatccatttgagttatggcagataattctttcacaagttcagcgaaccacatggaacagaggcagaggctaggtatttcctcaacacgtcagccatctccaaatcaagtacatcgttcacctgcaactgcaatcgagaaagttcaggtctgcattcccatctaaccatgaattgtagaatgagtaatttgttctggaagtttacaccactttcttcttttaggttgagatagcaaagcaggatgatgcgctctcagacttgagtaacatgttgggagagctgaagggtatggcattggatatgggcacagaaattgaaaggtaatacttctttcaaatatttgttaaaaatgttatagaagagattgcccatttcagctgttcacttcactgttcataaaatttgatggagttatcattttgctgcaggcaaaataaatcactggatgctttcggtgatgatgttgatgaactgaacttcagagttaaaggggcaaaccaacggggacgccggttattgggcaaatgatgccatcaggttgtcgaaccacagcaactctgtttctagcagttttctccatcccatgggattcaggacttgtgagtgcgattagcagatgcgcctacttcatctggatattctgtcgtgtctgaattctgagcaaatattcagattcccgtgttgtgttgttgtatgagaaatcgtcatatacacttgttgtatgataagttgatagcttcaattacttggtgtaggacataaccaccattccccttttctcttagaatcttgatgtaatctgtactcctaaatatgccagaacgagatgagaagagaattgaatcaagcgatagaattactccagcaaatttgatgtgtgctccttgttttgtccttgaagctcatcttaggacttggcgtacgcttttgctacgtcaaaacccatgttttgcccttgtcgatttgccgcgctctcacgcttattacgggcttggtctgtgtgctcgcgcgcgggcgcggcgggcggcgcgatggcctcgggtacgacgaagccatgcggcgccgaccgcgacgttggcgtcatctcgccgccggggccggtcgacggaagaggaggcggcgggcggtggcggcgcatcgcgctgtacgactcgttcgagctcaacgcgatggtggtgcggctgaaccggctgctggcgagcgggagcggcgatggcggcggcgcatgtgggggtggtggcgccgcggcggcggcgcgggcgcgcaaggccgggagctggtcgccgctgtgcccaaggcggtactcagcatggtcaagcgcgctctccgtgggcgcggccggcaaggagacggctggtgatgcggcctgtgacagtttgtgttgcttggttggacgcgcctatgtaattttattagtattattattattattattattgctaaagttgcacgagctgcaaaactgacaagcatttgcttttgagatggatagcaactttagttgcataattacaaaacacaatcaaatcttgctaggtaggagtaatttcatcaaattggacccaaaattataacaatctgcactgagaacaccttcagttgtcgcatgtttattgcaccgttaggacactctccagactttgtttggttaatccccgaggagaaaaggatttgaagagattgaggaggattatgtgtaaaataaatcatctcaagagaattggaatcttgtgaaagggattaatcgccacgcaagcgtctctcccacctgacagctgctacactgcaacaccacatcgaccacatttgccctagtcgatgaaactgggccccacccacgatcctggcccacatcccagtgggtcgggtaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgc

SEQ ID NO: 34362 - DNA, 745 bp, Oryza sativa
  unsure (1)..(745): unsure at all n locations
tgtggtaaaaaaaaagggtaggggggaaggagaaaatggggaaaatgaaggagagggtggttgaaaaagaaggagatttggatttagagagtgaaggagggcggacggggaggatgtgtgagtttttaataagaagtttttaagaaaggagggagaggattggaaggaagaagaagaggagaggttgaaaaaggaggagaagaaggaaaagaggacggggaaagaagcaaagaaaggagtattggagagattgaaggaggaagatgtagggaaattgaaagggagaagaaaagtgagggggctgaggaataaagtgatgaagaaggggttgagaagagtacttgattctggagttggtagtgtaaagaactttgtgaaggagttcgagagaattttttgaatttttggagtaacttttgaaagggaaagggagggtgaggggtttggggggttcaaggggttagagggatggaagaaagattggaagggtaagatagggatgccgagggtgtgggtgtaattttatgattgagttattgaatgaaggagagaaaaggatttgtttttgagttgatgggaaaagcgaaaggttggtaaaattgacacagtgggggatatggattgtgtttaggaaaatgcaaatggaatagtttgataaaaaattgtgcattttttaaggttgagttgggagggggtttntanagtnnnnnggngggntttntacgagtaacctcgcatgagagtg

SEQ ID NO: 34363 - DNA, 1356 bp, Oryza sativa
  unsure (1)..(1356): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataatttttttattaggataaatttataatattgtgaaagtgcttctcacgagaaatctcgcataacatttccatgttctcaagctaaggattttattaaaattgcatttatagtcgaagtttctgaagtttgaccagatcttttcgaaaacgttttgatcaccttagctgtataactcctagctggaacttcttgcgagtcgcagtgctgcttggccggctgtcatgtaatgggagacctcagaatcagcttaggttgccgacttacttacaatgagaatcttgtagcagtatgcgttttgttcatgccagtgtatggagttatttgtcctgctcctgccccgagtacagcaatggccatcgtagtaactggatgtgttgcgatcaatttttattatcttttaaactggatagtatatttgattcctgatctcttttttgctgcaaccttcgtgactaatgtttctgatcactggaaactaatctggtgttatgtctccctgctgcttctcttattgcaagtgtttggccacatggataaaatgttaactttcaaaagacattctcattttttagcatgtgttatcgttaactttttgagactggtgactattcgccttactaaaaaaaatcatataaatattatcatttattccttacatccccaaatatgtccccagatgtaagaacctacaacctgatgaacttatcaggaatgactggagtctgaccaaatttaaatttatattgctaggacatgttccattcgatttaaggtttttatattttattttgagacagatgaagtaagtattttgttgtgatttcaaaaataaaggttctttaagtataacctatatgtttatatgtttaataaaattaaacaagacgggagatcaaacgtatgaaaaaacacgtcatgtaaaactagtactccaataagaattgtttctggttaagtgctccagcctccggattggagcatatcgaaacgtcaatctagcaacgggccccctgtaatttaagggtgggtgggccaattcgccggcccgccaacgtgtatgcgagttacccatgtcgtctatgctacagaagagaaacgctctctctttcttctcaggcgagacgatggagggcgggcaccccgacccggccctccccagn

SEQ ID NO: 34364 - DNA, 2187 bp, Oryza sativa
  unsure (1)..(2187): unsure at all n locations
atgggnntttgganattgatatnnnnnnnnnnnnnnnnnnnnnnnnnnnnnnnnnnnnnnnnnnntatgtctcctgatctgctctgctatcttgctttgctcaggagcaatgccagagcatgcttctatcggcctatagggagatggtaagggcgtaaggctgtgcttggtcgaaactctcattgactgttcaatccaaagattggataccgcaaagcatggccggttcatgtgatagttcttcttgtttcacctgttaacaggtccttgctacggccgagttggttagagcttctcactctatgcgttgtttttccaaagtagccgcgaatagtccgttgatacggtttactgagcgccaagatgatatgaatgattcgggggacggaggaggatcccctgtattcaaatggttctccgtattagaattcggtgggttattcattttgtttcaatgcaaaacctgatttaagttagcatgcccccttcttttactctctggtcgatatgacatccaaccaactaagcgcgtataatctctgaagaacatttcctcgaagtcatgttgctgcgtaccaggtacatgccgggcgtagattatatttagcaaactgattcttagtttgcatataatattcagtttaacagtatcccatggatcagtatctagttttttatgtttttcctggttttttttattggacgatcctctttcagatcctcccagtgaaaatacattgcttttaatcaaacaagataaactcctgaatttaaattcgtttatttgtggtttatcacagagaatcttgctcaagaacttgtcgatatgttcatttcagaactgcaattgaaggtatatcgagagttctttttctattgttctatggtgatgcttattgattccagaaacagcatgtgcatttacttttagctttttttagccagtacaaatattggttttattatacttgcctgcttccttgttactttgggaaccttcctgacaatggaaattgtttccatatcacagagattgcttgtcttggaactcctctcggtaaccttcaaggaaggtgtacaacatgacgcatcattagaatggtccaatgagctatttgatggggagttcaatgagtttcagagtattggccttctgtcaggagatagctacgcactgcccaaaaattggagtgctggtgtctcaaaggcatggcaacctgatcaaaccccatcccatgaggttttacaggtacaggttgatgttttgagatttttttttttttttgaaaccttatgttttgagaattttggcatttaagacagaagaaagctcaattgatcctgtcttgattcatatattttacatcttctgtctggttgtcttcatagtaaagacaaagttgtcttatgtatataaagagttaattaatagtccatcttttgattggatttttttgtgcaaaagttagcatattgggtttatatcttttaactgctccagagtttcttttgcaggtttatttgacttcttggcttgctaatgtgaacatcaagacaagcaggtaatcatattattgtattattttatcttatggatttcataaactaagaactatagttattgaatcttgaaaataaaacatatctttttttcctcaaccttttgttatcatgaagttttcgcttctggcttgatgtcataacttgtgtgatagtaacagtgactttgcactatttcagaattgatgaaatatttgagcttgtcggggaggagatgcagataaaattgtcttgaggattctgatgcgtatgacttataagtaagaaaagttgatctatcctcctgtttgtggtttcgtttccttagaagtcctaaatgctaaaaccttatgtaatctgctcgaaccccaagggagaaaaccattctctcataatttagattttacaaacagaaagtttaacactaaaacagaattacttatctacccaaggttcactgaggaatcacgtttgagggagagcactgatcattatctgaaaagtcttaagccatcatccgctatcgaattaaacaaggttttgaagttctaaagtatattacccttagcttcaagtctgttctggctcatcatatatgtacataatcaatttgggtaccgagctcgaatntcaaaatcaatggacatg

SEQ ID NO: 34365 - DNA, 4807 bp, Oryza sativa
  unsure (1)..(4807): unsure at all n locations
cgcgcgccattgatttgccacttggtatccaacacaaacacaatctgctcgagatatctgaaggaatcaaacgcccttttcgttcctgagaaacagcctgcaatcaaccgctcgagtatgttcctgcagcaggtgtgacaatccacgacgactccatgtattgcagataagggtccaattcctttgctcaagaattcgactccaatagcaccttaataatggctttaatggcttggacactcacagagtaacacatgctctttaaaaatgctccttccataccatggaccagctctgatgcctgtcagctcccttgccctttcctcctttaagaaacaacaacaacatccaaaaaaacaaaatgctcactccctgatgctactatgagtcaaacccaacacacatgtgcctcctcctcctccttcttcctggcattaaattagccgagaccggcctgatccatttatctcccaatttatcctctcctgtctgtcacaagcaaagcacacgagtagtacccctcagtcccaaaataaaccaacctcgtacgggatatgtggtttattttttatggtgggagtagtttcttttcagggctgcctcacgtaacatgatcacatgaccaaaccggccggtccagccgagtagccgaccacatcgatccatccatcatccaaccagcggcagcacgcgactttgcaggggacattcccgtgacgacgcggcgggcagtagccgatcgatcgagagccaatcacgtcgtcgtactaatcaaatcaatacacttgccaccacacgagagagtatatatgtgttcctgtccacttggcccttttcaatgttcttttcgatgccaaccaaatccgttaattagtttctctctccaggatgaagagtacttgcacgtactaccactacactgccacgacagcagcagcagttgctgcccccggttgtccctgtcaaactctctctctcagtagatccggtcgtgcagctgcagtacgacgttgtagttgtcgtcgtcatcgtcgaggaaaaagtgcagccacagcctcgtgcacaagtagtagtagtagtgctgatgcgatgagaatcggttttgtcacttttgtttatggtttgaaagatagagagagagagggccttaaaaatgtctttttcttttgcttacttgtgcacacacactgcattgcttcagtagtgtgtccaaatcggcagggcttttttgaaaaggccagctcgagtcagtcaacctccgtctaattctcatataagaaaggcagaagagaaagggaacctatggtggagtatatctgatcctgtcacttgagtcacgcacacacactgccgccaaagttcaaaagaaaaaaaagagcacggcgatgatgtgaccatcaaatccactttgctaactaagccagcactaatactaatattcccctaatatttacattcctcctacgcatctatagtaaattgcacggctctttatttttttctcattgaaatatagaaaggaagaaagaaaaaaggttaccatgagcaagaatcttgtatccaagtcgctttaatttccccaagaatcttggagcaagtgcacacaccatgagcagccagacgacgagttgtgattgggcattgggcatgtggcgcgcacacacaacgtcaggctcgcagccaatccagtggcccagtgtgagattgcagtgagacagtatattgggctaacatgtgtgcgtcagtcagtcagtcagtcagcgcggctgctttgtttgtcccgtgctgttgtgttctgtgtctgaatggagtatttgcaattaaccgaggcaacagaacctgccatatcctgcctgcatatgcatgccagtgtcttgtagtagtagtagcagcagggacagagtacaataaaaaactgttggtactgctttggcatggcctgcacacctgcactgcagagaatgttccaagtgtactcctgctgatgctgatgctgcagttgcagtcatgtgtcccaagtcccaaagtcatgtgtgtgtgtgtgagagagagaaaagatttgatgacgagatggaaagcgttttgtactttagtacttctaggagaagtacagcaatgcatgcagtgcagtgcagtgcacagagatatagtgagtgagtgttgtatgatgatgagataataactcccattggcagcttctttgacgcagagaagtacgatgtgggggctcctcatgctggctgattgctgctgctgctgtcgtctctccctttggttttcttttgggagtactgtttgctttagataacagaggccggccgtcaacgtggggactatgccactatatatggtccaggaactcttccaagctgagtacttgacttttgttatactcatatactataagccatgtagagtaagtttggtatttatttatgaacatatgcaccaaagcttccactaatccactcctactgctgatcgagcaagaaaatattctagtggttcttaaataactctattatcataagttattttgtggtatgatgaattctcggattgagccttatgatatgttgttgtgcgagtgatatcatattagatctggaaggtgttcaaatctgtctagtattcaagtaataggatttttaccgggtactatgcatttcaagattcagagaactttattaattttgacaaacaagaagttcaacaatatgcatgtttacactgtagtcagatttgagagtacttttacagcatggtttgtagatttaaacaaactaacggtcaaaattttatttttagcaaccatatcaagttgaacgccgcgacataaaacaatatcaatttgggagcatggaggatctaacacgggggtgctgatggatccctatggagagaaggaaagaagagaaggactagaagggtagggggctagaggaggaggaagatgagcccctccaaacttgtcctagatccgccccagtttgggagtagtggtggccaggaatagacccaggattggctcaagggtcgggctagggctagcccatgctgagttgcgtcttacatgttgaaaaaatgtacatcataatgggcctccaatcctatgccttgggccttaggacggatgccctgaggcctaggccctcccccggtggtagtcatgccgagggggaggggggagggtaggataagtaacttgatatgcttatattctcttatgaacaacaaatggtacgcatacaagtgtatccatccacctaggtttgagtatcagttatatcttaataatattatcatatccttttagagaatcataccaaaacgtactttctatccacatgcaaaagaggtagctctcaactattgagtaactcttaattaattttataaaaagataataataaccactaccctgatataaaagtggtgtactgaaatatattcactacaatgataaatattatagtaagaaaacttagttgtttcaacttaaattttatcaagctaaacatatctctacctaatccaaagtatgatagtttcagctcaagcttcataaatttgctactcccttcacccccattttcatcatcccctaaggatttttatgtcttcccaaaataaacattatctaataagtatctcttccggcctcatcttttagcctatgcttatgcttatcagacaaaatttgaatttccaaccttaaatttgaagttgattttgaggtttttttcatcaaagtttagttttcagcctttgcttttagatagctaagaatacgaatataaaaattttatccacaaattatttttcgtttgcaaatctgtcgttttgcttattccccgaataagcaaaattgtagagtcgttcgtttatttgtgcaaaaagttaatgtgcaccattaagattaatttctattggtgcaatgtcatgcaatattttagatatgagcaatacatgagtcacgaaacgatgaaacaccttaaccaatgagaattaatttaaaaatgataaatattttggtgttcttggttttggtgtcatttgcttagagaaagatcaatctggaatggatggagtactatcttacacaaccacaacaatgatacatatgataaatatacttaaataaaaacaaagcaaaacatctcacccaaaatctatagccctaaactctttcaagcatctctagatggaaaaatccatgtagctcaccggcaaacaacccctcttttaaagtaaaaaccaaccaggtccatagcgcatttactcacaccagtcaccactttccctgcgcccccggctcgcatcccaatacccacgctttcctacccacgcgggcaccccccccccccccccaacaacgtnccttttcctgggtaccgagctctaaatcccctatagggggggggttacaaattactgggcgcggttttacaaccttgggactgggaaaaaccttggggtacccaaattaaatggcttgtgaaacaatccccttttcgccagctggggtaataccaaaaaggcccgccccgatcgcccttttcaacagttgcccaccctgaaatggcaaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34366 - DNA, 1875 bp, Oryza sativa
  unsure (1)..(1875): unsure at all n locations
attgagtctggaaacccttccccatttgcgggtccacagagaggaacccctaacccaatccgcacgggccgtcaaagtagtcccccggggggcgtcccgggggagggagggggggacgcgcgcgcgcaacagatccgatccgcttctccgccctaaagttccgaagccgatcgaggtaggtctccgcccgaatcggctccccggaattcgcggggggtgtggtcttggggtgtgcctgcgtgggggggctgcggggatgggtgtgaatcgggtgggggtgggagggggtcgtggcgtgaccgggggcttggggattttttttttgggaggggggaaaagtttgggggttcgtttgtttcatgggggatctgtgtgagtggggaaattgggagctatgtggcgctcgatcttgggtttttgtggctgggtttgcttgattgggtgctaaattttaggtttccgaggggtaatttgtgtgggatggtcgagggtttggctggattcaagctttagctcacttcagctgagttcatctacttgcttaaaagtgtaggctcgtgctaagcagcgcgggagcgtagctttgggttgctcttggttgcatgctccgggattcgggcgtctcctggcggcggagaaacgtgggggatttggggtctgcttcagtagatgcgttctctttatttcgtgtggccacctttttatggttcctttgagcatcgaggtctgagttgatgatgcagagttcgagctaattcgttgttgtctcctctgcatctttggagatttacaggctgcatcccttttctaatggtatataagtgggccaaaatggcatctttgagcttagcaaatagatcgtatggtgtgtctgctggtatcgacattttcagctttattttctcctgcagatatgcttgctttggtgccctgcttaaggggaatggagtntgtctttgtgatttcaagctggctgcctaattatagtgatagtatttatgaatctgctgacatagttgtgatgatgtgttcaagttcaagtttctttgttttgaattcatggttctactctgttcgcttttcctgnctcatagcttccgaatacagcatgagtttagagatgccatttcggtcgtgctaactaatagtgtttcctgggagatacgcttaacttagctgagcttttgtgtttattttttcgtctccatgccagtttcggtcaagtatggcactctagcaagtgagcttaagtagtgtgttgtttcatgagctgttgtgtctcctgtgcattgatctgcagcactcgtagctttcttcacttgccaccaacaaactttgaactctatttacataattcaaaccggaaatgcaacaatgtcttctttgaagattgttggtgcacaaattgaatccctccttgctacatttatcgacaacgtttcttaactctaatacagatgtagatccacttttgttgttgattacttatccaggaatgtaaaatactaatcttggtaaattgtctcatcaccattcaaacatgactacatatttttaattcaagtagcatagttcctatcaggcggtgcattgtgatgatttcaattaagtattgcttaaggttctaatcttaaattaacacaagaataatgattctgtagtctaaaatactgcagacacaattctaattggatcaaccataccgctgaatgttaggtgcaatcctttacaaaagcttacaaatgatgcacgtctatgcagatccatccacaaaagatattttgatgagaagagtatgggggtagattgcacaatcacaaccaactccttgttttaaatgggagataatttacacctgcttaatggatacttact

SEQ ID NO: 34367 - DNA, 13715 bp, Oryza sativa
  unsure (1)..(13715): unsure at all n locations
gcgtgttgttgtactatnnnnnnnnnnnnnnnnnnnnnnnnnnnnnnnnnnnnnnnnnnaacatttttaacatttcaggctacggaaaaataagaagccggtttcaggttgctttcagcttgaattctgctttattggttgagggttacccttccgtgttagctgtaatatcagtgggatcatcctcatcatcctgaacctgacagatctaagagctgcatgtagtgtcgtttgatatgaaactttggggtttgcatattgccgacgccttacgttttcacgtgcattagacccacagtaatacgttgggaatgtcacagtttcaccctactcagcatggaggtgatagtgattttcaggtgtggcaacaacagatgatgtacaagcaattgcaagagtttcagagacagcagcaggtacaacagcttgatcatggagccaggatgcaaccctcttttggtcagtttcaagctcctgcaaaaccacttccaactgatcaactctcggcaatgacgaatgaaatgccaaacaatgaatctacagcttatgcatggtcacatcaactacatggtagtagtgacccagggttggcaagcaattctcaaatgttgaatcctagcagtaacacaaattgggagcaatatggtggtgctcctggtgtagccaattttgtaaacggttcaatgttttcaaacactccgattcagcccatgagaccgatgggattagctgcacaccaaatgaacccatctttatatccaataaatactaccagcagagatggatctggaaatcagcactctcagttcttagggatcccaactgatccacggaatgcaatggcaagggcagcagcacatcagtccgaaaaggcatcgatgcaatttagctctttaatgagtgaacaaggtccatccagctctatgcaaaatttccttgggaaggtaggtgataatattaaggtgggcacccctgttccagtaaatcatctacaacatggtgttcaacaccaagattttcatggtaggccaaaccaagttgattttcaagcaggcctgcgtgaaaaatcaacaatgcaggtagagtcaggaaatggtggtgctagccttgatcctaccgaggagaagttcctatttggcaatgacgaggatagcaactggggagctctgttgaggggtggcaacgatcatggcagttctatggataatgacaactttggtggagctctgccatctctccagagtgggagctggagcgcccttatgcaggaagcactacagtctacaaccagtgacaacagtcccaaggaagaatggagcggcttgagcttccagaaacaagaacaaattatagccaacaattcaaccttgcaaagtcatgaccagaataaattttcagcattgagtggtgccaatctagaaaatcaacggccttcatcagctcctagctacggtgatggaacaatgcataatccaaagtttgctggttctcagcatgctgcaagaactccttatgagcaaagggacacgaatgcaacatgattctttttatgccactggtaccaatcatcaatcaactgcaggagtcaataatggatattttcagcagagcatgaaacaaaagcaatctgatgattacagtagacaagaacaaatgaacgcatcaaatggcatttgggcacaccagaaacctgaaatgccaagaaataattcacactcatctggtggacatgctacaccaccaagtgcacatggattttggatgtcccaacaaaacagtattgatcataatatcagcagagagtctggtagcacccaaaatgactggaaaagcaaggccccccttgtacaggacatcaacagtaccccaaacgtctttaataatgatgggagcttttggaagtctagtggaggcaatgcaaattcagtccacaggcctcaacagatgaagcctgatataagcaccatgcaaatgccaaatgacagttcggacggtaaaagcactagtgcgatgggctcaaacatgccaactttaaatcaggatcagtatcaatccattattggtcgaactggtgaacatgttgggcaaaaccataatatgggacgtaagggtccagagattacaggatcactaggaagaggtgcagagcaaaagtcaaatgaccacaaccaggattacctaaatgtgctccctactgaaaggcaagggcatggttcaaatcatggacaacatgtgagcagtgattttgctaccaggaggcatcctttctttgctggaaaagaatcccaaaatttgggtcaatctggtcagcaagcaatgggatcatacatgttgcagaatcatgccatggataactcaggaatgaacattaggcattcttcaggcaatccagtgcctaatcagtttccatctcagtcgcatcagttgcataataacctgaaacctcgattcattcctagctcccaggcttcgagtaatatggcttcagtaaatgaggtatgcctgccaacttcatgtacataatgaagagtattgttatttttgtttgaatacattttattaatgtacttttagtctgtttattcgtcttatttatgaagtaatttcctttttagaaaatgctgatgagagaggagcaatttaaatctcgacatgttccaaatagctccagttcaccaccctttggaggatctgatgctggcctgcctcaaaatcgagcagttcaaaacaggtatttcctatttcttaattactcaaatcatgtgttgcttgccgaattctagatcttccacttgtaagagtttaggtttattttttgctgtaatttatgcaatttgtttcctacacttgttcctttatctactattataaactaagtgaatgacggtggtgagtctgccatcgcatcaccaccaccatgggattttctgtgaaatgtatactacttgaaaaatcttatctggaatctggataactataccatctgcactcatggtttgtaatataattatttgcctatttcaattaaaaaatatatattcttttaaacttaagagtttatgatgtacgtattctaaatcattgcaacacatgggtatttggctagttatttttaatgaagtaagctattgttaccggttagttttggtgccctctagcattaatgagcgaactcaaatttgtggagaactgtatgctgcctttagcattaagataacatcaatgctcctttcaatgtagaaatcgttgcagcacatggtatttggctgtgtttttaaaaatgaaatgagctattgtaactggttagtatatgcgccatctactactaatggagtgaactcaaatttgtggggccctgtagcctttaacataaggttgcaaacaacattaatgctcctttcactgtaggactgaagcattcctttgctttatattctatttgggatttattgcaggactgattaactcttttgcaaacagtgtattttttccatgcatagttcttcgatcttttttttttctgtagccactttatgcttgaaattcttcataaggcactgacacatttgtgctttatgcagtcaacatatgcttcaacttctgcataaggtggacaattcaacagatagcaatgctgctgctgatatgccaaacagttctcctgataatactggtactgttcagcaacagcttaatcaatcttctctgcaaggttttggattaagactcgcaccaccatcacaacgacaattgactccaggccatgtatggtctactcgtgctgatgttgatggcaagcaacctgagcactcaacaaagggagaagatcaaacacaaccttccgctgctagccagtctttgccacctgggcatccaagttcacaaccgacaccgtttaactcttcagaaatagatagtactggacagcaaactgggcaatttcaccagtttggttcaggccaacaataccctgtctctgagtcaagatctggttctgtagcgatgcctcagcaaggcagttctgcaacagtgttcaagaatgtatggacaaacatatcagcacagcgtctagccggtgtgcaacctaacaaaattacacccaatattctccagtctatgatgtttcccaatagcgctgcagataccaacttatggggctcccaaaaggcagatgatcaaggacagagagcatcaactccatctgatgttgccacaagttctaccaattcacaaaatcaagaaacaaagcaaggtggggacagtgatgcagggttagcctcttctgagatggtaaatcttgattcaacaggagctactatgtcgagagaatccatacagaagcattcgtcagacgggaattttgccatgcatgtttcatccttggcacggttgcaccagcagggaatcatgaaccctaaacaaggggagaaccctgcagcgaactttcaggctatgaagacttctcagaacactgctattgggttacatggaagcccgacaccgtcaaacattcagcagcagaattactctttactccatcaaatgcaagccatgagacacgtggatgttgatcccgcaaatatagctggaaagaagcttaaatcacctgaaacaggttctgatgcttcacaggttgactggaaatctggtcagaggtttgcgcatggaaccaataactcggtcagatcgtctgtagataacattggcaatgcaaatgtcccagggccattccctgctgacatgaagatgctaagctttgctccaaggaacaatgaagatagaggtccaagcataccttctcaattcccttcaagagaacctccctctcagggtatggcagttgcagcacaaactgagcagcaaactcaagttcagccagcaaatgcatcatcagatttaattgaaagaagtgagaggcccaggataaaccctcaaatggcaccttcttggtttgagcgctatggaaaccacagaaatggtcagaatctttccatgttcaatttgcagaagacacctgttccgccatataatgtccaaaaaccttcttggaacatggacaataattctgctgagcaaagaatcgattctggccaatctgttaagcctgggcattacatttcatcgaaaaagatggaagtttcagtcccttccagtataatgcaaaggaggccaaagaagcgcaaatctgcagaatctgatcttgtttcttggcataaactcattgagcaccccaaaactttgagaaacatgaggtaattccccaccctttacaggtttagcctgtccttagttgttactttttatcactagtttctgtgacaattgtgtttctatgttgaattgctttaatttatggtcttgatattgctctctgtcgtgacaatcttcaattggcttgacagcacaactgagatggactgggcttgggcagctaataggttaatggagaaggttagtagggccttactgtttctaccttttaggtcttgagcacaacaatctttatttggtactgaattaagtttcaaaaaacaggcagaggatgatgcagaaaatctagaagatgtccctgtaaattatttatggcgcaaaaggttaagattgaccacacggttaatccagcaaattcttcctgctataccagcaaaggtcctcaaagcacaagctgcatcagcttatgaaggtgtaacctataacatcgctatgttcacactaggagatgcatgcaacatggcatcatataactctcgcactcttaccgatcatgaaaataagtaagtttctgtaaattgaatgagttttgttgtgccttatttgcttattctcttatgagcatgatagactgatttatttgaataaacccgttgcttaattctctcgttctaagcctggcactattcggcagctcatctgaacaaacaaatgccaagaaaatggaagacagattgtcaaaggttgtggaagtatttactggaagaatcaagaagatggaaaatgactttgtgaggtacacacgtttgactcccacctgacgaatgcagacattaatgctattcctttatttatgcacaaaagttttcattatgcaacatctgtcgctaaaagagttccatcatactccatccatcaaaaagtcttaagacctattccattttttggtttttccaaaggtctaagtcttatttgtagtcccatgtgctaaattaaatttttgattggaacccaagaagtcattttagtacttattggttgcatgttcattggtccacacagtgaatgaattaattcattaccatctattaactacacaacaagatgtgatctgtgttgcacttcttaaaatccctgacaccagcttccatcccatattttacttgtcaggacagtttgtttacttacacccctgggatgctgtctaaactagattgatgttaattcttatcatctccatttttcattattgcagcttgaacaagaggtcttctatgctagatgtgcaacttgaatgccaagatttggaaagaatttctattgtaaatcgtctgggaagattccatggccggaaccatgcggcgggagtcgaggcctcatcggcttcagaaatgattcctcgcagaatttttcccgaaagacatgtcatgtcttttgcagtgcctggaaatcttcctgaaggggtgtactgtttgtcactctagtgcattgattcctcccatcgttttttacaaactactcaccctgtgatttccagtgctccttgttctcatgcaaagcatggcctttcatacagagcaaccaaatccaggggtagtcgaaaaaaaatcgaaaccatcacataataccatggtgatggagaagccaaggggtgcgtccagccgatcaactcagtgctggctgccgttgttcctcccttgtatcaagtataggtcctgtatattgtggaaagcaagttgaaactacggatctcgcatcatttttctgatgaaggaagagtattagcttcatactttgttagagagcccagtgctttgctagcttagtacatctggcgaactatgtagctatttgtcatctttttatccatgatgatgaagtgttggctggttagagggggggaataataacgggaaccttcctctgggttcttttgttcgtttaggatgggatgcaaattggctagtgtgtccagtctaactgaccagtgttagtcagcagttaattactagagttatgtagttccgaaagcattcatggaacaagtggcgggtaagggagcttggaaacttgttgtaatttgaatccccgtgatgtcgaaatctcaatgggttcttgtaaatttaaaatgaaaatataactgaggtaagaatgctcttgtgcttcatgtaaccttttgtttgaaccagatgctcgttttattgttagttgtattcttaagcggatgctgaagttggcattgatatatgctttcaacactggatagtcccatcatttgtctgtttttgttgcttcctgcgtgagtcggttcgtgagaaaggtaataattttggtaaagtctaaatttcacgcgtttttggtgcgcgggttaataattagagaaactctaagcataatgaaatttcaagaagaagattaatatttactccttttcctcaaggttaatactcacaaaattttagaccaaaggctaatcctcgtgttttaggcatagtgctaaaatcacagttttttaaaaaatggtaatattcataaatttctatgtccaatgctaataatactcatgatttttttggacgaagaccagtgctccttcgtttttatgcttgatgttaatacttgtgaaattttatgtgaaggataataatattcatatgttttggaccctaaacctatactttctgaatttttgggtcaaatgcagtggcggagccaggaatttaaacctgtggggtcaattactagtgattagtgatttatatttaagtggggtcatttctctaaattcttttggatttatacataaaaatcaaagtttatagtatgtttttcaaaaagctgtggagttagccgaccccacagaaatagtctaaatccgccactgataaaaaatgctaatactaacttgttttgaggcataaggctaaaatttactcatttttgttcccaaggttaatagtaatgctaatattaatgcacttttgggtgtaagattaatacttacaaaattatggcataaacactatcactaatttttttggccaaggtaaaactcataaaattttggctgaaggctactattggacagctttcaaccaaattctaaaatgcatgcatttttgtgcccaaggttcataatcatgaaaattttaatcgcatgcaaatattcattctcttttactattcatgctaattttaaaatattaaatgttcatgattttttggccaaatgctaagattcaagggtttttggtcccaatgttaatactaatgaaacttttgggccaaaagataacattcatactcttttagcctaaaaaacaatactagtgaaagtttgggccaaagtctaatactcatgtgtgttttttttttttttgcctgaacgctaaaattcatgcatttttattcccaagacaaataagcatgaaattgccagataaatagccagtgctccttcatttttattcatgtgttttgggccactgaaccatgtacttttgagagagattaatactttctcttcaaaaaaaaaaagattaatacttgtgttttcagatcgggtcgaagaaccatactcatgcgtaatctggcaaaatctaatatttgtgtttttttacccaaggtttggactttttaagttttaggcccatggttagcatgcgtactaacatgaatattacacatgaaagtatgttagtttcatgatgttctcaataatactcatgggtgaatcattactcatgtgtattaacggaacttcatgtgtaatattactcatgtgtatttaactcatgaaattttggactgaaagctaatcattcatttttaggtcaaaggtttgtactcacgaaattttatgccaataactattactcatgtgcttttgggacaaagtctaaaattcagcatttctggacccatgttgatcacgaaattttaggcagaaggataatattatattgttcatactcaagaaattttaagccaaaggcaatgttcatgcaattttggacccaaaatctatagttataaagtttgttcccaaggctaatattcatgtcttttttggctaaaattcatgaatttttgttcccaaggaaaattgtcatgaaattttaaaggggtatattcatttgttttggggttgaaggctaatgttcatgtgtgattggtcccaataaggttctcatgaaactttggagcaaaactaaaactgatttattttttaaaaccaaaggcttaatattcatgcgtttttttggcccaaagttaataatcacaaaattctggacaaaaggataatatttatgcatttgccaaaggtgatgctcatgaaattatgggccaaaagcaaatattcacacatttttgcttaaggctaatacttattaatttttgggccacaataattgtttatttttggatccaaggttactaatcaaattttctgttaaagaataaacatcacgtgcccatggttaaaatgttaaatattcactccttttcgggccaaggctttcatgcattttggacctaaggtgaataattttggagcgaagggataattagcatgtttttcccgacccaaggccgaacgcaatttccaaggtaaataagtaaataactatatacacgattctcagcagatggatgatattcacgtgtttggggggacagtttattatcatgaaaatttatgcaaatagctattcatgtgtttttttgtggttaatactcattgaattttatgtcgaaggctactcatgttattgagacgagggctaaaactaccttttttgcccaagcaaaacgttttgagcacaaagttaaaactaccgccttctctaaaatagaacttggacagtgattcaaagctaaaaggacactatattatggacgaagggagtgctcacgaatattgggacagtctaatactaatgtgtttctgtgccaaaggtcataaaatttcctgcaaaagtgtaatattcgtatgcttttgggcctagagtgaatgcctatgaaattttaattctaaactcaaggccaatactctttaaaactttggaccaaaaattcttttgggtcagaggttatgttcatacatttttcccaatattaatactcattaaattttggaccaaagccttaatactcatgcttttataggcccaatgttaatactcctggaattttagctcaacgactaatagacactcgtttttgagcctaatgtttaattctcatgaaactttggaccaaattactaatacacgaatatttccaggccaaagccaaaattcatgcattgttgaagcaaatgaagcattcgtgaaattctaggctgaggttaatacccatggttaatactaacaaaatttaaggccagaggctaataaacattgactgttatggctggtaatagacaatgagatgaaggagaaatgagatgaatgagccaccgccaccgttcatttcataatattcgcggcccgtcatactgtatgtaagctcccaagggctcttaagataagatatgctgaacaactaaaccacggcaagatcggcactgatgagtgttgggccctacagtagatgagcattgcattggtaagccaacaagagcatcacacaccctttgcaagatgcccaagtgagtactcctgatcaaacccaaggtaggaatccgacaccaaaattagcttcgtctcctgaaaaagaatcgccccatcagtacatataaaaaaggttaataaggatcagtggaccagctaagcacacagtttgagctagatctccaacaacgtatctaactctcccagttatttttgaaaagacaaaaataacagaatcatccagaacagtggcacggaaagcttagtttagtggtactggtagttctttttcccagttttttattgctttactttgtacacattcctctatgttgcttgctaaaaattcaagaaggctcagaaaattgacacaataggttgaattcgaataatgaatagagtagtttcgacctgtaactggcaaggagtaaaattccaaccattctcaatctgtccagctaagttcaaggtacatacaacttgtctattcctcaggttcaacaatatacatcatcctgaaatactgctagactaacattttctagctgatacacaatgaaatatcacaaatgacaagacaaaaggtaatctattaacgatttggtgtcagctttgagatgctgaaggctcgttatactaagttgctaatcagtttgtcattgctattgcctagaactaaaaatcaaaagaatcaacaagccaaaatatggaacatatggaagtcacgggcacagacatcttgaatcactcaaaacagtaataaaaatctttaccttgagcttagcttagcctagaaaatttgcacatggtgtagtgttttaatacctgtatatcaaacattgctggcaattccatccgagtgttaaccacccgatccataaaattaattcttttcagaccatagagctctgaacttctaatgttcccaaggaccagccaccaagcttcttgttttgcctacagaatacagtatcaaaatgttgaatacagatcagcacacagtcccagcacataattctatactttgtattatgaatcattcacttagatttccataacatatatcaattttgcagattataagttgatttgtttctttcgtactgttatgctgagccagtattaatttacaattctcaaaggtagttattcttcaggcatactcttgcatggatattcaaaatagttaccccttctttagttgttgtcctagaatgcatgaagtaaaaaaatcatacacacaaaagtatttagatcagacaaattatagtacaatcttcaccaaatcttgtactcctatttgttttatataaaaaccatcatataataagaataggaaacaatcaagcatattcatcgaagaggtcatcaatgtcaaaaagtgacaaacataaagaaaatagtaatataagtaatattaaaaccagtagcctggtacttcactgtgattagtgaactctgtacatttcatgtaatcagtatagttactgaccttgggaaatctaggggaaaacgctcttgatgttgaacggcgcgcatctttcatttgcaatctaatgcttaaaattggaggcctggactggtccttatcttcattctgaagcttaagttttacatccacacaagggaaatgctgcagatcctgcataatgcaaaatccagcattcattcatgagttaatgatgtgatgacatctccatcgagaattatgtggataaaaaccaatgagataattgcaaggaaactatttttgagggaaacaagtcaaacaactgcacagaaactacaaaattacccagctatacaaaatgtaaaggagtgacacggagttttgacttgctacacaatagagaaaaccttaggatcctgagacattttgttatatcgtacaaaatattcaataactacaacagtaaatactgtagagctagaaaatttaaagttctgctgagcacggttcaaatactgctggttatcagcagaaccggatttcccactgaggtccagaatttgcatcgctcctgtgagtgttatctactgctatttaatgttcattagactgagggtacatacatatttatgtgttctttgaagctgataattctacaaacttctaaagtaaactgagataaaaacgagtatggtccatgatttacttggtaaagttgaaaaaaatgtccaacccagggttttaaccctggtacaaagcatagtgataggtgggtgaacctaacacatgatatcttaagcaggattgaatagcagattccctagcattcttctcatttttagaatacagtacatgaaacaataataacactaaaaatgttgggtggtgctgatttcacaacagtcaccacattctgataagagaaaaaaagaatctgctctgtttgcatttcctcttggctgcaaaaagggctgggcaaagaatgaaatacagcgatgtgattgcaaataatctgttttcagctaccattgtaaaataccaaaaaataaaatcgttcttccaaataaggttagtatgtccaaactctcaagcagtacctggtacaactcagaagcagaaaatggttgaagcaacctatgtaattcttcacgagagagacctagtaaggctggaattgttgaaactcctctgcccttcagatgatctagaagattatcattcatggatggtagcatccaaagagatgaatctctctcaaaccagagaccctggcaaagttaatgaagtctagttcaaaacaatatatctatttgggattttgatacaggactaacaacaaattcagatagggggggggggggggggagagagagaaatctgagacaatgaaattgacctgtatgatcatttgggngggtncaagaggtgtctacctggcg

SEQ ID NO: 34368 - DNA, 5404 bp, Oryza sativa
  unsure (1)..(5404): unsure at all n locations
aagaagacttggtttgcatatcactnnnnnnnnnnnnnnnnnnnnnnnnnnnnnnnnnnnnnnatgaagctcatcaaattctgcagaagctgacagtatgtgcacaaatgcctagaaagcaatttaggctgttagttatataggcattccaaatcaactagcactacaagcaggttgaactaataatgttgcaaacaaatggggcagcacttttacttacctctaatgatgtgttggggcctatatttgtcccgaacattgagactgtaaggtaactaaggtaatactgtgacgctatctttcccaaaatcaagtactttacagagtgatcatccacttttatgcatccactgtcctcaagatcttcaaatgttgtttccactagcctgtttagataaatgtgagaagtaattggtctcatgtgatgttatagctagtggcagatgagatctaagacaacagaagtcatcatcatcaccttgagaggtagcaattcaaggtgtacgtttcagtatcttccaatccatagtaagctgggttaacaacctgccatgcagaaaccaaatgttggtaacgaaccaaaaggaaatacaatagattcatatgaacatataagaagttacactgaattaaagtctttagtcatttttagctgaaaacttcaaatagccacagatttaaccagtgtaataagaatgtcgacagttcactgcatcaattgtcaactactagccatatgatttatagtaatgattctgttttcaactttacaagagtaggaacggtttccacccaaataattgagttgagatagaacacaaagcatgctgaaaccagattgactaaatacttttgtttcttcaatgtaagttacaaggacataaagagtaaagaaatggattgcacgagataaataccagtcttcggtacaggtatgtccaagtaagataaatgatcgcctcctctttattactgatagtgccggaaacaatctccgcatttatgtgatcatgcaagtgctcccttagattactttcaacagggaatggttcatacaggaactgagaatattacaatattcattgttaaacttcagataaatatgcattagaatgtttgttaggcagacaaagtgaaaaagtaatatgaaaccttcttataaaagcttttttttggttcatgaacaagaataacagctttgccatgttggtcatattgtggtcgacctgcccgacccatcatttgcagaatatccgtgatatcataatcgatgtatctttttgttttgccatcgtagtattcggttccctataacaaacgattaaatgagttctcaggaaaatgacaattgaagacaaacaaaatatatagcattgtgttaccttaattatgaccaggtgagctggaagattaacaccccaagccagtgtgctagtacataccagtacctggaaaaacatcaagcaacaagaaatgatgtttaaattagcccaggtatgtaattagcttgggttgcaagagaaatcgcaataatcttacttaaatgtaaagaatagcatgtttacaggaaaaaaaaaacactacttgacgccaaacaaacctgaatcttgttgtttgaaaagagttcctcgaccaaggatctatctctatcatttagacctgcatgatgcagacctattccaaattgcagagtatgtctcaaattggtgtcagagacttgtgaaagaatcatgtcgagagagttatctgccatgcttaggaactgccttggtttttcatctgatgcagcaagctgtaataagagtacagtaaatgtataagatagcagttatctatatatccattaaataaaagaatccaaaacagcatccacctggatgagatcaagagcagtaagtctagtctgccgacgagatgatacaaaaatcagaactggtttgtctggtgaatgagtacatattgctgcatatgctggtttattcatgctattcattcttggacagtagaacttcccaggatatccctgttggtataaaacaaaggcactatgaattgatgatagagatgtttacacagagtaggaaactgaaagtaacaaaaggtggcccatcaagcaaatactcttaaaaatagatttctcaaatgcttgctaatgcatttcttaaagaataaaatgaacggaagcaccaaacttgcaaagtggatggtggaataagtcacacatcttgcattttgatcaaacaagtcacccaaaatttgatttgttgatgcaaactttgtcactgatcatgaaatgtgggctaatatagctgagttggatggctacacaggctgaggggcactaatttcgcaaagtaagcacactcataccatacccatcaatgagataataacatgcattctgcattttactttcctgcagtcaaagtatgttggttcatgtacatgtttatctcgcatccgttaagcaactagaagaggtgcaaagcattacttacgacttacaagcatttcacaccaccctcattaggtttgctcactaaaaatcaaatgtagtgacctgcttgagcaaaatgcaacatggacctagttgtaccctctttttagtcttttctcttttcttaagaaccattcaagaatacatcaaaacaaatactaatccattgtaagagaaatgtgcatgtgtgtgtgtgtacatatattgaaaacaacagcttgatgcattttccaggtaaagttagcaatacaatggggcaaatggctgtgctaaaaaaaagtctgtgttagctctttttgagccagaataggagcttcagttaatgtgaaaatcctacttacctggatatgcacttcaagaggtacaggcctcacgctgggcttgaaattgaatagaccatcatctctcacgcccaaccaatcagctaaatcactgaagtaccatgacaaatggaaagatgtcagccaaaggaaaatagtgcacaagtgcacagtcaatacaacctttttggagttctgcacgggtattaaggaagtaggtgaaattaaatgaggagagggctgtgattggttgagatgaggatggtggggaaatttaattagagatcggttgtgattgcatgagatgagggagtaggtggagaagttgctatattttgaggcaaattttgaacgctagaaattatatttttggatggaggcactaataaaattttcaagagcttaaaattcacaccaatctaacacaaaaatcaaaatcaaaatcaaaatcaatgtaacattgatcatgatcaggactccaacaaccagggttaacaataccatcaaccacaagtaaggcagtaaccactcataacagttgatgtgactagacttctgcaatccatggagcaaaaatacatgtatagaaggttgtggacagcatacagatctatatagaactagtcatgtagaaggtattcctatgtgataggggataagaggattgcatgccaaagtttcccttagtaacataccgagcattggctaatgctgttgataaaccaacaaaccgaattgaacgttctgtttgtgatgatatgtatcgcattcttgatacaatgacctgaaaaaaaatcatcatggtaaacaattggcaaaaagataactttgaaaaacaagcacagcatgaatagatgggattaagatgaatgcagaagacaataaattatgttgccctgagatagagttaaagtaaatgaagttacttatggaccataacatgtgttgcatgtctttgacttccagaaatgatacctcgagaatagggccacggtcagctccaaaaaggtgtatctcatctaatatcatgagcccaacctattaacaggcttaacaagatatacttaatagaagtgttatttatcacaaagtaaagcaaaattacaaatcagcaaatagttaaagctaatgtagaaagtgaaaaactcataccttcataacataacttctactatgccaactacgactaatcccatcccccttttcaggggtagaaattatgatgtccgctgataatagggccatcatatctggagtgaagtcgccagtcatctcaacctgccaaagcacattacttgagataagttatatatatattggtgtattggaaaattagaagaacagattgccctttaccatcttcttcccaagctgagtaacaagacgttgtctccaatcattcattctttcccgtactatagcctttaatggagcaatgtaaactacctgaaagggtgttgaaaatcaattccagaaacaatcttagctcattgtaagtatttaatgaactaaccttcatgtctggttgtgtgttgaaaagatgaagcattgctagttctgcagaaatcgtcttgccactcccagttggagctcccaagagtacgttattgtcgctgtgatagaggacgtgaaaagcctgaaaaaaagataacatcagattataaaaagcaaacatataaaaaagaaaattcaagtggagtctgcatgcattaacagatatatgcattggccattatatagtaaaagaaattcacagcatgagcttctggttgttttttcttgattctttttttaatcaaagttttttcttgattcttgattttatgagcctttcataatgaagtcttccacttccagccaaatagaaaggttatgcagtgtaattacagtcatttttataacatgcagatgtaacatggacaactaaaacgcaagataatttgattttcaatcgaacctgtgtttgtatcgggttgaaatgggaaaatctgtatagatcttgatacgtcttgttgccaagagcactcaatggaagaggcttcaggtccaaaagttcagtgtgtgttatttgtgtctgtaaagaacacctgaaaacttcagtatatgataagtcaaaagaaaacattatagaactacagcaagacatcgtcgaattcacctgtggcaaggtaaggttatgaaaagaaacagtaaacagtgactctgctcctaaccaggaatctgatatggcccgtatgtagtactgtggtggatgaggttcaaagatcggtacattaaaagaaatctttgtaggtgctcctcttgccttcttcattagtgtgaacaactctgaatgataaatagtatcattttcagaatcctggaaaataaaactgaatgttaccaacgcattttcctaaatcacttggtggtaaatacattaatgcatgacataaatatagatagagttctacaggatcaaattaaaaacatataaaagggaatatacatgcttcgtatatcctctaccacttaaaaacaagagttggnnnnnnnnnnnnnnnnnnnnnnnnnnnnnnnnnnnnnnnnnnnnatntaatcaacgctg

SEQ ID NO: 34369 - DNA, 1520 bp, Oryza sativa
  unsure (1)..(1520): unsure at all n locations
gcgtgcattganatgcagctcggacccacatgatagaaacgatcgttagtaaaatacagataatacgtcacatttccacaagtgctaatgcataaaaagttagtatacagcactgcattcaattcacactgcaaaatacatactttccagaataagcttatgcaacatcatttgcatcgaatatgtaaacaagggaagaaaaggatacctcttcccaagctattccatacaccagaggattagtcttcatccttataaataagtatgtgtagccaagccaggcacaggcctccctgacatttgtaacagtgcccaaggcaacctcagcattcaaattatctttcaaagatccaaggaactgcacgatgaacatggccacaattagtcaaattcaaatcaaaccgaatgaacatgcaacatcaaccaactgaccaccagccaagaccaagaagcaaagggaggaaagaaaactacaagatgtatttccaaatgtatctatgggccttactagtgtatgcattatcctacccatctaaagcgctatgtatttgtgccgaagacattacaatgaatctggtttttgaatatctgattggtttggatattagaaattcacagtagtcttaaagcccgtttgtcaatgacagtagtgcaggtacccacatgtacatgtggaaaaggcattccacataactatgcaattttttcaaggcttcataaataatcttaagaagatactgacatggtaaacaaaaataggtttatgtgaaaattagtcaaccacctaggggttaatatagacaaatgggaagtgtgactgatttatgtttggccatggcatattcattttctcaacaattcaatgttagggccatatcccctgaatcttttcttcgccccataactgaactaagataaaggctgactgatattttccgcatccttatttcaatactctccgaatcaaaaagtaatttgctaacctggctttctatcggaagctgacttgttaataatcttaagtagtaagccaatttgtcgtgtgtcgtgataataattccttcgccacttttgtcaaactgcggtcgtccagcacgcccgaagatctaataaaaaataaaattaacattagaaacatagactttagctagctagaaatgaatatagcacgtcagaatcaaggcaagttcaaagcggtacctgcatcacatcaagcatccccaaatctcgccatccaccagctttaggatcatatagttgtgttccctgtttgtgggaagtcaccgtatttattagtgtttcgtttactaaactggaggaaatgaattctaacacttgacatattaacagtatattacaatttaccaatacagtcacaaaagtaatcataatagatgccaggaaactgggtgttgccgtcacacgtctgttttggacccaaaaagcagatactgacctttataacgactgtatgagccggtaagttcactccccaagccaaatgtgcagtacaaacaagg

SEQ ID NO: 34370 - DNA, 883 bp, Oryza sativa
  unsure (1)..(883): unsure at all n locations
ccgttcccacaagtattcataataaatgccaggaaactgggtgtgccctcacacgtcttttttgaccccaaaaacagatacttggctttataccgactgtataagccggtagtttccctccccaagccaatgttccagtacaaccaaggccttaaaccagaatattgttccaacccttgtcaaaactgttggttggctgaaaagaatagtacttactttcaggagcccatcagcaaacaagcgctccttcaactttctatctgatcgaatcattccagcattatgaatcccaaaaccagattcaaaaaaattctgcaacttcacgacttttggttttgctaccatctttctgcagccaaaagactagttgaatcataactagtagattcaaattaacgctacagataaaggtaacaacataccttgattaatgcatattggggatggtcagcacatgaaaataactccaattctcctgcatttgcagctaggtcgatctgcatagcatgtgaaaagaattagaaaccagaatactcaaatgaataaattatataaacacagcatatttggtactacaaaaacatgagtccagaatcacttgctacaaacaatcttcaataaggaagaacttaagagcatgcattctaacacttgataaatagtaatatccatttggattcatggcttgtaatgtaacatgtaaattattcttttaattatnnttnnnatagggtgcatagcagaatgtncaatcaatcactgnggggggnggnaagnaaagatnnanatacaaataaaagatgncnnnttcgaaggaagatgggaagacgtgtgangagtaaananaacattagtattagaataatccataaacacagtctcg

SEQ ID NO: 34371 - DNA, 921 bp, Oryza sativa
  unsure (1)..(921): unsure at all n locations
catgtccatttgtgatacaacctcattnnnnnnnnnnnnnnnnnnnnnnnnnnnnnnnnnnnttttgccatcattaagcataaggaccctttccacatcaaaaggaaaaggagaaggggctcctttaaaaagactgacctggcgaagagtccgagcaactagcgcctcaatgactgaacctctatcatcatttagcaagtgcacctcatcaatgattataagcttcaccaacattgacagtgacatgtcactgcttttccgtgtaataacatcccacttctcaggagtagtcactatcatctatggaaagcaccaaatattacagctcagacctgcaactgaaaataatgaaacaaagttgcatacctgtgtttcttcaatctcatttttggtcagctgcatgtctcctgtaagttctctaacaaccaggttcaacggagataatcggcgactgaatgtggatgttacctctgcagccaaagcctaaatggcacaattttgcaaaaatgccacaacaatcagaacattgaacaataacatagatcaggtgacctggtaaaaaaaacatagaataggaaagaagaaataccttcataggggcaacatagactattttgaattcgtttttatgcaaaatgccatctctgaagtgttgtttgacctgcaaaagaagtgcccaacccaatatttaaggttcccaactagatgtttaacgagcagataaaacagggggataatggtagaaatcagcagcttgtagaattgggtagcttttcaaggttccgccaatgaatacctcatgaagaacagcaatcattgcaatatttgttttgccagcacctgttggagcacaaacctgaaaatcgatggggatcctctagagtcgacctgcggcnatgcacaattgcgcactcaatcacc

SEQ ID NO: 34372 - DNA, 1188 bp, Oryza sativa
  unsure (1)..(1188): unsure at all n locations
gcgccctttgattacctgactgncaccctaacnnnnnnanaggataaatttataatattgtgaaagtgcttctcacgagaaatctcgcataacatttccatgttctcaagctaaggattttaattaaaattgcatttatagtcgaagtttctgaagtttgaccagatcttttcgaaaacgccatatattaataatcacagagagttagttcattttcaaactggtagttacttctgcaaacactatcatccattggacataaaacaatatgtaggcaaatttaatattttgattaatgttccctgtcctttcatctaccaatttacaagattaatgtgtatatctcgatggaaagaaattgctattcaaccagtttgtaaatgcattatgatcttagtcgggcctgaatttagttgttatcatggtgcaatcttttgttgtattcaatgctctttgctgattcaggataacttgaaccgaaccctgtgtggaaaagtcccgtactcagttgatcagcaacaccttgatgacccacatgttaaagcaaacttactctttcaggtaagtagatttgagcttatgattggaaatttggagtatcatcttatttttgtactggcatttttatgataacatctgaatgcacaatgaatggttattaccccctttttttcccgagtgaaagcgtgctggcacaacattttccacacagaattcccaactagtgcctatgtcactgattcgaaatcggctcttgatcaaagcatacgtattatacaggctatgattgacatatgtgccaatagtggatggctttcaagcgcattgacttgtatgcatcttctacaaatgatcatacaggtcaatttcattgtctcagatttctctctctcccccccactccccccctgtcttaatttgttgttagtgctgcgagcagaatcaaattacttataggcggtagaactgtactccataaactatgggaatacctcatgaaagacagagagacaaaatgtctcgatacatggcatccatcaatgaaaaaggctctataccatccgaagggcataggattttcaacaattccagacttactaggaattctctcgtgaagaattacataggttgcttcaaccagttttttgtttttgagttgtaccaagtactgattgagagtttggacan

SEQ ID NO: 34373 - DNA, 781 bp, Oryza sativa
  unsure (1)..(781): unsure at all n locations
cggtttgtanaccttgtatatcnnnnnnnnnnnnnnnnnnnnnnnnnnnnnnnnnnnnnnnnnatctatatatccattaaataaaagaatccaaaacagcatccacctggatgagatcaagagcagtaagtctagtctgccgacgagatgatacaaaaatcagaactggtttgtctggtgaatgagtacatattgctgcatatgctggtttattcatgctattcattcttggacagtagaacttcccaggatatccctgttggtataaaacaaaggcactatgaattgatgatagagatgtttacacagagtaggaaactgaaagtaacaaaaggtggcccatcaagcaaatactcttaaaaatagatttctcaaatgcttgctaatgcatttcttaaagaataaaatgaacggaagcaccaaacttgcaaagtggatggtggaataagtcacacatcttgcattttgatcaaacaagtcaaccaaaatttgatttgttgatgcaaactttgtcactgatcatgaaatgtgggctaatatagctgagttggatggctacacaggctgaggggcactaatttcgccaagtaagcacactcataccatacccatcaatgagataataacatgcattctgcattttactttcctgcagtcaaagtatgttggttcatgtacatgtttatctcgcatccgttaagcaactagaagaggtgcaaagcattacttacgacttacaagcatgtcacaccaccctcagaggtttgctcactaacaatca

SEQ ID NO: 34374 - DNA, 2840 bp, Oryza sativa
  unsure (1)..(2840): unsure at all n locations
cagtgtgatgatacnnnnnnnnnnnnnnnnnnnnnnnnnnnnnnnnnnnnnnnnnnnnnnttctattatgattcagtgttttttttcttaaatgaagtgtgatatactgtctaaagtctgaactaccaagtttgaaatttttttacaagacacatgttttataattttgtgtgcattgtacaaaatcttgacctatttttttgcttggtcacaggaaaagatggctggtggctttagggtattgcatcttgtcaggccttttctggctttcctgcctgaagtacagagtgctgataggaaaataccatttagagaaaaagtgatctacactgttatttccctattcattttcctggtatgcagccagctaccactgtatggcatccattcaactactggagctgatcctttctactggatgcgtgttatccttgcatcaaaccgtggtactgttatggagctgggtatcactccaattgtgacatctggcatggtaatgcaacttctagtgggatcaaagatcattgaagttgacaacagtgtgagagaggatcgtgctctgctgtaagtattatgagattaacactatgttctttactattacctgaaccttgaaacttagtgccttatttactatggtctgctgtttgtagcccaccatatttcagcgaatggctattgattaaatgctactacgtatctgattcatgtttaccatgtcttttgattatatttgttacgctaatgtacttttttacccaggaatggcgcacaaaagttacttggtatcctgattgcaattggggaagctgtggcatatgttttgtctggaatgtatggcagtgtaagccagcttggaactggaaatgccatcctcattatacttcagcttttctttgctggcatcattgtcatctgtctggatgaacttctccagaaaggttatggtttgggttctggcatttctctctttattgctaccaatatctggtgagcacattgaactttgttcttctctattgttgacattttctattcaacttgacttatggaaatctttctctgtagtgagaatatcatctggaaggcatttagccccacaactatcaacagtggccgtggtgctgagttcgagggggctgtcattgcattgttccatctgttgattactagaaccgacaaagtccgtgccttgcgcgaggctttctaccgccagaatcttccaaatgtgaccaacttgcttgctactgttttagtcttcctcatagttatctacttccaaggcttccgtgttgtgctaccagtgagatccaagaatgcccgcggtcaacaaggctcatacccaattaagctgttctacacttcaaacatgcccatcattctgcattctgcactgattaccaacctctatttcatatcccaggtctgaacttcaattccactgctttagcaagataaatctttaatgtttgtgtttagcattaacatgtttgtattgctttggcagcttctctacaggaggtacagtggaaatttcctagtcaaccttattgggaaatggaaggaatctgagtactctggccattctgttcctgttggtggtcttgcttactatgtaactgctccatcaaggtgaagaatcaatttcatcaatgaggccttcatctctttgtgctcgcaattttagtttctgttactgtttgataaaatttacttttaattatacttaccttggcatatgcactggaaatgttgcagtttagctgatgttctcgcaaatccattccatgcactgttctatgtggtcttcatgctgtcagcttgtgctctcttctcaaagacatggattgaagtatctggttcatcagcaaaggatgttgctaaacagctcaaggtaaaataaaacaaaactattttctatatctggtctggaatgcagaattatcatgcaagagctacctttaaaccaccaacctttgcaatttaacaggagcaacaaatggtgatgccaggccatcgtgagtcgaatttacagaaagaattgaacagatacatccctacagctgctgcatttggtggagtctgcattggtgcattgactgtcctagctgatttcatgggtgcaattggttcaggaactgggatactgctcgctgttacaatcatctaccagtattttgagacattcgagaaagaaagggctaccgagctaggtttctttgggttttgatcaccttagctgtataactcctagctggaacttcttgcgagtcgcagtgctgcttggccggctgtcatgtaatgggagacctcagaatcagcttaggttgccgacttacttacaatgagaatcttgtagcagtatgcgttttgttcatgccagcgtatggagttatttgtcctgctcctgcccccagtacagcaatggccatcgtagtaactggatgtgttgcgatcaatttttattatcttttaaactggataggatatttgattcctgatctcttttttgctgaaaccttcgtgactaatgtttctgatcactggaaactaatctggtgttatgtctccctgctgcttcttttattgcaagtgtttggccacatggataaaatgttaactttcaaaagacattctcattttttagcatgggttatcggtaaacttttgagactggtgactattccccttactaaaaaaaatcatattaatattataatttattccttacattcccaaatatttccccagatgtaagaacctaccaccctgatgaacttatcaggaattgcctggagtcttgaccaaattaaaatttatattgcttgggacaagttcca

SEQ ID NO: 34375 - DNA, 9474 bp, Oryza sativa
  unsure (1)..(9474): unsure at all n locations
ctgcgttgatgacctcctcttgctgcctgcacgncgactctagaggatccctgagccttttactaagattcctcagacagctacagcatgaagataaaggacttaatcagctagtttccacatcaaatcagctagcaagaaatatcattgcacttttaattaactagggagtaaaagagtgtttcggatgttggagcaaccaagcaagacaaaagttttgaccttggagaccataagtgacaaatgtttttccccactctgaaacaatcaatctacgagcagatttgtattctttcacatagaaaaggcaatacataacaatctaaaaatccttacagatccttatgtatgtcagcagaaaattttaagatcaagaaattgaagacgtgtttcttacagctcggtgacaactctgtaatctccttgctgagaacaggtcacaccagaccaggggggcagatcaccatgcccgcaagggtcatcaccaacccatgagtagacaactctccatcctaacgaagatttgatctcattcaatgctttcactgcagcataaaaaattgttttctttcagtcggttccaacattctacgaaccatgaaattactcaatggccgccaaacattgttaagtcagactaatatccatgtctctatgaagagataaacctctccacctgatgcagtgtcagtcagtgtggagcctaattagtatacagctaggaaatggcaaaactagatagtcacatgtatacaatcacagagtaatttagacatctaagacacaagccaacaacagatcccaatgctacacaccccaaatgaggcagctaaccgatcgagcaggtgcccaattcacagccatgagcataaaagaatgcaaggcaccagatggtcagatctccagcagggaacggccaaagaaaccaaatctttcccaaattccatgtcgcggaatcgcgcatcacgagaccagtatcactcgctcaattcacgggggggaaagaaaaaaaaaagaagtgcagagaaggatgagcggagcagccagctacgtaccgtccctcttgaccgtcttgccgcttgcgacgccggccaggacgaggaggaggaggaggagaaagagcgggcggacgggcaagaaccggggggcggcggcggcggcggccatggacgtgtggggaagctgcggctccgcgctaggatggacagtagcggggcgcgccgcgggagaccatatgagagagagagagagagaagaggagagggggaaggtggcgccgcggcgggggcggggttggggatggaagtgcgggagaggggagtggagtggagtggagtgggcggatgggcactcgcactccccccgcacagccgcacgcacactgactcgctgcctgccgcgtcggtgggttggccggttgggcgccgcgcaccgggactgcgacgactggaacgtggagtgtcgccgaaccggagcggaatacagtattttactccatccatcgaaaaaaaataaaccatgacttttcatgtaacgtttgactgtctgtattatatgaatttttttataattaatatttttattgttgttagaagataaagcatgattaattctttatgcgtgacttgtctttttaattttttcataatttttttcaaataagactgatggtcaaacgttgggcacggaaactcagggtttgtctttttttttagacggagggagtaggtatgtggtagagctctaacccctaaatttagctttataatgtgggtttagagtggagttgtggagcagtcgaaacctagctccacttctcagttcattttgtgagagtgctccacccagctccgctcccattttagctagagtttaaattgtttggctgggctccagagctgaaacggtgccaaacaaggctgaactatagaggtggagctggatttaagctgttccacaactctgctttagatctaactcctaaagctaaatttatgtgttggaattctactaaacagtctcatatacatttaacatgttaatctaatcatacaccaatttacttgtgtgcttcatttatacttttaaataaaaatttagagtggaaactattatcattttttttcaaatacaataaatctcaccacaatatgtggatattgtaaatcttgaggtaaatactatgtgctgtaagttacactagaaaataaaattgtgtttcctaaaaaaataaaatgaaaataaaattatctaaaaggaaaacgataacaaaagtattattaataagctctgttaaatacttcatctgtttcacattatacgacgttttagattgtcgatagattcatacacgaatccatgtacatattcatatgtatacagtatgggacgggctaactagctaacgtgccaaagaccgcaccaatttcttttttattagggccaattccctatatgcccatataatttcacccaatcccttctacgcccctgaaatttgtttgatatcttatatacccctgagtttttatttggatcccttacatacccattccgttagttgaccattagtttgaccgttagttattgtagaaattactttattgtccttgttatattgttaaaagctagaaatgttttatgtgtaaattttttgagttgtgaaaaccaataaggaataaattactaaatatttgttatgaatttttgaaaataaaacattatttcattaaaataaaaaaagatttattgtaaaaaaaagttctgcataagatttgaaaattacttttcaacaaatatttagtgaaaaaagattcgttgtgaaaaaacaaaggggatataattagtttatcacaaattagaaaacaaatttaaaatttttaaataaatttcagatcaaatttgatgaatttcgtatatcttcccaaaaatttaaacctaaataacatttagtttttgctcttaattttctggtgaaactaatgtatggatttaatcataatttttaaaaaataaaaaataataagttttattttttaagttgggcattaaatgattatattgcttgtattttgtataagtttatttttcatatgaaaatttattgggtaggtaccacacatatgtataggatgggtaatatagtcattttaaaatatttaacggtcaactaatggtcaactaacggagatgggtatagaggagatcaaaatgaaaactcaggggtatataagggataatgtcaaattcaggggtattgaagggattgagtaaattttcaggggtatatagggaattttctctttttattagcacatggacgggcaactagcgactagcgagcacgtcaaatttgcacaggcaactcttggaagacggttgatctcgcaaggtaacaacgactaatgtgtacagcgtactacagataatcatgagtttgtattgaacattttgacattattgtaaagtatggtttgtcaacggtttgtttaacttttgacctagttaacgtgaaaacggttatctgtcgcgattgtcaggatttacgtgggccgcattgggggcgggctaacgagcaggccagcttcgctatctccggccggccgggccacccgaagccgactcgaggggcataggcccaccacaattcgcacctagcttttttttttttcgttgcagcaaaaggttttctgaatctactgaatttatctagtcacatatttcctcccttttttaatatgtaatgttgttgttgttttagatacgtataatcatttgtcatattaaaaagtttatgtaattattattcattttattgcgacttgatttatgctaaaatgttttttaagtgtggcatatttttttatatttacataaaaaatttaactaagacaaatggtcaaacatttgtcagaaagttaatggtatcaagtatttaaaaaactaaggtagtaactgaaatatagagagtgtgatctgtagcaaaagtgatcagtactacaactgtttggaaatgtaatcaaacagcgttgatgaaatactgaagctggctttgatcattgcaaacgctaacagaatgctatagcagaacgcaacccttctcatgttgttggtaagagccaagaaatgcgttaggcatgtcctgctgcttaacaacttaaattaattgattacataaaaacgttaactcatccaggtatagcaaagtattattgaaagggattaccaatgtaaatattaaaattgtaatataattatagtgtaacttacacataactataatataatttgtttaacacattatttccactaaaggagtacacgtgaccaaattgcatcacccgtggttgcgctatgattttttcctttcccgcttgcagagtcttaaagtaaatataccagattaaaaatacataaaaagttacatacatattatattataattacatacaagttataatattttttgaacgactcgcataagacggtgcgaagttctattgatagagcagaagaaaaattataagattacaaccctggaagttgtaactaggaaaaagggaaaaatataccaccacccacacaccgacaacgccaaaacactgaacaaggagaaggctagcaccggaccggccaccactaaccgtggccgacctccgctaggccaacaaagaaaacacggtcgggatcgcccaaaacccaactcttacaatcaacacaaagccccgctctatccaagtattcaggagttaaggagagagggtgagagagaagaatggaactcctctccccttaggccctccgacatggccagcttgtagagactagttaggatgccgccacaagaggatgtaatctagagtgagtttgtactaattggttgggtggttttagctaggggatgcctaaacgatggatcatagcaaaaccgttacttgaatactgaagctacctttgaatctttgatcatggcaaaagcttaacagaaggctagagcaggatacaaccctttcgtgctgttacctgtcggtacgagccaacttagccaagaaatgccataagcatgtcatgttgtttaacgaattcactagcttagtagtagcttaattaactgcctaaaagataaaaaggctaataaaacggttaactcattcggagacaaactcgtactgcaaagcctacgtgaaaatcgcgtttcccgcgctctcgtggcgcaccttctttgtctgtacaagaagtctattatataccccccatcctggccaagaccacaccttgccgtcgccaccaccttcctcgccgccggcagccgagcgggtcggtgccgccatgcaatcgccagagaatgcggcaccgcgcgtgtactttatcccgttcccgacgccggggcacgcgctgccgatgtgcgacctcgcgcgccttttcgcgtcccgcggggccgacgcgacgctcgtcctcacgcgcgccaacgccgccaggctcgggggtgccgtcgcccgcgccgccgccggggatcacggatccgcgttcacgcgctcgccctgcccgccgaggccgcggggctcacgggcggccacgagagcgccgacgacctccccagccgcgagctcgcggggcccttcgccgtcgccgtcgacctcctcgcgccgctcttcgccgacctcctgcggcgcagacccgccgacgccggggtgttcgacggcgtcctcccgtgggctgccaccgcgggggccgagctccgcgtcccgcggtacgcgttcacggggacggggtgcttcgcgctctcggtgcagcgagcactgctgctccacgccccgcaagacggcgtcgcgtcggacgacgagccgttcctcgtgccgggcctccccgacgcggtgcggctcaccaagtcgaggctcgccgaggcgacccttcccggcgcgcactcgcgggagttcttgaaccgaatgttcgacggcgagcgcgccacgacggggtgggtggtcaactccttcgccgacctagagcagaggtacatcgagcactacgagaaggagacggggaagcccgtgttcgccgtcgggccggtctgcctcgtcaacggcgacggcgacgacgtcatggagcgcgggcgcggcggggaaccgtgcgcccccacggacgccgcgcgcgcgctggcgtggctcgacgcgaagcccgcgcggtcggtggtgtacgtctgcttcggcagcctcacccggttcccggacgagcaggtcgcggagctcggcgcggggctcgcgggctccggcgtgaacttcgtgtgggtcgtcgggggcaagaacgcgtcggcggcgccgctgctcccggacgtcgtgcacgccgccgtgtcgtccggccgcggccacgtgatcgcggggtgggcgccgcaggtggcggtgctgaggcacgcggcggtgggcgcgttcgtgacgcactgcgggtggggcgcggtgacggaggcggcggcggccggggtgccggtgctggcgtggccggtgttcgcggagcagttctacaacgaggcgctggtggtcgggctcgccggcacgggcgccggcgtcggcgcggagagggggtacgtgtggggaggcgaggagtccggcggggtggtggtgtgcagggagaaggtggcggagagggtgcgcgccgccatggctgacgaggcgatgcggcggcgggcggaggaggtcggcgagcgcgcgcgccgcgccgtcgaggtgggcgggtcgtcgtacgacgccgtcggcgcgctgctggaggatgtgcggcgccgggagatggcggcggatccacggaacgtgaaggaagtatgaaaccatatgaatcacaaactgaaatgttaaaatgtttcataactaaaaatttggaccgattaccaaacgagtgtatatcgggcttaaattgatgactacttatttcgtttcatatttcaagatgtttgactttttttttctagatcaaactctccaatttataaaaaaaaagcataatagtagtattttcaacataaacaaatatattcaatgtgaggtttaatgaagagagaatatagtgtacaccactgagtttatcccagttcaacaatatgccactgacattatttcattctacaatataccggcgactttaccaattagtctacaatacgccattgggctggagatctttttcaaaaatacctaaaatacccttataatcatataatgttaacaattgatttatctcattagaagtttggaaaaaatatgaaattttttatttggcctccttacacgatatgaaagtttgtaatacaagttttaagatttttttcatttatattttttttgtaatataaattatcagttatatgctatataaaatacttttttgtgttgttatttttaatataaatcatctttgatatgctatataagttatttttatgctattatcttttgtgtaagtaatttctctctttaattctacacaaaaatatattgttttagaaaataaaaatatcaaaaaaaaaacatgaaacttatatacaaacctccatgttgtataaaaaggcaacacaaaaaatttcatatttttttgaaacttctaatgagataaaaacaattgttaacatagtatgtctttaagggtattttgggcattttataaaaaaatgtatagactagtggcatattgtagaacaattggtaaagtcaccagtatattatagaaatagacaatgttgatggcaaatcgttgaattgagacaaactcagtggcatatagtagattttctctttaatgaaactaatttggtattccctctgtcttaaaatataacaacatttaaccatcaggatttcttctaaaatataacaacttctccatcgatattctcttcccaaccaatcataacccttcaccattcaattttcccacataccttcattacccatccaatcacaacgctccaccattcacttctatacattttcttaataaccgcgtacaactataaaacttcttatattctgggacggagggagtatactttagatgatgttattttttttataaaattgattaaacttaataaagtttaattaaggaaaaatcaaacgatttataatataaaatggagggaacaatttcttttcaaatagcgcacacacactctctctctttcttcgtaataaatatttgatgtttggagtaagatttaatcaaacctttttttgactgaatcaccgggaggaggggggcgagtttccccacctgaatatattaagtcaaacgaaattacacagggcaggctcggcctacacaagcgcaggtgccctggaggatagtagcagaggatacacagggaaacacaaagaagagaaaaacaacagagagaaaaggtggccctccgaggaaaccaaagacggttttcctgcaaaatcacccagccacaaaccataaccgcctaaaagctaacttcctagatcaacaacaaacaaatcctcaagcagccttggaatccagaacgccgcgccaaagggcagagtgccacgagcatgccggcaggggaaagtggtgaccaaaaggctatggaagtactagaccacccgcatgaagccttcaagaatccaaacattttcttgttgcagctagaacagtgcccgccaacgccctttgggggaaggaagccccagagggggagaggcactgaaggttgcggcctagagccgcctacatggagtcgtctttgatcaggctaaaacgaattgcttgttggcttcacgccttccaacatccattaagggaaggaagcctcaaaagagggaaggcagcgaagcaatgtgatagaggacatcccaaggaatggatggagatgaacagggagttggacataaagggggatggctgaggacaggaattccacaaggaagaaggacatcaatgggagacaacgggaattggcacaagattagaagcttggagagcaaaagggcgaagcaggagggggcacgcttgcgtcgatgcctttagcaaggaaagtgacatccacggacgccaccatcgacgaaaagagcatcgggcaaatggttgcaggtttggttggggagactaaaatcaacgcctccagggaggtatacggcaccaaaaggcgtcgccgtcgatcgcacaaccgggggtgtgcacggctttcgccctctctccccaagcccaaactgcaggcttgcatatgccaaggtagctggctagcctgccgagcaggtcaccgaagccaggtgcggctgctcctagaccttctcgcccgcaccggcaaggaagtggtaacggagggaaatgagggcaaggagggcgttgaggggccggcgaggacagcggctgcggagggcgaggatagcagctgcggagcacaaacataaatcagaagcacagaggggcagctggggatcctctagagtcgncgtgcaggcagacatgagtatagtataatcaacgcgt

SEQ ID NO: 34376 - DNA, 4938 bp, Oryza sativa
  unsure (1)..(4938): unsure at all n locations
ctgcgccggtgaactccacctggtacccggcgccgcgcgcccctgccttcaccgtcgccctccccgccgccattgccgtcgccctccccaccgccagtcgccatctcgacagcgtccgtgcgcagctaggggagccagcgccggcaacgacccgtcgccagctacgccaggtcgccgccgccccggacccgtcgccaaaccctgccgccgagcactccaggtcgtcgccgcccccgacccaccttccaaccccgccgccgagcagatcccgccatggaggaccggattcggcctccacggcgccggatctggccgccgccgggcgcttctcctcgtcgccggcaccaagcctgagctcctgtcttgccggcgtcccgtacggtttgaccacgagcgagggagagggagccccgccgccgccgtccttgcagccgcctggcttcgccgacggtggctcgggcgacggcgatgctggggagaggaggagaagggcgggggccccgcgtcgcccccgggacagcgccctcgtcaaaccttaaaattttaactattaataatttctcaaaccgtttggttttgaaaatctctatccgtagatttccttttttagaaaagtactatcataagatcgtaaactcgttagaatttatgaacatgtctgatgtaaaattgtgggacaaagttataaaaattattaaaaccaatcttatcctttaaacgtcgaacatttggccgatttctcccgtggtcgtccaactgtccaactgtacagcctgcttttacgcaacagaaaacggccgccaccgtccggtgaggcggtgagtagagacagacagctgggccccaccgagcagtgagaggacgagtagtacagatcccaccaaagtcgacgagacgaccaagctcttcttcctccctgcgaacaaaaaaaaaaatctcctccccgcgtcgaattcgaaggggagagagcgccgcgagcgagcgagtttggcggcgagatgggctgctgcagcagccggagcgcggactcgccggccagccgcgtcacgcgctggcgctccaccgggatcgtcgccctccgcgacgccagattgaaggttcctgttgattgatttttcctgtaaatttagtaccattggggattctgtctagtctgctagttggggcgtggaggaatttcggtgctcccgagttcttatcatctgatgcttagtgattcgggtacacgatgacacgacaaatatgatgatgcatcctaggatttctgttaatcagccgaaggggtctactgccacataggcgttaggttaagcaaaggtgtgatttttggattgcttgcgggtgttttaatcctatgggattgctaggtggaggtctgaaggaaaggcacaatcttgccgttacaagtatgtaatcatatgtggtgattggtgaatggtgatggcctgatgggttaacttggccaattctttttcactgtagtttcagggaatgctgatggttaaaaactttttgcccatggcacttccacactttatacttaccctttattctctctctctaaaacaactgctgtactttctcctctatttgcataatggagctactgcctatcaataattaaattcttaattagcatgggaagtactttttgcgactaaatatttaataaacactcaccagattgtaagattttagtgctttgttccatgtccagaagatagaggtgcattttaatattggcgttagttctcattcatttgtttgtcctcatatcagtatgtgatatgttctactatctcatctaaaatatatatttatcctgcaagtcaatgccaatttatatttaattttcttcgaagaacgaagacacaaggttcttttactgtgaaattgaacttttcttccaaaattgttaaatgtcaatgttaccatgcaggtagtaccaaatgaagttctacaagtagggaattccctgaggattctggatttgactaacaataagataggtatttggactttagaccatgacccctggatacttagaagttctgcaatgctagtatcaatattttctctctttttttttctcatatattgtcaggaagaaactagtttggagtcgttcattgcttctttctttcttttattatgcacatcagtatcagatgggaggaaaaaaattatgcacaccccttttttttcacttggcatcactaacaaatgcatatacttgaagcaagtcagcaacaattcgacaagttattttttttaccttgcagggtttctttgacagtttgggtagaaaaaaaatccaattgaactgcacacactgtatttagatgtttctatatcttgagaaatatcaattaaatatatattttatgttgcagctgagattccccaggaagttggcacactcgtgaatatgcaaagacttgtaagagttaatgttaatagaaatcatgatttggttcatcttaccaagttactagagacatgtatttttaagagtggttcttctttgcttgacatttaagtttactatttcttttctgttcctgtaggttttggctggtaatttggttgaaagcatcccagctaacattggatatctgcggaatcttaaaatcctcacacttgacagaaataagatctctgtcttacctgaagaatgttagttcataaaaacctaatgctatctttatttatatgtttagataatatttatcatttgtccacgtgtatattcttaatcctagcaacaagttagtagagatttattgacttttgcaatattacacttcacaatttcccacgtctaagtcctaacttgtttcttccattctatccagtgggttctctatcaaatcttcaacaactctctatttctcagaattctttatcacgcctgcctaagagtgtaggagatttgcgcaatgtaagtttcttattcgattcaagatgttaaattttatatatctttgaaaagcaacttttctaggcacaaaatatttttttgtcttctcaaaacttttttttggtatagcatgaatgccttcagagttacaagctgttccttctttttattttcctcttcagaatcaaataaactcttgattctatatttcctcatatgaaatttacgcagcttgttacattccgtaaagtttcttctttactagtaagtattttaaacttgttttaataatggagactatgctgtgctcatcactgttttttcaaccttttttttttcctgatgcagatgttgctactcaatgtatctgacaacaaactaattgcacttcctgaatcaattggaggttgcagttccctggaagaattgcaggcaaatggtaagtccatcagttttttgcaatggtagcatttatatcatttcaattttctctgcaccctgttcacatgcatccatgttaatgctatactgctgccacacacacacacacacacacacacacaaacatgagtgctctgtgccgtcgtactttcctatctcgtatgctataccacctgatattccattgggaaaggcatgccagaaccatttttagataccttttgtcatctaactcaaatatgatccaaccattcatatgctgtttaaaaaaaaaatgcaaagcacatcgtggttttcgttttcgatgcatcatcttagataaccttcacgaaaacattttcaggaaattcaattgaagacgtgccttcatcaatctgtaaccttgtttgcctcaaatccctatcattgaacgggaataagattcgtcaggtacgaacttatgaatatgcttttccctcgtcgattacttctgtgtttgaacctggaggctctagggtcaaagtcagtgaataatgactattcatttagatttgaaatatcctggttacattgttgccaacttgtaacgtacaaaataataagcaaagattctccgaactttgactctccctgacagcttccccaaaacctactgaaagactgcaaggctcttcagaacatatcgttgcatgacaatccaatctcgatggaccagtttcaacaagttagtggcatgaaagcttaatacagattcttgtaatttgattaatcttgattcaattataatttgttttctttgtctgttgaagatggatggctttacggaatttgaggcacgccgaaggaaaaaatttgacaaacagattgattcaaatgtcatgatgagttccacagcacttgatgaaggcattgatttgaactagtttttcagaaattttatttagtttataattaccccattagtcaaaagaccaactgtaaatctagtgtacatattagtttttccgatactctgatttggtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34377 - DNA, 956 bp, Oryza sativa
  unsure (1)..(956): unsure at all n locations
ctgtgncttgnatttgaattctagctcggtacccagatagttaatgaatgtggatagcccatcgaaacatccatttacatgagtttatgtgattatgtaatagttgcaatgcaagaaattcagataaaattagtaattcagatttcaaataattaacagctcccaggtacgacaggaaataacatggaggctcaatttgatgatatgaacaagatttacctgagacccagcagatatatgcaagtagagtggcttctcaccatcagtttgtccatttggtggatggtatcttcccctggttaggtcaaagcaagtaaatatcaaaagggaccatcgcagtcacaagtcacatctacgttttgcctggcttacctagtaatgatgacagtgcttgtacatctctgaatctgttaagtatccagcaaatcattattactgctatcacaaagtgatctacgcaaaaatggtgtttaaccctgtacaggaagcacataacaattgtctcgttaaggaattttacctcctcctgagtttgccgtttcgtaagcttatatcgcacagacggatcggcgtcatttataacaatttctcttgctattagctcatcaggcatttttgcctgaagaaacaagatgtacacagacaaaattttagaaccgtgtgctgaattgcctaatcaacacatattgatatacttacgaaaaatacatcattgtcacacctgactcaatttctggaccgctgccgcggcggtctggagcaccgaaggcgccagatgcaccggcaaagtatagggcacagcgactatattccccaacggaccggcggctcccgggatcgacacgccggagagggcaccgatgttcaccacgggcaaccccgccacagcagcagcagccgccgccgcggcgacgacatcctccgcgggctgatcccactttcctttttttctacag

SEQ ID NO: 34378 - DNA, 6092 bp, Oryza sativa
  unsure (1)..(6092): unsure at all n locations
ccgcgaggtttgtcnatcattattctcnnnnnnnnnnnnnnnnnnnnnnnnnnnnnnnnaagctagctaacaagtaaaatgtgctaatttttgccatctccaccattagatgtaattcaaattccaaataagttaccattttttaaaatgtggttaattatggataattcaccaatccatatgccacaattctactttccatagattattgatttgttgggatcttagatataggctataccggctagtgaatgttttaattctctctttttgtgataaacgtttttgtttgttctgagtgtgacaatatcacaatggacacaactacaccgagagtgctagctggatagtgctaaaaagagacaccattctttccaaaaaaaaactactagtacactcaatatctatgtatttttttcttcttatagaagtttctcttaagttactcatccgatttaaattccgattacactgttattgtaacaattaaaactttacaacaagatctcacatgattatattttgatgaaaaatcacaaattacttttatgatatgtctaaattacttctagatttcactaagttacttcttagacatataaaagtaaattaagtaaagcttaaaagtaatttaaatatattatagaagtaacttataacaaaaagaaagtaactttaatttagaactatatctagattcattaacatctatataaatgtgggcaatactaaaatgacttacattatgaaacggggtgattaactctctatagtagaaataactatattgtgagtgagctgaaataagaaactatatagagtaaattcgcaagtaaagtgtagagaagatttataaagtccacaaaatatagaattaactaaaaacagtaataaaaataatcaacttagagcattatgaatgtatataagtaatttagtcaaatctaaaagtaacttatatatatatatatatattataaaagtaacttagtttataataaaagtaatttacaaatataaatattttttcatcgtaatataatcatgtaagatcttgttgtgaatatttaattgtaacgaacacaatgatgtaattggattgtaaatcggataagtaatttgaaataaaactttataagaaggaagaaaaagacacacatgtctaagaggaaaaacagcacgcacatcagcacgtgtagcagtaattcttctcacaattaattcgtcgttggttaacactaaaccgagattttacctatcacaatatacgtgatgttggtgtagcctcagccatattgactccactttactgtaccgggcattgggcattgttaaatgtcaacgactaaagcaatcaaaaattcaaaaatgtgcattgaatacttgcccaagatggttgacaacgtcctccctcttcatagatcaacatgagaaagaaaaagggcatgtgttgattcaaagcagagctcattggtccccctcagtaatttatttgagtattacatgatatcattagaacacgagaccaaaccatttagccaccgccatctatcaggctaccacatgataggtgatgtgatacaattgttggtttcggtgttttggtacaagcacaaacaacattcccaacaaatattgcgtctatccgtagtgtaacttctaacatggcaatattttccgtcaccttagtgaagatggtagtgcctctcatccatacaacacggcttcctcatgcaatacgatcactaggccttctctcgttgaggtcaagcagccaaagccgtcatgtggcataataaggtaggaaatcaattggagacttcgagcgagatatattggggagactgggagagtgagtttgggtttgtcttaggtaaagagttagttattgtggtttcgatccgatccctgctattttatctttgctccttttatctccgtattttgttttaatgctgctataaaatattttgtatagtacattaatacatgttgtcagattatgactacctcaaattctcatacgaaatgaattaggaaaccgcaagcaagcctaagatgggctggcccgccagagcgccaggcccggaaaagctcggccttgctggactcgtggcgatgggccgttgcaccgagcggagggatctatcgaccctcgcgcacgatctgggcctctcgatccagatcgaacggccgccccgtcaccgcgaccgccgcggcgaatctggcacaagccgccgacgacgcagacacgagcccagcttgggcgaagccaagcaggcaagcatccatcatccatggcgcgccgttcaaaaccctaaaccctgaggcgaacctcgaggaatcgcagcggcgcgtcgtgtcggcacccatggcggcgtccccgtccgctcctcctccccccgccgccgccgctggagtcggagtctggagccctgctccgcaatcgccgtcgcccaacctcgctaacttcttcggtaagtgcttctcgctcgtttcattgcttcatcgcacggtggcatcggctccactagcctcagctaaaatccattgtcgcgatttgggggctaggagagacgggcatgggatggagaggtctcacagtggcattaaaaatgacttcgatctgatcaatgatgtgaaccatctcttgttctgttccttgcagaagaagagtgctgtttatgaactcctagcaagttacctgtgcatatttgtatgttttggcagttagcgtagcattgaactgtcattcagtaaatgcaatatgaatggacacacctctcttcagatttgagcttggacattgattcaccctattctcttagcccactcaattaggccaacaaatagttcagagttctgataacaggttatagatttcaattactctgtgacatatcatggtttaatttcatcaatttctttgcactttcaagtttcaacagcaaactatgtgataacttgtattagggttttacacttttactgcatctgggcaatgcattttccagaagagaaacatgcattagattattgctaagataaaccctgtaatgcagtatggagggaatttgtatggggagcaattgcaggcgcattcggtgaaggcatgatgcatccagtcgatactctgaaaacacggcttcagagtcaggctataatcacaggggctaaggtatgagatagtttactttacatgtgcacggacagtaatgtttcttgctgcaattcgtgatttgatacatggatactgcatccttcttttctttgtgctgagcaggctcagaaaaatatattccagatgatcaggacagtctgggtctctgatggtctgaaaggttagccattctctgttgtttgtttactaaacaaaggaaaaacaacatgaagcaactttgtattagctctgaccaaaaccagttacttcgtatcagcagcaatcttgatgaaattcaatactcacccattttcaggtttttacagaggaatcagtccaggtgttactggatcacttgctacaggggcaacatattttggtgttattgaatcaaccaagacatggctggagcattctaatcctaatctaagtggccattggtctcactttattgctggaggaattggtgggtagctattttcttatgtctcttgaatgtttagtattgtaaatatttatgacgttacctaaacttttttatactaggttttatcaactgtgatcaatatttatttttagaagtatgccctttttttccacgcaatgtaaacatttctggctgatggaattttgccttctcattggaatttcgctgctggaaatttgccttctgattggaatgcatggaactcgagaaaaattcttatgccgcttcattgtgctcattgcaggagatacacttgggtcttttatctatgtgccatgtgaagtcatgaaacagcgaatgcaagtccaaggcaccaagaaatcttgggccttaactgccacaaaaggaaatatttctcaaactccaggggctccgatgtataactactataatggaatgttccatgctggttgttctatctggagagatcatggtctgaagggactttatgcagggtattggcactgtttgcttgttgctagcatgcctatcgttattgatagtgcgtttcatctatttatagtggaggggaagcttttgttttaatgaattattattttctagacactctaaaatcacatccattgaaatatgctagaaaactatttctgctcgaatactgattattgaattatgctcgaatactatttctcaacctttgaatacaattattgatcattaaaaactacattttatatacacatttctggacgcgtaagtgtacagttgttgattgaacaaacctactatcagtacagtttgtatgtaaagagacaaactgatactatcccttgcgtgatgataggctagttatcattcatttcctttttctttaaactgacacaatcttttgtcatacacagatactggtctacacttgccagggatgtaccttttgctggtcttatggtaagtgagaaattcagcttgcacttttttctcattgttctagtaattttaatatacattttcatatctcaaagcaataggtttggggccctcctccttcatgcagtaggcatgtcttaagagctaaatactgaccacaacatggcagcctcaagcatatgaatttttaaaatttggccaggtctcatcccagattgcacatgtcttgataaataaatatgttttgctagagggctgtcttcactctttagtagctttcgactattagagttcggatttgaattgagcctttgagctcctgtaccctacctgttctatcttctatgcataattatctctaccatgaccctaattcttgtagatattcatttcagcttacagtctgattttattgacagatctacgcatgtaatgtacactttaagattccttagctgcagacagtaagagagttcctttttatccttttttgatgagcatgatcttttgcattttcaggtcactttctatgaggcaatgaaagaactgactgagtatgggaagaggaagtatttgccagagagtaatttgcatgctagcagctccttcgaagggcttcttctaggaggcttggcaggcggtaggtctggtccaattttgttaatacaccaaatgttgcctatagtattacttgattatccgaaaatgcttaggtctcttgatatttacttattttccaatgtttttctatgtcaggttttagtgcatacttgacaacccccttggatgtgatcaagacaaggctgcaagtacagggatcaacaactaggtaactggaaaatctcacctatctctccttttctgctaggccaatatgacagtcatgaaatgaacttttatgataactgcgatatccaatttatactctcccaaatcgtcacacgcgtcattttgctgtttgacaaggtactgattattcttttgtttgttaatcagttacaatgggtggctggatgctattacgaagacatgggctaatgagggaatgagtggcttgttcaaggggagcattcctagaataatatggtacatacctgcatctgcattcacgttcatggcagtggagttcctcagggatcatttcaacgaaaagatcgatacagatgcccgtgaactaaccggcctgtcaatggacacaagatcagaagttgaggaagctgcatgaagccctgaaggcctgaagtagttccctgttttgtaggactgatccagaggaatttctgatttctccgtcaagtaaagttcatttcacgaatataagtgtgaaaaatgcaatgtcagccaagtttcaacgtttacaagcgtagaagagataaggaaactgatcatccttcatctactcagtatttttttgggggtgttggaaaccaggattgttggtgggcagtagttcttctgggtcttcaaagcccatgtttggacctaactgatgcannnnnnnnnnnnnnnnnnnnnnnnnnnnnnnnnnnnnnntggacattgatcctagttgtacca

SEQ ID NO: 34379 - DNA, 1061 bp, Oryza sativa
cgactaggagcgacgaggtacgtagtagcatgagaacggagcagattcagagtcataagagatgggagtagtagtaggagggggttttaaaagaaagcggtcataacggcttcccctcttcttccttggcttccggaaggtgacccccgttcctccctccttggatcccgctttgccccggttcaccattctctcccaaaatacgccggcgggcgcgcccaggtccgaaacccggtggggccggttcgacgcccgattgtctggcgccttcgggcccagggtaagtaagtcgccgtggttgtgcgcatcgcctcgcacgcggaatcgttgctctcgtttctcgcccctgctataacactcgcacagatgcaatgcaatgcaaacaccctcgaggaattgatcatgttcaactactactactactactactactactactactactactactactactactactactactactactactactactactaccaacacgcgacttgattgattgctttgtcctcttcgtgtcaatggcgaccatgggcaaagcatgtgattaaggccggtgtctgatggaatttactgccgtggagtcttctccattttcacactttgaaaattgttggtaactcacgagcgagagctgcctctctgtctgcagggctttcctgggagcgtcactccggattacgtcccgttccagatgtgggataccttgcaggtgaattttttttcttgtggcaatgaactgtgtgtcacaatgtctattaccttcgtttttaataactgctttgggctaagttcttagccaagttggtattatgctttgcttatttgcagggtctctcgacttacatccgtgcaatgctgtctactcaagtaagcttgacgctgcccaatcttcgctcatcttgcactcatgtcctgtcatattttgcactgttctagatggaatgccatattaatttttgaatggactccaggctcttttaggcgctattggagtaggtgagaaatctggcacggttataggtgccacttttcaggttaaatttcgattt

SEQ ID NO: 34380 - DNA, 3881 bp, Oryza sativa
  unsure (1)..(3881): unsure at all n locations
gctgtcccttgaattcgagatgcgagctcggnaccctcccccctaattttcttcttttatgggcttagtttcaatttcctcatcatctttaattacatgctattcttgcagtggtttctcagggatttgacaggaatgctcggtgggatactgttcactttttatcaggtgtcaaattctcttgctaactcgaataggcaatgccatcttattgccattgatagtttgtttactgatgagataacttgcttggtcagtattttatttgtctatagggtgtactaattctttgtgctttcacttttcccagggatctaaccttgatagcaatgctaaaatgtggcgcctagttgcagactttatgaatgaccttggtaatatagtctatatcagtaatcgctgtattaattctttgaatgcgggcgtctaatttaaaggtcctgcaatcgtttggtatttatattcaagactaagcattcatttttcttttgaggtattctgctatagtaggtgaatattaaatagcatatgtgtcacatgcccctgcaaatgcatttcacatggaatctggatttaaaaaatcctttgtttaatgcgaattccttgtagtatcaaagtatgctagcagagtttgtttgttggttttgcagggatgttgatggatctcttaagccctctgtttccttcatcattgattgttataatgtgtttaggcagcctatctcgatccttcagtaagcggatttacatgatgaatttcataaccttttaaattttcttttaaaatgtttgttcgttaactaattatttgactatctgtatagctggtgttgctagtggagcaactagagcagcgttaacccagcattttgcacttgccaataatgcagctgatatatctgcaaaggtaactttgcattatcttgtaacatcctaaatgccaattagatggtaaatttctctaaactgtagctgcagaagcatactcaacttttcaggagggcagtcaggagacacttgcaacaatgttaggaatgggactgggaatgcttcttgcccatgttaccagagggcatgctttgggtgtatgggtttcattcctttctctaacgatattccatatgtatggtgagtgcatcattccaatatttatttatttattttttgtaagaaggcctttataattgaagaatattattcaattatgaggtcagaggaatatgaacaaaaggtgtgtagataagtttttccatcaggacactgccacaaaaacacaaatgaattgtgaaacaaatatggtacacatgaataacatgaagaaagcagttataccaagaatgctgcatacatggatttcctatcgaaattttctatggattctggcagtttaaggtatccaaagattcagacgtggcactaatctggatttagctaaactagataatttttatttggatcccgagtcctaacctcctttctggtccataccaacttttcactaaataagttttgttcttttcctactttgttcttaggaataggttagtttgaaacctcatttttctactttgtactagataatttgaagcaccaccgagtatttgcaggaactcttctatttacatcttgttttatttgggactattcagcaaattacaaggcagtgcagtcactttcactcacaacactaaattatgagagaagttccatcctgctgcagtacttcatggacaatggtgaaggtgagtacactattttccttttcatggtatcatgaaattcatgctcttgcgatcactattgcatgcgaaaaaagctaatgagccctggaaagtgttagtagcttgaagaggatgtaaatatattttactgtaatagtgtttgtatatcatcagcggcttaatgctatgtgctttgtgcccattattttcttctatatcaataaaagcccaagcttggtcagcttgtggttagcaggccattactagatgcacctaacatattgtaacaaatttcaagtataatgtgtactgcactctgaaaacgtcctgcttctctattttatcatgaattcatgtgttgatgttgaactattcacggcatatgaaatcatttccttaacaatagcttttgctgcttcatctgtgtgaataaaaattccatggcaagccattacattatttaatcatcaaaatttcttgggtggaattttcctagtcctcacaccacaacaggtttccaagcaagagcatattcttccatattggtcaagctggcggaaatttcttagaattaaactgccacatgagcatgtacatttaggtgctaaagcctcaaggcttacacaccctgatttgtaagtactaagttttgagttatgcttttatgtgtttatcactctatgggggaagaaacatttactctgtttgtcaaatttgataggctgcagattgcaaaaacaaggccctactatagaaatggtataactcgtctcttggttaatgtaacactaaactaactgttgctgacttttcttttacttcacaaatctattcagagaactatttcttgctggataaggaagccagtgttcacattttcatccacaagcaggcagcggcaacagatattttgatgtccttcatacatggactcgtgttagcacatttgatgcagaagagcaaatctgggcatgcggaggctcgccaatggattgatgagaaatataacacttttatctcaaaggtaaagccctataccatagaatatagatgttcatgttgcgtttgacttgctacgacattaactgatgttagtttatcctttaactgatgttagtttatcctctcagcgtttcttaatttgtattcacatacaattggtggtaattcatgcaaggccaaaatctttaaagaaccatctctctgagctctgagcttatattcgtagaatgaacacacagttgtaaatgccttcttctatatcattaatggtagggttgtggagatgtactatactccctgactgtctgttacagctaatgaaaaatgaggattccacgcatttgcctgttgtatatgacaccaaactgcggtgggagaagtcagatccataaagttaaggaatgctctattttgggtatgtcaaaaaccaaaagctgagtcatcgtaacactggttttcgccttagcatggctaccccaaaatggcgtatatccccatcgcagatagcagtatagcaccatcttatgcacgtgtgctggagtacattcaggtctcttagtagcctggtccttgtactttgtcaaagggtggatttaggtctggtaacattttatgatataaatgtgaatttcaacgtttttgcagttgtcttctactgatgatgattaattttctcccctttgcgcagttgcaagttgaaggttactcaacagagcgacttctttcacactcgatcgggtggagggcacattgggttcatggtccctctgaagagaagctcgagtaggaggaagcaggcgaaggtagcactatctgttcaacgcgatattattagagcaattcgacatactgcataggatgctttgcatatctcgtttgtttccgttccgaattgccacttttcaccatggagttgcactgcatcttgtaatcgcatgggatatactttaaaagctatacttgataataatactattaaatgatatagcaaatgggttcgttgatatttgggggtaccaggttactcgttagctacacctcgcaagaaacccaaagctgcgcacttttggtaacaagtgttgcttaaaacgaaaaggtgccgcttcctgttgcttaaaacaaatgatatggagcgccacaaatcaccccgttggaact

SEQ ID NO: 34381 - DNA, 6568 bp, Oryza sativa
  unsure (1)..(6568): unsure at all n locations
catgtcnattgttaactcatacnnctgccgcagcccgcggtcgactctagaggatccccaaacaatcataaaactacagatttaagacgtatcacaaaactacagatttaacaccatatttatcacaaaactatagatttaaggttaagtatcacaaaactgcatatttaatatttaagttatcacaaacaataacttttagagtttaaatccctagcaccactattatgctggagctataaacattattgttttatgactaaattggttctaaacctatagttttgtgataatttagttactaaaaacatgtagttttatgacacttcatcttaaatgtgtagttttacgataaacttggtgttaaatgtttagttttgtgatgcaccgagttaaatatgtagttttgtgatagattggtcatagtatttgtagttttgtgaaatttagaaaaaaaagatgaatacttgtaggcttgggtgaagcatttgtgttcgcattagaagccgccgaagagctcagaatatcagaaagaagcctggtctttggaaacaaacgctcctctgagctttcgtcccgttctgttactacctgcactagtacagctgctaatatcagctaaacaatgaatatatcattcaaatggaatgcaagtcaatacatcgtgcaaggcacaaagacagaagataattggaaactataaaaatgcattgtgaagtaggaacacaaatatatggctaaaattcagcctctgacttcacatttacttaaatagcataaactcgtcttcacatttactgaagataactttttttttactcgcagaattttttttaagaagcaaaacatggctatgattgaagccacaaggagcaaacaacaaaataatacctaaattttggcatttcaacaaaagataccctgcttcattgaaagtctgaaacaactattagaagagatgtaaaggatttttgaagggtttcaatccatgaaaccgcaagtaaactatcatcaggcaaatcaagaaccaaaagcctcagaaacatttctcatcatgttttgaacaaaaatcagggagtatttttttccatactagcagcagcttactggaatgtgattccatgagcaaaacattggtgtgaaataatgcacaagcggagcagtacatatgcacacatgcacttaaaataattctgaggttctgccattaaagtattgggaacacattgaacataacacaacacggcttactagaacatgggacaaattggcaatggttggtaaaggacaataaaatctcgtttaaggaaaaggaaattaaagataatttagaaagcatgggattattaaaataattaggatgggaaccatgttgtacctcatcctgcttacttttaatttcatcttcttttccagttgatgccttctctgtggccatacagattgcaggcaacccaggctcttgtttcactgcaagcagtttaataaatccaggaatggcttctgtttgtgcaacccttggaacattcagagtgaacttaatgaggggtttcttttcagaaacaacagtttcagatccagcagtagatactatgggtagacgatgggctttagtaaatcccggaggaacatcaagagaaaatcctagaggggtgtcccaagaaaggctgtgactgtgagaagggtttatgtgagactcagtagtttctcctgtatgagggagataatgagctttcataaagccaggagggatatcaagagaaagccctggaggtacgcccaaattaaggcttggagatgagtctatgtaaggctcagtggtttctcctgtatggaggagacaatgggcttttgtgaggcctggagggtcatcatgaggaaacccgggaggtgtgtccaaaacaaggtcagaaccagcatggaactctatgagcagattgacaagtaaaatctgtaactagaggaagtataataagcaaatcatggatgaacaaaaaacaaatcagttgaataacaagatgtgccggcccatacaaaaaagcaattgtacctgaagagcttgccgcagcatttggatcaggagtcagcattctcatgcattcgttgatcctatctctttctctgctaactgccgaatccaatttattaccaatctccccacatttttccttctctgtttttttgtcttgtgtctccaaaatcttgccagtttccttatttttgtgcctctcaatctctttgcatcctgttgcatcaaatgacatacttgtttgattataggatctgtgcagcgcccggaaaacaccccaaaagtaaaacttatcacattttcctgttaaattggtaattatacagaaaaggttagatgataaatttgtacatgcataccactttttaaaacatttaacagggactgtacagctatgctcatgcaaactccatgtgatttcatctggttgcaagagaaactactgcgacgaatcaaaaacaggtatcacaaaaaaaaatcaaattaaaaaaatattcatacaaataagattaccaaatagtaactttgagatatgcatgcatcacagcatcagtttgtttaagcatacaagtgtaacaagtccaagcattgtcagttatggggggatacatgacatggtttataatggaaatgggacataaaaaggatcatggaacatactttgatattcttgggtaagtaacttggatgaaaatatcagcaactcagtagcaccaatcttggttcgtaacccaatatgcgaagaaatatttttcaggagatggtcagaactcccatttggtctgcaaagaaaaagagagaaaacacataaatgcagataagcttcatgcacacagctgcattctgtagttgacaaaaagagattaaactccaaaagcactcgcatttatttttcagagataaattgttgaattggttttcaattgccggtaactgaaacgaatactccctccatcccaaaatatagcaaattttccacttacattctcctctcaaccaatcaaaaccttccacatttaatttctccacctacctccttttctcaacaaatcataacattcacccatttcattccacctacttccttaatacccgtgttcaaccccaaaacttcttatattttgggatggaggtagtacttgttaggatatgacagatgatgtggctgaacgcaccaaaaatcattggtgatacttctgaggttaatttctatcatgccactaaacatctgagaacttcctcattttataaataatgagttgggtccataccagcaggcccacatgccattgagacaagtgagaggaacaaaaggaaagtaagtagaagcattgatttgaggggttgtacctttgaagagagctaatgaagcacagtccaatatcttgtccttctggaggtttcatcttgaatgttttcggccacagatgagaaagaggtctagcctctagctttaatatttcaggcatttgttttgaagcctcatatacttgggcagaaatttcgaaagggaaatgggcttcaagtccatcacaaatatgtgttagctctccagtcacttcaaatttacccctaaagaacatggaaacagagcctcaatgtttaactgaaaatcaaacacacgtatactaaaatagcaaagtctcacagattttccattataacttaacttcagcattggataaaagttcaacacttccaaattgcataataattccaaaaacagaagcagcatcacttatcatacatgtgaaaattgttctgagatactatatagcttaccacattatcactggcacaaaaaagctcaagataattctgcagatactctgctaatcaactatatttgctgattagcttcatccataccagacaagattcaaggcttataatgcaagtgaaaaaaaaacaatgctcttttttagacaagaatgccaatttcatccattagtacatcaaatttgaggacaacttttgataactttgagtttgtaattgatcccaaaacaattttttatacaacacagtagctacagcttatccggtcagataaatatagggcatgtaactggtaaaatacagtgtgataaaaataaattctattgataattcaaaaatactctaatgcatgaagtaaattacttacttccagcaggcttctggttggtaatgcttcttgtgcagctttgtatgtaaaattactgggatacctgtttgcaccaataccaatgttactacagcagtgttctcaaaataagtttttcatcaataaatctccacaaggtaaaatggcatgcccatggctaaaacttagtaccgctgctttcacttttttcaccttttcaattttcaataagcataataattgaagggctaaatgcagggatgtctggatgctacagtactattaatgtcagctattttaaatatgtagatgaaagaatagaagagattactgtcaggatccacactgtacctgaagatacattacaattgattggtgcctcctggttcatttgtttttctgtaattatatggctcttagtagatggaactgcttcaaaatcatcaggcggttcaacacatcgtgcatgagatgtagactgtggactttgtgatggaggaatgattgtttcactttgcggtgagcccaccttgcattttgtatcaaataaatttggtctggaagaaggccttggagcagtatcaggatatgcctcgttggacttttcactaagcacagattttgggctcggtaatgcaggctccatggttagctttttttgcactgaaggcgccacagcagttcttgtgccttgacattgtaacgtgcccaacttacagctcataggggatgacttctcattgccaggcgcacaaaaactttcagcagaaggttctgcatttgtaccaggaggaactacagttgaatgtgcatgcgcagatgagaaggttctggtgcgtgaactgcaacttttgacatatgcttctctattacccgatctgctaagattcttgggagcagtggcatcagtaccaagaggtgtcccagaaggctgtgaaagaacagccctgcagaatggtgatggacgctgtgaaagataagctatttgtgttgtaaaggaatttgtgatatagcccccaacaagtgagtgaccatttccagctgtctcaggccacataggagagataggtgaggtagcaagtgagtgaatctttttaactgccccaggccagttaggagagataggtgaggtagcaagtgagtgaatctttttaactgccccaggacagttaggagagatacctgaggtagcaagtgagtgaccattttcagctttcccggtcaagtttggagagatacatgaggtaacgactgagtgaacatttttagctgtcccaggccggttaggagagatacgcgaggcagctggtgagactggtggtgtaggcctctgattaaccactgtaggtgtcacaagagacactttacgtgaactcggagggggggtgacacttcgtctgcgttgccttttctgtaatccatctgagccaacagttttaccacatagttttccatgacgtacatatgtaatttcttctgcaggaattatctttactcttgcatcaggttttgaatatgtaccaccagaagatttgtgcatcccatacttatttgaagagtttggctttgcaaatccctttgcctcaagcattgcatcattcgtatgatggatttcatgctttctgagatggcccaaaacagcaaaaaaatactactattaattataaaaccaataggactagaattaacacataaatattgcagaatctgtcatgtataaaaatgtgcacgacatttgaatacaatccaggtaacagaggattttatagtctgtcaagagcttgcacaagccaaaaaaatgtatgcatgcctcacataatgctgtaataacaaatatccacttttatgagaaataggatgccatacaaaataaggaagccagtagtctagtatatacacatgaatactcaatggtcaacagatatagatttttttttaaaaaaaaaaaaagcttcagccaatacaccttatcttatcgaaagtattatgctcagaatgacatcatctcattctaattttgcaacactgacttgatatcagatgtgaaatattttttttttgtgtgtagaaaatttacatgtatcaagttattaattggattatataaacttatatgcaactcaattaaattcaaatttacagcttctttctattgcccgattcctttgggtcattatgatccatatttgtgcatgtgcaagaaaaaataatactaaggggtctagtgaaagcctaataaataggtgcaatcacataaaacctcacatagccaataattacccgttggatgaaagatgaatgaatggctaccccggaccaggcggaagcagtgatattctaataattaaccatctatgaattgagtggctattaagaattttaccaccacatgaccctaaatccttgaaaattgt

SEQ ID NO: 34382 - DNA, 3509 bp, Oryza sativa
ttttataaaacatatgttggttaacatgtaaagtctgcatgatttcatctagctattggttgcactagatatgtcccctttaccaatatttaattatttattatacgcattggtgggttaggaatatgggttaagtttctcaatctatggacatttatgcatgttaaacagacaagctaccttggtattacgagtagtttggacactttcagtaaattgttgaaaagttttttggcaccaaaaagagaacagaccacattacagtttgaagaaaacaattcagcattatccttgtggacataaatgcaaattacaatgataaatggcaagcttctaaaaaattctttaggtaaaatgcacatgacaaaggtgtaaaaacaagcctatctttgtttaatataactaaataagcacaaatgacaaacaaagggacctacgcatgctctggagatttcttgcactgacaacgtattacatttcctgaatcaattttatcaccacaagttgcacaagctctatcctgcagtagttgaacaaaacaaaacaaaacaaagttacacatttaggtgtctctgtatggaaataaaaacaataatctggtaaaggcataatttattttaatttcattaggcagaaccagaatttaaagaacaattgaacaaacggtaagaaaataagaaaaaggaaaaaaatgggctaaaggcccaatgacacactatagagtatagattacccaggaatgaactggtttaaacaaacgctcccaccaaacactcacaccttgcctttgatcttatgaagtagggcttgttgggcctgtctcaacatgttggaagacccctactaccagattccccatgtaacaagattacaagaaaggcataatgagggtggactcttgactctagaaatcctaatccaagtgtgaaagttgattggaaggctgttatatatatgcatgcatatatatgcccgtcacaaagattaggccgacaagatgaaactaaggtgctatgcaggaaaccaacaaacacgtcctaagagcatgtccacacaaatgtaaaaaagaatcacccatagagatgtcgtgtgtactcaatgtggtaaacgctatcgcactggtagtttcatactttcatggcatgtttgaaaaagaaatggcccacataagtacccgtatattagatcaaacgaggtcagacattgtgaagcaccgggtgctaggtagtatactagctagtgcagaacaactgaacaagcacaagtgctactgctactactaccagctttacaaattaaactgggtgacattgcgcaacgattagaacagagcaatccccgcaaagtaagagaatagatagcctcataacaacaaaaagtaaaacacacatacaagggttccgcaaaatctatggaaccaaacagtaattagacccaaagctctgcaaagcggaatgcacgccctaccccaaaaacccctcttttctttctcacgcgacaaaatcggaccaaaatacccaaaagggggcgaactaggcgattgctactaacgcttatcgagagcaaagcagcacatacgcaaaacgcacacgcaaccaactattccaccccgcaaaacatcgcctgtagaaaaccttaataaagcaaccgcgatcgccagaaatgttgggggtaaaaaaaaaaactaaaaaagcagagtccgcccgatgatcaccttcatccgcgcaaccctccgtggcgcgtcgcggaggtcagcggcggcggcagcatccgccgccgcgaacggcggcggcggccgagcgggcccggggctagggtttcgcgcgcgcccacccaatggccgcgccgcgtgcgccattggatccctcggcgatcgccgcagagagaattgatgaaagtgggttttgtgcttcttgttcggtgcgtctctttgatatgaagagagagagggaaaaaggaaggagaagccgagaagggccttctcctccgggcccacctcgcagcttctgtttcgggaaatacacagtccacgcgacggggtcttccgacttccgagcctactggcgggtgggtcccaccgcgtgtgggaccgggatgtcattgtgtcgttgccccggcgcgtaaacgatgggcgcgtgtggttgtgtggaaggtaaggggccccacgttcccagttcgagcggtgggccccacatcaggcgtggtctggccggaccagttttggcaggggggaggagcgcatcggcccgtttatgatggacgatccgacggctggagattaatcttgggtggagacgcatcagaaggttacagaagcccgaaggcatcacctctgttgctcacggatttgaccgctgggctccacgcgaggaggtgcgttttgtctatatcgcacggtgaggatttttcatgcgttaggcccctttttctctcagagaagttggatgaaaatctggatatccgttgcatgttttttaaactgttaaatactattgacggagcgtggggctcctcaccgggagaccgcgcaggcccccctttgccggttcggccggggactcagggtgagattctaagctctctgtatgtggaaggttcgcgagaccggaaacacacaagactcgggcgatgtatacaggttcgggccgctgagaagcgtaataccctactcctgtgttgttgtgagatctgtgtaggaatgagctacaaagtatgagccagcctctcccttgttctgggttcccaatctcgaaaagtccagtctcccctctaagtgggcaaggtcctccttttatatcttaaggggataccacatgcaccatttctctcttttttgtggggacttaccccaccttttcataaatggacggagatttgtatagttgccgtccgagtcaccttctgatgagacggcccacaactacctccactttcgccgggagcagatgcgacgtggaatcgtggttgtccgctgacgacatgaccggtgtcagaccagtcacgtcggtcattcttgtccaccacgtgtcagcttagcaatctacatgttcgcccttcttcacacaacatcttgcctgtaatggttaggatgaagcctggcatatatctgaccatgactatcgtgccatctctgggaggtaacacgctagctccagctggggacgagcgcctagaagccctcgtcctgacgggatggggcgaggcgtgcgtcagatcgcctgtcgccacctaacccgcgatctgaccggtctgtgactggtcacagaccggataaataagtgcactgcactgcgttatatgcggcgtgacacgctcagccaaatcgcaataaatgtggttaggtgaggcctattgggctaacctaaccaatcccttggagcaaagacccaagaaggggtggggcgcctttgggctttgggtccaaggcgtgtgtcggccctaccctctttggggttgccaggccactcttcgcaattgtttcttccttaaaccttctactattatactct

SEQ ID NO: 34383 - DNA, 7717 bp, Oryza sativa
  unsure (1)..(7717): unsure at all n locations
ccggccaagggggggtggcccacccccctcgggggtgccagaccaagtgttttattttttctccccccccctctagtcatgatactcctgatcccatgtcaccgacaactatctagcaatatccatattcatatagatgttaatgaatctaggtatatatatatatatatatatatatatatatatatatatatatatatatacatatatgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtctagataagctaacatataagaaaggggcaatactagaaagtcttatataattaaccggatgaagtagtatatttcatgtgaaaactttctatatgaaagttgttgtaaaatataagataaatctgtttttaagtttataataattaaaactcaactaaacatacgttaatcccatatcattttacataaaacacttaatcttcatctttacccacatcgttttgtgttaaacacttatttttcatgaagaacaccacctagtattgcatatggatgggccgagatcttggttattgatgtttacggaccgagattattagattaaggcccattgaaacatatcctacgaagttcttttaacaccctctcctgaagaatacgtccatgtttccgcatgttgtcggcgaaaccagaaaatggcatccaatccatcaatcatcaattatgtacaagttctatgatctatcagcaaattcaaccatagcatattaacatggcttgaacacagctcatgccgatggaagtgtataatcacaaagaacgaacacaggcaggagtaatgaacaatgaaactgtaataaatacaccataactccacaagtgtggaaggttcactattgcagtgtcagtttctccatttgctcggcgtcaatcattcaagatttgcaaggatttgatgaccaacttgagtaaaacagcccaactacaaaagggcacagccagcaatgcatttaacttgagtaaaacaaatatcagaaacagtaattctctgtagtctgtaccctgcatttgctcagtcatagctgctctcgatttcttatgcactataaatatgaaacaatgtcagatttaggtgcacaagatagcagaaacacaagtaccaagctgagtgaaatggcaagtggagaggaaggaaacacaagagttctccaatgcagtgaacttatatatatcaccaaagatgtttgatggcattcggcaagtttccatgattcatcattgaataacccgagtaaacctgcttgtccaggcaactacaacttttgaacaccacagtggtaaaaaccagatatactaaccacctcactaaattagttaaacagtgccttcggttgggatttgacaagttgagccctccaaagcaaaggtaaactgggaaggagatagtgacctgacctccagagttcagttcaatagtttaaaaacaactgatagcaaggtccatctgctagaagaggcctcgctggcgagcaagcgcgatcaggtccataggaatggcaggagtgctatcccttgtgggaatcatgagaactgccttgtacagaggatcaccatccttgttctccacttcagaggtggtgcgatctgggcttggggttggggtcctgatcttggcaccccacctcacctttcttgtgcaaaccctaggcctgcgccgctgcttgacaatatcgctcatctcatcgtctcggttgtcctctgaggagctgcatccaggggtggtgcgcgacacggctgctggtgatggcaatggtgctggtgctggggactgggactgggtgaaggggagggtgcacatggtgatggcgtcctcttgagttgtgggaggtgtgctgaagacctcaccatcatcaccaccattgaggaatgaggagtgggcaaggagttcttcctgggaagcggagatgtcgccacactccaacaccactgagtccatagctgatttgataaaacccaaattgcaacactatcactatcaaatttcctttaacttcctttaactcaaaacaccctgaaattgccagataacttctccctccctgaaatgaatgcagatgcaaaaagatcagtactaacaaatttttatttgcaattaggattaaccatttgtcaaagaacaactactgattaacaccccaaaccgagcacaatatcttcattgacccaaatggaatgcagacaaaagtagtaaaatgggtactactgcattaatttaacagagctattgcccagggtttagatatgatattctcactaatcacatgtatggaatatcttccagtcctacatgaacactgacatgaagctcgtacttcatcggtttcataatgtaagtcattctagcattttccacatttcattaacatcaatatgaatgtggaaaatgctagaatgacttacattgtgatacggagggaatagtaagttaacatcaagaaataaacataacagagaagccagtcaaaactcaattaaattttctactttagcactaaacaaagaagccctggaattgactattatacctcaacaaataaccaagatcacatatccctgggcatgagacaggggcgaatccaacttgggacatgggggttcagttgaacccccaaacttttggggggaacaaacaataaactgttgttacttgtattaaggtaagggtctgaaattaagagaagagcttcttccagatctagaagagaagctagggttaacgaacgcaggcaaattccagacaaaagtagtcccggtgggagagagagatgagttctgagaaagaggatatgtggatgctcacctgcaggatcccctcctctcccctgctctgctcgccgcctcccctgttcagccgcgagatggcgcaaggagcggaggagccgagacgggagattttctttcagctttgctattttgcagttgcctgaaaaattgcaatccgtcaccgtcagccgatttgtgggccattagatttctgtcaagattcgtgcgctattgggcttggttgtggatgcgcgttttgtaatgggctgcatccctttggcccgctaaccatttgttttttttttttccctcaccaacagctagagccagacctacaccgagcaagccggtgatttgggtcgctgggcagccatgcgagcgaggccctgtgtagattccggcgaaaatttttttaccatgttacatcgaacgtttaaatgtctgcataaaatattaaatataggctaaaaaataactaattatacagattgtaactaatttatgagatgaatattttaaacctaattgctccatgatttgacaatatggtgctacagtaaatatttgctaatgacggattaattaggcttaataaatttgtctcgtggtttactgacggattctgttattagtattttttgttagtgcccaaacactccatgtgacaccccatataatattcaatatgacatgcaaaaaactttacacctttggatttaaacaccccctggactagcagcggtggtgccagcgaactagcagcggcggtcgagactttgtttttcttagcgtcttctcaggtacaaatcgatgaatcgatctcttttgtttatgtggatctgatagaagttcaaatcgttcctcctctccgcgctttgtatgcgggaccgcaccctctagttaccaacatgtctcttctcctctcccattgtcatgcacactactgttatggttgtcgtttagatcggatgtgtcgggcctgcagtgactcaagaaggcaggagccgacccaacgaagagcggagacgctagatctgagctccttgctggatcctcaattgtcggagggaaaatagaaatagagagagagacttagtgtgtggagtggttactgagtaatcggacttgtagatggatagaatagggtggtccaaaataaaatgtaaataatggttaaatagtgacataatatgaaaacttttaataatacatagtataaactatatttttttttctctaacaccgttaaagatgagacgtccattacccgatagtgtcgtcaaactccattataccataagcccatgtaaggcttatttggaaattagcaaattagaaatttccagttcacatgtgcttcgagttttttttttaaggaatataaactatttgccactcttataggtggtaattaaggatttatcattgagctcatgtgtcattgatacatgaaggcccatatgtcgtaaaatgtgagaggtaaaagtggcaaaaagtaaaatgccccctcgtgtgtgttttaggccatgtttttttctcccacaaaagttggatggaaatttagatattcgtgaaacgtttttcaatctgctaaacggtgtgtttcatgtgaaaactttttatatgaaatttgccctaaaatattacataaatatatttcaagtctgtaatatgttagtactacctcgttgttatatttgatctcatgagtttcaaagcctatctaaaggtctgtttcgggagcttaagattctgaaaagcagctggttggtaaacatcttccgagagagaatatggaaaagttgggtttcacagcttctcagaatctggaccaaaagctgaactgttagaggaaacttctgattctgagagaagctgtagtagctagaagctccccaaacatgccctaagggcctgtttaattggaaaaaaaatttgcccctgcatatcatatcagatatatgtggacataaatttgaagtattaaacgtagtctaataacaaaatatattactgattccgccatgaaactgcatgacgaatttattaagcctaattaatccgtcattaacaaatatctatcgtctcgtaattttctgacaaactgcgtaatttttttttctccctttaaatactccagccttaaattttttttttagaactaaacattccctaagtaataaggggaaaacaacccgctcgcgatagtccggtgtccggacgagaccgatccaaaacaccagtagaccaccagtagtagtccaccatcccgccggcgcgaccgccttcggcgctttcgtagggggcaagctgcttgcgcgcggcagaggcctctcctctcctcccttttaagggccttggcgtcgcggcgcgatccaaaccgccactatcccccaatcacaccgacaacccgatcgccgtatcgccgccctcgccgttccgctccgcctcccgcaccgaaaccctcgccggcggcggcagccgctacgccgagatgctcgcgccgctcccgcgcctgacgagcgcgctccgcggccactacgacgccgaccaggcctacctcctccgcaagtccgcgctccaatccctcaagctcccgaggtttatccctctctctctctccccttgccgtccccaaaatcccaatcgccgcggggagaacctaacgatttcgcctccgcaggccgcgcgacgagtgggagctcgcacggaagatcgtccccgactgggacgatggtaaacgcctccaaaaccctcgactatcgtgttgctgcgtctgctgcgcgcgagcgcttctgattttttccttttttgatacaataactggttgcgattgcccccttgtgttgcagcgcccagtgatgtgcgccaggcgtacaagcagttcctcggtgccgtggtggagttgttgaatggggaggtcgtgtctgaagagcttcaggaagttgcccctgctgtgtacgccttgtttgctggcgatgatacgcagtctaatctcgctgacaatgtccttcgcagaaggtaatgacacaattgttatggttcgaatttgtatgttcaattgatgatttcatgtaaatgctttggatatcccagtacttaagatgtgcctatctcctcaggaatgaattggagaaccttgtgggttacagtgtgcaagactctgttttaaagaagctagctcagttagctcagatgctctgttctctccaacgggcaaggggccatgaacttgttcagataaatgcagatgaaagtattacaagtgaatttggagcaaactttgatttcaaaccaccttctcgtttcattgttgatgtttcccttgatgatgacctacccttaggaagtggtgtattgagctctaaacctgctgaacatgatcaatacgatgccagcagcgcatccgtaagtcataattcagtttctcctgggggttatgtaaatttgaggtggctaaaggatcagtgtgatttgataactagaagtggtggctcagttctctcaggagatgaacttgcaaaggctttgtgcagagtgctcctatctaataaagctggcgatgaggtttgcaatgctgtggagtaaactgcttttagtctttccttttgttgctataataatctaatagcaccacttcgcagatagctggtgaactgttggatcttgttggtgatgctgcttttgaaacagttcaggatctcctttcggtaagagcggaaggccattttattttccatgtacagtttattttgcatgttgttcttcatacatgatacatggataagataaccaaaagaaagattatgagatgacctcaattgttataacttgtattgatatcagctagatgttagtatttctgtatatgccacttagtcctgtattctgcaacctatctaggaagtagggcatatgtaccagactaattccaggactcactttactggtacaaatcacacaataagatcactaaaacctcctagttggccatatatatccaaagtctatggtgtagccaacattcagaactgtcttggctctgtttaagttcaaattttgactgcttgtctttttgcggaaaatttataaatacttgagcatatattatattactgaagtgtgtagcgccataaatataatcatacaactttcatccatcataaatataatcatttaaaattaatctgtcataaaagtgatatggccgtagtcaacaatgtcagttatgtgagaaacggagggaatagtgaacacttagtacaacaagaagattatccatgtcccaaatagtaagtcgagtgctagaggactaccttaagccttattggtgctgttttattgtggctacctagcgataccatgaaaaggagccacacagtaaatgaactgttcttatgaggatatgcacacatgagaaatatcgaaacaaaagggggtggacttcagtgaattttggactctgggacatacaaatgtaatgctggatttctaatactatgtgcgtgtcaaaaagtactttatcaggatctgatgctttattgatcattaggaaatatgatagtgatcggtgagtggtcactggtgcaattatttcctatgggctcaccctgatttctcagcacatttccatatttagagttaaatatctcgtttcaagattgcaaagttccttatttatggttcagttcattaatacatagtggatttcatttgtttatcatgataatattttttttttatttttggtctgccatatgataatgtaatcaaacatgatcatgtcatgccctgcagcataggaaagagctagtggatgctctgcgggtgccagatcgtntctaanggccag

SEQ ID NO: 34384 - DNA, 1123 bp, Oryza sativa
  unsure (1)..(1123): unsure at all n locations
agaattttttaggttccaggacttttagggcgttttgttacatgttcattcgtgggtttaacacttaatttgtggaaaaccagaattccggcttttaagtaaagttaataccggttgccgcaaggggagagtcggggcgcaggatgtcaagtaagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctttgacagtttgggtagaaaaaaaatccaattgaactgcacacactgtatttagatgtttctatatcttgagaaatatcaattaaatatatattttatgttgcagctgagattccccacgaacctggcacactcgtgaatatgcaaagacttgtaagagttaatgttaatagaaatcatgatttggttcatcttaccaagttactagagacatgtatttttaagaagggttcttctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34385 - DNA, 1260 bp, Oryza sativa
  unsure (1)..(1260): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggtgcctattaatccattagatatcatatattaaacagactgagatatgaagggaagacctgtccgttgctctggatagtgccttctgggtttgggccttgttttaaaatttcctcaatcattgaagccgcacgatcaactgctttgatacgctcagcagtatcttttagctaaagttgggggaaaatattagcataccattatcttgctataaaaaggatcttttgtactacaggtattgtactatactaaaagcaatcactgaaacatgctgcaacataaatggcatggaccatgtagttttttgttgaaattacaacagcaataatgatggatgatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34386 - DNA, 736 bp, Oryza sativa
  unsure (1)..(736): unsure at all n locations
nctatggnccaggnatgcanngcaaaaccncacnnnnannntannagatccccacctaaattaaagcaattcaacgtanaaacacaattttcacaaaaactagtgataatttttaacaactaaagacaanctaaaccggtaaaattttttaaattacctcatgtttctcaaattttggggtgctcaatgaatttatgccaaaaaacaaaatcagattcttcaaatttgcgcttcttttgcctcctttgcattatactggaaaggactgaaacttccatctttttcgatgaaatgtaatgcccaggcttaacagattggccagaatcgattcttttctcagcaaaattattgtccatgttccaaaaaagtttttggacattatatggcggaacaagtgtcttctgcaaattgaacatggaaagattctgaccatttctgtggtttccatatcgctcaaaccaaaaaagtgccatttgaaggtttatcctgggcctctcacttctttcaattaaatctgatgatgcattttctggctgaacttgagtttgctgctcaatttgtgctgcaactgccatacccttaaagggaggttctctttaaaggaatttagaaagtatgcttggacctctatcttcattgttcctttgaacaaagcttaccatctttatttcaacaaggaatggccctgtgacattttcatttccaattttatctacagaccatcttacccaattat

SEQ ID NO: 34387 - DNA, 725 bp, Oryza sativa
  unsure (1)..(725): unsure at all n locations
caccttaccaggttcagtgcatgnncccnncnnnnnnnnnannntanagatcccctatatttatgtcatgcattaatgtgtttaccaccaaatcattcangaaaatgctcgtttacattcacatncattttccattgttgtgtaaattatactatttatcattcaaacttcttcacactaatgaataaagcaaaatgagcacctacaaaaatttcttttaatgtacccatctttgaacctcatccaccacattactacataccgtccatattacattcctttttaagaacagagtcactgtttactgtttcttttcataaccttacctttccacaggtgaattcaaccatttcttacttcacttctataactttttccttttgacttatcatatacttaaaatttcaagttttctttacatacacaaataacacacacttaacttttttaccttaaacctcttccatttaatgctcttggcaacaagacgtattaaaatctatacaaattttcccatttcaaacctatacaaacacaagttccatgaaaaacaaaatatcttcctttttaattgtcattttaacatttcattttataaacaaaactgaaattacctccaaaaccttctattttctccaaatcgaacacttattataaaagctcataaaatcaaaattcaaaaaaaactttttttaaaaaaaattcaaaaaaatcacccaaattcn

SEQ ID NO: 34388 - DNA, 2267 bp, Oryza sativa
  unsure (1)..(2267): unsure at all n locations
gtggtgantttataaatctattcgtgctgcctgcggtcgacttagaggatccccatcacaatctgcactgagaacaccttcagttgtcgcatgtttattgcaccgttaggacactctccagactttgtttggttaatccccgaggagaaaaggatttgaagagattgaggaggattatgtgtaaaataaatcatctcaagagaattggaatcttgtgaaagggattaatcgccacgcaagcgtctctcccacctgacagctgctacactgcaacaccacatcgaccacatttgccctagtcgatgaaactgggccccacccacgatcctggcccacatcccagtgggtcgggtaagaaacggcccaggtgcagaaagtagcaccaccattttagccacctcgggtgggcccgccttgcgagaaactagccgttaggatcgcccgctcgccgcaacgttctctttttttcccatctccttccgctcccccctcccacaatctccaattcttcatcgtagcaaaagaaaatccaccacctcactcatcacgcacgcgaggcccaaaccctagacatggcgacgtcgacggcgacggcgaggactccgaccaaggcggcggcggcggcggcgggggggagggcggccgggaacaccaccccgtccttcaagcccgcctcacgcgcgcggttcttgcacgccttcttggagaacgcgcaccccaacatcccggcggcggggcngcngcngccgcngcnggggagaccaggaccccgtccaagaaccccaccctggcgcggttctcgcacgcctcgtcggagaacgcgcacaccaacatcctggggtcccccccgccgtgaagcccggagaagttgccgaccaccgcgtccaagtgtgctaccgccnccgccgccgccaggaannagatctccacgccggcnccncnnccgccgccgcgggagaggcggttcctcgtggcgaagaaaagggcgcggcggaggcgcaacggcgccaatgaaggcggcggcggtggcggagaaggcgacttcgacttcgacaagtgcagggaggccgcccgcgaggccctgcgcacgtctcacgaggagttcttccgcaaggagcgcgccgcatcggccgcagcagcagaggagcagttgcaaaaggaggaggaggaggagaaggcggccgcgcaagaagccaagaaaggagcattggagacattggaggaggaagatgtagcggaactggaagggagcagcaaagtgagggcgctgaggaccaaagtgatgaccaaggcgttgagcagcgtccctgattctggcgctggtcgtgtcaagcaccttgtgcaggccttcgagagcatcctctccatctctggagccacctctgacgccgacagggccggtgaggggtcctgggcgctccccgggttacaggcatggaaggaagattgcgagggtaagatagggatgccgccggtgtcggtgtcctcttctgctgagttcttgaatgcaggaccgaacaggctctgttcttcacttgatgggaaaagcgacaggttggtcaatttgaacaagtgggggatatggattgtgttttggttgctgccaatgcaatagtttgatcaacaattctgtatcttttcaggttgagttgggacagccggacatcggcaggggggtgcaggagcaggcgaaatgtgaggacatacgatgaattttgtttccttttgggagttaattatgtttcatatttggcctctgatgtgaacgtatattattctttgattgtcagacatcggagtcgctaagaagcagttggaacaagaaactgaaggtcacaagccagcatccgttcaagctgagaaccgaggtaaacgatatgtttgatgcagtgtgaatcgttgttgtaaatctattgtgtcattaggccgtttaggataggagaagtgcacaaaagttttagggcccctttaaatcgcagggtagaaaaaatggaggaataggaaaaacacaggattctgacaggaattgaagtgtaaaacagaggattgcaaaatacaggaaaaacccaggaatgatcgtttgattggagcgtaggaaaaacgcaggaatcggatgagagagatagactcaaaggaaattttccaagaggttggagctcttgctaaatttcctccaaaatccacatgcaatgtgccattccataggaatttcataggaattggaaagcttcaatcctttaagggtacaagtggaaatcaatgcgcgc

SEQ ID NO: 34389 - DNA, 3623 bp, Oryza sativa
  unsure (1)..(3623): unsure at all n locations
ccccnncnnnnccgactgttatgtaatgctcatgctgcnnnnnnnnnnnnnnnnnnnnnnnnnnnnnnaaagcttcaatcctttgaatcaaagggccaaataaaattcccatttgaatcaaaggatttatgtaggaatttcataggattcaaatgctataggaaattttcctatttggccctttgattcaaaggattgaagctttccaattcctatgaaattcctatggaatggcacattgcatgtggattttggaggaaatttagcaagagctccaacctcttggaaaatttcctttgagtctatctctctcatccgattcctgcgtttttcctgcgctccaatcaaacgactattcctatgtttttcctgtgttttgcaatcctctgttttacacttcaaatcctgtcagaatcctgtgtttttcctattcctccgttttttctaccctgcgattcaaaggggccctatgggttaatttgatactacagtgacaacaacagcacaatcgacctatacctggcttcgtgtcaattttgaagtgtttattaagtccattaccagccagtgttactgttcttcaaactgaaatgcgccatcaagtgacaatgggtagaatggtagcataaaagtatactttttattatgaagcgtttcaatgagttggttgtatgtgtttataaggataaacatggcaacatacatctgatgcttatggaaagattattagatatctgaaatattcttagcccaagatttacagtacttgagtgaaatgtgtcgtgccatactattctttagtgtttctctttgacatgccaattgctagtaccatgttgatacatccaatgcaacaacatttggttcaatctctgatttactttgcttctcgttggattttgcaaatacaatttgctcagtgcattgctctgtattttctacagattatgattcttttgatgacaatctctagctgttccctcaaataaactagtgcatcaaaatcaatcactcctttttttcttttttgcaacagcaacggggaagggtgaaggaacaacagtttattcaaaaagtacaagaaatgcttatggaggaagagcagcaacgtatacatattgcacaaggacttccatggacaacagatgaacctgaggtatgtctagactagagcattcttgttttctcttcaaagcaaggctttcattaccagtttgttcaaaaagcaaagtgagttggcttaaaatttgttgtttgcgcttgtttgtcctggctgttctcattgcagctaggttagttaacatatcaaaatagtcaggattgagtatatttgcacagctttttacctatttttctttgaaatcagtatgatgaataattttacctattttctatggtatcctgactctgcgtttttattctgcagtgcttgataaagccaccagtcaaagaaaccaccgagcctgttgaccttgttctgcacagtgatgtacgagcaattgaacgtgcagaatttgatcaatatgtgagcatcgcaccacaaactcattatatgtcttgtgtattatatttaagtaaaccacaacgttacttattgcatatacttggtatgcttggttgagaatgcaggtgtcagaaaggaacaagttcgctgagcaactaaggctggagagggagcggcagcagaagctggaggaggaagagatgatcaagcagctcaggaaagagctggttcctaaagctcagccaatgccgtactttgatcggccgttcattccaaaaaggtgaatatccagtttataagtgaaacttagcctgccaaatttctttttgtagcactttcactctcgtctgttgcttggaaataatgattcagtattgtcatttctttctaaagaaatcaatgctgtatatttactttgcagtagcacaccagcattatcttaccatttgcacaagttactaatactcagttctatctctggtttgttctccaaaagatctgcaaaaccagcaacagttccaaaggaaccaaaatttcatcctcggccggaaaaacagtcatggtgagtttactttcaagggagctaagaaaatgtatttacttatgaagttcattgaatctaatccagaataaatatttctgcattcacaaattgaagcatgctcttaatgcttcttatatttcaatggtgtctgacagtttatgtcgacagcgatgcatggacaccggaatgctgatttcatcatgtcttcatgatcagtcgactgtacttgctgagaaatccaaggcattgccacgcatgttctagattctttgaactatctgaaccggaaacaaaatcacattaaatttttgtatcttcagttgtcccctccagttctttttatgtacatgccttatcagtagctctgtgcttcagatgcaaccacaccgaggttgagaagttgtacaaggaacataaaagtggaaattcaaacaagaatttctatgatatgctgcagtagtattcttgtactcaaaaccttcgttcttgccaaatcaaaaataccatcgtgttcatatatataccttgggtcttagctcattttgttctggacttcttgatgaaaatttttacggcgattttcactggactgaaaataattggctgtaaaaacagtaaactggaactgaccaactgagcatctccttgtgtgctaaaaaggagctcatgtatatgcttttcaagttttaaaatgatgtatgcccataatattcctattttgttccctctgctgaatgtttggtcactgtataagtttgtatgaattactccctccaatcataaacatttggcatgatttggtcaagtattggaactttgatatcaaatatttctcaaatgtttatttttttaaaaaaaaattgtgtgtattgccttgaaaaaataccaatacataccataaatctgttatattgtataacaaaattattcaatgtaaatttgttaggtaaagttttaaaaattgtctagatttatcctaatcaccaaatatatttttaggaagtacaaaataagattaagaactaaaaggatggagtatatttgatttctccaaacgaaatttatcagacgtcaaaagaacacatgagatctactacatagtactccctcattctcataaaaaaacaaatatattcatattcatattagtgacatatactaataatatgaatctaaatatgtttgttttttacaagaccaaaagagtacaacctagcattcgttttatgggctccattaggcccaaaaagagcccatgggctagaaacgaagtcaatcaatggcccagtgatcccgcggtccaagtccaaccgccttttctgactgacaggtgggacctccgcaagctaagcttcgcgcacccaagccctctcttcctcccacttggcaggcatcccaccctccagcctccacgcgacaacgccctctctctctctctctctctctctctctctatttctccccatctccccgatccacccgtctctctccaaaccctagccgagctagatctccannnnnnnnnnnnnnnnnnnnnnnnnnnnnnnnnnnnnnnnngttgtcatcaaatcacgc

SEQ ID NO: 34390 - DNA, 12071 bp, Oryza sativa
  unsure (1)..(12071): unsure at all n locations
cccgcaagggcgttcggccgcttcctctcggcccaagtgcgcggtcgctccgccccccgcgccgnncggcggggcccgggaatgcgcgcgaggcatccaccgcggtcgccgccgcggggcccggcgtcatcgcccccaacgcggccccggtccgccccccgatgatggtgtacgaccgcatcgccgaggccgtcaacgccaggctccgtcggctcgagcacccggacccccgcttcctccgttacgcgagcccagtccccgcccacgccgaccacaccgccatcctcgccgggccgaagacccgcgtcacgacgctccccaacgggctccgcgtcgccacggagtcttcgctcgcctcgcgcaccgccaccgttggcgtgtggatcgacgccgggagcaggtacgagacgaaggactcggccggggtcgcgcatttcgtcgagcacatgctgttcaagggcacgggtgaccgcaacgccgcgcagctcgaggaggagatcgagaacatcggcggccacctcaacgcatacacgtcgcgggagcagacgacctactatgccaaagtactcgacaaggatgtgccgcgtgcacttaatattcttgcggacattctgcagcactcaaagttggaagagtcccgcattgaacgtgagcgcgatgttattctgcgagagatggaagaggtttgcttccttatgcttagatgtgaacatcccttaattaatcatcttcattgtgatggtggctgatttatgttactagttgttggcgttctggtgtagattatatatgcattatatattacctttaggcccatgataaattagataagctgcattcaaatgcaaattcaacacgacagatgctggatggaaataacttcaccttatcctgttgtgttatgggtatttttatatgatgcgaaatcttctaaatcttccttttggattaagtacatttatgttagacatatagacatactaattttgaagcgttgcggttgttcacatgaattttttctatagattgtttcttttgctttatttatcctaattgtggaaaccaatatttatctaatcctttgattgactagctaaggcacactgtgtcataattcactagctaaggccttttttttttttctgtttgaggggcatcggcataacttctgactgttgctatcttatattaggttgagggacaatatgaggaagttatattcgatcatctccatgcaactgcattccagtacacttctcttggcagaccaatcttgggttctgcagaaaatgtcaagtcaattacccaagaggacctccagaagtatattgaaacacattatacggctcctagaatggtacatgataatgaatttattgaatttttttattcacagatttattgttttatagtacctctattgctgcagttggatggaccattttcactagtaaatatcatacgcttctatatgttttcaggttatcactgctgctggtgctgttaagcatgatgatattgtagagatggcaacaaaactgtttaatgacctaccaactgaccctacaacaacaagcatgttggtttctacccaaccagcctgctttactggttctgaggtgtgtttgacgcttacctgcactatctattgntaatatggcttgatctcagantatgctactcaaaaggtccgcatcattgatgatgacatgccccttgctcaatttgctgttgcctttaatggagcatcatggatagatcctgattctattgccttgatggtcatgcaatccatgcttggctcatggaacaagagtgctggaggagggaaacacatggggtatttttttctttctctagctcttggggttntatcagngtttctatatggaccaaaaatttgttttgtctactgactgatgatcatcctacataacttttacaggtcagagcttgtacaaagggtagcgatcaatgacattgctgagaatataatggcatttaatacaaattacaaggacactggcctctttggtgtcaacgctgttgctaaggtagtctttgcttgaatgtctatttatcaagcaaaagtttatattaagtgctcgaactggtcttttattcttatatgtttttcatagtgatgtatgtctgaagtgcaaatcattggtcatgcaatccttcctatccatggttaccataataataattgtccgaacccttcaaatgttatggttagagtaattgaacaaaaattcaggcctacagagctctgtataactgatctgtgaaagtgatgatggtgttcctgtaccaattcttgcttctgctttttcgtcgaatgaagtgttaaacttgattacttggcacagatatactcatgggttgcttagatgaagtggatgtttttgtgtgtatgtgtgtgtgtgtgtgtgtgtgtgtgtgtgtgtgtgttttgcattgtggggttattcttcccctactttggctagcaagtttgaaatatcttggcaaacttggtagtctagcgcaatatgcaaaattttcctctgtcggacatgagcatggtacatacacgatattgctcttcttttttcttgggtccacttgatttgtctgttcgattttatagcactttgttgatcgagggcttctcgaaatgcacagtagtattgtgataatattgttgctagtgttcacaccctccttttttatgatggttttgtatcacctattttgcagcctgactgcttggatgatttggcttttgcaatcatgcaagagattagcaaactgtcataccgggttactgaggaagatgttatccgtgcacgtaatcaggtatctctttgaattactactgatttgggccacaatatagtactatgcacttcagcttcacattctcattactttggtctgacttccagctgaaatcttccatccaactgcacctcgatggttccactgctgttgttgaggatattggccgtcaggtattaccaggttttagctatgtgatgtcacatcacattcttgattaatgccatccacactagcttatttttttcttttttctcagttactcatctatggtcgaagaattcctattcctgagctttttgcaagaatagatgcagttgacgcaagcacagtcaagcgagtggccaaccgtttcatttttgaccaggtaattgttattttgccagcatacagatatggcatgtagaatatttgattttctgtactactttaaatgatataatggtggtgtccaagtctgcctccaacgccgggccataaggtccccacacgaccacacgtgcttttgctttagatatggcattatatgcctaatcaactaactatgctgtaacctatatttttttgcttttgctatactactttaaatgatgctagtggtgctgtccgagtctatctccaatgccacaagctgacatgtggggccataaggtccccacacgaccacacgtgaatatgcttttgctttcgatatggcacttttatatgcctaactatgctataaactgtattttttttgcttttgcttttatctcttataatatcagttgcaatgcatggtcctttagctagtttttcatagtattaatatgctgaacctaccaaattttagtcacttgtatcatgtttttcatgaggcatgctttgttatggagctgccagtaatcctctctttcacactaatcactagtgataaacgcgtgttttctttccttaccatcctacagaatagtttactggttacttgtgtacatatagtttcaatgctatgcttttgctttgctgtgagcaacaaattctcattctgtgaacccaagatgcacagatttttaggagcaagtatttttggtggcttgggcaaatattgcgctttatgtgaagagcaatacaaacgttacatcatatgaacttaaattttgctcagtgggcaggaggccaatattcattgtcattatctctttttctcaggatatcgctattgctgcaatgggacccattcagggtcttccggactacaactggttcaggcgccggacctacatgctccgttactagactctccaaccgatgtactatgtttacattctgcaaaggcaagataattgcctcttttggcatcagtatattatggcctcgtccatgcacattgtgtgtgcgacgtggaggaaatttttttgagcaccattttccttgttttctttgtccaaaaccaacaaagctgtcaataatgataggcaaattcaactgacgtggcttacttgagttgccacccgttgtttctacgatgaatcgttacccctacttatccttttttttattgcaagattgctttctttttcttggaataatttgatgaagctgcttatgtaaagatgatagttttgctgtgtcgactattgacaactgcacgaggtgcgaattgtaccgatctgttaatctcttattgcctcttggagaaacttggctgttggttcgttgtgttgtagtatttgggaaggtatggcggtgaatggttcgaacgaggcggtaacagccatccatgtgtctccttgtgcggtgttcacgctccatcgccttttccggctgctctttttaagtcatggcgaaattgttgtgcgttacgtttccagtcacgctcgcacggccttggcgcttgagcagttggcatcatccgttcgccgggcgtcgcgacttggactgattctgtattaggttgtgtttagttccacgctgaaattagaaatttgactaaaattgaaagtgtgaagaaaaaagttacaagtttatgtgtgtaggaaagttttgatgtgatggaaaagttagaaatttgaagaaaatgtttggaactaaactcggccttagttgttcattggtttgtttacacacggtggatggcgatagagagtattgagatatactccctggcatttccaaggccaagacgacctaatatcccagtttatagtgaatctggaagagcggagtattatcttgtcttatctcattttttaagttaagatacagatcttatcttaatttttggtagcatattttctaaatagctaaacgatatattttatgcgaaaactttctatataaaagttaaattaaaatatcagataaatatattttttaaatttaaaataattaaaacctaattaattatatactaatagctttatcgtcctgtgtactcgtacttaaagatcctcgggccatggtgtccgccgctttaggacagctagttactttccgctctgcgcgcctgaaggcctgaaccaaggaggctcaggctgatcggatcggcaagaacggcaacaaaccgtctcgccgtccgctactccgatgtggatcttgacaggtcgtgggagtgcgcggcgcgcgctgctgtgccgccgggaggggaaggtggggtacaggccatgtttagttgtttaggtatgaaatttttttatgtatacggactcacatttaaagtattaaatgtagattaataagatttcgtttgtaaactacgagacgaatctcttaagcctaattaattcgtcattaataaatgtttattgtagtatcacattgtaaaataatggcgtaattagccttaaaagattcgtctcacaatttacatacaaactgtgtaattggtttttttttcacatttaatgttccatgcataaatgctccatgcatgtgtccaaacatttgatgtgatggaaaagttggaagtgggagtaaacacagcctttggctactggggtgcgctggtcacgcgtgtttctttttccccagcggcaaagctcctcaacaagaacagtaactcacaatttttgacttgagtttttgatacaagtcagttcaaacatgcaagaaccatgaacgctcagacttgcaaccatctcctccctgtcaaaatatacgaacagcaaaaataagaaagatgtttaactaatcacagccgttgaatagagatagatggataggattggagctaatgccaccctctgcattagccgaatccggacttccaatttgaagctgacaaggtgcagagtgcagtactaccccttttcactcgtgtgctaacagaccagacgattcagtgatacattctatcgtatcacaaacaaaacaaaaaccacaaaacatttccgagatatgcagggtatcgtatattcgtatatgtgcagaccaataaatctatcggatgtatggaaatggcgcccaaactattgtagcactacttctcagctggagttcaggtcttcaggagggccttgaaccactgcaccgagttcttggggtatctcttgaggttatccttgtagtccacgaagtagagcccgaatctcgaggagtatccggccgcccactcccagttgtccagcagagaccacgcgaagtacccacgtacgtcgcacccgtcctccctgcaacatcaccatccacggaggactaattaaggcttttattgtagaagaaaatatatatctacactttgaatgcatataaccaatatttgcaatgtgaaattagcaaagaatcgtagttgctgtagctttacttgatggaagcagccagattggtgaggtagtcattgtggtatttgatcctcttgctgtccttgagggcgtccttgatggaaatgaacgggttgttgctgtcatccatccctgaatcatcatcagctatacactgtcacaactctggtgtaatcttgggttcacgactgctagtttcatgcgcaaaaatatgggtaaagcaaggattcatgctcttaccgttttcagtgatgtacactggtgggctgttgtacctttccttgacatagttcatcaggctcctcatccctcggggcacaatgtacagccatatcgaatttgcctgcgaaacaacagcacacctcgtttcaaattcagtgtgacattgcaaaattcgcaatggtcatccggagtccacaagattaattctggtgccaaactcaccctatctccaattggcttcccattcttgaatgctgcaaaagcgcaaaccatcaccaagaaaaagaagaaatcagcatccataccattaccagaattatgggtgaggattctctaccataatattattatcattatagtcactggtatgtgggtcacacctttctatcgtagggttagtgtttacttcctccgtttcagaatgtaaatcattctaacatttcccacattcatattaaacatcattatgaatgtgagaaatgttagaatgacttacactgtgaaacagagggagtacaatgatagtgtcactaggtagaggatatgaaccctggaatcacactaaaaaccaagcacgaaaatggcgaaggagaactcacggaggctgacggtgccggtgtctgccaaggtgttgttgagcaatgtcccgatgatgttggtgttgttgtgcctcgtgtagtaggtggtgtagtggtttatgccgacgaaatccagcgcccccttgacgacggcggcctcatccgccgtgaacctcggcagcctctcccccaccctcgccctcatcgtcgccgggtagtcgccgaagaagaacggatcagcaaaccttccattgcaaacaatgcagccggtcaatcatactgtaacatgtgtgatatgttttccttagaaaaaaagaacatgtcgattcggcactgttcttttcaactcactaaaaatggaatacgtttctaaaaaaaaaaaacttttttgttgtattgtttagaccacttttttcaggccatctgttaagtttatcttttaagatatttatttacccaagtagataatccgcgacaataatctaaatcaaatatagccgaagtcgaagcagaggtagataatgactaatgagaagacgataagaccggtgtatgaaaagggaggtgaagagagcttagctcaccatcctagctgaaactcctgcgctctcttggccgcctcgatgtcgatcgtggtgttggacatcggctcgaaccacatcacgtcgaacgctatcccaagctgcccgttctgcgtcgcctgcgattcccactccatccgtatagtaagataaagatcgataatgggaagaacgcagcagcaacacattgacatgggaagaaattcagaacggatcagtttgtcaccttgtattttgtcctgtagatgctggcggcggcggcgtgggcgaggatgaagtggtgggcgacgacgtagggctcggtgccggagttgccggccttgcagtagaggtggagcagcacggagcagcggccgggggcctggagccctgcgtcgtagccctggatggccaccgtgtgcggctcgttgagcgtgatccagtgcttcaccctgtccccgaactccctgaagcacgtctccgcgtacgccgcgaaatcgtccctgcatttttggataggtacattcaccaagatggttagtgtacttacttaattaactgaaactaccactgggattagtaattctgtcatgaagattgatgctggattagttcaagtgtaagttctctgcatttttttgatacattcattcatcaagatcgttaatttctcctacttagttaactgaaattgccattgggattggtaactctgccatgaagattgttgctgggttagttgaaagtgtacgtttttggtgttttcaggtgtttagtgctagcttcgaggaatgatcttaggtgcttgtaggatggtgttttcagtatgaaccctttctttagttgatgtgtatctcttttttatcaatgaaatgaggcagaacttcttcctttgtttttttttttaaaaaaaaggaaattgaattgtaagtgtgtaactggttagttaattgagggagacgacactcacactatctgcctgtcaagccagcccttgtacttgtcttcaagggcctgggggaggtcccagtggtagagtgtcacatatggctgaattcctgaaagattgttatactttttcagcaaattcagaagctgtcaagatgacctgaatttatcactttcaaatctgtgtgctcaccttttgctagaagtgcatcgatcagcttgttgtagtggtcgataccagcttgattgacttgaccaacaccatctggagtaagcacgagatgatgcaaaggctaattagaatatggggacagaaagtgcaggtaaaaatttctgactgaagacgcagtttgacatcatggtcgacttcgctagtttctcagttggagaccacgtacttgggtagattcttgaccatgctatcgagaaccgatacgcatccatccccatgtctgccatgagctgtatatcctcctgaaaaaagcatccatttcgtaggctacatcgattatattgtgctcattttgcaggataaatggataagatatgaatacgtgtgcacttgatctgaaagatagagagaatcagagagagtggtgctcacctcgaaacggtggtactgatcaactgcaacatcagcattgctgaagtcggtgatctttcctgcacaaaaagatgagaaataagcaaaacattagcgttacggtagtgactagctgcaactactagtcctgagaacacctggttaaggttaaagatcagccagtattacgaaagatgaacacagatgccaactaattcttacccactaggcccactatcttaagctacatgagcactaccttagttatccctactactgaattacatgtactactaattatgaaaggtaggtgagatctagtatcaaatagcacaattgcggtcttgtttgctccattatccaactttgggtgaagaaagttgcgacaagcttcaagcactaactatactgtctatctaggtaccatgtctgcactctgcacaagagacgagatgtacaagtggcacgatccaatgattggattctccacaaaaggggagctttcggctttcgtattgcagttttaggctatatttgaaagatattctgacaactacagcttcttataaaataaggaactcacttaatagtatagcttttcatttagatcttaggaagctacatttgtagaatctagaagagctaaaagctgaaaaaaagcacaacctttttagattgacagaagctgactatccacgagttgtttattaaaatcttaagctctcctcaaacacacccctagtgtcctataataaacgtgttcagaaatgaaatcaccacgaatgtgcttgaacttgataggtataagtaggagtatttgctttgcagaaacgccctaatttgatatgacgacaggcagattaatctggaataaactttgcagtactgagaaaagaaaaacgtgtagcaatacgtacgtaccaaaggtgtgcgcgaacgtgtcccagatggtctgccctctcccgtcctccttcacagctccctcgtactacgaaataaaaaaaaacaaaaacccactgtttattcacatcaaaatacatacacgaatctgaatcagactcacagtgctgctatttgcatggtcgcgtcggtatttttagcgtagcgtgtcttgtcgtcaaacgaacaaaccaactgaatctggttaccgtacctataccgtttccaaactaatataataagtaacaatttttacaaatatttatcattcctaaaatttagttttttttaattctatcaatgttacattgaaattggcactaaataattaattcataatataaaaatatctcaattattttcgatcgtttttataaaaatgataaaataatgataccgtttatgatcatttccgattgttttcgtgtctactctggtcaccaagcagagctccagggggtttctctccatgctggtgaagatgtgaggatttgttcagagctttcaaatgtgcctattccctcagtaaagaaactttacctcaaaaacttcaatgaccgccttcgctgtgtgaattggaagttcatctggtgcaacagagcacctctaaaagtgcaattttttgcctggcttctagcaaaggaaaggttaccaacgaaacataatctaattaaaaaaggaatcgtttcctctgctacttgtgacatctgcaaccttgaagtggaagacggaagtcatttttgtctaaattgccccttcgctcaaggcttctgggaggcaataggtttaagccctcgaatacacatggttactgatatggccaatcttaaacccgatgggaatctgcctgaattgcacttcagggtgttctatctgctatgtttttggtccttgtggaaacatcgccatgacgttgtcttcaggaacatgtccccgtctctgcaatcggttcttcgcaaatgtatggaggaatgtggtctttggctagaacgcctcaaatttgagcatcgctctgtaataacttcttggaagcttatcttttcggctccacttcaaactctgacgaatgtgtaacaaactttgtagccctcctttttaatgaaaattcaggtggggaatccccccccccccccccccggtgacttatctaaaaaaatactctggtcaccaagccttctcttccgggcgccacgatctcacgatggccgcgccgcgcgcgcgggagacggcgagagaatgcgtgagaagctgggcgccggcgcgccgcgcggcgcggggtggtggtggactgggcggtggtgtctcgcggcgcggagccagccaaccgccaaggcgcccccaactactcctggtccgcgcgcctctggcgatcgaattcgcggtaggccgcgcggggccagggcccagggccacgtccccccatgcgttctcgtcttctcctcgcaagcggacgcggcacgtgaaccgctgctggtggtggaggtggttccgatcgtttccgcggaattttccacggaccacggccaaaaccgcctgcgcaacggcgagcgacgatcagacgcaacgcacgcacgcacgctgcgcacatttttttttaagaaaaaatgatcaccttaacatgggggactctgggaacatggtccaatgttgttccggtttg

SEQ ID NO: 34391 - DNA, 14621 bp, Oryza sativa
  unsure (1)..(14621): unsure at all n locations
cactgcgttatanatcatatgctcgcatgcctgcaggccgactttagaggtatccccaatccggccaagacgagagacacacataaattccagaaacaaaagcaaagtttgtttcttattccatttgcacttccatccggctatccccccttaatttggtaactaatcatccctgatcaagtcgtacgtacgtgtgttcaaccactgtacgactaaaacggcaaaaaggatgaacaaacaagtttgtctctgaaaccgaacaacagattctccacaagtttatctctcaaaacaacaatgggaaatccatccgtgactaacctggtacgcggcggaggcggtgccgaagacgaacccctcggggaagctgcccctggttagccctcctccgctctgctgcgcaatgcatcctcgcagcgacgacgacgcgacgccgaagacgacgacgaggacggcgaccgcctccagcctcgccgtgctgcatcgcccactactactctttatcctccccatctcgcagagagaaggtacgggagatcgtggtgtgtgggctccaaactgcacggactgatggtggatgatgagatgagatgagtatttatagcggcagaaatggaggcatgcacgctcccactaataaccaatttttcgcttgggatgtgatctctctcggtgtgtatgtatgtagtagtgagctcttgctttaagggatggaagtgtgaagcgtggttgggactctatcggttgcctgtgaccgtaatggtttattagtgattaaaacattatagataagaacttttacaaatctgtttttgacggcttaaaaaactaatggttattttaccatccttgagaagatatctagagatatcatattttatagtgtataatttgctacctctaaatactaaaaattgtagtgtaaaatttaagtaccataaggtactttattaaggactataaagtttctcaaaaactaatgatgaagaaaaactacgttagaaaagcattgatccaaatcaagttttaaaatttaaattttggcaacaacttataagtactagggtagacgatgaggtcctttggttaggtgagaaatgaaggaacagcgaaagtgtgggaggagaaagcattctgctagtcctgcttgcatgatgccatgattgatcagtgatcagtgttattattggggaatcaaacattttaaatttgtaactactatgaaatggtgattgctgtttgattataacatgattggcgtgcttctattggggcatcaaattaatgtattaaataagtaccatggaatggagtaaaaaatggataaatttgagatcagggtacgtatttataacaatttttaacagtgtgctatttttatcctagtgcactagccggatgaatgaaatgtccattatctagaaaaaggtgtactattttagtatttttatccactatttgaatgcatattatctgtgaaaaaaaatcaatgctttctttcggcatgtaatgtttttaacaggatcagatagcatggatacttgtgaataggcaggttaattggagcaaattgaccagttcaagtatttaaataagcacaaatcgagccagtttttaggggtttgatcaccttgcctgcatgcggacatctgttgaaaaggactgcgtctgcattgatcctagataaattaaagacgtgaataacatctgcatcaacgtggttcagatttacaaggaacctaatcgcgtgtgttcccctgtctactttcagagagtttggcatgttccaaggttgtcatgattagttcgttatcatctcgcatgtttccaaccacaaaccgtgcaatttgccgcaaacaaatgcacaattgatacagatgatcccttgcacgtacggaccatcacaaaacgaatacatgggagtggattctaatccctcgagaggatatcccctcgtatatctttttcttctaaattcgatgtaaatagttgtgaaaaaatctgaaaaaaattgacaatgtagagtataatggtacctactagtccaccaaaattcatgttcaaattcgatctacaaatcaagaaacaaaaaaaaacaaatttagatataaacagtacgctactattcatacgctgaatttgtcttttttatatctcgacgtttgagttgagtttggacttaagattttgtaaagttatatatatgtgttgtatgaatgttgtcaaatttttccagaatttttcataaccgtttagatggtttttgagtaaacgagggaacatcccctcgagggattagaatagtttccccgcatacattgcctccatacttgtgagaggcactattgcatcatatatgcagttctctatatatcaatataattgtctgttagcttatttctttatatctcgctttgctttggctgcctccacccaatcatttgatttcgcgtcttagtttgccagctcaaatcaatctccatggtgcatgtacacatgcacagatcatcagtgctgaactgctgatacaattagtaatgtactgtaccagtatagaagtttctttttcagatatatgcgaacctatcgatatataatatcggtgtcatgtccatgctcgtctcgatcgatcatacagatactacaccggaggccagctggctggcgctatctgaaccatttcatattcttgtgttcattctgaatatatattctgaatggactcgatgatgatctgaaccctcctttttctgagcttctaccctaggactaggaacatcagactggaagttttgaaggtttgttgtgtgaaacgacaagtgttgattgatacacgggacatgggggggcgaaacgtgtaggcgctcgcgactccactccactcttgcgcatctctcggtcgatctcctcgtgttggtcgccgtctccttcatggcgatgatttgctggcctcactggaagtacgaaatcggtgtgaagcggcgagcgaacttgtaggcgactcatgcacgcgtcagatcggaccagacctgacctgacctgcagcggattaatcctccgtcccaaaataacccagatcaatcttaacaaagcctctgtttgactacacttatttccatatattgtgtgacagccaatagccactgtgtttctttatgcagctgtagctggtccaaacacttattaatattcgttgttttaacatatatcaaattcagagcagagaaaagagttatcttggaacgaaaatagtagagtgtgtttacaccaaatttgtcacctataaacaaaataggggaaaattgccaaagtttgaaaagtgccgggtttccttcacagggccggttagaccgcaggtatgtgggcggtctgaccgcggcctgaactctagtctgaccgaatgtatgtggccggtcagatcgtcagggtccgagcccgagtctgttttcgtcgggtttcggatttccttacttgggaagacatgtttcgggtttctttggtttctatcccgagttggacatggaggtgggtctgtagaggataagaccaacctctatttaagggacaaggccggttcaattgtaatccctaaacacacaatatacttgaatcgccttttcttttatctttacttttcagttatgttttccactttaccctagttttagtccatctttgtcaatttgtgccgtaaatcgtccgccgccgctgcgagagtgcgacacctctttgtaggtttgtcctgaaaatcttccgatttgcccacgagacgggtagttatcctcatatcaatctaaatcggcctagatgctgattttgatctctaaatcggctccgttagccggtttagctgttttccataaaacccatcttaatttggccgggggttccgctagagtcgaggtggttggtgactccatatcaccgcaaggcgtttaagtgctgcgatcgtgcttatcaacttatcatataaagttgctaacagattgtaccgagtactttcagttcagagattcagaaacaagctgtgtctcggtctaagcttgtgcgcttccgcggctttcacattcgccgcaagcgagttgcatgcactgcattgcgagtcgctggcgtgcgttgcagtctgaataatttgatttgtgggagtatactgcactgattgcgaccccaatcccgaccgaccttagctggctagtgtatgtgcttcggttcttcgattcattcctgcaataatgtttgatcatgcatagtgtgaacgacacctttgtcatcgtttaggcgttgtgttgttcgtctcgtcttgtttatgatatgatgaaatcttcgttcacattcagaaatcaaattcagagcaggcaatgcgcgtgccggtgccggtattcgttggtttatatattcgacaggcccatgataattaattggatcggtggagactggaactatgccgccgaacagctgggatactctgtgttactactactgatgatgcagaagcaagaaacaactgactacagaggcgagaggggaatttaattatttactacttttagctttgtcacttatccaaatacccttttagatttgcgcttaataatttgtcaccggagagaggtgagttcttaactatttctcacttttgcctatgtggcgtgcccgcgtggaaaatagcgtggaccccacccgtcagcccctccctcaccttcttctccacctccggtcgccgtttctctacctatcaggtcgagatccgccccgtgggggaggttgggcgggcgctggtgccagcgcacaagcttgacgcggtggagggaggcctaccagtgcggtgtgaggttggcgagcgtggtggggtcgcggtagtagacagtgagcgaggtcacctgtaacgccgcgcttttagtgggacgttaaaaactaattcggcaaaatcctaattgcgaaaatttcgttttttgtgtgcgagtctaagtcatgccgtggatctcagtttaaatccatcattgttccctctcgtcgccatcaaaatcctctacctctaaaatgttaattccgattcaacttcctagatcaattctgaaattcaaatccttcctttgaatcctcgccaaatacttctacgaatccagaattattcaaattccgcctcgaatccttcccttgacttcaccttatgttcctagagtcaaagtatcatggttaaattccaaaatccttctcaaattctctccaattcaaaaacaccctccaaatcagttccctcggaaaaagtctaaattacgtccctcttggttgtgggccgtttctcccttgctcggcccattctctcctctcgggcgctcctcctcctccccgcacgtgcactgcacgcgccgagagagagaggcagcgcctctcttcttcctctctccttcctcgctctctctctctctctctctctctgcttcctttctctctctcctctcgccgcgctatgcaccgtcgccgtgattcgattttcgccgccgccatttgaacccgccaccgcttttggttcccgcgcacgcgccggtcgtgactgaccgcccggtcgccacctgtccttgccgtcgccgtctgtcgccgagcaccgggggagccggtgcgtgcgtggacgcgtgacgaggagcttcaggcgccacctttcctcccttactactcggccgcgcaccctcggtgccgcgtcgtcccgcccgcgcgaccgttttgccgtgacttcattcgtgccgtcaacgccgctcctctcttgtggtgagcttcccaccgtgttcttcgactcgatgaatgcagtgtggtcaccctcatgctctcgcgcttagacgccgcgccgcgcccgtcgccgttcgccatagctcgccgtccgccttgccctgccccggaggtcgctcaccgtcgccatgacttcctaggctagctcgtcgccgcccgtcgcttgaaacgagttcccggaaccgtgtagaagctccttccccggtgaattggacttccgttgccccggcgagttttccccttctctcggccggcaatggccgccgctgcaatccgccgccgtaggcccttctcccaccgattccttgcgccgtgaccctccccgtgtccccttgaacctccccggcgagccgccgaggccgcccgcctcgccggctgcgcccgcgccgtgccacccatcccgccgccgcacggctgtcgtcgccggccgccgtcgcgccacctctccctcatccgagccggtgaatggaaccgccttgattccctctcgcttccggtgcccgccgcctacgccggttcgtcgccgttcgccggcggcgttgcgccgtcgtgagccgtccgatcccgggcagctcctcctctctcctgcgcctacgtggaagtccacgtggacgccacctcagcccacccggccccgcttgacctcggtcagccgcctccctccgttcctcactcgcgcgcggggtccacggagagccgagaggctgcgcgtgggcccgccgcacaccgcatccacccgcgcgccgcgcgtggaccgctttcccccgaaccctagcgccgccctcgcgtgcgcccatcccaccgtgggccgtgtcaccaataagcgggccccacccgggaccccgcacggtgcaatcggtccaccggacccgcccccatttctcccgtgccctaatgggccgacttccgcgctcgcccggcccaatacggctcggcggagccgcgcaagccatcgggccgcgccctaagccgcccaacgaagtctgattcacgtccctcctttatttctttccaaaaaggatttaataaatcctttttcctttagacagaaattccttaatccttccaaaattcatatctcttgatccactcgtccgaacgcctccgttccacttccaataattccgtaaaattgagatctattcaatggcactattatttagtctaaataggatattcttttggtcttttgtttaggttttttatcgtttgcgtatagtcgcggctaccggatttccgtcgatcgtggatttctcgaagattcgtgaagctccgtgaaggccttgagcaaggcaagtcaccctttgaccaattgctcctataattggaaaatcattactattttgtttgcaagttgcattattagaatcactcacgtttaatttgcttggcctcggtttgtgtgccaaaccgacggacctacccagtagtcgcgctaattcctgtaggccatactaccctgattccttgtcgctccacttttgtggtacctcggtatccgtgctctctgagcgcgtataccaaatatcccacatacaccgttgtttgtcgaaaacttgggaaatgggtttgagaagccttgaaaacccgacatgtggtgtcggcgtgtttgaaaataaaataaattgtgaaaactcgcgatgcgggggttgtgcctatgtggcactatcccgtattcgcatataaggaccgattcctgtgggaaattcatccgagcatataacaagtgcgaccacatgggtgcaatgggacgcccctggctgagtaaatagcaaaccagggaagtcttgatcccaagagacatgtggattcaacgaggtggtgtcgggtagaaccctcgggcttcctggcatagtatggtatgggacctaacctgttgtcggtctgggacccctctcgttggcatatggcaaccctgtgtcggctttcgaaatgccttatcatgaaagccttagggtctcccgacgtggctgatctcacgggctgggtgatccgggttagtaatgtcgtgtgggtaaagtgtaccccctctacagaggttaactaactgttcaaacagccatgcccacagtcatgggcggatgtgaggtgtttcatgtagcgtagatttgtttgcttgtgctttgtgaaaagttgttggggtgtgggaatcgttatcagaatcagcctatgtggtagatggatgacctgagtggtcaagaaacgaatctgtgtgattcgggatgtctacgagcattatagactaagcttcccgagtggaagcggattgttgtgctgctgggcagctggactctaagagtccgagaaaatgaaaaggctctgggagccgattaatcaagtgaaatggctctgggagccgagaagtaatgatctgacccgggaggtcggtacattaccaattgagttgttagaaaacatctcttaaagtcgaatcgagacgcaagtctcttttcggcccaaaagagctgttgaaaaaccagggtttcgttctggttcccagccgtcgcctgtggtgttgggtgttagtccgttggttccgctgctgctgcttctgttgttggtgtttcctcgtccgtgtcatcggttgtattctcgggctgttctgagctgcaacctaagttaaggtaaataagtcctctatttattataaggattgcaatgattcatatttgtcaccgtgggtaccagcgctatgtcctgggactggtactgagatcgcggttttgtaggaagcggttcgcgccatttttcttacgacacgctcctgtcaagtgccgttgtatggcggtgcccgattagggtgtgacatcaccgccgggaagcaacctgcaagatgggtggcgatggaggcgttctactcggagatttcctcggggtggtacaggttcatccccgacgacgttgacgacgacggcgtgccgccgccaccgggcgagacgaaagagaggagcgggtgcccccacgacgagacaagcgagaggtcgaggcggtctagcaccggaaggagaacaccggcgagaggaacaagaaccctggcgagctaaggtggaggagaaaagacagtcggaggtggagaataaggtgaggggaggggctgattggtggtgtccatatcgtttttcacacgggcacaccacgatgcctcgccacgtaggcaagagtggcaaatactcacatcccttcctaggttgagtttttttggacggagggagtagttaaaaaatcacctctctctccagtggtaaattattaaacgctaacctaatagggacatttggataagtgataaatctaaaagtggcaaatagttaaattccctgaggcgagaaggcatgttccgatgtccggcgttgaatgtgcccgtgtgtcatgtcacgttcccaatcgagtatgtgaaactgaattcctttagctctggatctgaaatgtgctgactggttatgaactatctcatcaggagacaaactacctgccggcatgggcgcgtgctgtgctaggaataagttcacttaccgctttcatcttaaggttaaatttatttagcatccttaaaccatgataaagcccaatcaagtcccagcgttcgatagttagtctgtgctggttctctctgatggaatgagaagccaaggtggcaatggccgccgtcgtctcactctggcgccgtcttggacaacttcttccaagggactagcagctagcctttcgccggcgaagtcctcttctgaagaatgtgagcgcgcttgttttcggcttggccgcttggtggaggcggcggcggcttctgcgacaagaccaagagctgtgcatggatcgtccgctgcgtttgatcaggtaaatgaatacggtgattcatcgggatctcgtttttcgattttgcaggatgcgtctggtgacgattccggtcatagtttggcagacttggaaagtgcggtaaaaccctggagcggtcctcttccgtctccgaggaggtcgccaccgagaacgttggacgctatggtttcttcagctctgcaaggtaattttcagagcaacacactggcttcggttttgggcacagttacaaaggtgtgaggatgatggggaatttctaaaggtcgcatgccgcaggttggagtcgatggttatgcaactatttgccaattatgggtggaggttcacaaatagacttcaataaatgtgttctccttattttggcttggttacctttgtttttgtttggtgtgttctttttatctgaactacactctcttctggagtgctactttgtaataattggctgtaactctttttcagcaaaggctggaatgttatattccattatcttaaaaaaaaaagtcccagcgttcaaaaaacatggtgtcctcctcctcaaggtgagctaaagctgaattttgatggatctttcttcagtgaaaacaaaactggagggtggggttttgcaatccgggatcatgcggggagtgctgtgcttgctgtgcagggaggattgattcggtgcaggatgctctaagtgccaaggctgttgcttgtttgcatgcgttgcgagctgcagtagatcatgggttctcgcacatttttgtggaggcaggctctgtcaccctggtgaatgccttggagtcttcttactgtgtccgaactacggcgggtgtcatcttcaggcagattaaagcgatgattcatttggattttgttatgatcacagtgtcttttactggtcgctcatgtaataactgtgctcatgaacttgcttatcaaggagttagttgggacccgggtcatatgtccatttgggctgaccccctcccagattttgtacagtccctggtggtttgtgattacactaaaccaatgtgataataaagagcacgtttcctcaacgtgaagaaagggaagagagcagataaaaaaaataaggaaagagagggagaggggtatatgcgagattgaggtaaaatagatggagacaaggatttttatataggtccggaccccttatctgacaggtaagagctctacatcctgttggtcgaagccggtgtattatctatgttgatctgcttccccctctccttctagggggcttgtatttatacccatagatgccccattgtttgagtaaaactagtgagaccaatatggatacaatccgagtagtcattgtcgtttctatatagaactttattcgtcattccttatccgaaactccttatatatacgaggtataattccgtataagacttggtatgtgatgggccctgccgagcttagtcgattactattgagtatgtggtatccatgaccctgacaatatgggcctcatatgtttttttttttctgctgacatgttatgttggtgaaaccattcatctatattgtcatgggacctgatttggatgattttacttagacgagaggtgaacattttattgtagtttaggaatgcccattaaactcgacgtaaatacgagggatgtcaagtggacttctgctactgctgctgcccaacgctacctctctcgacgttattcgagatgggccataatgaggtccagcaaggaaggaacaacagttcaattgatgggccatggcctccaggatcccgggacccagcggtatctagttgatcaccgcatatgactcatttcctcaatcttggttgcgtcaaaatgtgattatgatgcattagtgatttgaaaggggttctttggcaaatgtggtaggaaataatattccacttattaaagcttgacattatatattatccatacattcttcccatatattttttcctctttttttggcaaaaaagtagagagactctaccttgtatccattaatgaaaatggtgtgtcaaagagtacaggccaagctgccaaattcagaaagacagaagaaatactgaaaataatgggaacagaatgtaagagaaagtaagaataatcacaagagaaaaaacaaaagaactaaaacttgaaagttaaggtgtaagacagtttagctgagcttgcatgctcagttagtaatgtgcactcggaagcttggtttggctctgttttcctaggttttgatgtcatccttgattttgtggagtaggtttgataatgtgcagtttttttgctgaaacacattgtcattccagcacaagccgcgaagtagattggccatctttgtccttttttcgaacggctcacctaatttaattttgttctaaccgttcacttagagttatattatttcgcctatgcttataagccaaaatttaaattttcgtttgcaaatatgtcatttcgtttattccacgaataagcgaaacgatggcccccgttaattatttccctttctccaatctcttacagtgtgcatttgcgaaacgggatctacagtgttaaatagtcactcgtttttttgcacggttggagaagtctttgggatttttttctgtttgagtcggcacgttttgggctttcgcagagaggtgaaaatcaattgctatcacaccggcacacgaccaatgttgactgagcccactctttgtgactcgtttgcactagacaaaatcagggagaccgagcatctttcacccctgcaagttgcgaaggaaaaatccgtcaccctgtttctgaccaactcttcgtgttctcaccgggaaagaaagagagcaacagctaaattttatttttaaaacacactgtttatagtttagtagttcgtgaaacgtgaacctataaaatattacttcatttatcctataatataagacgtgcacaaattacaatatttaactttaaaaatattttaccaacaattattataatataaattagattttatttgctaaaattaatattattggattgacatttaaatttactttaatatgattataattttattgcaataaaccttatagtatagtatatgagaaactataaattaaagaagattagttttaaagactgtgctgagtttgaccatatcttatattatgggatggagagagtagcagcttaaaaaaagtaacgaaaacatacaaacattttaaagcgtcgtctcgagagctttgactgttcgacaagtccaaatataacaattcagatcctctgttgacatgtggagccgagggtatgttggacccatatatcagctattgaggaccctcactcaaaatataggtgcaaacatctcgtgaaaaacgcacaacaattttcacaatgggcacgtacgttgagttagaatctgatggccatgatcaaaagccagaacgaacaaaaacgcctaacaaatctttcaccaaaagcacccagctcatcacgttatccgaacggaaagatggtagatatgagagatgagagaccaggtcatcgccaaaaaccgtaaaagcaaaccttgtcccgtgcggacacccattccccccttcccctttctgttagacacccgccttcacgtcacgggagcgcatctccaccgcacgatccagatccgacggcctccacgttccggggcccacctgtcagtgagcgccagcgtggaggagggggcacgcacgattcgtctcctccccatccctctaaacccctcccctcccccccaccacctccgccttgcgcgttgtttcttctcctctcttcgtctctctctctctctcgtcgcgttggatttgacgagctcgtcaccaccggctgcggcggcgaggcaggcatccgcactcctcggcgtcgggccgtcgtcgttgtccgctacctggtagatccgcgtgttcccttcctcgtcatgtctcgtgtctggatctcgcggaggcgatgcgtttcagattcagtggcttgtcgttagaattacgtttttgcggcgaccactttttgatcggtgaaaaagcgggaagtgggtgttccggtggtggattcgtgctcagtttggggatttttttttgtgggggctgatctgggtgctacgtgcgcgcgtgtgatggaacgctcggttggtcgtgcggtgtagatgtaggcctgatgctagcgaaatttgttctagatccaagctggttgatccatgaggattgctttagaaaaaaattttagggatgccatagttttagtgggacttcatatttgtcatatgagcgttacatggccagcagccagttaccctgttcatttatcgggcgtgtgattcatctatgcatgttgtcagattgacatggaaagcgtgtcatgtattcattctgtgattcatatgatggatgcggatcatcagcttccttttgtgcagcccgggcctagccagagttatctttttcaccgaactgtttcaatcaagtctgcatgaggaactgagaattttttttattattatttcattgtgatgtgatcatattgtttgatttcaagttcatgcagctgaataagcattcatgtttgcacattatttaagaaagaagcctattattgttcatgttaatgtgggtttccattttttttttcaattgcgccctcctgtttatggtgaagaataacttctctagtttgttaggttctattatgattcagtgttttttttcttaaatgaagtgtgatatactgtctaaagtctgaactaccaagtttgaaatttttttacaagacacatgttttataattttgtgtgcattgtacaaaatcttgacctatttttttgcttggtcacaggaaaagatggctggtggctttagggtattgcatcttgtcaggccttttctggggttcctgcctgaagtacagagtgctgataggaaaataccatttagnnnnnnnnnnnnnnnnnnnnnnnnnnnnnnnnnnnnnnnnngttnttcacnnggcaca

SEQ ID NO: 34392 - DNA, 1171 bp, Oryza sativa
  unsure (1)..(1171): unsure at all n locations
aaaaaactgattgtctatcnnnnnnnnnnnnnnnnnnnnnnnnnnnnnnnnnnnnnnnnnattctgtatgcacacatttcacacacagttaaacacaagcagaaaatgagagcccaggccataaattcacaagaaatacacatactttacactttagctgttctcacgttctatacttctaaaatagttgtccctgtgtgattcaaattttatctcaaaatagtaggattcaattttatttcaaaatagttatcacttcatattactccctccgtcccaaatataacaacttttagcactcagaatttgctccaaaatataataatttcttaactataattctcttcctaaccaatcacaactatccactatctacttttcccacctacctctttctgaaccaatcacaatatctttctatttaattttacctactttcttatattctgggacggagggagtaccctatcaattaccttccattcaaatatctcgttattataccctcaacaagggcggatccaggaacaaaaaaaattagggggggctcaattatgcagtttctttaacctctagccatttaaggacctttagtttatcatttatggtgaaaaaatcgaaggagtgctccgggaggtatccatgggtatagagttccccctgcacccacgttggatccgcccctccctcaactacctaaccatacaccattcaattcaaatttctctttattctatctccaatctccaactactctctcacacctaaacatacaccattcaatgacgggcactataatcttctctttaaatcataatctacactaaacaacctagaatagtaactgtatgggaacggaagagtaacagtgctcatatacctcgtagactgggcaagttctctcgtagccatggacatggccgtacattgcgatgtcgaccttgtacttctgccaaagcggctggaagctcttccttcccatgggcttctcggttgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 34393 - DNA, 1087 bp, Oryza sativa
  unsure (1)..(1087): unsure at all n locations
aggggcttcttctcggcnngcttccgtggcgccgcacttcggaaccggagggagtccatgatgccaaacaattcggcccaccacttngtaagccgccggcccacgccggcgggcgcggatctggatggaacgccgcccggcgnccgcngcngccacggctnggagctctgcttccgcgtgcagtgcagggcacgtcgcgggcttctgctcagctcaagacgaggagactggtggagtttctgcttctttttgtcagactcacgtgtgctaatgacaatcggactagtgtgcatcgggagggacccactgggtagacgctcgatgataaaaagcttcttctatattctgccaggaatcggctccaatttcgtgaaattactgcaaaaatttctccattacaaattcggaagagattcagaagcccaatggacggcgctttgcagcaaactgtattactgtttttgaatgaacaaaagaactgcgttgtactcgtgctctattcaatggaattgatacattctagtgccggctcgttcattaaaaataataataaaaaaaagaactacgttgtaattgcatttggatagaacaaaatgttggaaggtacatatggtatggaatttggggtgcatcagttaggtccaaacatgggctttgaagacccagaagaactactgcccaccaacaatcctggtttccaacacccccaaaaaaatactgagtagatgaaggatgatcagtttccttatctcttctacgcttgtaaacgttgaaacttggctgacattgcatttttcacacttatattcgtgaaatgaactttacttgacggagaaatcagaaattcctctggatcagtcctacaaaacagggaactacttcaggccttcagggcttcatgcagcttcctcaacttctgatcttgtgtccattgacaggccggttagttcacgggcatctgtatcgatcttttcgttgaaatgatccctgaggaactccactgccatgaacctgaatgcagatgcaggtatgtaccatattattctaggaatgctccccttgaacaagccactcatttcctcattag

SEQ ID NO: 34394 - DNA, 735 bp, Oryza sativa
  unsure (1)..(735): unsure at all n locations
atcttacgttaccgatgncatnncnnnncnnnnnnnnnactntanaagatcccctcaatcttttcttctccccataactgaactaaaataaaagctcacttatattttccttatccttatttcaatactctccggatcgaaaagtaattttctaaccttgctttctattccaaacttactttttaataatcttaaatagtaaaccaatttgtcctgtgtcccgataataattccttcgccacttttttcaaacttcggtcgtccaccacgccccaaaatctaataaaaaataaaattaacattataaacatagactttaactaactaaaaatgaatatatcacctcagaatcaatgcaagttcaaaaccgtaccttcatcacatcaaacatccccaaatcttcccatccaccagctttaggatcatataattttcttccctttttttgggaaatcaccccatttattaatgtttcctttactaaacttgaggaaattaattctaacactttacatattaacaatatattacaatttaccaatacagtcacaaaaataatcataatagatgcccataaaccttgtgtttcccatacacattttttttttacccaaaaaccaatacttacctttataaccactttattaaccccgtaatttcacttccccaaccaaatttttcctttcaaacaaagacctttaacacaaattttttaccaccctttcaaaacttttg

SEQ ID NO: 34395 - DNA, 725 bp, Oryza sativa
  unsure (1)..(725): unsure at all n locations
atatgcaatttcatgtagcatacatgaattttaaggtaacagacctccaagtaagtgggcagggtagcagataggccaacaatgcgaatcattgattgcatagactcaccctgtaagattcagattattcataaatataaatcaagggtaaaagacaagatctaaacaagagcattcatgatctaaagacttagtcatatggatgcgtaataaatttcaagcatgtccatcttaacagccacaagttttttacagatcattcaagtttaatttttgccatcattaagcataaggaccctttccacatcaaaaggaaaaggagaaggggctcctttaaaaagactgacctggcgaagagtccgagcaactagcgcctcaatgactgaacctctatcatcatttagcaagtgcacctcatcaatgattataagcttcaccaacattgacagtgacatgtcactgcttttccgtgtaataacatcccacttctcaggagtagtcactatcatctatggaaagcaccaaatattacagctcagacctgcaactgaaaataatgaaacaaagttgcatacctgtgtttcttcaatctcatttttggtcagctgcatgtctcctgtaagttctctaacaaccaggttcaacggagataatcggcgactgaatgtggatgttacctctgcagccaaagccgggtnccgaggtaagtcgcttaccnggcacca

SEQ ID NO: 34396 - DNA, 752 bp, Oryza sativa
  unsure (1)..(752): unsure at all n locations
ccacttatgtacgataannatatctagtnannaccncnnnnnngtgnggaaaaaccgcgggngaaaaaaaagggagaaaaaaaaaaaanaaaataaaaanattttttaanannaggnggggaaaaaaatgtggaattaaaaaaaaaaangaaaaaaaaanaaaaaaataataaaaaaaaaaaaaaataaaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaagaaaaaaaaaaaaaaaaaaaaaaaaaaaaagaaaaaaaaaaaaaaaaaaaaaacaaaaaaaaaaaagaacaaaaaaaaaaaaaaaaaaaaaaagaaaaaaaaaaaaaaaaaaaaaaaaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34397 - DNA, 3078 bp, Oryza sativa
  unsure (1)..(3078): unsure at all n locations
cgcatcttcaactctattattcactaatatcacaccatgcatgattaannananttagtcaacttatggatatacacatacaacacaaccaccgnnnnnnnnnncccnnnnnnnnnnnncnnncccccccccccccccctccctttgatgtacaanctacttgaaagccngcacgncgactttagaggaaaccccggaggggcacacaagtcagggtgcgcccagttggctactgtcgaaccagcctggtccggcagcttcgccatagagtcaaggaccccagttcgacctcagcaacgccatttaagcaccaaccactcgaccacaggcaacgacgccaggctgcggaacaaatcaagcgctgaaccaggtcgctatggcatggacccagcctccgttcgacccatccatggcggcacaccaagcgccaccattcggagccaggcaaccggatactgtggtccaacctcacacgcaagccatgacttcgctcttcgccacgacatatccacagccaaacgggccttcgcagcaaggtaccgtgagcaaggcggggggcgaaaaggggctaccgctgagtgggggaatcaaaattcgtccaatcccaccccagttcaagttcccatctgttccgtggtactcgggcgaaacggacccaaaagagtttctatccatctacgagtccgcaatcgaagccgctcatagcgatgagaacaccaaggcaaaggtaatccatctcgctctagatggcatcgcccgttcttggtacttcaatttaccagctaatagcatttactcatgggagcaattgcgtgatgtctttgtccttaactttcgaggcacctatgaggagtcgaagacgcagcaacatctactcggcattcgctagaggccgagggatcgataagggagtacatacgtcgcttctcgtaatcccaatggcaagttcaggacataaccgaggcgcccgtcatcaacgccgcttcggcggggctgctcgaaggcgaactcacaagaaaaatcgccaacaggagccacagacactcgagcacctgcttcgcatcattgacgggtacgcaaggggcgaagaggattacaagcgatggcaagcaatccaagccgagtacgataaagccttcatcgccgctgctcaagcccaagtacaagcacaagtcgccgaaccggctcctctcgccattcgccaatctcagccggcgaaccaaggacaaccgccaaggccaagtcaatctcccatgacttggagaaaattcagaaccgaccgcgcaggcaaggccgtgatggctgtcgaagaagttcaagccctccgcaaggagttcgacgcccaacaagctggcagccatcaatatcccgttcgtaggaaggtcagaaaagacctctactgcgccttccatggacgctctttgcacaccaccgagcaatgccaaaacattcggcagcgtggcagcgcacaagatccaaggccacagcaaggaacaactgtcgaagaacctcgcgaagctactcaagaacaagcaccaccggccgaatagcaccaagacgtgcagcgcagagtaatccatgtgattacaagggccgatccgccagatcaactgtcaaaacggcagaagaagatgcagttgcgaacggtgcacaacatcacctcggtttgcgaaggggctccgtggtatttgaaccagcagatctctttcgggccggacgatgccgaaggagtgctgttcccacatgaagaccccctggtaatctcggccgagagagctggcttcgaagtccggcgaattctggtcgacggaggaagttcggccgttgtcataatcgccgaagcatatgccaggatggggttgccaaccctagctctcacccaagcaccaacctcgcttcgaagtttcggcggcgaagcagttcaagtcctgggccaagtacaactggcggtggctttcggcacaagcgacaataggcacgaagagcaaatactcttcgacgttgtcaacatcccatacaactacaacgccatcttcggccgtgcaaccttgaacaagttcgaagcttcttccaccacaactatctcaagctcaagatgcctggtccggcaagcgtgatcatggtcaaggggctccaaccttcgactacatcaaagggcgatttggccgcaatcaacatagcagtgcacaatgttgaggccgaaccgcatgaccgagcaaagcacatgccgaagcccgccccccacggcaaggtgatcagggtgcaggtcgacgatgccgatcccacaagatttgtttcgcttggaggcgacatgggcgaaagggaagctgagaacatcctggaggtgctcaagaaaaacattgacatctttgcctggggccccgacgaagtgggaggtgtttcagcagacctcatcatgcattatctggcggtcaaaccggatgccaagccaaggaaacaaaagctgcgcaagatgtccgttgatccccaagaagccgcaaaaaacccaagtgcagaaattgctcaaaaccggggtgatccaagagatcaaccatcccgagtgtttggcgaaatcggtactggtgcggaagtcgaaccgcaaaatgggcatgtgtgtcgattttaccgacactaaataaggcgtgttccgaaagaacaattcccccctaaccgcggatcggacaagctcgtggattccacaggctggctttggaacttataacctttttggatgccgacttccggtttttaacaggatacccattgaatccaacttacaattcccgaagacagcctcttattaacgccgggtcggtaactttttggccacctcaaggaggactttttgggccaagagaaaatgccggagcaaccttttgacagagttgttgtacaagagcctttaacaaaaatttggggcgaaaatgtggaggccttatttcacaatttttgttaaaaagcgcagggtttttacatttttccctttataggaaactttaaaaattaccctgggggtgtaaacatacctccaatattttttgtggtcccgcgaaattttggtttcttgtttaagaggat

SEQ ID NO: 34398 - DNA, 742 bp, Oryza sativa
  unsure (1)..(742): unsure at all n locations
cttctacaacaagtggggcggaaattgtgaaggcttatgtcgacgatttggtcgtaaaaagcagcaaggttttggaccatgtgtccgacttacaggaaacnttcgacaacttacgcgtggcaggtatgaaactaaaccctgagaagtgtgtttttggtgttcgcgcgggtaagttgttgggttttcttgtttctgaaaggggtatcgaggcgaaccccgagaaaatcgatgccattcagcaaatgaagcccccatcgagcgtacgcgaagtacaaaagctcgcaggccaaattgcggcgctcagtcgattcctctcaaaggcagccgaaagaggtttgcccttcttcaagaccctccggggcgcgggaaagtttagctggacacccgaatgccaagcagcgttcgacgaggtaaagcaatatccgcaaagcccacccactttggtcagcccagcactgggaagcgaactgctgctctatctagcagcttcgccggtggcagtcagtgcagccctcgtccaagagacagagtcaggccatctttggctcagtgaggttgtagtactcagtcaaggcggcagaaaaatcttgttcttttttgagctcggccttgagacgctcaatattggtattcgcctcgctccccttctccagctcagcttggagccgctcattttgtgccttcgtctctttaagggtgttggcgaggggtacaagctggnacantcaggtntntcacgcct

SEQ ID NO: 34399 - DNA, 2007 bp, Oryza sativa
  unsure (1)..(2007): unsure at all n locations
ggaaagaacttcaagaaaaaattgggttttaagttaaactttagcactgcttatcatccgcagacagacggacagaccgaaagagtgaatcagattttggaagacatgttgagagcttgtgctttagacttcggtgaaagttgggataagaatctaccttatgcagaattctcgtacaacaacagttatcaagctagtctgcagatggctccttacgaagcactgtatggtcggaagtgccgcactccgcttttgtgggatcaaacgggagaacgtcaggttttcgggacggatatcctaagggaagcagaagaaaaggtgaaaatcattcaagaaagattgcgagtggctcagtctcgacataagagttatgccgacaatcgccgcagagatttgagttttgaagaaggagattatgtgtatcttcgtgtcacgcctcttcgaggtgttcatcgttttcacaccaaaggaaaattggcaccgcgttttgtgggaccttataagattgtcagtagaagaggagaggttgcttatcagttggagttacctcaatccttggcaggagtccataatgtgttccatgtgtcgcaattgaaaaagtgtttaagggtacctaccgaagaagctaatcttgaacagatagaagtccaagaggatctgacctatgttgagaaaccaatccgtatcttggaaacaaatgagagaaaaaccaggaatcgagttatccgtttttgtaaagtccagtggagtaatcactcggaagaagaatcaacttgggaacgagaagatgaattgaagtcagctcatccgcatctgttcgccagttcttccgaatctcgaggacgagattctgtttaaggggggtaggtttgtcacaccctgaaaattcaaattatataaattgttgtttaaatggaatttctagaatttattttaaaagtcttgaaaagaaaatctaagtttaattaataaattccaatataaaaaggggccagataaaatttcattaaatactttgcttaattctataattcctagatttttctgggatttatttgagctaaggaagtatttttaataaatggaattgcatttaagaaataatttaaattgaaaaaggttttaaaagtcctcttttggctttgggccgaaagtcggcccaaaacccgctctctctctctcctcggcccaaccgggccagtccgcagccgccgcgcgcgcgcgttcggtcgctgacaggtgggtcccacctgtcagtcgtcgtctaccttcggccgccgccggccgaaaccctagtttcgcgccgccgacgttttctttccaaaatccgcccgtccttttcttctccggccgaaatgatagaggggaaatgatcttcgggatctcctctaccctttctccggtggaatcttcggctaattcgttttggaattcgtggaatcgagttcgaatcggatcggcttttctttcttcaaagccgaaggtttccttcgcccgttgcctcgcccgtgggcctccgccggtcgcctccgagcccctttaaaagccctccccggtgttttctttacccgtnggcacccttgcctttgcctttcgtggtcggaaccgctctacgcccggtgccctagcttcttttttgccggcccccgttcaaccgggctccgccgttcttcagcccgtgcctttttttgggaaggcccccgcgtgttctccaatccggtgccgtctttttttgccctttgccgttccggaaattcccgaaaaacttgtcgttttgaccccaagttttccccgtttcctttttggccgcgtgggtccctttttttcctcccctttttgacccgcggggcccccggtttccctcagcctgggcttctttgtggcccccccaccttttcgtggagttcccgcccacccccaccacataaccctccccgggtgaatttatttcccatcggtggccccgcgggacccggcccacattttcgcccttttttggttcctccg

SEQ ID NO: 34400 - DNA, 1248 bp, Oryza sativa
  unsure (1)..(1248): unsure at all n locations
gcgatgagatcctagttgtgctgcccgcangncgactctagaggatccccgtaatttccgaacttattgtgcataaaatcctcgtccaggaatcaaccgaggtacacaaactgacaatttaatatacaaatccatcttaataataacgttacatacttacaaaagaaaagaaaacagcagcggaattaacggtctaacgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttacgttccaattctgagcggatttttctaccattgggcggatttaaacgatatgtggctttagcaaattgttgaacccatagtaaacagcccaaaccgcaaaacgttgcgccctgagggtgttgtcccggttcgtttcaaaaatgtaccgttcgggggtgtttgttaaggtttacccttaccaacaccaaaaaggggcctgaaacccctttttgggaagccgaaaaaggttttacacaggggctttgggaagtgcgggcctttggtttttaaaataaaaattcgcctgagaaaccctaagtttctttgaaggggagggttcaatcgggcctttttttgggtagtctgttttcccaaatgaaaaaaattaaaagggccgggtctactgtctccggatttggttccaaatttaagacttatatgggg

SEQ ID NO: 34401 - DNA, 7713 bp, Oryza sativa
attatcagttgtgaaacaaccctttatttaggttttttgtaaaaggtccggctttcaaaccaaaatatttccaaattcaaggcctattaaaagaggagaacatttccaagttctaataggggaaagggtgagaaccttttttcacattacacttgttaaaagaaattcctccaaaacattttggccgcttgccaaagcaatgaatgtttccgcgtggaatttatctaccaatattttttttattttgagacttctcaaatatcaatgtgtggaaccaaaatttagtggtttacgctattaaaataatttgccgcttaatttctgtcccagtcacaagatctttttttttcaggacatttagaattaatttgagcttcgggaacgtccaatttttttagtagaacagaatttttcatgatattttcacacgctgaatttgaatggtagaataccatctaatcccacctctattcccacttatactccaaactggtagggaacaagacatatcgtgacattgaatacagggggattggagaaaaggtattgcgtgtgggagcggggccaacccaaacaccacgtgggttggttttccttcggatcatttcccacggctagcgaaataggcctcaatcaattttggaaacggacgggggagtcgggtggcatcggatgtgaatttgggctcggtttcaacaatggcatcgggtgggaggtaggggatgacactgttcataggcccacatgtcagcgagagaaaggggcgaagggagtagatgcggactttggccgaaacaggggtgaaggctgcggatggcgtgactggcccgagaaggtgggaagaaaggaatgggccgggtttcggtccaaaggctaggaagaaattttattttattttccaatttaaataattgctgaaatgatctttcattcattaaaaataattacaatgctcaaataattccaggaaaattgtcgaaaatacttgggcaatcaatgtatttaacaaaattttatctagctcagtttgatgttcaaatttttcataaattttattcaaacacttgctttaattattgaataatttctaaaaattcctttttcacaacaatttatattttaatgatttttagggtgtgacaaatccaccacccttacaaaaatctcatcccgagatttgaaacggctagcaagaagttgggtagggcaatccttcgccgaccacttcctttatctggctttcatttttctgtgcttcttccaaaaaaagcctatcttctgtagttgcgttcttgtttgcctttctgaaatcaccatcccctcaaccttggtaggatgttgattaaaagatatctagtttactgtggtatcagatcggaggttcattctggctcatagtttgaacacccctgattctatcaaatccaggaaagtcttgcttagcgctagagccaaattatttccccagttgtcacatctctgagaagaaatgatatctgacattctgtctaattcaatctttcgaggtagaatgatttcctggtatccaacgaaaacaagtctcttatctattaattagattaaccagatattaaagccatctcgccatatttggtcctattatggcatcaagtgagttttgccacgagaactacatattttgatacatgctggttaatggaggtttttcaaactaatacatatgcatttcaatccaaggcatctcatttgtcacttctttctctttttaaaggaaggtttgaaaaagtgaacttttatgtatatgttttctcaaacttggacttgtccaaaaatgttgaattcatggatttcaagtaagagatacattagggtgaacttatgtaaataatattcatgtatctcttgcttccaaaacatgaaagatttcaaattttggatttatagccctttcaaatagcctgtttggtcaaaagtcgaaaatttgtgaagatcttttcaaaattgcttcaatatttgtttgtaacgtttttcaaagctgttggagtaaaaattattttattccaagcaaaatggcttttatccaaaatcttgtttcagcacatttttacttaaacttgcatgcatatggtgggtttagctaatttagctaatgttctttgtggatattggcttctctttacgtctctaactcatccaagattttacaaatgttaaacttcatgaaatctttttttttcgtgatgtttcaatgctctttccaagctcattttgagtttccaaaatctgaaaacctgaatttttcaggtttattaatatttatgagtggttgagatctcagcatggcttgcaaaataaaaacttgtgcgttatttataatccatctcaaagttttgttgtagatttttgagcccatgtttaccacaacctatcaagtgaaggcaattatgagtcaaatcgataaagcctcactcgagacaagagcttgaagctatgatgcatcaatcttcacgaactcatcgcttatctaaacacgtaagataacaaatgcggtcttgtccttaattatgaatgagtttttttctacttcatttgggttttttttccttgtgcttaacatgaaacccaagacaccttcgagtgaaatgcacggtgtgctcaatataagactgagcccaaggttgagaaggtgtgaagtgatgaaaatgaaaaaaatccaagaattaaccgactccaccaacatgtgttcttgaagaaagcaaacgggcatcttaacttagatgctcaaggtatccctaatgaccaagtgctttcaagtagtatcttcttctattgaaatttcaatttatatctttttggaataaggtccttggttattagacaaaccctcatacttaccatgttttcagctaatatttattgaaatcacgataggtgtggtgtgtgatgttgctaatgactcccaaatggagcatgttctctcaattatgctagataatggaaaaaaagagaatacttggggatgtgagacatcaagaagtccatgatgaccaagatggaatacttggtcaaccttcatcaactctagtcaacctctcacaaccgactatgaagaacttgaagtcatgcctccaacataagtgaatgggattgatgccaagggtactcaagagcaaagagacaccatgcaagctcatgtcccctcagtgcaccatccaagaattcactacattgttcaacgagatcacctcatcgataagattcttggtgatatcacaaatggggtaactattctatctcattgtaagttttctaagaattactcttttgttttttctttgaagccaattaggatggaagatacacttggtgatgtagattgggtgatgactacgcaagaagaattgaacaatttcactcgcaatggtgtatggtcattagtgaagagacacaaatataatgtcattggcaccaactgggtcttcctcaactaacaagacgataatggagtagtcacttgcaacaaagtacggtgtctcacccaaggattcatcaaagagtcaacaagatcatccctacaacatcctcaacaacatacataaaggagtaactatccattctcaatttacaaattttgtgaatgtgtaacatcctgaaaattcctgataataaaaatcactaaaaatttgaacctttttaaaacttttacatcatgctggatgttatggctgctattgcttgccaagccataaattgtcacaatgggaaattaaactaaagttgtacaactaagtaataattttaataataagatatttattatgaaccctataaatatttacgcacaagaaagcaaagctagacaaagggaaggttaattactaatttaaattataggtcaaatattaaatacttgaatcatgttgatgagtgtcatgaaatataagtacacatgaaataatggtcaccactataatgaccctatctataagtttcactagaatatttaaaacactttatcaagtctcttaaggcacaaaattcactcatataaaataattgttcatgtaaataaatttagctctctatataaaataggcttatgggagtatttgattcaatatttagacagacattgcaccaagtcacacagtggcttcatggaataaaaattaaatagattaaacctatctgtgtaaagtacattcctatacacataaactcggccaatgtgccattgtattaatagggccacatcggaatatttaatccaacgttattctcaatgttgtgaccttaggccacggacaagttcagggataggcgggaaagtacgttttccccacctatcctaaaaatgagctcggacacaaaatgcacggtattagcaagtggtatttctctattaagttatatcttgtcttgatacaggattttggccggcttatatagcccacagccgtacatgtgaggttataatcttgcccctataggctcttgtgagtttaccataatacccttgccatgtcagcaatcctaggggcaatttggaacattttggaggtgtttatggtcttttggtgccagctggcagaggtggttgagtgtggtcccatgcaatcttcttatggtatcttccttgctcaagtagtgttttccctcgagttcctcgattggacgtcttttccatcttgagagttcaaacattccttttcacctgttaggctcttagaatttacctgtcacaagtaaaagtctactcaagcgggataagctgctgaagtatcacaaaatcactcgaatagaactttaccactcaaatggaactttaccagtcgaatagtatttttcccaatcacaagtcttttccgagttggaaacttaggattctcaagacctcctttccctcggtgttttgattgaatgggaaggatgatgtttaccccatacaacaacaagcccctcacgggtaagggtgacatgtgtttttggccaaaacagtgctcgagttaaaagtagggggaaaacggccgtcctcctattcggtcaaaacacactgtttatttcatatatgctgatatgcatattttatttcttactatatatgcgttattattattattttttttgtgtgccacgtgtcaaccttgcattgcactaaccgaccggggggagggggttcgtcgcttcggtgctcgcgcccactcacccactcgcgacccccaccgccccgcgctatataaggggtgggggtcgctttcaaatagccactcctgctcttggccacgttctaaactagctcaaagacactcaagccgtcctcgaaatgtattcgagctagcactgtccaattcaatccaactttttagtgcgagctctctcttcttgagaatgggaaaagacataaagaagttagttggcaaggccaagtccacgaaatccaagtgttggcggtatgtcatcagacccttcaaccagacctgccgaaaccatgcaaccagcgaggattcgagctcaaggcgtcaagttcatctgggcgaagcccccatggcgaagactgtgaagcaaagggggcgaagggcgaaggatcgcgctggtatcccacaagaccaaaggcatcttgggcgaagactaaatggtgaagggtgcatgccgaaggagggtgacttcgccataacgagttcagcttcaaggaggcccaaggggccatcccagccgctcaagcccgttggcccttgggccaacgttcgctaattggcccattatagtcccatgtatcacaattacgctgtgtacccatgtaaatgtccctttcgtaagggcagccatgtaaattcccctgtaaaacctaaaccctaacggggtaacctgtgataggattataaatagaccctagggccatgtaaaagaggggatcccaagaaaaattccaaaattaatacacttcactgttcccaacaactgttgagtagccacgtccttcgatgtacgcagttgttgcttcgacaacagctggcgccgaccgtggggatctctgagcgaaaccattgagagcgaatgccaccgaagaaggtcacaaaggagagggttgctaagcgaaaggagagtgaatgtcacaccctgaaaattcaaattatataaattgttgtttaaatggaatttctagaatttattttaaaagtcttgaaaagaaaatctaagtttaattaataaattccaatataaaaaggggccagataaaatttcattaaatactttgcttaattctataattcctagatttttctgggatttatttgagctaaggaagtatttttaataaatggaattgcatttaagaaataatttaaattgaaaaaggttttaaaagtcctcttttggctttgggccgaaagtcggcccaaaacccgctctctctctctcctcggcccagccggcccagtccgcagccgccgcgcgcgcgcgttcggtcgctgacaggtgggtcccacctgtcagtcgtcgtctaccttcggccgccgccgcccgaaaccctagtttcgcgccgccgccgtttcctttccaaatccggccgttcctttccttctccggccgaattgatagaggggaaatgatctccgggatctcctctaccctttctccgttggaatcttcggctaattcgttttggaattcgtggaatcgagttcgaatcggatcggctttcctctctccaagccgaggtttccttcgccgttgccgtcgccgtgggcctccgccgtcgcctccgagcccctttaaaagcctccccggtgtctcctctacccgtcgccaccctcgccttcgcctctcgtcgtcggaatcgctctagcgccgtgtgccctagcttcgtcttcgctgccgccgctccagccgtgctccaccgtcgctccagccgtcgccgtcgctcgggaaggccgccgtcgtgttcgccgtcgcgtcgccgtcctcgtccgccccttcgccgtcgccggagatcgccggagcagcatcgccgtcgtcgacccgaaggtttccgccgtttccttctcgtcgccgtcgtcgtccgctgttcttccgtcgccgttttggtcaccggtgtgttcgccgcgtcgtcctctacgtgctggtgctctccgtttgcgtcctcgcgccgccgttcgccggtgagcgtgcgccgcccgagccgtccgagccgccgagccgccgccgccggggtgacgtcatcgctgacgccatcggggtcgtccgccgtgagccgccgtggacccgatcgatctcggccgtccgatttggattggttcgatctcggccgtccgttcgcgtgaaccgtcgcccgtgcgcccggtccaccgaaaccctagccgctgacgcaataaatccccttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgttgttttggtgattttgttcttttctgcttagattccgtcgtttccggagagtccgttttcgccggagaagagtttgaagagttccaaggccagcaaggcaagttacacagatcccaaacaaccctttgagcatgttgatcctatttaaag

SEQ ID NO: 34402 - DNA, 736 bp, Oryza sativa
  unsure (1)..(736): unsure at all n locations
agatgggaattttgatnaccncctgaagaaccancttggtttgtatgcccgcctgttgactttacgaggatccccgagtttaaagtatcatgagcttctttcagaattgcatcttttaaatctttgtttttagggacacagattctctgacccaaccatacagttccgtgctcatcctccaagaaaccgatagcttttcctcttctcatattcttcttgatttcttgaatatcaggatcattaatttgggcttctttaacttgatcaattagagtgggcttcgcttctaaggctgcaacaaaacctctactgacaattcctaatctttcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34403 - DNA, 1273 bp, Oryza sativa
  unsure (1)..(1273): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggatgatgtcagcatgacatcatcatcttctccttttccagttttttctaatagatgaaatcttcggaaaatcataactaaataaccgtagatccgtttcaggtggttcaagttgctaaatttttctaaaatcaagatctacatgttaaaaatatccacatgtactgtttatgcttgtttttgtattgttttgttgatttttattcttttgctttagtttccgacgttctgaaggagagcgtttccgttgaggaaggttcggaagtgtttgcggaagctcaaggcaagtcacacagatcccaaacaaccctttgagcatgttgaacccatttaaagctattattttatttcaactatgcattgttttcgaatgtcatcgggtggtgaacctttccccgttaattaatggccgaagatgatcttattttcctatgggttataatttgattagtatgaaccttatatattggattggttcagctaaatgctataccaacgggatcctctagagtcnnnctnnnggnngnttntgagnngtagcctaaccaat

SEQ ID NO: 34404 - DNA, 2587 bp, Oryza sativa
  unsure (1)..(2587): unsure at all n locations
aggctggtgtacaaaggtcctctacaagcagctggggcgaaatgtgaaggcctatgtcgacgatatcgtcgtaanaagccgcaaggctttcgaccatgtgtccgacttacaggaaaccttcgacaacttacgcgtggcaggtatgaaactaaaccctgagaagtgtgtttttggtgttcgcgcgggtaagttgttgggttttcttgtttctgaaaggggtatcgaggcgaaccccgagaaaatcgatgccattcagcaaatgaagcccccatcgagcgtacgcgaagtacaaaagctcgcaggccaaattgcggcgctcagtcgattcctctcaaaggcagccgaaagaggtttgcccttcttcaagaccctccggggcgcgggaaagtttagctggacacccgaatgccaagcagcgttcgacgaggtaaagcaatatccgcaaagcccacccactttggtcagcccagcactgggaagcgaactgctgctctatctagcagcttcgccggtggcagtcagtgcagccctcgtccaagagacagagtcaggccagaaacccgtgtatttcatctccgaagctttgcaaggggcgaagttaagatacattgaaatggaaaagtttacttacgccctagtgatggcttcgcgcaagcttaaacactactttcaggcccacaaagtcactgtgccatcacagtatcctttgggcgaagtgctccggggcaaggaaattactggctggcttagcaagtgggtggcggaattatctcccttcgacctgcattttgtcgcccgcactgccatcaagtcccaagtcctagctgacttcgtggccaaatggacaccggcgttcgcctccgaaaccgagcccgtcgaacaaccttgggtaatgtactccgacagctcgtggtcacacaagggggcgggcgccgtggcggtgctcacttcaccagggggcatgctgattcggtatgctgcaagactgcagttcgacacaaccaacaacacggcagagtacaaagctgtactgttgggcctaagaaaggcgaaagcattgggggttcggcgcttgctcatccgaacagactccaaacgggtggcaagccttcttgacaaatcttttgaggcaaaagaagaaggaatgaagaggtatctggaggctattcgatctatggaaaagtgtttcgccggcataacggtcgaacacctacctagaggccagaataaagaagccgccgccctggcaaaatccgctgccagtggaggcccacattcaccaggcatcctcttcgaagtcttgtacgcaccaagtgtgcccacagagagcctggacatcatggcagtcgaccaggcagaactgggcgaagacccagaggactggcgaacaccgttcgtgaagtacctcaagaacggttggctcccagaggacgaagcagaagcgaagcgcctacagctcaaagccgcacgatacaagcttgtctctgggtagctgtatcgctccggtgtgctccaaccctttcttcgctacatctccttcgccgaaggtgaagatatggcaaaagaaatacaccaggggctgtgcggtgcgcatcaggcagcaagaacggtcgcttccaaagtgtttcgtcagggtgtgtattggcccaccgtgctgaaagtttgtgttgagcaagtcaagaagtgcgaaagctgtcagcagcatggctgaagccaaacagcaccccagtacgaacaacaacctatcgcaccagtctggcctttcgccagatggaggctagatatcattggccctttccccgtggcacgaaatgggtacaagtttgcagttgtagccactgaatacttctcccgttggatcgaggccgaaccacttagcgcgatcactttggcagcagtacagaaggttgtgtgaaagaacattgtttgcccgttcggagtgccaaaaaattcgttactgacaacgggaagcaatttgattttgacacatttggagaaatgtgcgattggcttaacctagaaatcaagttgctttggtcacgcacccacagtgaatggggcggccaacctttcaatggtaaatgctttgagcgcttaagaaaagggttgagggggagttttgtttaaacgacaacctcctacgttgaaggactggttacccacagttgttggggtcagggaatgttttatatttggaaattttttggataccccttttcatgggcctagggtttatttgaacttatacaagttccccatttgggttggtttacaaggaaatacatggttcccttccaaaggtattttctggtcaccaggtttttgtacatggctttattggcatttgcgaaattgtccaaggcatgtgtttgcggtggatggcccaggcccttaaatgtatttatggaataacctttggagccctttcatatatttccaaaccttggtttggaacaggaactctcctctccgtttttaaattgcaggggttcccaaaaatacccgttaattttgtgtgtttgggcagtcgggtctttaccccacacccgaggtgaatattcccccccaatgttgtcaccctctcccg

SEQ ID NO: 34405 - DNA, 13346 bp, Oryza sativa
  unsure (1)..(13346): unsure at all n locations
agctgtgtaccgattacttgtcgnacccaacggntaaanntagaaatcaagttcgcttcggtcacgcacccacagtgaaatggggcggccgaacgttcgaatggtaagatgcttgaagcgctcaggaaaaggcttgagggggagctgttgtcaaagcgacaactacgtacgtcgaaggacgtggttacccaacagttgttgggtacagtgaagtgtattaattttggaatttttcttgggatccccccttttacatggccctaggggtctatttatgatcttatcacaggttcccccattagggtttaggttttacagggaaatttacatggttacccttacgaaagggatatttacatgggtacacagcgtaattgtgatacatgggcctataatgggccaattggcgaacattggcccaagggccaatgggcttgagcggctgggatggcccctagggcctccttgaagctggactcgttatggagaagtcaccctccttcggcatgcacccttcgccatttagttttcgcccaagatgcctttggccttgtgggataccagcgcgatccttcgcccttcgccgcttttgcttcacagtcttcgccatgggggcttcgcccagatgaacttgatgccctgagcttgaatccttgctggttgcatggttttggcaggactggtcgaagggtctcatgacataccgccaacaagcccctcacgggcaagggtgagataagagcttcggccgagaccgtgcaaaccatgtggtatggtatgacgcgcccccttttcgaccgacgctcctgccgaaacctatactggagtcctgcggagaatgtgtgcactatgtgtacatgtgtttctagctttcgccttttgcaaacggcgaagccgtctttatttttctctgggccgaaatgaacagtgatgggcttcccttcgtgggcttatcattgtgtggcccgatcaatgagaatttaccgtttcgcataccctcgtgacacgtggcggctcataattgggtgggaaggcgaaccggcgtctgggtgggttatatataccccctttttcactaccgcccccgtcattttcaccgcgagctctctctttctccgccctcttgcttcgcggcgctcttgaatactagacctttcgcctgttcctcttttcgccaccgcacacactttttgccatggctcctcgcaagccgaacccagccttcgcgacaggccctgatcccggcagaatcgatgatgacaccaccgcctttctaggggcttcgcttgtggacgacgacgagttggcaaagctggtcacctccggcgcattggcagagaatcaggccttcgccccggggaaggtagtggtgccgaagcctggcgacaaaaggaaggtggtcttcgccgtgttgttcgaggcgggccttcaatttctgggcaacgtgttgttgccggagatccttcgcctttttcaggtggagctcccccaattgagcccaatggcaaacatccagatcgccatcttcgactgggcgtgccggaccgctgggttcgagccgagcaccgagctcttcgacaccattttttatgccaccgtgaattcaaagacggtggtcactccggcaggaacaaagaagacggcgttcgggagcgtgaacttcaatgttcgccccgagcgctccgatctttggaaggtcaatgccgctatgcctaaatgggatcaccattggatgttgaagtggttctaccacagcatcccctttgaggccgggtttgaggaggcgaaagccctccgatggcggcgcagggcgatcgcgccgaacaggaagcccaaggtcaccgtcgatggcgctatggaggcccgattcgccctgcttcgcaaggtctgctcccgccttagctgccgtgacctggtggaagaattttgtatgcttcgaatcttccccctctcccaatcatggcaagtcgaggtgaaccaagacgaggaggtcgatggcttgccgaagctggtcatgccggagggggcgaacggtatgccccatacattcctgtgctttgcctttttccctgttcggcatctgatatgataacacgtttcgtttttgcagtgttaacccttgcttaggccgacatcgaagcccggaagatgatcggtgatgtgttgatcgctgagttcggccagctgcttatgcggcaggcggccggccgagcgaatcgggtgtatgacggtgatcttcctccccgagcgaagcccttcaaggccgatggcgatgaggggacatccaggaaacggacacacaggcaagtgaagttggctcctcggaagcgaagggcccctacctccaccgactccgatgcccacgacgaagacactgtcgaagatcatgacggcgaaaaggagggggaggatgagggggagacaaaggctacggccgaaaaggccgcggacgaggccaccaacaaccgcaccgagatgcgcggctacaccccaactccaagccccgaccatgtcaaaaccggggtagagtcgaacagctccccccaccgccgaaaggatttgaagggggcgaaggcgctggtttcgatcgcagcggccaaggtggcgaaggggtgtttggtcaagaaaacctccaaaaagaaagggctcgtcgatgtcgctcgcgttttcagcgacgacgagtctttggacgagacccttacttcgcctgctggtcggagcctaggtatctcgaccattcctggtgctgcggtccacgcgggcggagcgggtggtagcgttgctgtcgggacttcagcttctgctgatcgggttgtgaaggccgcggccagtctctacggcagccctgtgcgcaaactggtggcttcgccgctcgccatcgagaaggggaagaaaaaggccgccgaaacgtctgcttcagagtactctctagcggtgccccactttgcccctgctgatttcgatactcgggcagaccttgtccccttcgtcgagggggtaagtaatctcgtctctctggttggcagcccgagcctgttcaccgagctgaacgggttcgacgaaggctattctaccatcaagagcttggcagtccgggtatgtcgttcgtttttcttttccttttaatagtcatttttcgacaacttatattaacgatcacccttttcggccccccttttttcttgaactagattctcgcggcccattgttcgacggagagaaccatgcgtgctcatcttgacggcttcaagagccgtcttcgagccaaggacgatgaactgggccgcaagagcctggaaatggaaagcctcgccaacaccctcaaagagacgaaggcaaaaaatgagcggctccaagctgagctggagaaggggagcgaggcgaaaaccaagattgagcgtctcaaggccgagctcaaaaaagaacaagatttttctgccgccttgactgagtactacaacctcactgagccaaagatggaggctcttcgccaggaggccctcaaggcgtaggcgaacgctgagaaagaggcgcaacggttcgcgcaggagatggcgaaagccaccgagtccgccaagaccgtgtgccatacgcttcgccttgcccttactgacatgggggcgagagtacgaggactccctggcaaagatgcttccgtcttcgacttcttggagtggactcaacaggccggcggtgcgatctcagattgcgccactgcgtacggcgattattgtgcgcgtgtgtcggcggccttcaccatgggcctgctgcagcagttcaggtgcgagcacatcgtcgagttccccaattttgcgaagggggactgggaggtcagttctcaggacgttttgcccgcacttcgtgcctagcgcaaacagttctagcaaaaggacggccgatctactgccaaggcgcgtctacttgagcacatggcgaaggcagaggcggcggactagggcgaagagcctgtcacaccctgaaaattcaaaatatataaattgttgtttaattggaatttttagaaataattttaaaagtcttgaaaagaaaatctaattttagttaataaatgccaatataaaaagtggccagataaaatttcattaaatactttgcttaattctataattcctagatttttctgggatttatttgagctaaggaagtattttaataaatggaattgcatttaagaaataatctaaattgaaaaaggttttaaaagtcttcttttggctttgggccgaaagtcggcccaaaacctctcttctctctctcttcggcccagccggcccagtccgccgccgcgcgcgcgcgttcgcccgctgacaggtggggcccacctgtcggacccgtcgtcaacctccggccgccgccgcccgaaaccctagtttcgcgccgccgccgttcctttccaaatccggccgttcctttccttctccggccgaattgtttgaggggaaacaatctccgggatctcctctaccttttctcctttggaatcatcggttaaatcgctttggaaagctttggaaatgagttcgattcggatcggttttctttctctccaagccgaggtttccttcgccgttgccgtcgccgtgggcctccgccgtcgcctccgagcccctttaaaaggatccccgtgctcttcttttctcgccgccaccctcgccttcgcctctcgtcgccggaagagacctagcgccgtgcgccctagctttgccgtcgccgccgccgctccagccgtgcgccgccgtcgttccagccgtcgccatcgctcgggaaggccgccgtcgtggtcgccgtcgcatcgccgtcctcgtccgccccttcgccgccgccgaagaccaccggagcatcgtcgccgtcgtcgatccgaagagccccgccgtttcctcctcgtcgccggcgccgtccgttgcttctccgtcgctcttttggtcgtcggtgagttcgccgtgccgcccgcttcgtcccggtgccttccgtttgcgttctcgcgccgccgttcgccggcgagcgtgcgccgcccgagccgtccgctccgccgagccgccgccgccgtcggtgacgtcatcgctgacgccatcggggtcgtccgccgtgaaccgccgtggacccgatcgatctcggccgtccatcttggatcggttagatctcggccgtccgttcgcgtgaaccgccgcccgtgcgcccggtccaccgaaaccctagcccgctgacgcaataattctcttttccttttcaaaaataattcattattgcgtcataattcaatttaaaccgatataagtgttttaatccgatttaatctttaaaaattcataactaattcatcttagctccgatttagttggttcaagtctctaaatttttctaaaattgagatctacacactaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttcttttcaactattgcatttattttcgaatgtcattgggtggaattaacctattgtttgttatagcccttttgttcttgattacttaattccttgataccttgggttattataatttgactagttgagctttatttatattggttcaactagatattagatataattgcttagccctgcttagaaacattagcacacttatgggataactaatgactcactattatttcatgatggcctattgatagttcacgatgatcaatcgtgattagttaattaattaatgtgccaactaaaacctggtaatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggagcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactggtaataatttgattagctcctggtttggaatggtacattcctggtttggagatagaactgtgcagccggggtggttgttcagaatggttgggcctatacaacagggtatgttgtatagcgttggattaatattgtttaattacttaactgttttatcaaattctcaaatgtttgctaaatgctgcttttgcaaatgcaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctacgccgtttattttttttccgctgcttagatttttattgattgagagggactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttatccatagaagccctctaaaaatattggaaaagtagaactgttctcctccctttctcttttaattaaaccaaactaatggcacatgcacttcataatctcttttaatggttctcattaaaaatttattccagtgttattagtactatacatctattactgtactaatggctcatttaccagcaaaagttttataatactgttttatttaatcttgctgcaataaaataaattaagcatgttgatttgataatttttcttcatttctttagaaaccagttattcaaaattacaaaatttgtgacctcgtttccaattgttttaacttatctcgcaaagctgggtttactttatttgcttacctttttactctgattttctaactttattcaaattaatccaaaaacttgtgctattaattggataaaggtcttaactctctcctttcacttgtctttacatgccgcgttacaagcctgagtacctgtttggtgttgagggttttgtccaggagttgcgtacgatgtcctttgtcattcgatttgggactgcccctttttatgcccagattcctcatgatcgtcatgaaaagaagtgccgagtcaaagtcaccttgaacagtaatagtgaagatatcccctcagtgatgtttgaagctggaggaagaaactacatccatgcatgtcaggaggtggcaaggatcgccataagagagctccgtgatcgctacagtgatcaattggccgacactgagtatcgctaccatcctcgccaaccccagggaagtgaccgtggcagttaccttgagactgaaggaattgagaatgatgctaccacgaagcatttggttgagatgctgtgggctatggatgaaagtcgtgcggagactgtgttagcagctcaagatcgtgaagaccggaatcgtggtaagatttgcaagttagaagacaaggtggatcgtttagagaaggaattagccgcattgaagggagaagcaccgccgcagaaggccaggattcgtcttaccgcaaggaagagagctctatttgtccctcgctatcaactggcgccaaaggttcgtgtggtggagaaagaagttgccccagctcaagcggatcctccggtcatcatcataagtagtgatgaagaagaagaatccaagcgcaacaattccaagattgagtgggtagcaacccaagatgatgaagacgagccgaacgagccttcaattgacctccgatgcttggaagaactagagtgacttgttaagtcgttgtcttagatcgttgtgttagtttgcttgcttaaagtttgcttgtgtgtggctcgcatgtgatttacatcagtggtgggatgtaagtgcatgcgtttgtttgcttttgagtgttaggaagttggtgagtttagtggtgtgagagtctttagtttgtaataatgaaactcagttaagatcaataaaagttaaagtaattctctgtcctaagtagtttcccccgttttctcttcttgtgccctgtccatgccagatggtgaacactcgcagcaatgggaatggtcccaacaaccccaataacaacaacaatggagagaatcccactcttgctcaagttcttgctcaacagacacagcttatgaacatgatgatgcagcaatttcagaatcagcaaaaccaaggaaataatcatgcacctccacagaacaagttagcagaatttcttcgtgtgaggccgcctgttttctctagtaccactaatcctgttgaagctagtgattggctgcatgccatagagaagaagttggatttgcttcagtgtactgatcaggagaaggtctcatttgcatcacatcagttgcatggccctgcctctgaatggtgggatcacttccgcctgaataggattactgctgaacctatcacttggcttgaattcaccgctgttttccggaagacgcatataccatcaggagtagtgtctctcaagaagaaggagttcaggtcgcttacccagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctattcgtcaggaggacaagtacaatcgcatggagcagaagaaacgtcggattgctcaattcaagacacaacagggaaataatcagaagccgcgtcttactttaggaccccagcccatgccacagggaggttcttcgtctgttgttcgtccgcagcgtcagttcttcaacaacaatgctggcaacaacatccgtaatcaagctccacgtcctgttgcagctccagcacagcaacaacctgccaagagggagcaaggcaacaagcccgtggtgtgtttcaactgtggagacccaggacattatgctgacaagtgtccgaagccccgtcgcgtgaaggttgtccctgtccagaataactctgctgtaccagcatccaaggctcgtgtaaatcatgtcgctgctgcagaagctcaagatgctccagatgtgattttgggtacgttccttgttaactcagttcctgcaacagtacttttcgattctggtgctacacattcattcctatctatgagttttgcgggaaatcatgggatggaagtagaagatcttagacgtcctttgatggttagtaccccaagtaatcaagcactctctttgcaacgtagcccctctgtcagaatagaaattcaaggagtaccatttctggccaatcttatcttgttagaatccaaagacctagatgtcatcctagggatggactggttagccagacataaaggtgtgatagactgtgccaacaaaaaagtaactctcaccagctatgatggtcgagttgtaactgttcatgcattgtcatctgagtctttaaggtcaagactgaaccagataactttggaagagattcctatagtccgggagtatcccgatgtgttcccagatgatttacctggtatgccgcctaaaagggatatagagttcagaatagatttggtacctggaacaactccgatccataagagaccttatcgaatggcagccaatgagttggcagaagttaagaggcaagtagatgatttgctacagaaaggatacatcagaccgagttcatcactatggggagctccagttattttttgggaaaagaaagaccatacccaaagaatgtgtgtggattatcgtgcattaaatgatgtgactatcaagaataagtacccgctacccagaattgatgatttgtttgatcagcttaaaggtgccactgttttctccaagatagatcttcgatcagggtatcaccagttaagaatcaaagaggaagatatacctaagacagcttttaccactaggtatgggttgttcgaatgtactgttatgtcttttggacttaccaatgcccctgctttcttcatgaacttgatgaataaggtgtttatggaatacctagacaagtttgtggtggtctttattgatgatattcttatctactctcgaaccaaagaagagcatgaagaacatcttcgccttgcattggagaagctacgagagcatcaattgtatgccaagtttagcaagtgtgaattttggttgtctgaagtgaaattccttggtcacgtcatctcagccggaggagttgccgttgatcctagtaatgtggaatccgtaaccaattggaagcaaccgaagacagtttcagagatccgcagtttcctaggcctcgcaggatattaccggaggtttatagagaatttttctaagattgctaagcccatgacacgactgcttcagaaagatgtgaagtacaagtggtcggaagaatgtgaacagagttttcaagagttgaaaagtcgcttaatatcagctcctattttgattttgcctgatccaaagaagggtttccaagtgtattgcgatgcatccaaacttgggttaggttgtgttctgatgcaagatgggaaggtggttgcctatgcatctcgtcagttacgtccgcatgagaagaactaccctactcatgatcttgagttagctgcagtagttcatgcgttgaaaatttggcgtcattatcttttcggtactcgtacagaggtgtacaccgatcacaagagtttaaagtatatctttactcagccggatctgaacatgagacaacggagatggttggaattaagtaaggattatgacatgggaattcattatcacccaggaaaggctaatgttgtagccgacgctcttagcaggaaaggctattgcaatgctacagaaggacgacagttgccattggaattatgcaaggaatttgaaagattaaatttgggaattgtcagtagaggttttgttgcagccttagaagcgaagcccactctaattgatcaagttagagaagcccaaattaatgatcctgatattcaagaaatcaagaagaatatgagaagaggaaaagctatcggtttcttggaggatgagcacggaactgtatggttgggtgagagaatctgtgtccctgataacaaagatttaaaagatgcaattctgaaagaagctcatgatactttatactccattcaccctggtagtactaagatgtaccaggatctcaaagaaagattttggtgggcaagtatgaagcgtgaaatcgcggaatatgtagcagtatgtgatgtttgtcagcgagtcaaggcagaacatcagaaacccgccggtttgttgcagcctttgaagattcctgaatggaaatgggaagaaataggtatggattttattactggtttacccagaacgtcatcaggccatgattctatttgggtgatagtcgacagacttacaaaagtagctcattttattccggtaaagacaacctattccggaagtcgcttggcggaattgtatatggcaaggattgtgtgtttgcatggcgtccctaagaaaatagtgtctgatcgaggcagttagtttacttcaaatttttggaagaaacttcaggaagagatgggttctaagttgaactttagcactgcttatcatccgcagacagacggacaaaccgaaagggtgaatcagattttggaagacatgttgagagcttgtgctttagatttcggtggaagttgggataagaatctaccttatgcagaattttcatacaacaacagttatcaagctagtttacagatggctccttacgaagcactgtatggtcggaagtgccgcactccgcttttgtgggatcaaacgggagaacgtcaggtttttgggacggatatcctaagggaagcagaagaaaaggtgaaaatcattcaagaaagattgcgtgtggctcagtctcgtcataagagttatgccgacaatcgccgcagagatttgagttttgaggaaggagattatgtgtatcttcgtgtcacgcctcttcgaggggttcatcgttttcacaccaaaggaaaattggcaccgcgttttgtgggaccttataagattgtcagtagaagaggagaagttgcttatcagttggagttacctcaatctttggcaggattccataatgtgttccatgtgtcgcaataaaaaaatgttaaagatacctaccgaagagctaatattgagcaaatagaagtncaagaagatttgacttatgttgagaaaccactccgtatcttggatacaatggaaggaagacccaggattgagttttccgttttggaaattcatttgagtatcacctcggagaagatcaactcgggaccaaaagatgaattgaagtcaagtcttccgcatttgttcgcagtttttcggattctaaggaaaaaatctgtttaagaggggaagtttgtccaccccgaaatccaaaaattataactggtgggtaattggatatttaaaataattttaaaagctggaaaaaaaattaatttttgtataaaatgcccattttaaaaagaggccagaaaaatttcctagaacctcggtaatatcttaatcccacatattctggtgttatttggccaaggaaattttaataaaggaagggcttaaaaaaaatctaatgaaaaggtgaaaatctctttggtttgggaaaaaagagcaaatctttttttttttttgcaaaggcaatttccggtgggccggttctttagtgtggcactttgccctttaaatcgccccccgaaaatttgtgcgtgtttttaaaaaggcgtttttttccaattgtggaaaccgccccc

SEQ ID NO: 34406 - DNA, 3082 bp, Oryza sativa
  unsure (1)..(3082): unsure at all n locations
agaaagcaggcttttttatataatagnccctccgagaagggtattacttctaggaggaagattaatatattgtttataaagaaaagattatgtgttccgcgcacattatcctcaaaaaagcactcgtgggtagagaaacgccgtttttataccgcagacatatatagaaaaaaggaggtgtttggggaccctcttttcaccccgaggttgtggttaattaggtagaaacatattaacaaccgtacgctccccatgaggtgttatacgttattttttataagaagacgtggaaccaaaaattaacaccaaaaggggcgctacaccggtttttcgacgagtttctgggtctggtgttaaacataggcgccatcaaaacagatattttttaagaaggcgcccaaaaacgggttttaaataaccgcccccagatgggataaggaagaaaaatccgccttccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaacttacgagctttttggatgcgtactccggctatcaccagatccacatgaatccagctgacatccccaagacagccttcatcacgccgttgggtacttttttccacctcaggatgccttttggcctaaggaaagccggagaaaccttttccagcctggtatacaaaggtcttttccaagcagatggggcgaaatgtgaagacctatgtcgacgatattgtggtagaaagccccaaggcttttgaccatgcgtccgacatacaggaaccctttgaaaacatacgctcggcgggtatgttcgcgcgggcaaggttttgggttttcttatttttgaaaggggtatcaaggcaaaccccgaaaaaatcgatgccattcagcaaatgaagcccccgtcgagcgtacgcgaagtacaaaagctcgcaggccgaattgcggcgctcagtcaattcctctcaaaggcagccgaatgaggtttgcccttcttcaagaccctccggggcgcgggaaagtttagctggacacctgaatgccaagcaccgttcgacgagttgaagcaatatatgcaaagcccacccgctttggtcagcccagcaccgggaagtgaactgctgctctgtttagcagcttccccgctggcagtcagtgcagccctcgtacaagagagagtcaggccagaaacccgtgtatttcgtctccaaagctttgcaaggggcgaaattaagatacattgaaatggaaaatcttgcttacgccctagtgatggcttcgagcaagcttaaacactactttcaggcccacaaagtcactgtgccatcacagtatactttggccgaagtgctccggggcaaggaaattactggccggctcaacaagtgggtggcggaattatctcccttcgacctgcattttgtcgcccgcactgccatcaagtcccaagtcctagcagccttcgtggccgaatggacaccggcgttcgcccccgaaaccgagcccatcgaataaccttgggtatgtactctgacggctcgtggtcacacaagggggcggtcgccgcggtggtgctcacttcgctagggggcgtgccgattcggtatgctgcaagactgcagttcgacacaaccaacaacacggcaaaatacaaagctgtactgttgggcctaagaaaggcgaaagcattgggggttcggcgcttgctcatccgaacagactccaaactggtggcaagccaagttgacaaatcttttgaggcaaaagacgaaggaatgaagaggtatctagaggctgtttgatctatgaaaaagtatttcgccggcataacggttgaacacctactgtcacgcccagaaatttagcccaaatttctagactattttgtgtattaaatccctgttcaggaccagccagggtacacaaaacgacaagtaatatacaattccaaacgtaaataaagcgtacaatacttacagaagaggctcttagtgctcgcaccaaaaagaaacgacagcagcggaaaaaaatgcgatcctagcggggcttcagctccattccaaaggtaaaactcaactgggggtctgagccttggttttctaacttcgtcttcagctcagaagcactacacttctgaaaagggggaataatagcaaggctgagttcacccaccgtactcaacaagccacaccaacgatgcagacgtgcaaggggaacgcaaggacggtttgtggctatttgcataaaggcggttgtaaaacattttattgagcaaaacagtaaaactgttgagtaattaaagtaacattaaatctcccctgatcaacgttacaccacgttgaaaaggcccaaccaacccacctgaactacagtgcattgggtcaatttattaagtgtgagactaatggggatcctctagagtcgacatgcagacatgcaagatagattaacaatnnnnncaa

SEQ ID NO: 34407 - DNA, 2632 bp, Oryza sativa
  unsure (1)..(2632): unsure at all n locations
cctaaaataagagaagcgtgttataatatacaacctttagtaaagaccctcttagagaagaaacaagggttgttttccttatacacaccacaaaacactggggagagaggagggttttgtatatatacagcgtgttaatttttttggcaaactaaattggtgtgataaagactatttttctcttaagacccccttatggaaaggccacaaacacacttagaggggaggtgggatatataaggggaaacaaaaagataatgtggacaccacaaaccggggaggggatttagaatatttttcttctacaaggtgcacgttgtccaaaagaaaaagctccaccctgtggtaaaagagtggtaaaccaaaatttttttagggtccaaaaagacaaaggttagtgatatataaccaggttccaaaggccagattcagttaactaaccaaacaccccgttggtaaccccggctcccatgaatacacagcaagcatgttatttcaaaggttaaacattttaattaggcccaacatgcacaggggaaatgttacctgccatgtttctaccttttgtttcccgatatttttcttcgcgacggggaattttaaaacgacggattatacacgttgcacgcaaaccagggaaaatttttaataaccccaaggaaaatagtacataaaaagttaacaaacatgtagtgctcaattttagatgaattttgcaagttgaatggctcaattcggagttcgaatgaattagatatgaattttagaagttttgagccattttaattgatttctacaattattatcgaattatgatgcaattatcaattattttctcaaaggaaaaggcattcgctgatatcagcaaggggcgtcggcgccgacaggcgggcccaacgcgtcagcgggacaagggtgtcggtccaccgtggaccaggaccaccgagacggtccaccgccggtccacgggaactgacggcccggatcggcccaaagctgatccaatggccacgggcggcacggctggggcacggcacggcacaaagccaaccggccgaacgacggcgctgggcagctgtcacgcccagaaattcccgaatagaattccaagcagaatgtgcattaaaatccccgtccaggaccggccggggtacacagacgacaaagttgacatacagatccacgtcttacaaacattgtcaaagtcttacataaatgcagcggaaaaacgaaagataactggagctaagccttgacttgatctgcagcgagaacaccactccacaggcatcctcgacggcacggacgaagcctactcctcggagaaaccaccatctgacgcatactcaaactctggggtttggggaaaatagagcaagactgagtactacccactgtactcagcaagtatcacgcccggaaattcactagtaatttccgaacttatttgtgcataaaatcctcgtccaggaatcaaccgaggtacacaaactgacaatttaatatacaaatccatcttaataataacgttacatacttacaaaagaaaagaaaacagcagcggaattaacggtctagcgatggcttcagctccactcccacaggcagctcaactggggtataagccaaacgtcttctccttctggatcctttttcttcaactgaggtttgatgattattgcaagaatgagcatatgacatactcaacaaggcacacagcaaatatgcaagtgcacaaggataccaaaggatggcataatacaggctcatttgcaaaagcagcatttagcaaaacatttaagagaagtaaaacagtggagtaattaatcagaaattttattcaacactgaacagcacacccatgctgctcaggcccaaccatcctgaacaaccatactcggctgtacagatctaactccaaaccagggagctaagcaaattattaccagttataacatccataattattgtgagaggtgtgagactaatcacgaaaaacattgctcaacccgcccataaccgcgggcacggctattcgaatagttttactctggcaagaggtgtaccactgtacccacaagacacgattccacacatgttgccatgccccaaaataccaccacggcattgcaaagggggaaatcgtgacaataccctttgcacaacacaactcaaaacagtgcaccattcccggatcataatcacccccttataaacaaggcatggactccccagtgacccccgtggacttctcgccacttcacagtctggcacactataatgaaccatgctatacaaaagataaagccgttgcccatgctggcttgtggttggcacggtaaatgtttcacaacagtagctcgcgaaccggtctttaattgccatgagcacgaccttcaaaaccatatgctcacaacccaccttaaccaggttttaattatcaattaattaacatcacatgattaactttcaaatagcctgattggtcaccagtccaaaatttgtgaagatcttttcaaaattgcttcaatatttgtttgtaacgtttttcaaagctgttggagtaaaaattatggggatcctctagagtcgacctgcnggcntntgnccagnngatggtgcattcatcact

SEQ ID NO: 34408 - DNA, 5436 bp, Oryza sativa
  unsure (1)..(5436): unsure at all n locations
tgccaaggaatatcacattgagggggtaaacggcccgggaaatacgtggcctcggaacaaccttccttaaagatagccacgggtttgtttgtttccagaaagtgtttggcaaccacccgtaattccttatgctaggagagtcaacatatgtgcgttcttctttaagcttccagaatttntccggcttttctgggcagagagcaattttttgaggcatagcgaggtaagggtttaacttctgaaaatccttgcccgggtatgatcttttggttcaaaagccataacctccggtttcttcaaagcaccaaccccggcaggtaagtgtgtcttctgaatccttaagtaactcgccaaagtgaatgggtgggcttncgctntgttcaaccggatgtgatcccaccattctaaagaagttcctggcaactgatgtgaggcgaaacaaactttcttnctgatccggtgcactggagcaattaccaatttcttctcaacaggcgtgcaaacaattcacgtgcttccanttgggttggtagtgctaaagaagtaaggcggcctcacacgaagaaaatcagctaacttgttctgcggcggcggaggattgacattgttgttcccttgctggttctgcatttgttgcactaacatgttgatcaattgggtctgttgagccagcacttgagcaagggttgggttctcttcattgttattgtttccacttccactggcgcgagtgttcaccatctgttgcagattagagaagataggaggagaggggttacactaaagataagaccttaaccaggttaacactgatctgatgtgtgtagaccattatattgttcaagttgattaagcaagcaacctagtatagttacacactcatcaatgaactactccaatgatgggaatgcaactatacctacacacaaagcaaacaacaaacgttctaccctactaactattcttcgaggacagtttggcggcataggttctaagataggatccaaacttcattccatcttgaccacttgcacttcggttcttcctcgatccactttactggcctccataagttgacctcatcaacatcttctagtttcaacaactagtttcagaactactcaagttgaacgagagaggagagtagacaatgaaacaatttgcaaagaattctagataaggaagaaaggagaaattttcacaaattatgttttcggaagatttgtccttaaggtttgaccatttggcttatcctacagtcgagatggctctgataccaacttgtcacgcccggaaattcactagtaatttccgaacttatttgtgcataaaatcctcgtccaggaatcaaccgaggtacacaaactgacaatttaatatacaaatccatcttaataataacgttacatacttacaaaagaaaagaaaacagcagcggaattaacggtctagcgatggcttcagctccactcccacaggcagctcaactggggtataagctaaacgtcttctccttctggatcctttttcttcaactgaggtttgatgattattgcaagaatgagcatatgacatactcaacaagccacacagcaaatatgcaagtgcacaaggataccaaaggatggcataatacaggctcatttgcaaaagcagcatttagcaaaacatttaagagaagtaaaacagtggagtaattaatcagaaattttaatcaacactgaacagcacacccatgctgctcaggcccaaccatcctgaacaaccatacccggctgtacagatctaactccaaaccaggagctaagcaaattattaccagttataacatccataattattgtgagaggtgtgagactaatcacgaaaaacattgctcaacccgcccataaccgcgggcacggctattcgaatagttttactctggccagaggtgtaccactgtacccacaagacacgattccacacatgttgccatgccccgaaataccaccacggcattgcaaagggggaaatcgtgacaataccctttgcacaacacaactcaaaacagtgcaccattcccggatcataatcacccccttataaacaaggcatggactccccagtgacccccgtggacttctcgccacttcacagtctggcacactataatgaaccatgctatacaaaagataaagccgttgcccatgctggcttgtggttggcacggtaaatgtttcacaacagtagctcgcgaaccggtccttaattgccatgagcacgaccttcaaaaccatatgctcacaacccaccttaaccaggttttaattatcaattaattaacatcacatgattaaccatcgtgagctaccattaaatataaccataattaataagaataatataatatagtttataattaacccctttagttagctaatgtttctaagcatagctaagcaaacttacatatagcatttagctgaaccaatccaatatataaggttcatactaatcaaattataacccataggaaaataagatcatcttcggccattaattaacggggaaaggttcaccacccgatgacattcgaaaacaatgcatagttgaaataaaataatagctttaaatgggttcaacatgctcaaagggttgtttgggatctgtgtgacttgccttgagcttccgcaaacacttccgaaccttcctcaacggaaacgctctccttcagaacgtcggaaactaaagcaaaagaataaaaatcaacaaaacaatacaaaaacaagcataaacagtacatgtggatatttttaacatgtagatcttgattttagaaaaatttagcaacttgaaccacctgaaacggatctacggttatttagttatgattttccgaagatttcatctattagaaaaaactggaaaaggagaagatgatgatgtcatgctgacatcatccatggcggccggctcagatggcgacctcgccggagctagggtggtcggccgggaaaaaggagggcatgtacacgtagaggacgacgagacgaacccaacggtactcaccacaacgacaaacgacgtcggacgacgaccggcaacgagaggggcgacggcggcggctcggttgaccggcggcggaggggctccggtggccggcggcgaaggggaacgggcggccgagcatccccacggcttggcgcacctaaaggcgatggcggcaagcggcggcgacggcggagaaggctgctcggcgcggctgcaacccggccggcggcggcggcggatggtttcacgcggcgacggctctacgggtcacgggaggggacgggagagggggcaaacgaaagaggaggactagggggtcctatttatagccttggattgaagagatcggactcctcccgcaagaaatcgatccgggaaatcaaaaactcggttttggagataaactcaaaaacgagttcgattcggataaaatactcaacggtttgctccgattcttaggggaaaggatagaggagaacgagaggatcaaaacccctcaaaaatccggaagaaacggggccggattgggtgcggatttgaggcggcaaggcggcggctcgggctaggcatggccggccggccggaggtaggagaagcaactgacatgtgggccccacatgtcggcgcctgaaaaggagggggcgggcggctaggcttgagccgactcgggccggttttgggccggctcggccgcgcgggaaagagggagtgttgggccgaattcggcccaacgacttaagggagggcttttaaaactttttcaattaaaataatcactaaaatgatctttgaattgttaaaaatacttccaacgctcaaataatttcaagaaaaatcctgaaaatacttggacactaaaagtacttagcaaaattataatcagaccatttaatgattaatttaatatgtgggtaattactgaaatgctctttgtatgattaaaattaggaattgagctccgaaaaatccgagaatattccagagagtataattaaccatggagaatttaataaaaattaaatccatccatgctttatatttaggaaattttatttcccacatttaacttcatttgtaaattaatgaacatttaatataaattctaataataatttattaaataatttataaatcctgaaacaaaaatcaggatgtgacaaatctaccccccttacaaagaatctcgtcccgagattcggaacggctagaaagaaaagggcataggtaaactgcattctatcttattattccataactcagataattattctaaggctttaaagaaaactactgctgctttgaaactggtggctgagctgtaacacttgaagacgcaactcttgaagacgcaactggcactgcattagctcctgtgacaacaatgttgttgatctgaccttgcggctgctgatgcttcggcttcggacactctcttgcaaagtgacctggcttgtaacagttgaaacatacctgctgctcccttccactactgttattctcttgagactgatcctgctgaactggcaccggctgattagcttgctcgatgttaacttcattgctttcattagtctctgatttgatctcaccaccgatgttcaactgttgcgactgtccttgaccagtagaaaaagattcaccaatttggagtggcttgatacgctgcctctggctactatcctgtgcctcctggaaaacaatccttcctctcttacgattgtccatcctgttcttcttgtcttccagtcgaattgctttgtcaaccaactcctgaaaatcctcatagtcatgagagatcaacataactgacagctcatcctttaagccttccaagaacttctcctgcctttcctcgtcagtacgcacatcttctggagcatagcgagctagacgattgaactcatgaagatactctgccacggtatgatccttttgcttcaaagccctaaactcacgtttcttcaaagcaacaacacctgcaggtatgtgtgtcttcttgaatgcctcagtgaactccgcccaagtgattggttgtccttctgctctgttcatccggatgtgatcccaccattctgaagcagatccttgcaactgatgtgaagcgaaaacaactttcttctgatccgtgcactggagcaattccaacttcttctcaacagcgtgcaaccaatcacctgcttccactgggttggtagtgctagagaaggtaggcggcctcacacgaagaaaatcagctaacttgttctgcggcggcggaggattgacattgttgttcccttgctggttatgcatttgttgcactaacatgttgatcaattgggtctgttgagccagcacttgagcaagggttgggttctcttcattgttattggggtgcagagcggacantcaggnttcaaatcc

SEQ ID NO: 34409 - DNA, 9308 bp, Oryza sativa
  unsure (1)..(9308): unsure at all n locations
agggtttgtaaaaggggccctatagattgtaactctgccccccacaaacaagtaggcccgctgttcttaacaacggtgtctatattcccgaaatataagggaaaaaaaccggacccacacccatcccggtgaatgcggaatagtttgaaatgggaagaggtaaatggtcggtttcctctccaaccaggtattccttcctgttccgtcgcgggggctccnccttgcttcagagcactttaaagcttccgggttaactaaaacgtgnccaacttgtcttggcctttggtgttggaaagccaacaacacggtgtgccaagttggtattcctgccccggtacaacggtgatccacgttggtcaaacgttcacgtcgctgggaaagcccacgtggtgataacgttgggtacctgtcatagtcggcacattcccgtcgcagagatacgccggagaagcatcnccgtcgtcgaaccaaggtattccaccgttacatactggtcgcggtagtcgaccgctgttcttcagtcgcagtattggtcacggtgtgttcgccgcgtcgtcataaacgtgatggtgctcaccgtatgcgtcctcgcgccacggttcgccggtgagcgtgcgccgcccgaacagtccgagccgcgaagccgccgccgccggggtgacgtcatcgctgacgccatcggggtcgtccgccgtgagccgccgtggacccgatcgatctcggccgtccgatttggattggttcgatcacggccgtccgttcgcgtgaaccgtcgcccgtgcgcccggtccaccgaaaccctagccgctgaccccataaatccccttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgttgttttggtgattttgttcttttctgcttagattccgtcgtttccggagagtccgttttcgccggagaagagtttgaagagttccaaggccagcaaggcaagtcacacagatcccaaacaaccctttgagcatgttgatcctatttaaagctattatttcttttcaactattgcatttattttcgaatgtcattgggtggaattaacctattgtttgttatagcccttttgttcttgattaccttattccttgataccttgggttataataatttgactggttgaactttatttatattggttcaactagatattaggtataattgcttagccctgcttagaaacattagctcactattgggataacttatgattcactattatttaatgatggcttaatgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgcttataagggggtgattatgatccaggaaggtgcgctgcagtggattgtgttgtataaggggtattgtcacaactcctttccgaggtaccgtggtggtattgaggcacatggtgacatgatgtggggttgtgtcttgtgggtacagtggtacatctctgatcagagtaaaactattcgaatagccgtgcccgcggttatgggcgggtcgaacaatgtctttcgtgattagtttcacacttctcaccatagtaaatgatgctataattggtaataatgtgattagctcctggtttggaatggttcattcctggtttggagatagaactgtgcagccggggtggttgttcagaatggttgggcctatacaacagggaatgttgtatagcgttggattaatattgttaaatacttaactgttttaaattctcaaatgtttgctaaatgctgcttttgcaaatggagccctattatgccatcctttgttaccctgtgcacttgcatatttgctgcgtggcttgctgagtatgtcatatactcaccttgcaatcattcagcagaggaagagttctacaatgaggctgatggagtggaggattaggtgtagccttggtcaagctgcctgtggagtggagccgtctgcgccgtttattttattttccgctgcttagatctttattgattgagaggaactatctacctctgtaatgacattttatacgcttattaattagagtaataattgtactctattatcaatttgttattgtgtgcctcggctgattcctggacgagggttcacacacatgtaagcgtttggaattttggatagaaattccgggcgttacaagttggtatcagagccccttgaccctaggttatgccaaatggttacccatagaagccctctaaaaatattgcaaaagtagaactgttctcctccctttctcttttaattaaaccaaactaatggcacatgcacttcataaatctcttttaatggttctcactcaaaatttattccagtgttattagtactgtacatctattactgtactaatggctcatttatcagcaaaagttttacaatgttgtttcatttaatcttgctgcaataaaataaatttagcatattgattttataattttcttttatttcttttgaaaacctgttattcaaaagtacaaaacttgtaaccttgttttcaactatttcaactcatcttgcaagtttggtttactttatttacttaccttttactttgattttctaaactttattcaaattaatccaaaaacttgtgctattaattggataagtgtcttaactctctcctttcacttgtctttagatgccgcgctacaagcctgagtatctgtttggtgttgagggttttgtccaggagttgcgtacaatgtcctttgtcattggatttgggactgcccctttttatgcccagattcgtcatgaagagaagtgccgagtcaaagtcaccttgaacagtaatagtgaagatattccctcagtgatgttcgaagctagaggaagaaactacatccatgcatgtcaggaggtggcaaggatcgccataggagagctccgtgatcgctacagtgatcagttggccgacactgagtatcgctactgtcgcgtcccaaatcgactctaaaattcatcctcaaaattgtgcaaaagaataagtaaaattcgtgtgaaagcctccaacaattaaaatgtgcaaagataaaagtcaaatgaggcttggaggatttttgtatatttcctaaaagcctaaaatgcttaaataaattttagtggaattttcagagcacaaataataatagaaaagaaataaacaaagttaaaaaggttttataaaaagaaaaccctaaaagaagtcttttccccctcctcctcccttcttgggccggctcggcccattccttccctctccctctctctctcttcccccgcggcccatcggctccccgcgcgcgcgcgccgctgacaggcgggcccgcccgccactctcgctgacgggtggggcccacctgtcatcgccttcctcccgccgcgcccgccgccgcgcccgtgccctatcgccgccgccgccgcggattgcgccgcattccgccgtccccgcgcgcattaaagagagggggaatcactccccgtgattccctctcccgtttcccccgctttcgcctctctctctccctcggattcgctcggatttaatcccgcattcatcgcccgcgcatctatggcggccgaaatctccgcgaccgattcctccctctccggccgctctttccttcccccggcgctatttaaacgttgcccgagcttcgctcttccgtttccgccgctcgccgctcgctctcgccgtcgggttcgtgctcgcgccgtgctcctctcttttcgccatcgccgccgagctccgttccgccgccgccgccgctccggacttcctccttactcggcgacacctccgtccgcttcgccgtgttgccgccgaccccgtccgccgctccgcttcgcccgtcgactgccggagcgccgtcgtcatcgtcatcccgaaccgcgccgccgtcttccttcgctccgtccgtcgtttccgccgccctcgtcgaccggggtgagccgaagaccgttccgttcgctttccccttccctcctctctctcgggtgccactccgccgcgccgttggtcgccggcggcgaccatcggggcgcgggtgcgcgtcctcctcccgtcggccgtgccggcgagaccgccttcgggcgcgccctcgcggctgccaagtgggcccggccgtcagccgcccgcgcccgcgggtgcggctgacgcgtggtacccacggcgccgaccgccgccagcggggtgcgcccggtccaccgtggacagtggggctaccgcgtggcccccactcccgtggacacggtccgcgcgccccgctccttcggctgacgcaataaataggatttttaattgaaaattaaatgaagaaattcgcaaatatccatttaaagagcatataaacttcaaatggccatatcttggccatttgaactcggaattggaccgttcaagtctctaatttttccttaagatgtaaagaacccatttttgtgctttgtttctgctgttatgtggagttatttagtgttaaagcctttttcttttccgttggtcgtgtagacgctgcagcttcggaagatccgctcttcgtggaagtcgaagccgtcgattgggaaaacgagcaaggcaagacacatcatcttgatcatattgaatcccattttataaaattatgttgatttaaattattgcattatcgctttatttaaattcccgcgttatcactattttacttagccatgcctatttacctttgttatgaccatattattattgttattgttattattactaccttgttcaccctagacaaacaaaacctcaactagtggacactctactcatggtatccctagtatgattttaggtagatgcttcgcaatctaattaggtaaccttaggtggttttacaactatagactttgggaaatattcatatcacctggatactctggaattgttggtttattgtggaattggactcacaccatccccctttattcaaaatccccaaaatggttttaggctgggctcggggtgcatggttttgatagtagcacctcggccgtttaaggaccggtcttcgggcctctgttgcaaagcactaccgtacttccacatgtctaatgggtaaggcttagtttgtggctcagtctagtcatagacaaaagtacacggattggagatggatgaagtcgggcgtcgatggacattctccagggcaaatgaaggctacacgagctgcggcccggtagtcgagatgtcatacggcagagggttggtgccctgctgctaggggctcagttctgcctgcctgtcccgggtatcccggccgtaggtgggattgggtcggtactcttgtctaaggctaggatgggttggaaactatgtcacgtcttccgtccgtataccgtggtggtatgtggcacgtggcaacacgtgaggaagatgtgtcttgtgggtaaagttgtacacctctgatcagagtaaaatctattcgaatagccgagccctcggttatgggcaagccgagcaatgtacccaagttagtgttttaattcttaaaacttgcttaacaactaaaatatggaatggttggcctgggttggcttaggacgagctgggacccagggtcgggttgccagttcggtctgaatcatcataggccttgggttaaggcaggttcgtgcgggttcacggccttgattaataatattgtttagttctaggatcgcgtttacaaagtagctttgagcaactaaatgtctttaaatgctgtttactgcaaccctaaccctttatattataattcccttgtactcccttgcatttattctgcattggtgggtgtgtcttgttgagtacggtggttgtactcagtcttgcttaattttcccaagcccagatgaggagttcctggaagatgaaggctttggtgtctagctcgtgcctgccgtcaagcgcctgtggtcgtcgccctagtcttccgctgtttttcgttgtctttgagtgtgctgggccttcgttgcccatgtaataattttatatacgcttccgcttgttaaactctgtattgtatcaacttttggtgtaccttgcctcctgggacaaggaataatacacgcacgtcgggaacgcctgttgggtgatttccggtcgtgacagctaccatcctcgtcaacctcagggaagtgatcgtggcagttaccttgagactgaaggaattgagaatgatgctaccacaagatatttggttgagatgctgtgggctatggatgaaagtcgtgcagagagtgtgctagcagctcaagatcgggaagatcggaatcgtggtaagatttgcaagctcgaagataaggtggatcgtttggagaaggaactagccgcattgaagggagaagcaccaccgcagaaggccaggattcgtctcaccgcaaggaagagagctctatttgtccctcgctatcaattggcgccaaaggttcgtgtggtggagaaagaagttgccccaaccctagcagatcctccagtcatcatcataagtagtgatgaagaagaagaatccaagcgcaaccattccaagattgagtgggtagcaactcaagatgatgaagacgagccgaatgagccttcaatcgacctccgatgcttggaagaactagagtgacttgttaagtcgttgtcttagatcgttgtgttagtttgcttgctttaagtttggttgtgtgtgtgggtcttgcatgtgatttacatcagtggtgggatgtaagtgcgtgcgtttgtttgcttttgagtgttaggaagttggtgagtttagtggtgtgagagtcttcagtttgtaataataaaactcagttaagatcaataaaagttaaagtaattctctgtcctaagtagttttcccccggtttctcttcttatcctgtccatgccagatggtgaatactcgcagcaacgggaatggtcccaacaaccccaataacaataacaatggagagaatcccactcttgctcaagttcttgctcaacagacacagctaatgaacatgatgatgcaacaatttcagaatcagcagaaccaaggaaataaccatgcacctcctcagaataagttagcagaatttcttcgtgtaaggccgcctgttttctctagtaccactaatcctgttgaagctggtgactggctgcatgccatagagaagaagttggatttgcttcagtgcactgatcaggagaaggtctcatttgcatcataccagttacatggccctgcctctgaatggtgggatcacttccgcctgaataggactactgctgaacctatcacttggcttgaattcactgctgctttccgaaagacgcatataccatcgggagtggtgtctctcaagaagaaggagttcaggtcgcttactcagggatctcgctctgttacggagtatctgcacgagttcaatcgtcttgctcgttatgctccggaagatgtgcgcactgatgaagaacgtcaagagaagttcttggaaggacttaatgatgagctttcttacccactcatgactggagattattctgatttccagaaattggtggataaggctattcgtcaggaggacaagtataatcgcatggagcagaagaaacgccggattgctcacttcaaggcacaacaggggagtaatcagaagccgcgtcttgctttaggaccccagcctatgccacaggaggttcttcgtctgttgttcgtccgcagcgtcagttcttcaacaacaatgctggcaataacatccgcaatcaagctccacgccctgttgcagctccagcacagcaacaacctgccaagagggagcaaggtagcaagcccgtggtgtgtttcaactgtggagacccaggacattatgctgacaagtgtccgaagcctcgacgcgtgaaggttgtccctgctcagagcaactctactgtaccagcatcaaaggcccgtgtcaatcatgttgctgctgcagaagctcaagatgctccagatatgattttgggtacgttccctgttaactcagttcctgcaacagtacttttcgattctggtgctacacattcattcttatctatgagttttgcgggaaatcatgggatggaagtagaagatcttagacgtcctttgatggttagtaccccaggtaatcaagcactttctttgcaacgtagcccctcggtcagaatagaaattaaaggagtaccatttctggccaatcttatcttgttagaatccaaagaccttgatgtcattctagggatggactggttagccagacataaaggtgtgatagactgtgccaacagaaaagtaactctcaccagcaatgatggtcgagttgtaactgttaatgcattgtcttctgagtctttaaggtcaagactgaaccagataactttggaagagattcctatagttcgggagtattccgatgtgttcccagatgatttacctggaatgccgcccaaaagggatatagagttcagaatagatttggtacctggaacaactccgatccataagagaccttatagaatggcagccaatgagttggctgaagtcaagaggcaagtagatgatttgctacagaaaggatacatcagaccgagttcgtcactatggggagctccagttattttttgggaaaagaaagaccatacccaaagaatgtgtgtggattatcgtgccttaaatgatgtgactatcaaaaataaagtaccccctacccaaaattgatgaattgtttgatcagcttaaaggtgccactgttttctccaagataaacttcatcagggtttcaccagttaaaatcaaagagaagatttcctaaacagttttaacacttggattggttggtcgaatgtactgttatgtctttggacttaccaaggccctgcttttttatgaactgatgaaaaggggttatggaaacctaacag

SEQ ID NO: 34410 - DNA, 6037 bp, Oryza sativa
  unsure (1)..(6037): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgattaataatattgtttagttctaggatcgcgtttacaaagtagctttgagcaactaaatgtctttaaatgctgtttactgcaaccctaaccctttatattataattcccttgtactcccttgcatttattctgcattggtgggtgtgtcttgttgagtacggtggttgtactcagtcttgcttaattttcccaagcccagatgaggagttcctggaagatgaaggctttggtgtctagctcgtgcctgccgtcaagcgcctgtggtcgtcgccctagtcttccgctgtttttcgttgtctttgagtgtgctgggccttcgttgcccatgtaataattttatatacgcttccgcttgttaaactctgtattgtatcaacttttggtgtaccttgcctcctgggacaaggaataatacacgcacgtcgggaacgcctgttgggtgatttccggtcgtgacaagttggtatcagagcctcccttgaccctaggacgagccgtagatcccaagccttagcaatattttcaaaaataaaaatcctttattatttgtgaaaacccgctattctctctttgtcttgctgcttcacttatcatcaaaatctgtcctttaaaatgttgtttctctttttgtttttgtttgtagatggccggcagcgttacccgtcgtggtttggacatgactggcttcgttttggagctgcggggcatgtgcgtggtcttggggtatccacatggagtggattaccaggccaggccgctcccggagcaggagggtgaggatgcagagccccgcgctggttgggaggtcactgcagtgatcctcgccggctcttctgagcggacttcgctgacagtcaccgcgggtggcgactccttccccgccgcttgccagaacgccgctctcttcgccatcggcacccttcaccagcgctacccggacgagttgcagcactcgccctaccgctaccaccctcgtcgcggaggagcccgcgattacgccaccttccgagacgccagctcggaggatgacgctaccgtcgtgcatctggcacgcatggtggaggcgtacgacgcggctcgtatcgacttccatcagatggtgcgccgtggcatggtcgagaacaacatgaagatcctggagctgcgtcaggagaacctgcagctcaagaaggacctcgacgcgttggaggcgcagctgcatcagctcaagatcgcccagggagaggacagccgacccaagcgtcgccgcgtctgccgcagccagaagatcaccgcccgcaagagcacctccaggcctgagcttgttcgtcagtccctggcgtggacctgcttcgtcgagacccctcgtgccgagcctgcgcccgtggttccccaggagggggaagcctccggcgttggtagctcggagggtgcgctgttgctcaccttccgtcctggcccgtcgcagcgttagacgagcagttagtaggcttgcgcgtgtgttttttctcgtttgtcttttttgagttgtgtggggcatggttacaccggtgtgtggtgtaactatgtcggagcctgtctttatttgtttgcctaagcaacttgaacattaatgaaccaatttaatagcagtaataaattcaagaattatagtagtcgtgggtggttagttttaatcgtcagctctccttctctgtttgctggttctgtgtggggttttcagatggtgacgaccaggagaaatgttaacaccggtgaaggcaaccaacccgaaggcagcaaccacaaccaccaaggcaattcacctccaccttctgctcggcttcaccaccaccaccagacaccaacgccattctcacccaaatcctcgcccagcaagctaacctgatgaatgctttcctccaccaccttcaaaacccgccacaacagaatgctccaccaccacctccccaacactctaaactcgccgagttcctccgcattcgttcacctaccttctccagctccaacaatcccgtagatgctttggattggttgcatgccgtggggaagaagttagacactgtgcagtgcagtgacaaggagaaagtcgtcttcgccgcccaccagctgcaggggcccgcatctctctggtgggaccacttccaggctacgcagccaggggggcagccgatcacttgggctcgcttcaccgccgctttccggaaaacccatgtgcccgccggagtcgtggctctcaagaagagggaattccgagagttgaagcaaggcaaccgctccgtgatggagtacctgcatgagttcaacaatctagcccgttatgccccggaggatgtgcgggaagatgaggagaagcaagagaagttcttggcaggaatggaccccgagctgtctgttcgtctagtctctggagactacccggacttccaacgactggtggacaagagcatccgcttggaagccaagcacaaggagctggaatcgcacaagcgccgcttggcgaatttccgcaatcaacagggtgctaaccagagggtccgctacaccaatccctacccagggggatcctcctcgcagcagcagcagcagcagcaacctcgcccagcgcctcgacctcaattcgtggtgcgcgtcccacagccgcagcagcagcagaatcaacaagggactcgtgcgccccgtcctcctacgccagctgtgcagcccgttcaaggccgcagggacgctcaaggtcagcagcgtctgtgcttcaactgcttcgagcccgggcactttgcggataaatgcccaaagccgaggcgccagcaaggccaagcgcctccccgccccaacaacggtggtaaggatgtcattcggggtcgggtgaaccacgtgactgccgaggatgtgctgacgactccagacgtcatcgttggtacgttcctcattcattctatccctgctaccattttgttcgactctggagcttcccactcgtttatatctgtgccattcgtggggagaaatcagttgggggtagaaaggcttagaaaccctctactcatcaccacccctggaggggttatgacagcaaagtattatagccctgccgtccctatagaaattcaggggattccttttccctcggatctgattctgctagacaccaagaatttggatgtgattcttgggatgaattggttggctcaattccaaggagtagtggattgcgcgaggcgcactgtcactctgtaccgagggccagaacaaccggttgttttctttgcacccccaacctctgccagaagttcagaacttcatcagatagaactgtcagaaatccccatagtcagagagttcggagacgtgtttccggaagaactacctggtatgccgcccaagcgagagattgagttccggatagatcttgctccaggaaccactcctctgtacaagcgaccctaccgtatggcagcaaatgaactagccgaagtaaagaaacagttggaagagttgaaagaaaaggggtacatacgtccgagtacttccccatggggtgctcctgtgatttttgtagagaagaaagacaagacgaagaggatgtgcgttgactacagagctctcaatgaagttaccatcaaaaacaagtaccctcttccccggatcgatgatctgttcgaccagcttaaaggtgccactgtattctccaagattgatcttcgttccggatatcaccaattacgtattcgtgaagaagatattccgaagaccgcattcactacgcgatatggactgtatgaattcacggtgatgtcgttcggcttgaccaatgctcctgccttcttcatgaacttaatgaataaagtgttcatggaatacttggacaagtttgttgtggttttcatcgatgacattctgatatactcacaatcagaggaagaccatcagcaccatctccgtctggtgttgggaaagttgcgggaacatcaattgtatgccaagcttagcaagtgtgagttctggttgtccgaagtcaaattcttggggcacgtgatatctgctaaaggagttgctgtggaccccgaaacagtgatcgccgtcaccgattggaagcaacccaagacagtcactcagattcgcagtttcttgggtttggcaggatattaccggagattcattgagaacttctccaaaatcgctcgacccatgacacagttgttgaaaaaagaaaagaaatttgtgtggagcccgcaatgcgagaaggcgtttcaaactctcaaggaaaagctggtttcctcgccagtgttaatcttgccggatactcgcaaggatttcatggtgtattgtgatgcttcgcgccaaggattggggtgcgtgctcatgcaggacggtcatgtggtagcctatgcctcacgtcagctacgacctcatgaaggcaactaccctacacatgacttggagttagcagcggtggttcatgctctaaaaatctggcggcactatctcattgggaaccgctgtgaaatatatactgatcacaagagcttgaaatacatcttcacccagtcggatctgaatcttcggcaaaggagatggttagaactcatcaaggattatgatgtgggaatacactatcatcctggtaaggccaacgtggttgccgacgctctaagtcgaaagagccactgcaacactctcaacgtccgaggcattccacccgagcttaatcaacagatggaagccctgaacctaagcatggttggtcgcggattcttggctgcgttagaagccaagcccaccttgctcgatcaaatccgcgaggctcagaagaatgatccggacatgcatggactcctcaagaatatgaaacagggtaaagccgctggtttcacagaggatgaacacggaaccttatggaacggaaagcgggtatgcgttccagatagcagagaacttaaacagctgatacttcaggaagctcacgaaagtccttattccattcacccgggcagtaccaagatgtacttagacttgaaggagaaatactggtgggttagcatgaagcgggaaattgcagagtttgtggctctatgtgatgtgtgccagcgtgtcaaggcagaacaccaacgaccggccggacttctccaacctctccaagtgccagaatggaagtgggatgaaattgggatggatttcatcaccggacttccaaaaacccaaggtggatatgattctatatgggtaattgtggatcgactaacaaaggtggctcgatttattcctgtgaagaccacttatggagggaacaaactagcggagctctacttcgctaggatcgtgagtctccatggtattcccaagaaaatcgtatctgataggggaagccaattcacctctcacttttggaagaagctccaagaagagctgggtactcgattgaatttcagcaccgcctatcacccgcagacagatggacagaccgagcgtctaaatcagatcctagaagatatgctccgcgcatgtgtcctagatttcgggaagacttgggataagagtctcccttatgccgagttctcctacaatagcagctatcaagccagcacccaaggggatcctntanntnnnnctnnnggngggttctacagctatcaaacccctgnnggggngngggganagtgggatagaaatagaagtgnttagaaagaaggtcaaacaatgatagtntgaagagagagtataagaagcataacgaagataggagtga

SEQ ID NO: 34411 - DNA, 1410 bp, Oryza sativa
  unsure (1)..(1410): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcgcagtggatgattttgtgtatcttcgggtcacgccattgcgaggtgtgcacaggtttcagacaaaagggaagctcgcacctcggtatgtgggtccttttcgtatcactgctcgacgcggagaagtcgcctaccagctggagttgcccgcctccttgggcaacgtgcatgatgtgttccatgtgtcgcaactcaagaaatgtcttcgagtgccatccgagcaggccgactcagagcaaattgaagttcgcgaagatttgacctacgtggagaggccagtgaaaatcctgaacaccatggagcgcaggaccaggaaccgagtaatccgtttttgcaaggtccagtggagcaatcacgccgaaggagaagctacttgggagcgtgaagacgagctgaaggcagcccatcccgatctcttcgccagttcttccgaatctcggggtcgagattccgtttaaggggggtaggtttgtcgcgtcccaaatcgactctaaaattcatcctcaaaattgtgcaaaagaataagtaaaattcgtgtgaaagcctccaacaattaaaatgtgcaaagataaaagtcaaatgaggctcggaggattttgtntattttctaaaagcccaaaattgctaaactaaatttagtggaatttccagagcccacaatatctatcaaaaggaattaacatagttaaaaaggtttttttaaaagaaaaacctgtaaagaaaattgttgcccctccttctcctttttggggccgctggggcaatcctttcctttccttttttttctttccccgcggcatttggttccctcgcccgccgcggtttcaagtggccccgccgcaactttttttaaggtggggcccactttatttgttttttccgcggcgcacggggggccgtgcctatgcgcccccccgcggtttggccattccgcttccgcgcctttaaagagggataacccccggtttccttcgttccccctttggctctttttccggggttgcggttataacccttttgcggcgtttttgggcgaaatttggagtttttcttttgggggtttctttcccgggtttatattgcgagttttttttttcccctcctgacttttggtttttttcgccgggtttttttaactagcgaatattttgccgcggttaatttttttttgtaacacccgttttttgaaaaaacgcccttttttctggggggagagttgtttctccaccccccccg

SEQ ID NO: 34412 - DNA, 6020 bp, Oryza sativa
  unsure (1)..(6020): unsure at all n locations
gatgataataancggtcagaccacctgttcccagtgctgtctatcctattgtgaggggatgctggctccggcgactgacctctactgatgagtgtttactgtgtggaccttgtccactcttacccgactgcgtcgactgtgcggtgcggcggcgagtctatcgactgctagcggtggctggagtatcttgagcggcatctacggatgggtgcactgcgcgtgagcgatggggagcatgagtgagttcggcgagatggggaaaaagagagggggggtggcggcggatcttaaattggggagggggaactcggatgtggccggtatgggcgggattctcctgccgacgtttggagtggtggatggctctggcgggagagatggggaagtgggtgcgggagacgcggcgcatgcaccggcgtggccgacgtgggcgcgtcaacggttgttggcgcggctgctcgggcgtgaggtgggcgacgggcccgacagctgggccccacctggcggcgacccccggtgagaagaggcgggccgccggctcgcgccggcttatctgggcctcggccttcggccggaccagtgggaggagggggaagaaaaagaagaatgggccggcggcccatttcaaaggaaaaagagaaaagaaaaagaaagaaaaaggaaaaagaaggaaaaaggattttcctgggattaaatattgcttgtggtcatttttaattggttaaaattatttcgagagatctgaaaattccactaaaaatcttgttagcgtatttcgacatgtagaactcaagaaaaattccacatgccaaatccgattaccattcgcattaatttattagggtttactcttgctttacactggtattttcttgagaccatttataacttcaatttaggcttgggaaagaacttcggggtgtgacagcagcgcacagccaccggaggcgcggaacgacggcaagcggccgagaggcggcagctagcaaggaaggggatgggaaaggaagaagggaggagggatcctcaccggaagcggcagctggtatggaggaagacaacggcgacggcgattcgaccgcttccaacgaaggaggaggggaggccgaggggcggctacacctggggaagcgattggagggattagggaaaagggaggaggcgtgagtatggccggccgaagaggaaaaagaaagaagatactcaccggcgacgggaaaacatgttttggcggggttccggcggtgaaaaacagcaaccgaggtgctccttagcgctacgaaacgagtgacgaaggcggcgcggtgcgcggctggaggctacaagcggtggtggagctcgggttgatgggggaagcagtgctacggcgatgttttggggaaaggaggggttgccggggtggagcgcggcgttgcgaagctagcagcgcaagcggcaggacgcgacggcgacggaagcggcggtggcggccggcttgagtccgcaaccgtggtggaaagaggtggtgcacgtggtggcagcgtttcggggtggaagggggaaaaaggagtggaggctggggtggagttcggcacggcgaccgacagcggtgccggcgcatcgcggcggcggctagagttgcggttagaggccgccggatctcgccggcaactgctgaaagaggttgtgcgcggggagcatgggaaagggcgtgaggagctcgcgaggatggggaaacgaaagaggaaagcacggggaggcttttttatagcgcgagggaacaacggggaggccggggagtggtgaatttgggcggcaacggccggcgacatggagctcaacgtgggtggagatggggcacgaaacggcgccgaaaattggggaaaaagtggggaagaggtggacgaggtagtggggaaccgatttttaatttgtttttctttttatttaattgattcaatgaactttgtgatgttaaaattacttctttagctccgaaaattcacgggaaaatttcggggaatatttagggcacaaagaatattacaaaatatcctcggccaatgatttttaagggagaaaattttaattccctcactatttcacttgattaaattgcttaaatttttatttattttttgtcaaatgcattatttaatgatttttaatccctaacgaaaatcggggcgttacacctacctagaggccagaacgaagaagccgacgccctggcgaaatccgctgcctgtggaggcccacattcgccaggcatccacttcgaagtcttgtacgcaccaagtgtgcccaaagagagcctggacatcatggcaatcgaccaggcagaactgggcgaagacccagagaactggcgaacaccgttcatgaagtacctcaagaacgattggctcctggaggacgaagcagaagcgaagcacgcctatagctccgagccgcaagatacaagctggtctctgggcagctgtatcgcttcgatgtgctccaacccttgcttcgctgcatctccttcgccaaaggtgaggatatggcaaaagaaatacaccaagagctatgcggtgcacatcaggcagcaagaacggtcgcttccaaagtgtttcgtcagggtgtgtattggcccaccgtgctgaaagtttgtgttgagcaagtcaagaagtgcgaaagctgtcagcggcatagccgaagctaaacagcaccctagtacgaactgcaacctatcgcacctgtctggcctttcgccagatgggggctagacatcattggccctttccctgtggcatgaaatgggtacaagtttgcaattgtagccattgaatacttctcccgttggatcgaggccgaaccactcggcgcgatcacttcggcaacagtataaaagtttgtgtggaagaacattgtttgccgtttcagagtgccaaaagaattcatcactaacaacggcaagcaattcgattctgacaaattcagagaaatgtgcgaggggctaaacctggaaatcaggttcgcttcagtcgctcacccacagtcaaatggggcggccgaacgtgcgaatggtaagatccttgaggcgctcaagaaaatgcttgagggggcagcgaagggtaaatggcctaacgaaatgctatctattctctaggcccttcggacgacccccacaaggccaaccaagttcagcccgttcatgcttctctatggtgacgatgcaatgaccccaacagagctaggggctaattcgccaagagtgatgttctctggagccgaagatgggcgcgaggtgtcacttgaactcctcgaaggggtgagagtcgaagcgctagaacacatgcgcaactaagccacaagcacttcggtgacttacacaaaaaaagttcgaccgacagagctattgcctggccaccttgtcttaagaaagaaggcgaacccggtggcggtcgggaagcttgaatcaaagtgggaaggaccatacctcatcaagcacaggtccaggacgggctcctatcgcttggcgacgctggaaggcgaagagttcgaccactcctggaacgctgcttctcttaagcgcttctatgtttagaaggggtggcacctcattcgttaacttgtaaaaatgtacatactattgtataggactttcggcacctctcgttatgtaagcccttcggcacaaaaatgcaaaaaaagaggaaaatgaaaaaagaaaaaaactagatgtcagactattatccatcctggaggcccgaaccaatataaaattcttgtgtctttcgctttttttacttgtgtgaatgatagttcgtggaaaaaccccaaggcaaatgcccgatcagcgaaaacgctaagggggcgaaacgaatcggccgaagcatcgctcgccaaacgttgaaaccgcgacagcttgtttcgggaagtaaataaccgaacaccgttatattcgattcatgtgaaaaaacgcaagcgcttctcttggcgcggaataccacagatcgaaagcggaagtcgaaagctgaaatgttagcagacctatttcgctaatatacgcaagggggccgacatgtttcgacctaacgaaagcacgaaaggtgactatgcgaacaatagcagaaaggaaatgaaatacatctttattaacttcaaaaaatatcaaagagtgcatgccatacaacatggtacaggtgaaagaaagtaacgggctttacagcctagcttacaaaaaaattacatcttcgcccccaaaacacccaccactccctaaggaatgattcggcgaactcggttcgtcatcactactaatgttatacacaaccctaagaggagaagggggcgaaacacaaactaaactataacggcgctgggcgatcgcttcccgacgatccgtcctccggtggtttcaccaaaagcgaaccatgtcctctagacgttccacatggacactgtcgtagtcgtccagggttcgcccggggtgcgcccgcatccagccggtaactttcaaaacattgtaactgttgccgtttattatcatctcgtggtaaaaaggctgaaacggacaccggaccttcggcaaacccttcaccgccacgaacttctcgtttttacttcgccaattcccaaggggggccgaacacaaaattttcggcgaagaccctgctaagacagtatagaaagggtaaatggcaaagcgcaaagttaagactcagcaaaacacacaaagttggcgaaaagggtaaacaccctttcgtatgtgaaacaatgcaagcatatgcaccaaaggcatcaaacataatagttggctaaacttgggtcatctatttcatatattaaaaatgccgttttcggctacaatacgaaagggagagggccatcgcccaaattcacatcgttcgccctccatggcaaacgccaaaagaaaactacgaaatctaaagagcgggcggagggcctcacacctctgggtgatcttgggcatctcctccaccctctccggccgctggctctgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagtccctctcaatcaataaaaatctaagtagcggaaaataaataaacggcgtagacggctccactccacaggcagcttgaccaaggctacatctaatcctccacaccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagctttaagcaaacattgagattttgataaaccagttaagtaattaaacatttttaatccaccgctttacaacatacctggttgtataggccaaccaattctgaacaaccacccggctgcccagtctttctccaaccagaattgtccattccaacccggagcttataaattattaccgtttaacgctctttccatggtgagaggtgtgagatatctccgaaagacattgtagacccgcttataccggggcacggttattagaatagtatcctctgaccagagtgtccactgtncccacaaaaccaaccccattagtgcccctgtggctatatccccccggttcttggaaggatgtggaaatcccctcgttaacacaaccatggaggccacttctggtattatcacccttttaacaggttggcttccagcacccccgggctatttccccctttaaatggggctcaggaacctcttacaaataaacccctccactggttggtgcgctcaaattctcaccactcggccgcgtttattttgaccacttaaaagttgtccacacctacgcgtngtggcataaaataacaccggtcgtcactatagcgcaaaaaaaggggctttccccgggggttgttggcg

SEQ ID NO: 34413 - DNA, 1743 bp, Oryza sativa
  unsure (1)..(1743): unsure at all n locations
nccannnnnnnnnnnnnnnnnnnnnnnnnnnnnnnnnnnnnnnnnnnnnnnnnnnnnnnnnnnnnnnnnnnnnnnnnnnnnnnntttgtttgcttttgagtgttaggaagttggtgagtttagtggtgtgagagtctttagtttgtaataatgaaactcagttaagatcaataaaagttaaagtaattctctgtcctaagtagtttcccccgttttctcttcttgtgccctgtccatgccagatggtgaacactcgcagcaatgggaatggtcccaacaaccccaataacaacaacaatggagagaatcccactcttgctcaagttcttgctcaacagacacagcttatgaacatgatgatgcagcaatttcagaatcagcaaaaccaaggaaataatcatgcacctccacagaacaagttagcagaatttcttcgtgtgaggccgcctgttttctctagtaccactaatcctgttgaagctggtgactggctgcatgccatagagaagaagttggatttgcttcagtgcactgatcaggagaaggtctcatttgcatcataccagttacatggccctgcctctgaatggtgggatcacttccgcctgaataggactactgctgaacctatcacttggcttgaattcactgctgctttccgaaagacgcatataccatcgggagtggtgtctctcaagaagaaggagttcaggtcgcttactcagggatctcgctctgttacggagtatctgcacgagttcaatcgtcttgctcgttatgctccggaagatgtgcgcactgatgaagaacgtcaagagaagttcttggaaggacttaatgatgagctttcttacccactcatgactggagattattctgatttccagaaattggtggataaggctattcgtcaggaggacaagtataatcgcatggagcagaagaaacgccggattgctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatgcgctccgcccctcggcagataaaaaaaattcccctaattgaaggtggcaaccccaggcttaaaactaccgggttctcctgaaattcttggtctttttgttccacctcgttaacgaaccgttcctttttcttggagaggggcgttttaataccagcgtggtattaatggggtggnggttcccaaaggtgtgtaccaacacctctagcccccgtgtttatgtttattggtttggccaccgaaacataatatccccttcaccatataaatatagaaggtggtggcgcttctattt

SEQ ID NO: 34414 - DNA, 1576 bp, Oryza sativa
  unsure (1)..(1576): unsure at all n locations
cgagtgaatnccactctgtacccctcacccaagcaccaacctcgcttaaggtttcggcggcgaagcagttcaagtcctgggccaagtacaactggcggtggctttcggcacaagcgacaacaggcgcgaagagcaaatactcttcgacgtcgtcgacatcccatacaactacaacaccatcttcggccgcgcaaccttgaacaagttcaaagccatctcccaccacaactatctcaagctcaagatgcctggtctggcaggcgtgatcatggtcaaggggctccaaccttcggctacatcaaagggcgatttggccgcaatcaacagagcagtgcacaatgttgaggccgaaccgcatgtccgggcaaagcacattccgaagcccgcctcccacggcaaggtgatcaaggtgcaggtcgacgatgccgatcccacaagatttgtttcgcttagaggcaacatgggcgaaaaggaagctgagagcatcctagaggtgctcaaaaaaaacattgtcatcttcacctagggccccaacgaagtgggaggtgtttcgacagacctcatcatacattatctggcggtcaaaccggatgccaagccaaggaaaaagaagctgcgcaagatgtccgctgatctccaagaggcagcaaaagccgaagtgtagaagttgctcaaagccgggttgatccaagagatcgaccatcccaagtggttggcgaatccggtactggtgcggaagtcgaacggcaaatggcgcatgtgtgtcgatttcacagacctcaacaaggcatgtccgaaagacgacttcctcctaccgcggatcgaccagctcgtggatttgacagctggctgtgaacttacgagctttttggatgcgtactccggctatcaccagatccacatgaatccagctgacatccccaagacagccttcatcacgccgttcggtactttttgccacctcaggatgcctttcggcctaaggaacgccggagcaaccttcgccagcctggtatacaaggtcctctacaagcagctggggcgaaatgtggagacctatgtcgacgatattgtcgtagaaagccacaaggctttcgaccatgcgtccgacatacaggaaaccttcgacaacatacgctcggcgggtatgttcgcgcgggcaaggttttgggttttcttatttctgaaaggggtatcgaggcaaaccccgagaaaatcgatgccattcagcaaatgaagcccccgtcgagcgtacgcgaagtacaaaagctcgcaggccgaattgcggcgctcagtcaattcctctcaaaggcagccgaatgaggtttgccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34415 - DNA, 10207 bp, Oryza sativa
  unsure (1)..(10207): unsure at all n locations
agaattgattgtcctttccagctcggtacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagtgcacggtatggtgaggaagaaacagagctcctgaaacagtgctccatagcgccagcttatatcatcaagtctaacagcccctagtgccatcagccggcagggcaacatagtgtcgcacaaatctttgacccaaagtgttaagaataatacgattattgatggaagcaatcttagtttcctgaagacagacaagagtggcaccatattgttgcaaaataactttcactgcatcttgcttcgccttggaattcagaacccttacattccagttaaacaagtaaacattgtcttgtgacatgggcacagaagctgctgcaactactactctagttgatggtgaaagtaacaaggcctttcttgaaacacaaccagcaaagctgggagaagcacaggcagaggaagacaaaacatctttgactggaactaacatgcagagatgacagtaggaagacaagcttatttgatgaggggtgggactcttcatggccaatgcagggtacttcttcaggatgcagcgcgctcacaggggcgcgatcgctgccttctttcttgctgccttcaggcggatgctcttgcatcctcccttctccgccagctcagtgattgtcttcaagaaggagggggacaacggtttcttgtagcgctgcaagtaaatctttttgatgttatcatcaaaggaagcatgatcatcaattataccaaacttttttgacatgatctcttgagcaaaagtttcaagttttgctcccgcccgcctcatgccaagcaggcgttcgctatgacattgtgccgaggaaattgcaggtattgtcactttcacgtggcttggatggcgagcatttgcgtccagagcaggcaggagcggcggctgaagcggaatcgagagggtgtcaatgaactcttccacattgttcacctggcttaccagcaatgcagcttgagcttgattgttcacctgtcctgccaccgacgccccatgaacttgagtcacctgttctgcaaaagaggaaaatacgaaaacaggggaaacagcacggagggaatttgtgtccggcgagtagatggagtactgcaccgccgcctcgtgcagcattgggtcaaggtggctctccgggagggtaagaacatcctcctgcccctgcgaacaaaagcagttgtcagcttgaagaacagcctggtccgggatggcaaggttgacggagaaggtagcagtggcgtccccgtccgggctcggtttgcggaccgagcttggttgcttgcatggagaggcaagccgattgggagagggtagaagggtgtctgaggcaggattgttctgagaggtgaaggatgaagagagaggtggtctcaccttgcttggctctcgggaacggccgcttctgctacgtggatcagagcgctcccggttgcgcgagcgccccctggccatctcttctttctggctccctgctgtgacttgaggacaggcgcccgagccaatcccacacagagcggctcttgtgacgactcctgcgctgcctgtccctgtccttgtcttcatcatcatctgttggcccctgcatgcttgtgtcttcaaccctcggcgcttgcagaaaattctggactctaatttgcattaaaaactaacaacacgcatgcatgtatataattaatcatcaaaaccatatagttaatagccaaacaactttaaaccatttgttttctattcggctaattactcaattaataaccaaattaaacctatattttagatttggctatcaacccaaacttttaaattatatgaaaaagatttttagtttgcctttttcttaaataaaatgagggtactacaagtacaataccttgggaggtatatatataatccttctggcctttgtaatcttgcagtggaagcaacaaggatagttcgatcgagttgtatcgcgaaacgggaagaaaacaaaagagaagaaggaaaacgaggccagaaccaaattaaaccaatagcaaagcatcaacgtattcacgatgccttgcgaatgaagacacttgtgaacaatatatctgtgctgctttaatttcccatcgagaatttgttcgtttctttcttccttctgcattacgttgattctttcttggcagcaattttaatcctgtcttgccctactaacactagatagtcaaaatctattatccctttttaattttcttcttacaaaacaaaacgtatattcacccatccctcttcccgatcgacactccattcctctgctgcaccaacactccatcccttctctcccttgcttcttccctcttcctcttggaggagtcatggatacttcatcctctcattctcctactcctcttgtatatatattcactctgaggcaacctctgcaggggcaggaaaatatactgcatcctttggctgctgcacagtgagacaacaaggcatcttccacctaggagtgtgtggcaatagtgactagcatgccgtcatcgctgaaatcgctgcttccgggtgggaaaggtgatcatctttatccttttgcacagtgtggtcccatctctctcccctaagacccctctaaaacatatgttgcatacttcttcacagatgacaagaggaggaccctaatgcaccaggtcttcacacttggggagagggtgtcggagttggaaaacaaaaatgcccaacttcttgacgagaagggtaaagtggagaagcaattggaggagacaaagcacgaagctcaggtcatctcaaggcagaaagaggaggtggagagtagcttgaagggtcaaaatgaaatgcttgggttgaaggttttgaatgtggaggaaaaatataatcatatggtcgagaagctccagatggaattatgtgcattggtgaaggaaaaagaaaaaatgatgatggagtcagaggatcttaagaggaggttggaggaaatccaggcgaagaaggatttgatggagagtgaaaaggatatgcttcggtcggaggctatgattacaaagcaaaaacagatcatgtttgaagcagagattgagaggctcaatatggaattggttgtattgacggaggcgaagaaggctgctgcaaaggcatgtgaagctcaaaatgatgaaatcatgaaggaactggaggatcttaagaggaagtttgaggaactgcaaacaaataaggatttagtgcaagctaaaaatgatgaacttctgtcaaatgttttggcaataaaggagaaatatggccagtcagaagcagaggttaagaagctccagatggaattaagtgcattggtgatggaaaaagaggtagctgttaagacatttgatgacgagaaagacaaaatgatgatggaatcagcggatcttaagaggaggttggaggaaatccaggccaataaggatttggtggagagtgaaaatgataggcttcggtcggaagctctgattacaaagcaaaaacaaatcatgtttgaagcaaagattgagacactcaatatggaattggttgcattgacggaggcgaaggaggctgctgcgaaggcatgtgaagctcaaaatgatgaaatcacaaaggaactagaggatcttaagaggaagtttgaggaactgcaaacaaataaggatttagtggaaggtgaaaatgataagcttcagtcagaggttttggcaatagaggagaaatatggccagtctgaagcaaaagttaagtggcttaatcagatattgagagtagtggtggaggcgaaggatgcagctgcaaaggcatgtgaagctgagaaggtagaaatcttgaaggaatcaggaaatcttaagaggagggtagaggaaattctggttaacaaggatttggttgagagtgaaaatgacgtgcttcggtcagatattctgacattgaagcagaaatacaatcaatttgaagtagaggttaagagcctcaagaatgaattggaagcattcgaggaggagaaggaggttactgcaaaggcgtttaatgttgagaagacagaaatcctaaaggaattggaggatctaaagatgaaggtactggaaatccaggccaagaaggatttggtggagagtgaaaataacgtgcttcagttagatattgtgacaacgaagcagaaatataatcaatttgaagtagagattaagagcctgaagaatgaattgaaagcattagaggaggaaaaggaggttactgcaaaggcgtttaatgttgagaaggcagaaatcttaaaggaattggaggatcttaagaggaaggtgcaggaaatccaggccaacaagtatttagtggagggtgaaaatgataaacttcggttggatgtttctactgcagaacagaaagaaagcatatctgaagcagaggttaagcgtctctggaagatattggatgctttgatggaggcaaaggaggtgactacgaaggcatttgatgctgagaaagaaaaaatcatgaaggaattggaggatcttaagaggaaggtggaggaaatccaggctagcaaggatttggcggaaagtgaaaaggataagcttcggatggtagaggaaatccaagttggcaagaaagcggctgagaaagccgtgcatgacaaggatgctgaggcccataggctaagagacgagttggtgaagatccgtgtttctttatcagagttgcaagcatcatacaatgaacttgatgccaagtatccgtgcctgaatgatgagaagaattcagtctaggaagctctagatgcagagaaggttgaagcatggaagctgaagtcaaacgttcaggaacttgagaattacaatcctgaaaaggatggtgagactgagaattacaatgcagcataggaggaaaagaagagtgagattgatgccctcatcagggacaacgagctgctgcactatgcagttgctgaggcataagagaagaataagggtagcattttatcatgcctgtcactacacggcttgaagtaattatgttggcaatgtgtcgctttactaatgtaatggtgatcagttggtactcaacaataaaataaaactttcacttcctttgtgatatgtgatgtatccgtgttctatttagtcatttactttttgtgacacttctgcattgttaacactttggtaaaatgccacgttaactataattacacaacaaagggatggtccttttagcaatctatctatcaatctatctatctatctatctatctatctatctatacctctatacctatactaattgggcacttcctacgagttctcatgttaattagaaagttatggccgttgattaggtcgagcgtatcatcgtcaccatcgatcatgtaattaaatagcttttaagtaatagatcgattcatcgacgttgtgggccaggttaagcccatctaatacgcctcatttacctaaccaccgtacgtatctcacgtacaatgtaacaagtactccagtaggagacctatcccaaaactaagacggcggccaagatgaactccttcatagcctctggtgtgacgtgtccatcaggatcggcggcgattatgtagttaaccggaagaagtacgcacacagaatcagctacacacgtaacacgtacaccttggcatcgatggagcgagctggaggcatggacatgcatggtagcaggttagcagtggcatatatatgctatcaatttaattgaagtttaatttcatgggcttgctgcgcctgctccagcgttggagcttcgcgcatctaaacatgtgtgttgtgctgctctgtgaattcaaatgatgagattattggtcgggtcaaacacaaattttatgatttgccaaccagtaaatctactattacgttcaccaaagtacgtatagtttcaattaaaattaagccattgattaacccatatgtacttcatgtctgttttttttttcaattcgttatatagactgattcatgcaaatctaaatcgaaatatggagatcaagtaaggctccggtcagtagtgcgtcaatgaagatgaagtacaggcatgcaaaacaaaaaaaccattagtgcataattacttgatttttaattatttttaacttgaacaatagatttatgtatcttttatattgtaaagtatacttctatataaacacttttcgcacgaatgcatcgttagtagtttaaaaagcggaaacctagctaacatctgtgattagaaacgaacggattttaaatcttatctctgtgcacctaggatttctttaattttgacagtgttacaatggatgtttattcgtatgcttatatactctgagttcagcaaacttatatttgtcatctaaattacaattattatttgtatcagttcgtaatcgttaggaataatacacaaataaatgatgaattaataagactggattcacactaggtatacgtaatattttaacccatctttctacaatgatggcattttgaacaaaacttatatgattggaaagttttgctctcaacaccatacagtttagctgcaagttataatatgtcttgctatttataaatgtagcccatgcagatatgataaccgtagataagtagccagaatatgtgtcacataagacatcaaattaaatataacacggacccttagatttttaattgtttaaaattaaataatgccaaatcaaaattaataaatacgaagtcacaccaatcttaatttgatcagtattttgctaattttatttttaaatttgaaacaataatagaaaattaaaaccatcataggtatcttctattatttcaataaaataactatcatatttagcttaccgctatttttttatgataacccatgcatcgcgcgggttgccgactagtacttatactaattggccactttctacgagctcccgcattaacttgtaaaatctgatcgttaattttgatagatcatataatcttaaccattgattataaactttaatcggcattaacattatgggcctcatgtaaagctcgtccaatcaactgctttaattacaggcctagccaatctatgttttgcccaccacatatatctcaacctttatttgttttgctcatcgtacgtacatttaggagtcgtacagtgtggggaacgcaggagtagatcgatggggagcacagcatcacgagatgtatctaggcacgtacagcaaggtgtagcaggcggcagatcggctgcagtgtgcagaccggtcgaaccacaccacatcggaagctggtaggtattcctcaaagatttaggaacgtaatatgtagcttacatgtgcaatctacatgttaattagctcttgagaagatctcatacaaatgctaggcaagtgcgatctgctcgcaacactcagctcaattatgtgtataaaaattatattcatatgcatgtgttttcaaacacgttcacgtcaatatctctttatatctaccaaattcatgtctcatatggttcaacatttatagcatattttcaatttttttatgaattgtcatgttttggtcgaagtaatttgactttgtcttcaaaatttatattttaaaattatatagttccaatatcttattatattacggcaattgctactattaggtcaaattattaatttgtaattaggttttggaagtattaaatcaatattgtgacctttgattatattaacaataatatcatgaccatagattaattttaaccatggatttttaaagcccaaaactaatctcacgtgtgggtcactgtccagtttagattataggcttcaaagttcatcattgagtacattagaatgcagagagtagatggagagcgacagactccatgtctcttcctgcacgtgacgagacggcgtaacaaatgacgcaccccataactccaccatctgcgcgcgctgagatggcgcctacgtcgatggccaaattcaccctgcacccgataatcaaccgaaagtcctagcgcagtttcactggttagcttctcatcacgatgtaggttttaagtaaacttctttctgttttagtttagattagagtttaattagatctcatcaattttatctgttgtttttatgtttcttggtaaaaattgaacctaggccatgtttataacttatatttcgagtttcacataaaatggaatagaattggtggagttatagtgtttttcgtgcaaggtcgatcagtttgctgttttaccggacatgcacaatgccatagtacgcgcgtgtaccgtagccttcatgtttcggtgctgtacccaaggtttcatactgtgcagggtgtcttggttattagggtgattaatttagggttccagtattattagagtaactttattattatttctttttattttcgttgtatgtttggtttcgtgctttcaaacaatctttcaatccaatctgatcgacgctatcctaatcttttcatcgatgccaaccagacatatgcgcgagtcgtccaacttctgtaaccagtacaaatctgtcacttgtctgcttgatatagtctcgcgtatattctggttccaatctttcccatgctctacaaatttcgtctataggtatagcccgtcgacacatatagcaatataatttagaaataactattagaattgaaaaataagaaatattaaaagaagagtccatctaaaatacaacttgagataaactaaaatttaaaataaaaaaattattgcaatatgaattgcaaaataaactaaatgtataaaaaaattttagaataaaatataataataaaaataaataagtaaaaaatatgtatgaagaaatgcttgccgcgtagcctgcgtaggccatatgctatacttgaacacaaagatatagatagatagatagatagatagcacgacatatagatagataggattatagacgttattgtgaccgaatcagtaaacatccacacaaagaaatattgcattggagtccggccagaggagatgctccgtgacatggctttaccgaggcatgctctgtgccgattacttgtgcctgctattgggatcttctttgactgcacgctttcgtcttcaaccctcggcgcttgtagaaaattctggactctaatttgcatgcaaaactaacaacacgcatacatatttaacagtgaccaaaccgaaaatccaacaacaattagctttggtaaattacgcttcatgtatataattaatcatcaaaaccctatagttaacagccaaacaactttaaaccatttgttttccattcagctaattactcaattaataaccgaattaaacctatattttaaatttcgctatcaacccaaattttaaattatatgaaaaatatttttaatttgccttttttttaagaaaaagagggtactactagtacaataccttgcagggaatataatcctttctgtcctttgaaatattgaagtgggagcaacaagcatagtttgatcgagttgtatcacggaacgggaaaaaaataaaagagaagaaagaagaggaggcaagaaccaaattaaaccaatagaaaagaatcaatgcattcgcgattccttgggaatgaagttgtcacatgctgagttttcatatttttccttagtctcgaattcattaataaatcaacgggagaaattatttaatttaacgtggagctaacattaatttaccaatgcagttaataagtggaattgggatggtggaattttttttgagctaacaaggtttaaatacactcacagaatttttagtggaatttttagagcaaacaaggtaattataatgaatccaaagtaattaaggggatcttctagagtcnncctncnggnnnnnggnatnnggatcagtgtacgtcgtg

SEQ ID NO: 34416 - DNA, 1536 bp, Oryza sativa
ttcaattttgtcccaatgtgtcaaatttagcattacattccctggtgctttagtgaatttaatgttcatgctgttaatctgacgggacaatggcttagttccttgctgcttcaatgtctgcactgaagcattggagctaggcttcaaagttgctatatgaattgtcagagtctgagataacagatgttggcctaaagcaaggcactcaaatgcctaccgcagcatcaacttctaagctctcccactgaacttgacctcctcgccatctgtcactatcgtcagtctcggcaatactgttgtagccaccgccgtcagacttgacctacccgttgtagcaaccgtcgaactcgacttcccccacggcgtagctgttgggctcgacccccatcactacagccaccgcggattcgacctccccagctccccgccgctatgaacacctctcagattcgtttcacagaaaacttatacatgatcgaaataccaaacaatagaaggggttttctgataaaatagggccattgcttacgagcaggcaaacctgtccttcttacgtgaatgcttagttggtggtctactcatcatccaactcagcaaaattagatttgctattctatttagtcatagtccgcacgcacctatacaagtttgtgcaccaaaacaagagttttgtaagtttttacactaaattgcacccacctaacaagtttgtgtaccgcgggcgcaatttactcttttttttcaaagactagctaaatgtatgtgctttgctacgtatagataaaaatgacaaatttcataatattgcctaaataaagagtaacatattttcatgaaaagtatatattacccgcctttttttatagagaataccccttaatttaatttcaaatgtggttatccacttagatttagttgttatgcgatattaaaatgtttaaggggtaatatgtaaaatctacaataagagtgggtggggagtctttttaaggagtatagatcgatgtcattgtagatataagtggaagttctcaattttcatctagaaatattgggtggctaaaagcaagtttatttatttttttgaataggagaaaaactaagtttatccgataacgagacttataaattatactaattaggcaaagacgcaaaacaaggcaatccagtgctcaaaactcatacccaataaatatttcatataactattggggaatatgaccactttctagttgtacaccaattattgcctaagcatttgtttcaacatatcattgataatacaggattaatggacaatctttttaagtacataggtaatgatagacacacagtgctaccaatccttttggcgcttgtacttcaattatctatcatgacacatacctatttacaagtgattgaagaaatgtagaaacgcaacatctctagctctctgcatatgtatggattaaaactgtattagtgttagcatggactaagtcaacatctaaaaaaatacacatctttatagggaaatatggaagtgtggtcatg

SEQ ID NO: 34417 - DNA, 9889 bp, Oryza sativa
  unsure (1)..(9889): unsure at all n locations
ngtgtatatatggatgagggagcgaaatatttagtggagcgcccgagaaaatgtagagtaagccacagcccatgcaggtgagagagaaatgatcacaactttaacagcgatgcgacaaagagaagcaaccacctccttatataattcggcgtatcaagagtaacgagcgcggtatcaagaatagaaagaaagatttactaaggtgggagaccacataaaagagagcacgcgttgaacaagatgttcctgacacatagaaaaatttggagcgttatatatagcccgcttagaccaaaaaccaatccatcttataagaggggctaataaaaagttggatattagttaacccggaaaggcccaagacgcaggtaaattttgaacagagttaaggtaatttgtataattacgtaccctctaaaaggctgatatagggcgcgcttataaaagcaggccctattaggacaacttaaagagggtgatattgaaaagggcactttggtacaccatcattcctaaggttggtaaaatgtacaaaatttcggccaaataacgcagaccccgatgtagaggccataaccgtttttccctgtccaagaggtactcaagcaagaagtccaaattgtgcactgggggatcatcaagcccacaaaagtgtgtcaaagtgggtacagcaggcaggattctgattcatccaccgaatcaatgtccggaaaatgcggaaccatgacccagctttagcgaaggaccacagaagcaaccccatgctgtttttctaaaggtgatctcaggtgaaatcagcgtggaaccggtgccacaaattaaggatatagctggagaacagtacccattcaatgattgaaatcacgccatacctggttaccgccgtcaaggcctaacacgacaaggcattccatgtcctcaaattttgggtatttaaganttnttttacnncccccccccccccccaacacccgcatccatccacaccacccgcacgcgcagccgcacccgcaggaaggacggggacgcggatcagaccgaccgtgccaaacgccaacgccatactccacctgacctcacactcgcaccgcaccgcaccacctcctcatcgagccttgttttttttttctctttcctctcctttccgtcgcgctgttcgctgcctacaaatcgcaattccccaatccatattcccttcccttcctttcctcctcctccatctccaccctcccgccgccgccgccgccgccgtcgccgcggcacactccccgggaccagcagaggccgccgccaacgccgcgggggcaggtaaaaaggcgcgcgagacgcccgcctctgcccgctgacctagatcggtagggtttactcgggcgcccgggtcgttcgtgtatgggggcgtgggcggtgggggattaggctttcggggtcggggggtcgggaaggtgtctgatcggatgatgggtggctctgttctccttctggggtgcggggttagagctagggctgtcgcggcgattttattttattttattttagttgaatttgaccggaatttccacgatttggatgggtttgtattggttggattgtggtaggagtgtttttataggggggttgggagtgagggggggtagggtttgttaatggtttttgagtgatataatctatttgattcctgttagggtcttctcctgggagatttcccggcgcggattttgttagcatttattaagtgtgcgcgtgttgttgttcatgcatgcagctgcggataaggttgcttgaagcagtggaagatttcctggatggcttgtgctgcagcaactgatgattctgctgcgagcacggctgggatgagggacgaggatcgtagcctgtctggcgagtcgttgtccgagtggcggtcctgcgagcaggtggagagcgagagcccttcgacgtccccgcccttttgggacactgacggtgatgacgatgatcctggtgagtaaatgcacttgcttcgcgttacgcgtgttaataatgactaaattatttggtccgtgtcgttgcaacgccatttgagcttaacatgattggttcggacttggaggaaatagcacaaattctcgagtagttagttgacgtagcacctgtatgcatgatgcgtcttgttcagttgcaagtgttagggtcatctaccttacagctgccagcccagacttcacaaaagatctcgatcagaaactggaaatggtcctcgttgcagagtagcttcagagtccagaagacagtatacacgtgtgctctcataaatgagacggttttgtagccttaatgcatagcgtccagtcaggtcatttatggaaatccgtgaattgtcaactgaagttgcttctggttagcaccctccatttcacaattttaatccagctactctgtactcaagtgtgcgttgaccggagaagcagacaatttaagaaataattaatgagggcaatacttaccccatacgttgctacctccattcccggaacataattaacgagggcaatacttaaatatacaatcttgtttcatccagaattcccggaacattctgtttcttcgaaaaaaaacataatacagtcaataatcctatttcatctgttatgctgttcatgttcgcatttaaattctggctggaatttgcgcttctaggcatttaggtacctgtgcttcaacctgaatagcaggagaatcgcatgctgcaaaccaacattactaattgcacagaaccgcagttcttgtattaatcttgtgaacaactactacacagctaggaggcaacctgcaatatagagaattgtgatatgcagacaatcatgatttcttgtaatgctcctttatcatagcttcgtacttgtttctctatttttaactcgcaccaaaatatgtttgcaaacacagtcatggctagataaatgttgtgtatactccaatatgtacaaaaaagatagctgtatgcctgccggtacatttttaattaaaatcaatcaatctacactggtatggtccatgggtccagtgcaaaatgtttcattccaataggcaaaacggaatgtccaccggaaaagtattgacatgtacgcctaataccatgcttaatatgtgttaatccattatttcttctctttccatgctgccttcaagtgtcatcttgactttcctctacaaactcaaattttgaattaatatttgctctatcaacaaggaatccagattcatttaccatctcttttcacgctacttcacaatgttatttggtctcattgtcattgatgcagtttatgttttgtgtacagtagtaaatatgattagggcatttaaataggtggcatgcttgccgggctgttctcacctgaattacgttcatgctagcgtcaacatttgctattgctgcatgaataagtttaactctctttcctggttcaagtcccaattcctggcatgtctgtttttgaactattttagtatttatagagtaaaatgctcttttttcctttagaagttcttttttctttccctattttaacctcatctctgaactaccattacaggccccaaaccttcagatttatttgggcggtatacttggagaattgaaaatttttcaaaggagaagaagagagaaatgaaaagcgagccatttgaagctggtggttacaaatggtaaaaggcttggtgaccattgctatgcatgatttaccaatgctttgcaatttacctcctatgctatccttttgtctcccaaaataaaattccgcatgatagtttttttcttgaataacctttatcctgtagacattagtacttttttgcaaatatgccttctttttcctcttatgttggtgcctagagaatggtattgtcaattttcatctcaccatgtttcctttccatgcaatgcaatcatatacaaacaccgcataattctgtcttatatgcattttttgacataatgtttgttatgtaggaaatgtaaactcgcacgattttgggcattataaaattgttttctgtgatttcttaattgaaaaaagatctttaacaagttttggataacgatgctgctttctttgccctatgttcgccaccacaatattgtgaactgttaggtttacttttctttattgcagccatttatttcatttagatgattattgggtttgaacactgttatctctgctttagctattatgtaaaaaaaaaaagaaacaactgtaaacatagcatactgcatactggtcaacatgtgatatttatttagggatttggcttacatgaccaccaaatattgtttgcttcaggaatctttgctgagggccataggaacaaatctaagagcttcttgtctctttccagtttaaatttgttatttatatatgcctatttacttattccttactttgtctgcttgctattttacaggtatattcttgtataccctcaaggatgtgatgtttccaaccacctatcactttttctctgtgttgctaatcatgacaaacttctcccaggtttggtttttgtagtctttgctgctatctaatggtgcaccatggacctaatatctcatattagtattacactttcagggtggagtcattttgcgcagttcactatagctgtaggcaatatagatcctaagaaagtaaaatactccggtgagtggaatttggcttgttctcttcctaggaagctaccattcttatcttcttgagcttcaggtcttaagtaaattttgtagatactttgcataagttctggaagaaggagcatgattggggatggaaaaaatttatggagttgtcgaagattcaggatggctttcttgttgatgatgttcttgaaatcatagctcaagttcaagttatcaggtagctaatctgtcagtgcgaacaattggtagctaatctttgtatcatggtgcttccaattcgtgtctacttaatctattaggctggttcatttgagcatgtctgtctttattgcttcatgtcctaatcgcgggaacaatatttttgaattttctacaggtagtctgccaatttatctcaaagcattgtttctttattcaattgcattccttttgattctactgtgatgttcccatggtgggaatttatttaatctattccagtttctcatttttttgctctaatttcctagcgttttgtagctcatacagaccagcaagatcacttgtatacattagatagtttgcctacttctgtttcttgttgatatgaattgactacaaactatcatgtaacatcatactgctgtatttaatatgtaagggagaaggtggacaaaccatttcgttgcctcgatcgcccttatcgaagagaattgctccgtgtttatacgacaaacatcgagtcaatataccgccgttttgttgaggaacgaagaaataaacttagcaagctgattgaggacaaaatgagatggtccaggtttgactagcagctattccaatataatatgctgcaataaaaagcaaagtattttttctttaattactgcctattgaaatgagatctttattggattttcagtttttgtgctttctggtcagcaattgacccaagtactaggcatcggatgtctagagagaagactgatgtcatattaaaagtattagtgaagcatttttttgtggagaaagaggttacttcaacattagtgatggattctctgtatacgggcctgaaggtgcttgaataccagagcaagggcaagaaagggagaacgatagctgatttggatgaactgcctgcacccatgatccatgttgacatggacatgtttgttttggccagtgatgttatagatttgcttgagagagcagccttagaaccactgccttgtcaacctgtgtctccaaaggatgacaaatgttcccagagtcgcatgaaggtagggattgctttgatgattgaagcatgatttttttccctgtttaataatctcagtataaatctttatgctcctagatatattatattgggaatattttttgttgtgagtttcttgtattgtatctgtgcatagttgtttggtgatcggtttattgcagagtagaggtttttctactggatttgcagtctgtcttactattctcactgtcataggatggtgcttctggtgaggttaacaaaatttccatggagcgcgaggaaagacgcctaactgagcttggtcggaagatacttgaaacatttgtgctatctcatatattcaggtaaaaagaattatttaggctgattttcttttggttaccgatgtagtgttggccagtaccaatagtcgatccctaggctttgtgggtggtttatgttgagccttgggcatttgaatgaaattatttgacctctaaaattcgaagacttctctaacagacaaactaccgaaattttagaaagctgcgtgtacgaattttgcattaagctaatgcatatacatttttctaacttaaaacagaatagatttttagacaaattgttagctacctaatagtcctactgtgctctttatttgtcagtggaattgaagttgcgtaccaagaagctgttgctttgaagagacaagaagagttaattcgagaggaggaggaagaggcatggcttcttggaaatgagatgaaggggaagcgtgggggtggtgctaatgaaaaagataagcgtgcaaagaagaaacaggtcatattctttatagaccttagttttattatattgagtatcatattggctcttctatgtgcctcaatagtgaagcagaactatagctagaagcttcataagcgattatcgtacccaatagttattgaacttaaattgcttagcgatttttggagtcagcatttacaacttttgtgatttgatttaattaggttatgcatcacaaaagaaaatatttaatcctatatcttgcagtttcattagggtatattttccacatttccatccttccctgcttctactgccaagttgtggtgagcaattttccatgtagttgatgcttagaaccagcctctgggatgttttatttggtcaaattgcatctgctttctcctggatgctgtttagaaactttctgattgtatgtactctgatttttattttgaagttgatagaaattaaaaacacatgttgagttgtactgcacttggccagggtccaatgcaacctttcataaaactgtccaaactggacagatacttggccagggtccagcgtagcctgtaaggcatccattcttggtcatctcaatttactcaggaactatattctttatagtttcttctatcatggattcgtggttccatattactattgctgcactagcatatttctgttgcgagcttaatatcacgtgctaggattatttgggatgaaacgggtgaaggggaatagattggatcataatagaggaaagaacagggaatggccctgaacctaaacggcacgtcgctctccgttgcaccaagaaggcagggccgatgggcgctaataaatcttgatctaatgcctaactgacctgagataggatccctccttatatagatggaggactccttaacccaatcctaacagaccgtgactctatccaactaagctacgtacttatattgatggatatcgtttccattgggcctaggactcccggcccaaagcccatgacacttaataataattattggcttttattattctctgattttactgctgttgtgcgaccctagcatcgggtttcccttgtgacattccaaatgaaaaatgttattagctcctagtcctgagtaacattgaattatcttctgaagtcttgtgctagtgccattctcgaagaacagctcttattctggggttgaaaatatatttgggtgaacatttaatattagtgtgaattgctcaggtacaactgatgtgaagttttatggttttgaagacctcaacctactttatttagggtcactacatagcttcatttcatcatgtcagttgtgttctatttctataattttatatgcattttgatccttagctctccttaatagtttgatgcgatgtttctttctcttgtatcatcttgttttttccactaatgctgaatcattcttttcaggccaaacaaaagaagaacaatcgtaagattaaagacaaggaaagagacgaaaaatttgaagcaaagattctggaaagacttcatgatgaaactgcgattgatgatagtgatggcttatcatcaaagcaggccgaagaagtgacaacaaaggttgaaaacttggaagaaggtgcttcagataggcaaggtgatctagatagttcagaaattgctcaccgaccagactcaggtgacaagtatcctagacaaatgaatggactgagtgatgttactggcaatgcacaaaaggtaaagaaggcctcctctatggaggctaactcaccagtctttctggctgattctgttgctgcaagcggcactcatagcagaggaaataatttgtcagacagtaagaaccgcatgacaccaaataggtaggtgaactctagtttctaaggcttgcattgtgatgctagtaaaattggcatctgctctaactggaactatctgcagagggaaaaatcagcgtaacaagggcataagcattatcagcttttctgaggaaggtgagggtattccctcgagttctactggtggttcggctcgttgtagttctagttgcggcacatctgcaaagttggaccaagataccgttctactcaccttgaaggataaactccgtaagctggggcaacgtctacatgaggtgatacatcttcttgaaaagttaactgcctttgttttgttgtgatatgtgaagtccagctgctctgttttggtcatatgcacgaccttccacggattatattatgagcattgtttttaaatgggatgagtgtcacatatgttgattgtatggaatatttgttttcgacccattacccttgtgcaattcatatttaaaatttattacaaaaggtaaacaatataagtatgtcttccatatttcatgcctatggctaatgactggagtctatgaattttaatctcaattttttcgtcagactaaacagctcttccattttctttttattaatggatataacttgctttaatctgtgtgtttcagaaaaatatggaggggcgaaaacttctccaagctcattttgaagccatggaagcaaagacgagtggttcatctccctcatccagtcctttggatgaaacacctgatgttgtgaagagccctgagcagtctgcagaaggtacaacagatgcaaaagctaatggaacaccaaataaggatgaacccgtgacaaattgcgtggcagaggaatctgtttcagtcatgccaggcacaaagagtactgaagctttatctggcatggcccttgccaagacaaaagttgagccagtttcaaataaagatcatgttccaaaaccaacattgcaagccaatagagcatctgctaattgctcgaaatcaactccagttgatatggagaaagatgttcctcttccttcaagatcgccacaaattaataaacctgctccagttcctccaaaatctccacaagttggtaatgctactccagttcctccaaaatctccaccaattgaaaaagcttgtccagttccccccaaatcaccaccaagtgctaaagatacatcccttccttcagtgagatcacttcaaattgataaacctgtcccagtccctccaagattaccccaagnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34418 - DNA, 1278 bp, Oryza sativa
  unsure (1)..(1278): unsure at all n locations
atgatcctcccccttgtgcacaagtttacattccacaaacctaccgtaacgctatcatcggtaagcatggccggggtacaacctcaggaactactgcatatcagtcaacctctctgggccaaggtactgccctttcacagccattgtcgacatatgcaccaactatgtcagtgacgatgcctcctgctggaaggaatgatcagttttctggtaggcatggattggagtctgggttgggaaagccagaagcacgtgatagctggcaaccatggaatgctaacaggcatgttgacaaacatctctggagggatgactcgacataccaacaaacaaccaacggtcatgcatatccgcaaccttggaaggatgttaattttcttcaagcaaggggcacagaaacagaaatacccagcaggtttggaggaccgcaactacctaggcagttccaagctgagactcatgcggattatctcttgcaacaaccacaggggccagtggcagaagaatttccgcaccttgacatcataaacgatttgcttgaggaggaacagagcaatggcagtatgccagagtccattggtcatgattaccatacatttggtctgccgttgccgtttttgttaagaggcaatttggcagatcaggaaatggcttctgctagcagtcctgggcggtttaatttgactgagccatattacgacgagggatactcaagggcctatgacatgagtgctttccaggggacaagggaaagacaatttccctccttggatgcctattctaatggcctgtctgacatgagtccatcaaagccttggctgaatggctctcctaatccatcgatgaaccatgcagttggtacaaatggatacccccagcaaataccggactacaccaatttggctagtgagttgaatggagcctctctataccatcgccgctacgccaacggtcgctggtaacgtgatgacgcctgtatacagtcttgcaatcaaaaaaaataatgcttgttacctgtaatagatgttcagtctgggtctgagccgtgtcatggcctgtaattccaaacttttaattccaaaagggcaaagggttgcattctgtaaagcgttcgccgtgtttaggctggttaatgctaagtcgagtgcttttctgatcaactgtgtcccgttttcctaatggtcttttgagaagaaatactgggaaccgtgtcaannnnnnnnnnnnnnnnnnnnnnnnnnnnnnnnnnnnnnnnnnnnnnnnnnnnnnnnnnnnnnn

SEQ ID NO: 34419 - DNA, 38562 bp, Oryza sativa
  unsure (1)..(38562): unsure at all n locations
aaacaaaacctggaggttctaacccagaaacagtgtgaaagaacccccaaaacggaccacatggaaagattaagactcttaaacttgcgtaaacaggtcgtggaagtatagctaacaatttgaaccaaaaataacttgtcgtgaaaatttagtcggttaacgttaatgctgtatccaactttattcaaaagcaagggtgctttgtaaacgtcccgttttagctgtaatgttagcaagtctttctgatcaacttgtccgtttcctaagtcttttaaaagaaaactgaaccgtgtcaacacggggtcaccaagttgacgagtnccgtcaaaagtggtgcaggtggttggttttgggcctttaggtcagtctgccncaggtgccatccacctactaccaaatcgtatattaccgatctcgatattggtccagtctaccccatgttcacgtacttttagtctttgacctgactcctgagtatagtgggcaacaaacattagacctgctactgcatagcagtaggtatatgcaactccattccagtacttggttctcagcaaaaatctaccagtcgtaaaacataacgcaaacgtccatttacgtttccatcatactcgttctgcaagcaagttcgctatcagggcaatcagcgatgctgaccactactgtgtttttctctgtgttccaattcttagccctgtctttcagcttggtattattataatccagattattaggagtaagctgaaagaaatagacaacttattgaagtagcttattataatctggagtccagtttattataatctgataagctcatttaggtgagctttttccagattattggatgaaaaattacctaccatgccaccccactccctctttagacttgcaaacctaataatctagactctaataatttaggaaagaaacaactaaccgcttattctactatagattataataatttagcttatagtaatctgactcaataatctagattataataatcataaactgaaagaaacatggccttagccgttgcactggtgctattgtgctaatgatggtttggttttcttccttgagaatttcaagctctaataattttcttgacccaacgcatcattgacgctaagaacggttgcctttttattttccttccgaaactttgagacaaaatcatttctgggcccacccgacagggggcaaggtcagggacggaccagaaaccagaaatgccgggggtgccatggcccatggtaggtccaactccacagccactggccgttggcacatgccgccaccggccaccgctcgcgcgccgtcgcgctcgctcgctagtcgctaccctacctagctacttactcggtttcacaatgtaaattattgtaacatttctcatatttatatatatatatttattaataacaatatgaatatgtgatatgctagaatgatttagggtgtgtttgagaagaaggggattgaggagattgggaagataaccaaaacgaggtgagccatttaactcatgattaattgagtattaactattttaaattttaaaaatggattaatatgattttttaaagtaactttcatatagaaaatttttaaaaaaacacactgtttagtaatttagaaagcgtacgcgcggaaaatagtgtgcattctcactccctatcagctaaatgaacgcagccttacatcgtgaaacggatgaagtatagcattagcagtagcactatttctttggacatccacgcctcgatctcttcctgggtctagtagtcttctcttcttccacgcgcaggcgcagccatcgtcgtcatcgccatcgccgccgcggcgcgcgcgcgcgcgcccgtgactgacttccgtagggggggactgaggcacgccaccccgcgcgcgcgcgcgcgcgcgtgcgcccgcacaaccacgaacgcgctccgaagtcttccttccgggagggcacgtgtggttggggtataaagggggagagaggcacgatgccgcacggcgtcgcgctcgtcgtcgtcgtcgtcgtcgctcctggccggtagcggatgggcgtcgtggtggggttgcagcttgctcgcctcgccctcgccctcgccgtcgccgtcgcccccgggttgctcagcttttccgccgccgccaccgcagcttgaagcgcgccgggcgtcgaaacgaggatgagggagtacgggcccgcggcggcgccgcggctgctggtgtccgactccggccgcgtccatgagatggagaggttctcgcattacgtcggtacgcaacctcgctctactactacttagtaccttcgatcgataactttgtaacttggcttaagcattcaatggattttttttttgcgagagcaatattgcttccgattgattgaatggattgctctccgatgcagtacattgacttgcaagaactcaattccatccacgattttcggaggggatcgcatgctccagcgttggaatgtgtgatttatgttttttcaccttgtcttctttgtcgatttcgtaagggaaattgcgctacaaccatttccttttagtttgttcatcactttgtccaatccaaaaatccaggatacagcgcggaattcgagtgtgctcagcacacgcatctagataggcatattattaatggggtggcgtggagattgattagcggcaacttgggcatagaaaattttgagggggtggaaatggaagcgagacattagattatgctttccactccatgaaacaccactagcgagattccaaacaatggcatattctatgtggtttgagttgtagcacatcatcacatattattcttttgtccctttatgatcttgggaccagcactggtttccccccaccttgtgtccttcttgccttttctgttttctcacaaatatgtggcaattttcagctaggcaaattgggtttgaccatgtggatgaatgcccccacctatgtacgctggcctatgattatctgaggaagaacaagggttacgaagaaaacatattcgcgttcttccaaaacagccaggatcccgagactctgattgtaaagttcatcgaggaactcgacaaatgtatacttggctacttctcattccattggaactatgcaacctatataatttcccaggtaaaggagttaggaccttttgccttatggctttgtcctctattgcttccttatgaaactctcctccactgatattttacgtattgatacagtggtgattttcacaggttttgactgtagaaggtgctcctaaaagaaagctcaggaacatggtattagaggccactaggtaattaatcatccttgagctacatgcttggtagttcaaaatatttaatgcacagtcattgcctaatctctgccttttttttatgccaagtattagttgctttagcttgcagcatcttcttgctttactgcagcacaagtttttcttacttgacttggatgtactattaatcaactcgtatgatctcttgtttggagttctttttgtacaaatatttttgtaggagtatcatatatttacagaatctctcctcatttaatgttgtgttggatctgtctccttgaagtgcttattggttgagttgaattatttattctattgactggttattttcttcctatctgatcaaacctttcactggatcaacttcagagctcaaaatggatattttagcagaaacagcacatttgaagtcaaagcaattagatttagatgataggcatgtgcttaggctaaactatggtttctttatttactcctatagccctatgtttggcctgccatgttcctttgaaaagtacattggtaattacttaagtgcctaaccggagaagttcaagtggagaaaatgcttatagtttcgatccaatatggtctcttatatcttgaaaaacatgtttataaccagttacaattcaatccctgtatttaagtagatgaactctgtttctctgacatcaaaactcaaaatgaggtctagcttctgactctccactaaatacaggaaacagagatttgaaagggttacaagaaacttgaaggtgaccagactattctccacattggtggaggagctgaaggccataggactatcttcccatgttgaagcaccacggagtgatgtgatggtcccagcagcacattgtgatcgcagcccagttctactcttgatgggtggtgggatgggagctggcaagagcaccgtgcttaaggatatactcaaggagtaagttgatcacttccatgctcgacattctgttcgtgttttgtttcatctcccttttcgtgtatgtttctcatcctgtggttcaatattttgttaaagctaaaaacattgatctgatctgccaaccagcaggttaatgaggaggagaataggtgaatgagaaatggcaagatgtaataatcaattaggaggagaaaaacattgcttggactttttaatcaaagccagagcagctaaagaatataaaatacgccttttcagaaagcttatcgtgctgctacctgtttcttgatctgcagagcattctggtccggagcagctgcaaatgcagtagttgtagaggcagatgcattcaaggaaactgatgtaatctatcgagctatcagctcaagaggccaccacaatgacatgctgcagacggcagaactggtatttgttagcagctgttactatactatatatgttaataccagtataccagtcagtgagtaaaacggcacatgaccactacatgacaacccaaaatgtacaattgcaattatttacattttagtgtcttggagatgctgtcccacctcctaaatctccacccctatattcatctttactatacattgaaacaagaaactcaatctcctactccctccgtcccaaaaaaaggcaaactctgggtttccgtgtctaacgttgactgtccgtcttatatgaaatttttttataattcgtattttcattgttgttagatgataaaacatgattaatattttatgcgtgacttgtctttttaatttttttcataattttttcaaataagatggacggtcaaacgtttggcacggaaattaggatttgtctttttttgggacggagggagtatgtacatttcagacataccatggctcattgtcagtgacccctcgattccggtgcaggtacatcagtcatcgatggacgcagcctcgtcgctcctggtgactgccctcaacgaagggagggatgtgatcatggacggcaccatgtcgtgggagccgtttgtccagcagacgatcaccatggccagggctgtgcaccggcaacggtaccgcatgggtgttggctacaaggtcacggaggacgggtcaatcactgaggagtactgggagccagttgaggactccagtacagatgaagaaggcgagacgagaaacaggaagccatatcgcatcgagctcgtaggtgtggtctgtgatgcctatcttgcggttgtcaggggaatcaggtatgcttcagaacttaatcctactccactacatgtctacattactgatactatgcttgttcatattactcaaacaaattctgcttgatcttgcctgtttctgctcacgcttccattatgtcagcattgcgattgactcaactgcactattttccgtgtactaacaaagaggtataagcacaaaatttgacacggttaatcacattgtcaggagagctgtgatcaccgggagagcagtgagggtgaagtcccagctgaagtcccacaagcggttcgccaccgcgttccacagctactgcaacctcgtcgacaatgcgaggctctactgcaccaactccacgggcgccgccaaggtgagcttaccaatgcattccgtgttcggttaccgatgttgttatcggggccggttttataacatcaggcacattgagaaatgagaattcaccatcgctcgctggctctctctacagctgataggatggaaggacggcgagagcaaccttctagtggaccctgaagaaatcggctgcttggagagggtgagccacctcaacgacgaggccgactgcgtccacgagatctatccggacggctcggcggcggcggcctgggaggccctggtcacgtcgccgtcgagggcgccggcgcagcgggagatcatggcggcggtccagaggagcgaggcgcgcttccggaccacgtccacgccctcgtagctgcagcacacgatcactcgtgtcaggttggaattttcttttcttttgacacgatttcaggtaggattgggggtatttgggtgttggttgtgtgtggtggctgccaaatggctcgtgggacacagttcgtgttatgtacgtatcatactgtacattgtatcaactgatcctgactccgttaccacccggcatattgtttcgttttgccgggcgatcgagctgcatcgaatggagctcgtcggagtcatcggtcatgtacacatgtgtcttgtacgatgtattccggatctagacaagaaccaacacatacttttcatggtcacttcagtgaaagaaatgatgaaaaaaactcaatgacacttcccatcgaaacacttgtgtcaagatatatagtttgttcgttgagccaatgtccatgttggcatgtcggacgccgtgcaacctcctggcacatatatatactactacgttctgatactctgattggtacatgctcacctgggtggctggttcttcaggatttggatctgtggtcctgtacctgacacccaccgttacatttctgaatctaagatagtggcaggagttgcacttcaccggtgcaaacgcccgcttacttttcaacggaaatctaccgcgttcaggtggcggacgcccattcgctcagaggtgatagaccacgacaccacgccacgcatggataaccagaccagaagaactaaacacgattcgcgagccacactcctgctgtcactcgttgcatctcacctagagaccagcagagtgtagtgtgctgtgtgcctcttgctagctaagcaaggagatagccggagccatggcgaccatcgccgctgccgccgccgcccgcaccgccgtcgttggccggccgtcaggtaagttcacaaagctatcaacagtgctatagtatacttcctgtgtccctaaatatttgacgtagttgattttttagcacatgtttaactatttatcttattcaaaaacttttgtgaaatatataaaactatatgtatacataaaggtatatttaacaatgaatcggatgattagaaaagaattaataattatttaattttttttaataagacgaacggtcaaatatgttttaaaagtcaacggcgtcaaatgtttagcgacggagcgagtaagaattttggtaaaagaatcggagatcattcagttcactgatggaagctgccattgcccattgcgtgcaggggtggctcagctgagagcgaggaggggtgagagggtgaggtgcggctactcctccagggacggcaaggaggcgacgcccgccgccgccgtgaaaggcgcgacgtcgatgctcgcggcggcggtgacggcgtcgtcgtcgtcggcgccggcggcgatggcgctggtggacgagcggatgtcgacggaggggaccgggctgagcctggggctgagcaacaacctgctggggtggatcctcctcggcgtgttcggcctcatctggtcgctctacaccgtctacacctccacgctcgacgacgacgacgagtccggcggcctctccctctgaggccttgttcggttaatccgagaaagagattggagaggggattgagagaataattctacactataataggagtaaaataaatcctctctaaatcctccgctcgcgcgttactcgacacgaggcggcagttaattattttgcattcttagttggtgtagagaccaattgaagttaccacttcgatgagtccgtctactgatcctgcctctatctttttttttttttactgttctgcaaataggcggggcctgcctatgcttgagtgtgcatgtcgaatttggtgtaattaattggagacgtgcatggatattttgtaactaattaagttggtgtttaccttgagtagtagctggctaagtttttcatgaaagtttcaagccagttatgcgttccactatatatagaaaaggttgccacatgcatattcctcttcttttgcttggatactagatgatgaaaggaatggtacacctgcagttgcaaggatggttcccaggttaattgctttcaactctctgtaaagttaaatataaaccagcactaataatgttatgaaataaattaagcaacaacacgaaaaaaaaaagaactagcactatgttcaattgctgcagctaaattgctaatggtataaaactgtcgatgtgtttgtcatgcctagagatcactagaggtttggattggctcaacactgacaaaaaaaaattgacaatttgacccatttccgaaaacttatttcgcaaatgaaccgcgcctaaaattacttatttcaaaaatgaaccggaggttcaacgccaaatgctccggcgttgagcttagccacctcagtgccaggtcaaccagtgctaaatgtcgtgtcaccgtggatggcaggccgactcggtgtgccgacgtgtcaaagtttagcgccacctgactcggcgctgaggtgtctaagctcagcgtcattcaatctggcgctgagcttcgagacattaaggcccacctgccccggccgagagagcgagctctctcatttctctcccttccccgctccatgaaaactacgacggcgatggcggcgttcctctccgagccctaatccccctctaacccatgggaaatcaaggggatttggaggggatttcatgtggaggttgtggagtaaggtaaccttctcaaaatcctcctatattttcttcatttggtgatttgttttggagaagagcatgaaccctaggtttgtcgtttttgtgagacaaggaagatcgacttcatttatcggttaggtgagttctataggttaattttgaggggatttcattcatcggtactgaaccctagttggtaggatggatttggtaggttccaatgtagggtttgggaagaatttttattctcattggcgatgtagtatgtagtgaatcgaatgaatgtgatggtatgaagtttgtgccacattgtctagtttggtttacttgtgtaagttagtcttttagtacccttgtcgttgtttaattgaaatagatgtactaatagtattacttactttgaaaggtggtcggactttgtagatggagagagttgttcatgtgcactatggtggaagtgtcctagagtcgagtaatggtggtagtcagttcgatgggatgtcggtgaagatgattgtttttcaatctaagcctaccttcgaggagcttttgtgtcgtacgaaggatattctgggttggtcggacaaggtggtatccattcaagatagatatgatatggggggagagcctatttcacataagcaaatgctagagttgaatggagagaccgaatgggaggcatatgttgagatagtgaaggaatcacggttcactatgtgcacttagttgtcgtggaactacgaacctattttgttaaatgtgcttctgcttggaaactggtttgggatgcttctgcatgggtgtagggatgtttgaaagtttaaatgctaatttctgaatatacctcctccactctcttgcgagcttttccctccttgccgttgttgcgtgatgtggagaacggcaacacctggtcggtgctctggagagcacctttccctttgcgctggggtggtgggtggttcaagctgcccgctccgacgaaattggccatggcagatggaccaagaggtggagggaagccaaggggacgacgcggtagcgttgcgactcagaacaacggcgctagcggcggagatgaggtgatacgggtgggacgcgtctggaactctggatctgatgggtaaagtgaagtggtgtgtgtttcttacttgttgctgaagaagggaaggtaaatgggcttaggcctaaactacagtgcagctcgccactgtatacttaacaagttctagtgattcgtcgaggggcttaacaactcatgtttaccatgagtagatcgatgttatataagtatgtgttacgatgctaaaacaatttctgaaagttgaaatgttaatttctgaatagaaagaatctgtccatgcaaagatcaaaataaattacaattggtacaatcatatatttcaatggaaagggatgaaattcaagttgaggtgatacataccattggaattgttgcaagatatgaattaatttcccttcttcatatatagatagcctacctttgatgtgtttgttatcctgttcttttcttgcatgtactgttcacttttcaatttcaattgcatctaggaattgaacagtacgatgttttatgatctttttagtttcttggcattacttcattacaatctataactaaactatttcctcattggcgtttgctccatacatgcacattacttaaatatcccgcgtccagtccgttgcaggtaccgtgacgcatttcgctaacctagctaaccgcaacgaggaattggaggcccagcttcaacaacttcgctccagcttcaacatcctccaagcctttgccactcccttcgtcgctgtcctgatttgtatcatcgccatcgctgcgtggcgtttcgcttaatccgaccggctacaagttagccacaagtatacttttgtgtagcatatggtgctaatgccaatatggtagtactataaagacaactagaggtgaacgcgcgcttcgcgcgttgcaccagtggtgccaggagaggaaaatcattgattacatctgttggttctggtaggtaactgaaacaaatgctatttgcaaggtctgtgaaggtcaagtataggctaacgacatggtgtgagatttaggtttagtgtagtgcaaaaaatgaagttttgtgacgtgagcatttatattgaaagttgttatagaggctaaaagctaatcacaacatatatgcagattgtggacagtcctaaatagcaaaatgtgccacatgtttgatggcaggatagacagtacatagtagttttatagtggtagcattgaaacagttctgctagatgagcacataggagtataggactataaaactatattacacatggctaaattctactaatatggtttggatgccttcaccgaattcacacaggggcccttttgttgatgtgcaaatggaagtgcaatatgttttgctatgatgaattgcttcccccgtgtacatagctgcctgagaagtgatgcaaaaatacaattttttttatcaatactggcagtcaataatcttatggcattgaactactcaacaatattagaacaattaagcatccttgtttcctagtaatgttctttttctgaatgtgaaaaaagcaagttaacatagttgttttttggtatatattcagattgtaagaatcaaagaagcaattgccgatgtcaagtaatctgtgaatgaattaactgaaggaccaccagcaggtacaaatttagcccaatatgaggaaattaattaaacatctcaaatagcagggggggggggggcacaaaaaggtaccaaccaaaagcaaagtaatgatttatccatactaaaaaaacaaacaggtaaacaatccaaactgttttcagtaattttctaataatcaggtatgtgaaccaaataatgcacacagcagcatatttatttagcaaagaaagttggaatggacggtattgtaggattgtaaaggtcaattctgtcaagttaacctattggtttctggttgtacatcttttacatagattataaaaggtatgtgattttaatacctaaatcatagcaagcacaataattttatgagcagatactatcagtatgtttaaaggaagagggtgaaagtgcaagctagtcaaataatacataacttagttaaaatgggattttaacctacagggcagcactcatcgtcctaaactgaagctttatcatcccaaaccaatagttatattatcaagagtcctgaaaaaccacttctatggcaagagcaaataataacattagtcgtttcaaagaaaacttcaattttagaaccctaatcaagccaatcttttatatgctagtctaagcattacctaatcatcacatattaaataaaaaagggcataaatattagaagcattaggtagaagattcaaagtgagctgcaataaaaactggatgcatccaatgtagaacatgagaagcatctgaaggacaagtcagttacatttgtaaaatatcataggcattactgaatgcaaattagaaaacaatgtaacatcacttttttttatatcaagttaaattctgttgcacatcgtggggatgtcatgataatttaatatgttcagagttaatgtctattatgtcatgataattaattttttttatagagttaccaatcttcagctataacttgcaacagaattcttgttcacaaacaaccaaattatagaactaatatatgcctatttggtaaacagataatcaactaaattttcacttccgtaaagaacatgtcaaatataatttaaacggtgaactcaaggtaggcaacgaacaacgatcagccaaactggttgccagtggtgccatttctcctcctggaggatggcaccaatgcaggcatcctttgttctgatctactatgttgtgtgcacctggagtcttggcgtgttaaggcaggcatcagcctatcatagcctagttttgctactgaaaccattgcaccagctaaagcctacaagaataagagaagtggacagctatgccagtcctttgatcttgcaccaatccatcatgttttctttggttcttctaatattattcgcaaagcaataatgtaatccattgtaatgcagcagctgattggcgttgggaagattagatagcttagaatagaattgaagctatagatggattgtgcaacaaattgagataaattgattttctattgttaggcgccggccctaagtggcatagcgcgtagctgtgctcgaacgggagggcgaggacgcacgcctcacctccccggagccgtggtggaaactaacaggaactgggattaacttctttcttgattaatcacttaaaccgaatggcctatataggcttacaatggaaaaccaaacagctactaaccaggaactaacaacttaatcttcctaacaaacttaatcactgaaactaatcctaacaacttgatccaacatcacggcgcctgctctggctgttggcgtcggttccggcgctgatactgaatgccccacataacatctatagtgcaaaaagagcagacacatagcgagctttagtaatcacatccaaaaataatacagagaaaattacagttcattaatttatttttggtgcaacagtaatatacagttctgatccagacctgtataacctttatcaaatgcacttgtatatttttggtacaacagtaatatatagcagcagtagtagtgattagtgtgattagtgtatatgtttagtctcagattctgcatgtaaaaggtcatctaatgtcaagttacaaacatgctcgttataaattaattttatagaagtcactaccttcaaggggcataattagtaatgaacaaactaaaaatgcaaagccacagtctattttgatgaagatgcatgactacatttggatggagcattatcaaattattatccacaaaaaatattgtacattgctatattttgctggaacaaatcagcatactcatacttcaacaaaagatatatcaatttcttatacttggaaacaaagaatcttatgcattaactcatttgtaatttaaagtcatcagcatgctacaatggatcgtagatgaaccccttaaagaaatgcacagccaaattgacagcaacactaccaaagcaaagctcgccgccatcaaagtggggtcacattcggtggagatgcaacctggttgtggtggcagatgaccttagatgctgtgccagaggaccagtagggcagcacggccgtgacgcaaggggatggaggtggcagcatcctctaggagccccgcgccgatgcccttctctgctttgcgtaagctcaacaaagcttcactacaagctgcattcacacgctcacattcatagtgttacactgatttaaacttgcaaagaaaaattcaatacacatatcttcatcggtccaaattaatcacagtatcacactaagaccaccaacttggcaaagatataacatgcagtatgaaattccagaggaaactttcctctcctcacctccttccaaaaaggcagaagaagaggtaggacggagctgacgaggagccctccatgcggcagatccagcagcacccgccgtactggagaccgccgctgtccgaaacggtacaccaatgccacagatcatgcagctccctctccaaatcggttcaccgacctcctggatccagtgattccccgtctcctcgacgtcccacacgcacgtccgtggccgcctaatcgcaggcatccgctgatccggaaatgaacaggatggagagggagagggagagggagagaggggcagtgccgggcatagaggtagaagagtagaaggcggctcctggcttcccctcacttcagggcggccggatctgccggcgaggaggccggagtcaccggatccgacagtcccggcctcctcgttggcggatgcggcgcgggagcgagaggatggcgatggcaggacgacggcgcggcgacagcaacagctcgcagtagggagtgcgcgggggaggtcgccaactgcgggaagaagaggatgaggggacggcacgcggcggcggccgtcgcttgggcaggagagagagcggagcgagaggagaggaggcagaggaatggtggcggctagggtttggggaaaggggtgagggttgcaaaaacaacccctaaacttctagttttcagagcgcggttcaattttccgttttttcgcttcttcatatagaatattgttttcttaagaggtcctctaagtaagagtgcacaacgttagaactaaggaccagggatctataacaaattatcaagtaaatgaagggtgtttttgcaaaatcaccaacgacgacacggacgtgcgagagctcacgaaaaccacccgccatccagcgcctcgctaacgcgtcggcacgcgcaggtggccacgccagctcaaaaatctccaggagccgcaaatctcggcaggtttgtatataagcgatggtaatggttcagttattgtaagtattgtcctggtatcctccaagttgatgtgcacaacttatgctgaatatgacttttgtatggacctcgtcatgtaaggctgtcagaattagcatcacttttgcacctatggctgttaggcacttctatggaccttttttttttgcggggttctatggaccttcttatgtatggctaagacttgttctctagttaagtactgcttctatatatgttaaatggtttgcttagttgtgactttcacttcgcaacattgctttggttgcgcactggttatcaaccgaatgactgcatattttttgctgtgttcacttaactccaaatgtgtcagaagtaaacatagttttaagcctgtcaaatatatctcagcgccaaaccacccggcacggaaccagccatactcagtgccaacctatttggcgctgagatctagcagagcagccagccataccataatgctcggcacagctactaagttccccccttcagtgccaaatacaatggcgctgagcttagccacctcagcgccgagtcgggtggcgctgaactttgacacgtcggcacactgagtcggcgtgccatccacggtggcacgacattcagtgccggttgacctggcactgaggtggctaagctcagtgccgaagcatttggcgctgaacctctggtttatttttgaaataagttttgtgcgcggtttatttgcgaaataagttttctgaaagggtcaaattgtcattttttttgcagctctgaagcatgtacaagcagtagagaattgtgccctgtgtcgtccctccagtaatcaccctacaaaagtgtaagtaatggtccaatggggaatttggatggataaaattatgagggccaattaatgtagttaccaatcagcgattcccaaccttaagcaagtttgagtttactcatctcacgatctcatgcatcctactatgggtgtgtttagttcacatcaaaattgaaaatttgattgaaatttgtctaaacaagatttccgcaatactaaaagggggtggctatcaagctggaaaagtggatggggttgagaaacaaagaattttatacaggttcaggccttcttaacaagaagtaataccctactcctgtccggggattgatccaccgagtgtattattgatcgtatgatctgggagcagatcgtgccccaagaggcacccggacccctccttatataggggaaggggtccgtattacaaaatacagtccatatccctaacggaataggtagttacagataagattcaatcgtaaccgactaagatcccgagtatttccttaacatacaagtttggaatttaacccaagtccctttaaagatattctatctatacatggcaccccatacctagtcggattatacatgccgtgtaggtatggggtatccataatctccacagtagcccctgagacctttacagtcaacaaaatagttttctctcgtaatcccaaacgataatccgagcactccaacttcttctgccttggtctcccgagtatcaaaatcaaagactgtgaatggctgaaaatagaaaaaatcaggtgcatcgactagatgcacctaattaggtgtagcccccgactaagtgattagttaaaaaaactaaacatatagtcaaggtgtaaataacatccaaccgagtggttttacaaccgaatcatccaaagtatcatacaactaagcatatgagacgtttgataaaatatccagccgactgctttagctttgatataccaaaaatggaaatataaagaaacccgagtaaaaaatactataaggtccataatccaacacatatgacaagaatccgagtaaaaactctcaaaaagatccatcaaatgtgatataaatcgatgagtctaaataacctaggccatgactcacgtcataatcaaaataagcatataacatgccgagagaatgactattcaaaaaccagtcacctcaacaaaacccaaatagtttttgcagcctaaaaaggcctacaaaatcagtataacacttttctgtcaggcacctttttatttgcattgtagtaattccacagaattatctaactgcgtcaaaaaggattttaacagcattgggctatattgtcgtgagcaagtgttgccaaagcaaaaacaaatgcctaagcccctaaggatcacaacttaaccacgctgatagcaaaactgggctgaagtactgtttaggcccaggcccattagtactcccgataccctaatgagataacaccgaaggcatagcgtcgttttgtcttccccgccgaaactcttgccactttccctactcactgctatagtgcgaaatcacttcggtgaagctagggttcacaaatcccctccaatccatcctccaaagttccacaaaaatcttccgcgcaaccaccgcatcgatctcctatccattcccggccatatttcaaaccaaatcgcatcatccaatttgcatccatggcagaggagagagaaagctttgaaagtcagtgggtgccctctgatgtgacagaggaaaacttgaaggagatggtggcgcacggcgttcttccggcaaaggagatcattgggtggcgtccggcgtgcggcgaagcatttccaacccctgacacacatgaggtcgtggtattttctcatttcttctatggaagattttctcttccaacctcaagattcttccgggggattttggaattttatgggattagtttgcatcacctaaaccccaattccatagtccacattgccaattttatccatgcttgcgaggctttcctgggtataagaccgcatttttccctgttccgtcgcatcttcttcctcaagcctcagccaaacaagagcaaaccatgtgttgtcgggggagccggtttccaactaaggggaaccttgagccaaaaatacttttccatgcccttcaaaacttcgaataagggttggcatgcaaattggttctatgtgcaaaatcccgagccagcgcttcccgagtattcttgtctacctccagtatatcaagacacctggaactcgcttcccatgggagatgaggtggcccaagcacttgccctgatcgatcgcatgctgaagctcaaagagcaaggtctgcaaggagagcagatcacccggcattttattaaaagccgactagcgccaattaaagagagatcccgcacaacctttgagtttgacggcaagcatgaccctaaccgtgaagatctagattctcttgagtttaaagtcatgaaggagagaatgtacaaaatcttctcgaatgctatcgtggtcagttattcgcacttgttgccagtggtgccatacaacgccttcaaccctcctccgcgggtatgtatcaaacatctcagcccttctcaaaagcatgcttttatcttctgcaaagttaattgaaagcttggaatatcatgcccaggaatttgccttgatgaagtcggatcctccaattgctcaacatcgctcgccccgtcggcagactagtcaggcgagtggagtacaaaaaattcggtccgatactcaaccaaacacctcgaaatcgactaaccagtcagactcccgtaagaggaaattggtcctgagcgatgatgaaggtgatgatgccggcaacaaaggggtgaccgaaaaacagccaaggcaagccaatccaaagaagaagacatccagtcgtcccataccaaaaatcaggaaatcatctaggtacaagtcgtttagcaatttcctttgtatcgccagtcactcactattgaagtagtactgatagcatatctcaaacttgcaggaagccatctgatatagatccttccggaaaagaccctgagccgaatggcgcggagactagtccttcaacagaaaccaggccgaccgccgaaggtcgcccgagtgataatcaaccagcaaccgataatgtagaggccagcaacgagcccccgactggaaaccagttggccgaagctgaagccaatgttgaacaggagcccccgactagagaccagtcgggtacagaacaaaataaggacatcccagaagtagaaactcaagctaacagccctcccaggaaggacgctggtgttgacccgggatccaactctcctgttaggataaaaggacctgctcatccccgaccggaaatcataacaggtaaacaagtcctccaaatccgttttgatccaacaaactttcttcaattgtctcaccattattcatgaatatataaggcccaatgattggtgacaaagaagaggtcctccggatacgatcggctgaagattctcgcccacccatattagtcaagtggtgagacgatgaaatgcatccacagggaatcgtgataaataaacagaaggaagacgaggaagtgtgtctgctgaaaaagacacttggacaagctacccgtcttgtaaatgtaagtctctttacatacagcttcaatcatcctgtcggccactttactgaataaagacgcacttgtaatgcagagaatccatcttagaaatgaggcaaaaactgcaatcctcgagaaattggttccccaccttggaaccctggaagcaaccagagatcaactgcgtgaagccaaggagcttgctaggaagactgagcatgaccttagagaccggatcgccgagctccaagactccaactttgagctaagtggttcatcaaaaggtaactctcatccttatctgatttgtttcatgctgctattcatgtgcgattaaccagtggaaagcaatatagtgaaagctgccaagatatccaagctagaaaggcgaatccaggctctggagaaagacaaggtcgaactggcaaaacagagggactcggctctgaaagatgtcgaaggtacttgtagctgaaacttcaaaaaccactctcatcttcatgcccagtcattgatgtgaatttatttgtacagatcgcaaaatcaaatcccaggctcaattcgacatcttggttaacaaaatcaagaagcttgaaggagctagagatgaagtcgccaatgccgctacgccactcgtccaggccatgtttttcaataacaatggtccgagttcaattgatgctgtcgaaatcttcgacaagcttagaactgctccggatacatattttaagaacatcaaagaagctggaagtatgggggcaagtctagagttggcgatgaccaagtccttgtacccgaagattgatattgatgttgttgacggcttcgcagacgggacaagtgaggaagccgcccttgacctcatcagtgatgcgcaaaaagctgccgacaagatagccgctgatgtagttgagaggttacaggacaacgatcttaagccgactgggtctgataactctaatgattaaaaaactgaatctgattgattgtgtattctgatgataatgatgatgatgatggaggcacaatttgtacaatactgatgaatttatgctgtgcttgatgatttaaactcagctctagatttcttaaaagtttttatcaaaccttattgagcctagaacccgcaaaagttgttaaaaactttcagtcctcattggctaagctaaaaaatcaaacaagacaatgataaatcaagtaagcaaattgaattgataaaaatcacactccattattattatagtagcccccgactggtaactcaaggaacaacttgatgttagtagtcaaagaggaagatacaaaagtaatgcctaagcataaaaacgacgaagatgctcaatattccaagagttgtcaacatgagtaccgtcttcacacatgagtcgataagaatctggccgagtaacttcagaaattatgaatggtccttcccataagggagatagcttatgccgatctcgtgtagtttgaattttcctcaaaaccaggtctccgactaagaaagctcgtgaaagaacgttgcgattgtgataacgtcgtatcccttgtaaataccgagccgactggattaaggctgcttcacgggcttcttccagtcggttgagatcatccactcggtcttctccgtagcgctcctccttgaagttacgaaatcgcaaagacttgtccataccattggtcgaaaactcgtacttttattccttaaagtaccataccattggcgcgttcgacttgtccattgctcatgggatgcgctacggaggcataacaaattttgatgccgaagtcttcaaaggaatctttaaatactccgccggtgaattgagtgccgttattagtgatgatccgattaggtaccccaaaccagtgcacaatgttgatgaaaaaaatctatagccttgtctgccgtgattgtgacgactggtttggcttcgatccacttggagaatttatcaacagctacaaagagatgagtataaccaccgatagcttttttgaatgggccaaccatgtcgagcccccaaaccgcgaacgaccaagataacgggatggtttgcaactcctgagccggtagatgagtctgtcgggtgaaaaattgataaccctcacatgttcgcacaattatgtcagcatcagatacagcggtggcccaaaaaaaaccctgccgataggccttgctaacaatggttcgtgtggcagcgtgattgccattgatgcctgaatgtatatctcttagcaattgccttccttcctccaaagacacatagcgttgcagaatccccgatggacttttcttgtacaattcggccttgtgtatgccataaagtttgctgcgcctggagattcgctcggcttcgtttttatctggagggagttcttgcttggttaaaaatttaatgaggggctctctccagtcggcttcaatcatgcttacttcttgagtgtccgtggcctcgactatttctttcctcggtacagttggttcataaaaatgttcaacaacacgtcggaaggagctgcttctcgttttgaaccaaaattagccagtctgtcggctgcctcattattatgtcgaagaacatgggtcagctcaaggccatcaaatttatcttctaacttgcgtacctcctgccgataggcggtcatattatcatcaaggcaggaccactctttcatgacttgattaacaaccaactgagaatctccacaaactatcagacgccgaattcccaaggagatcgcaatccttaatccgtgaagtagcgcctcatattccgccacgttatgggacgcagaaaaatgtatccacaatatgtagctcaacctctctccagtcggggagattagaacaacccccgctctggtgcctgaaagcctctttgacccataaaaatgcatagtccaatactcgatcttctctgcaggcgtgtcttcttggcacttggtccactcggcaacgaagtctgctaaagcttgggacttgatcgaagttcacggcttgaaggatagatccaaagacatcaactctaaggcccactttgtgatccgcccatatgcttcgtggttttgaagtatatccccgagtggaaacgatgtaaccaccgtaacgagtgatcttgaaaatagtgagataatttcctaacggtaatcaaaacaccatataacaacttttgaacctgaggatatcttgtcttggagtcggccaaaacctcgttgacgaaatagattggtcgttggactttttgaagatggccttcttcctcacactcgacaaccaggaccgtgctcacaaccttggaagtcgccgacacgtataacaacaacggctcttgcggatgtggtgaagctaagactggtggagtagtgagaagtttcttgaagttttcaaaggctttttgtgcttcaggtccccactggaagttgtcggttttctttaacaacttgaaaaagggcatcccccgctcgccgagtcgtgagacaaatcgagtgaacgccgccatacatccagttaacgtttgaacatctttctgggaactcgatggtttcatgttgatgatggcgttgattttctccgggttggctcgtatgcctctatgggacaccataaagccaagtagcttccctaactgtactccgaagatgcacttttcagggtttaatttcatcctgaaagcgcggatgctcgcaaaggtctcttctagatccgtaatcaaatcatccttctgcttggtcttgacaactacatcatcaacataagcttcaacgttgcgaccaatctgagttgaaaagcatctctgtatcatgcgttgataagttgctcctgcattctttaatccaaaaggcatggcgatgtagcagtaggccccgaagggcgtgatgaacgaagtcttcaagcagtcggactcctttagtcggatctgatgatatcctgagtagcaatccaaaaaactgagtaactcgcagccagccgttgaatcaactacctggtcaatgcgaggtaacccaaagggatctttgggacaagatttattgaggtcggtgtaatcaacacacatgcgccattgccccgtcttcttccgaaccaggactggattggccagccagtcaggatgtaggacttccttgatgaagcctgctgctaacagcttggtcaattcctccttgatcgcatccttcctatcctgtgcgaaatggcggagtcgttgctcgataggtttagcatcttccttaacatgtaaagagtgctcaatcacctctctaggaataccaggcatatcagatggtttccacgcaaagatatctttattattttgaagaaaggtgatgagcacgctttcctattgataatctaactaagcgcctattacagcagtcttagtagggtcagagggatctagaggaatcttctcgatcttggcatcgccttctccgccttttgacatcttggttgcagacacttctccttcggttgcagtgaacgcagccagtcggatttcttctcgagcgagcgcaatctcgcgggtctgagctatctcccaactttccttgtcgcaagtgacagcttgcttgatgtcactccgcagggatatgactcctcggggacctggcattttcatcatcatgtaggtgtagtgcgggacagccatgaacttggctaacgccgggcgtccgagtatggcatggtacgctgtctcaaaatcagcaacttcgaagcaaatattctctgtgcgaaagttctctcgagtgccgaaagtaaccgacagagtaatctagccgagtggagtagaagacagcccggggatgactccgtggaagggcgcattacttggcttcaattccgtgcgagggatttgcatgtcgtccagagtcttggcgaaaaggatattgagtgcagtgccaccatcgatcagggatcttcggagcttgatgttgcaaaccactgggtctagtaccagggggtaccgccctgggtggaccactcggtcagggtgatccgagcggtcaaacttgatagttgtttctgaccaccgaagatattggggcgtgtcgggctgaacagcattgatctcccgttcagtcagcttttgctttggcttggattcataagccaggggtccgccaaagatatggttgagctccttgcgggggtcttggaaaccagtcggggcatcatcttcatcatccttcttctttgatgtgctttgatctctgtaagtcgacttgcgtgcgttcttggcgtattgctctgcgaactgtttgtaaacgaagcagtctttggccgcatggttggaatttggatgatgcggacattgagagttcatgatcttgtcgaaagtgttgacgcgcgaacattgtcgggaggatggtgtagtggttgccacaagttcctcgggcttacgcttgcgatccttgtgattggtacttccactccctcctgtggtcggcgtatctttcttcggcttccaagtggtgcccgactgcttagatgcggtgacggcatcttcggcttttgcgtactcattggctttctcgaacatctgcttgactgtcctgggaggcttgcgtccaaacttgccaactaagagatcatggtgaatgcccttggtgaaggcggcgatgatgacgtcgtcggtgatatcggagatcttgttgcgttgctcggaaaaacgtcggatgtaatctcgaagggattctccggacttctggacaatgttgtaaagatcgaactgggtgccagggcgttcaaaggtgccttgaaaattggcaatgaagtggtcgcgaagttccgcccaagatccgatcgtgccacggggtagcccgtgaagccaggaccgggcagaatccgctagggccacgggcagatagtttgccatagctttgatgtctcctcctgctgcgcgaattgcgagactgtagacggtgagccaagtctcagggttagtggtgccgtcatacttctcgattccagtcggcttgaagccggctggccaatccactcgacgcaggtcgcttgtgaaggcagcaactccatccacgtcgtcgtcgtaacgatctggtgaatggtgggggatgtagcctcttgccgcacggcgctgattgatagtttcgcgaagatcgatgggacgcctgcgatgtggggagcggggacattcagctcgacgctccctgtgtcggtcaggaggcgagtgaacggattgctcgtcgtgatccctgctcctacgactggttccggcgccgacgacgctgaggctcggttggtgatagtcttgagattgaagaggcggaactcggctgccagttggcgtgcggacactcgcggagttaaccgggaccgaagctgcgatcatggtcttggtctggttcaagatgttgacgacgtgattggcctgattgagtgcgtcttccttgaggagggtgtcgaggagggtgatcgctgcaaccacgttctgttggggggtgcgaaaaaccgccgtcccctcgacatcttgttgcccgatgagttctcgtgctcgtcgcccggcctccaagcctcctttgcagctcgctcgcgctcctgttgctcacgctgcagccgttctcgctcttgtgcttggcgctcctcctccagtcggcgacgtttggcttcctgtcgcacgcgttgttcttcttcttctcgggcttgacgctgtttttccgtctcgttgtcggccatgaaaatgccgaagtagagggggcgtgtagtaatcttcatagccttcgtcgaagtcgtcgaggttgcggtagtcgtagcggtagccgaagtcgtcgtactctacgatctccgttggtcgtgagtcgacaccgggggagctgaggtagccgtccaactgtttcgtcgaaaccgtgccgagaggctggagtatgacaccgacttccctagagctagactggatcggggccagggcggatcccgcctagacctacggggagatgacgctcttgtggtgaaaacgacagccaaatcgttgaggagtttcatcaggattggcggataggctctattgtcttcatcgggtcgtgttggagtagattggatctcgtccgagtggtttggggccaactcggttgagatgatcttggggtagatctcggccaagtttggggtacgaacggggcggaaacctggtctcttcccgactggttcgaatccgagtcaagaagagaaatcttgccgaagtcgttggtgaagaagttgaggctgccgaaccggaacgcctgcccgggagggaagacgaagtcgtcgatgccggagacgaaacccatcgcactaatcggcgaagaacttgacgctacccctatctggcgcgccaattgtcgaaacaagattttggcaatactaaaagggggtggctatcaagctggaaaagtggatgggttgagaaacaaagaattttatactggttcaggccttcttaacaagaagtaataccctactcctgtccggggattgatttgccgagtgtattattgatcgtatgatctgggagcagatcgtgccctaagaggcacctggacccctccttatataggggaaggggtccgtattataaaatacagtccatatccctaacggaataggtagttacagataagattcaatcttaaccgactaagatcccgggtatttccttaacatacaagtttggaatttaacccaagtccctttaaagatattctatctatacatggcaccccatacccagtcggattataaatgccgtgttggtatggggtatccataatctccacaaaattggaataatgtgacggaaaagttgaaagtttgtgtgtaggaaagttttgatgtgatggaaaagttgaaagtttggaactaaactcggcctataatatataggacgattcattttgcttgaagattggtgatctaccggtatatttcctccgtactaaaataaacaatccagtatgaagtatgatatatcagaatcctattgttacgaaatccggacagtagatcgttataattgcccaaccaaaaaaaaaaagatcgttataattgccagtacacgaaggaattattactattgggccgattgggtcaataagcccatgagagcccactgggccggtgctgctgacgtcacgccgagctacttacctccgcgagcggccacaactccgctcccctcccccctcttcgcctgagtcgagtcgcctcccccaccgccggccaaccatgctgccgccggccgcccgcctcgcggcccgccgcctcctagggctcgcgacctcctccgcctcggaatcggccgcggcgcgacgcttgtcccgttctccggtcagtgcccccctccccctcctccaaatgcctctgtatctcctcgctgttcgtcggcggagctttgccgtcctgatctctccctccgggggcaacgtctcgttgcagatctcctacgccgccgcgggctgctcctccaggctgttctccacggcgcttaactacgtacgtgaggcgcctcccccttccctcggatccaccccctaccctcttccctgatctgtctgttttgtctgaggatgataatgagtcggatttgtgggtttgcttgttgtgcagcacctcgattcgccggaaaacaaccccgacatgccgtgggagttcacggaggccaacatgaagaaggtgctgttgttcgtctcgttcattcatttccctgtgatttatgttttggattggaacagtggctggttttggagtagttgtggcagaatttgttcagttttgttttcggatgttcagaaatggctgttagggtaccattttattcaggactattagataataatataatcttacgttggaactggttgctggttatttgagaaggggaaacgttatctgtcatgtaaaacctttagaaatgtgcaaatctgcaaatgtccaaatgtaatagagacgtggggtatagtgttctattcctttgacatgggatttaggttttgtgaatacggtttatatcaattgtatcagctattttggttatctggcctaaaatctctatttcaataactaattcaggttaatgagatattgtctcactatccaagcaactacaagcagtctggtattattccaatgcttgatcttgcccagcagcagcatggtggatgggtgccagttgcagcaatgaatgctgtaagtcccttttttatgagctttcgatgatcaactgttttccgcctttaatgtgctatatcctgttttcaatacttcaattttcagaaagtgatgtacctcaacatttgttagttgttacaacccacgttagctatagttatattggacttgcttagcagacattcataaatcaaaaccttattgcactggccttgtttctgttcacttcttcgtcctactgaagatgggtgacactaggaaattaggagccttaatagtaagaggcattggagaatgggggttggcaatcacaaaagaaaaagttcttgtcagcatatcagttgacatatttatataattataattacaattgagttaatctcctcaggactaggactattacaataacattgctactgggagtgttatagcttatgttacattttagatattttgtacatagacccaaccaccattccaccaccactgtgctcacaaaaagcatttctgacaatactattttcatgtcttggactttcagattgctaagatcgttgaagttgcaccaatcagagtatatgaagttgctacattttacacaatgtttaaccggactaaggtatctttgcatgacttagtattttgtacttgttaatccctccactagcatcttttcaccctattttgccatgtaggtgggtaaatatcaccttttggtgtgtggaaccacaccttgcatgattcgtggttcacgtgaaattgaagaagccttgttagaacatcttggagttaaacggaatggtttgtattattcacataacttatcctatcaactaagaataacacttcctgatttgttaccacaaacggtcttcgagcatgtgtttctcttgctatctctgtgatagcattaacatttttctttcatttgcagaggtgaccagtgatggtttattttctgttggagaaatggagtgcatggtaacttcgagatctataattttctgtcattttggatgcttgcaaataggtgttctagttgagttaagtgtttaactatagccaataggaatggtctgtaggattttgtcagtgaatgattcagtactctaatgaaaaaacataagtacaaggcaactttttattcagctttctgttatatgttcacagggctgctgtgtgaatgctcccatgattgctgtggccgattattctaaaggttcagagggttacacatacaactattatgtaagtatacacattgatgcatccgattatctattgttgatgacttatgctagtacacgcggtggaaattttagtagaaacatcacagcattagtaagaattagcagctggtgcccactcgtgttagttcatgtttatgcacaaaatgaaacattgtcaactgaagaatataaacttgcatgttataggatgctgggcccctgggtttctatacttcttagcaggcgtctttggagaaataatgctaacatagctacatttttttgctaaacttccatgctatagcagtactgtggcactgaaagcactaatgccaacagagtaacaaaagacgagtggataaaacttaacaaaacctgcctgccttttgctgagagaggaagaaaagacttatttgtgtactgtaactgagcatttccatttccccttttcaggaggacctcactcctaaacgagttgttgagatcgtcgagatgctgaaaagaggagaaacccctcctgtaagctttgctcttgaacgaaataattcttttgatatttctagcgacaagttttactcagtttgatgttatagatatcaagccccaccattggtttaggttgcgaactgattttgatgattgtgatgatttttgcagcgcggcacacaacacccagagcggaaaaactgtggccctgctggagggaataccaccttgcacggtgagccgaaacctcctccgtgcagggatctagatgcttgctaggtttgctttgaattacaggcacacaaataagttgggccacactatgattatatggtgtggaaactggaacaaagcaaggcgatgtgttgtttgtattttgatcttgttttgtttacctctgcccgcatcttttttctctccttttgcaccatcagagaaatggtacattgataatgacgatatgttattttgtcagctgacatgaggcggcagtggtaaaaagatttgtattcgtctttcggcaaagataaaactcttggacattctctttttgggcattccttttcagcttctgattagtgatgagtgcccattaaagcacgacatcatcgcgtgttacattgctaatctagctgtttgatcttttagcagccgttcatgatttgatcatgaacattacattcttctccaactaagttactctagaaaaggttagggcctgttctttgtctgctcggatgatggattaagtgtatgacaattattcaagaacatgaaccgatgaattaaatattacagggttgaaagttgtattttaaaaatgaagttctaatatatgttgatgaagatttttttaaaaaaaattatagcgtttaaaaacttggaagcgtctcctcgtaatccattactcgtaaacaaaaaaaagaatacgacctaaacagctaaggccatgtttaaatcccacccaaaaatttgttaccccgtcacattgaacgtttgaacacctgcataaagtattaaatataggctaaaaaataactaattacacagattgcgactaatttgtgagatgaatcttttaagtctaattgctccatgattagataatgtggtgctacgataaacatttgctaatgacggattaattaggcttaataaattcgtctcgcggtttcctgatagattctgtaattagtttttttattaatacccgaacaccccatgcgacactctatgtactacccgatataacacgccaaaatttacgaccctgtatcaaaaccaccccctaaacggctaaactaatttcggtgctttctctcagggaccattttgaatattacgcgttattatttggacctacctgcaaatatctccttgtctttccgccatcagctttcccctcctaaacctctccccattccctcgcaaaaccctcgtctcctccacactctgctcttctcgcaaaccctaatcccacgcgcggccacctcccatggcgcgctcgacctccctcaccgaggcggaggcggggatcacctgcttcgcctcctccctcccgggcttccgcggcgtcctcaagcaccgctactccgacttcatcgtccacgaggtcgcccgcgacggctccgtcgcccgcctcacctccttcgatctccccgacgaggtaagcttagccctctcgaccccgattccgcggctccctcccgggatccccgattttttttcatcgcgctagctcagctccgccgtgtatcgcagtgcgtggatgtgagtgaggaggacaaggcggcgccgtccgccgacgcggaccactcgcaggccctcgagtcgttccgtgcgctctgtggcgatgcggattgcgacgcgttgaaggggctcctcgagaaggcgtccgcgggggctgaggctgatgtatcgccggttattctctcgccggacgccgataaggctcatcgatcggttggtttgatcccccagttccagtttctggttgtttatgtggttgagattggtggaaatggtgtgatttgggcgtgtttttggctgtaggaggtgcataatttcttcaagaggagcttcaagtttttggtcaccgacacggtcgaacacaatgatggagttcagagatgcattagggtgcggctgggatcaggagctagggaagggcggggtgccggtggaaaaagtggtggtgggaggggaaggaagaggaagaacatgggtggttctgattggagagatgacaggccatttgatagcagaggatcaactagctggccaaatcatgttgggaagttcctaaggtggtggaattcagcttgaattgatagtttctattggcctggtatctttagctggcctttgtactcgaatgtgttcatctgacttgctgtgtattttacttggctaaacttaataaaaaacatctaatctatgtgtataaatttgtataagaaatattatgtttttgcttcgtctaattttgctgttaattagcgttataaccggagttgtcattctggtgtgctgaccaggtttcacctttgcaaagagaacaaggacacacaagaagcgttaggagtaattgggaaaatgttaggacttcaggtatacctcggttgctaactcataacattgtgttcttgtttctactgaatgctttgattcttcttttttaccttccttcgcattcctagttgatttctataccttttgcaatttgcagtcacgttcattcgggtttgcagggacaaaagataaacgtgctgttacaacacaacaggtacttattcctcatgtgcataccatctcactcaattttctttacataaatcgtgtttttgtacaatttgtttaaaagttcgcatacaagtatgcaagaaatactggtataattttaattaaggcataatttatggtattatgatgttacaaccagatgagataagtgaagctgctctggtttggaatactacatgtagtattgtcttggcaaaggagttttgtgaaatgaaactacaagatcatttttctttaactagtaccgttcatagtttttagtcttttcacctttagtttgtattgcttggctttgttctcatctctagcctacccagcttggttgagattaaaggctggtgttgttgctgtattttgcatagtgatttttagtctatttgacagatttgtttatgttatctcactcctttttcatggttgtgatcctctgcatgtaattacgttttcttgcaatggttacttttctgattgttttcccctggttaggtgactgttttcaagatatcagccaacagattggctgcacttaataatcgactatttggaattaaagttggaaactttaggtaggtgataaaatgcattatcctctttgttgatatcattgcaatgtaattattctaaatactaattatttttgcattcctttctagttatgtgaaggagggacttgttcttggtcaactaatgggaaatcgatttacaattactctgaggtacttgttttttatttctccttttagtttaatgtaaaaaactaaaaatgttctctagtgctctaaaaaatgatttgcactaatcttagagctcatggagggcctgatttgcagctacatattacttcactacaaacagtactatatttcacatgcaccaaacctcttcttttcttggttcaagaaaaccaaacaaatggagagctgatattttcctgcatttcttcaggggtgttgttgcagaatcagaagacataataaaggcttctgtggagggcttaggaaagaatggatttatcaactactatgggttgcaggtatgaagccagaaccttttcgttatgcttcaaaacctaactggtacgtgtttacttttgaagctcatcaagttcatcttttttgttggttagcgttttggaagtggttcagtacctactcaccttgttggagctgctttgcttagaggagagtggagaagttctgtaaatttgattcttgatccaagggaaggagatatccttgatttattttatccaatcagcagttgcatacttggatatatagctgtgccaacttttgttcaacataacttaatactccgaacagagagatgacataagggagatgcgtgaacattacaaggagcatggtgatattgatatggcactaagaaacttccctcgacatcttgtagccgagaaggctattgtaagtgtagttcttttccttcattacttaacctggaattatttaaaacattggctttttagtttttattcaagttatgtaatgtagatcacattatttggggaagttaaactgatattctttcatgcattgtttccagcttcaatgtttgaagaaatgccctggtaactatctgcaagcattaaagagtataccaagaacattacgaatgatgtatgttgtttaactttcttcgtcttttcatgtttctttacattgatgggttagtcaatttctgttacctcaaaagctaagtagattttataatatacaaaattgtattggaattattatagacattagtcatgaacagtagtagatctgttatatgtacctgtttttaaaattgttctctgctgctcaatatacataccgtttgatatattcaagcttttctgttaccctttttctctgttctgttttgttgaccaatttattaattctcatattttgcttatgcgtctttcttatttgctgttgcctcttttatgaaggtacgttcatagttaccaaagttacctctggaaccatgctgccagtgccagagttgaaaaatatggtcagtgcacttcatccttctacagctactcagttttagttgaatcatgatgcagtttgataattttctgataacggctaaccttgacctttttcttcaggcgtgttaccttttgtagttttatatggtgaacttctcttttcccattcctccttatgctaactggtgtacttgacaggcatttcgcaggctgtagaaggtgacttagtttatagcaaagagccccctcctggagaagcaacttcagttgatacttcagaaccttgcgatgaccaaataaattcatctgatattgatctatgttctgagacacttccagaagaaacaatccagtctgtgaaggtctgtaatttgcagcaaacaatgcggtgtacatgctcatgcacaaaaagttcctaatcatgcactgtcatttctcgtgtagatagttgattctgaagatttattgaagggtgtctacacatttgaagatgttgtccttcctttgcctgggtatttaccattccacatccataacttcaattttcatattgaatcacattgagaaatatatatggtgtgcttatttctgtaaacatgcagttcgcaagcattatttcctggaaacggaattgctgacatttatcatgaattggctaaaaaggtgctactatcctacaaaatttattttatagtttattcagaagtacttcctttgctttgccaggaacttgtgcattcttgaatttcctctataacccttctgttgctaaacgcaaaaaagaaaaacacatattgtaggttattggttgctagatatgtttactgtgaaatgtgtttagtttcccttttctttttgtggataaacgatacttctgtaatgtcacaggtttaattggctaatatattatgaatgaattacacaatattttttaaagtgaaagattaaatccaagaaataggaatcatattgttgatttgctttcatgtctcaggatggcattagcttgacagagaatgcacatggtgtcaagtaagtttctttattttactgtaaagatcaaaggcacctctaaaagtcaatacttagtatatgtgctatgacaagctttatatctttttgttctgatatcctactatattctcattctgttgtatatattaccttggcttgcatatttcaatttgctactttataccctaacttctatgctatatgatacaaactccatttttaagggagttttcaattacaagcatgaaaggaggttatcggcgggtgttccagcggcctattgattttgagtggtatgccttatcccattgacttttcacttcattagatgaccaaaatcatcaccttttctttcgtataaattctagccctgttccactaaaaaatgctttggtgtgactgtagggaactcatgacttatacagatgacacagcatttttagcagaaactgatttggatgttctgtccagaaacaaacctacaaaagccaaggaagtaaatgagactatatctagcgcgatttcaaatgctcaatcacatgattccaaggtggcaggaccattggatagctctatgccaggtagtgaaactggcttagtagaggaaaagtctgtcggtagctcagatatgttagcaaggaaattggccataaaattagcatttactctaccagcatcttcttatgctacaatggctattaggaagttgctgaagacttcaacctcggtatgtttctcaactaatattatattactattcttttactagaatttaaatgatgttaaatggactctgtttatggtgttatgcatagttaagaatgcatgcctacttgagaattcaaatacatttaattatggcagttgcccaacagtattgttaatattttaggacgtcaggagaaaatattgctgaatatttcaatatatatgctattgctctaacatgttaacaaataacaacattcatttcataattaccttctgctcgtctgcaggtcacgtatcagaaaacactcgattgttaattttgttattgacatcaattctttatggggaatcttccaagccgcatcttagaggagttgacatagttaagcaacatgagttggtatggtgtttgaattgtgtttgtgtaatttttatcgcgtggcactaagttattaacttataaatcctgatctgattattgcagtattgcatttaacagcccaaatgaatcggcattgagatataccatgctgctcggcctgctcccgttcggtgcatactgaattgctgatgcacgtttgtgctattgtgggggttaaaaacttgttttgccactagaatatgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttatcgatgactcggcttccttgtttttcccggccaaaccggaaaaggacccccgggccaaagcttctttacacctttgtttcttttttagggggttttaaaaaactttattttacaaaaaacggcacctctaccggaatttttatttgaaaaccccgggccccccctactttttacaccaagagcccagggtattttttttctttcaccgcgtgggcctaaccccaaaatatttaccggttt

SEQ ID NO: 34420 - DNA, 741 bp, Oryza sativa
  unsure (1)..(741): unsure at all n locations
ctccttatcgtaagtacccgtanntnccatgnannanncnntaannnnnnangggaaattaaaccctgaaaagtgcatcttcggagtacagttagggaagctacttggctttatggtgtcccatagaggcatgcgagcccttcccgtagaaaatcaacgccatcatcaacatgaaaccatcgagttcccagaaagatgttcaaacgttaactggatgtatggcggcgttcactcgatttgtctcacgactcggcgagcgggggatgccctttttcaagttgttaaagaaaaccgacaacttccagtggggacctgaagcacaaaaagcctttgaaaacttcaagaaacttctcactactccaccagtcttagcttcaccacatccgcaagagccgttgttgttatacgtgtcggcgacttccaaggttgtgagcacggtcctggttgtcgagtgtgaggaagaaggccatcttcaaaaagtccaacgaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34421 - DNA, 1647 bp, Oryza sativa
  unsure (1)..(1647): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttattccttgacaacggaacttgattgataatagcactcagtactcaccctatgggttatgtggccactggttccatgccttgcagaccagacggattggtcacccctgtcgtactcgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatctataatttacaatactttctttcatcttatccctctctcttcctcacttctatatcctccttctcttcccttcttactatctttcttctctcttcactcttcctctctctctttactcttctccttctttttctttcattaattctctctctccttatctttactccttattcttttctcttctttaatcacttacttctttctctttttctttccctttctcttttacttctctccatttattacttcctccctcttctttcttcattcatctctatctcttctctttcttctcttcnctttcttccctctactcttccttccattcatct

SEQ ID NO: 34422 - DNA, 1259 bp, Oryza sativa
  unsure (1)..(1259): unsure at all n locations
cgtgtgcctttgattgatcnaacnnnnnnnnnnnnnnnnnnnnnnnnnnnnnnnnnnnnnnnnnnnnnnnnnnnnnnnnnnnnnnattgtcagtacgaaggattttcacctttctttcagtttgtctttcaaccatagttttccactctttaaacacatcaaaagcttgatatttgtgcttcaagaaataaggccaaacttttcgcgaataatcatcaacgatagtcatcatgtaacgagcacctccaaaggatgtcttacgagcaggccccataaatcagaatgcacataatcaagaatactttcagtagtatgtgtagatgtgttgaacttcaccctcttatgcttgccaaagatgcaatgctcacaaaatttgagcttcccgatgctttgtccatctagcaatcctcgctggcttaattctgccaaaccaatttcactcatatgcccaagacgcatatgccaaagattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34423 - DNA, 1859 bp, Oryza sativa
  unsure (1)..(1859): unsure at all n locations
ccgctttccctaaagccccttggggttgaaccccccgatgttaggaaaaccccccgaaaattgcaccttattttttaaaacccgttattttttaaaaccctttttttaaccaaaggcgaaaggcacattccttataacaaaaaaaacccaaaaagtttgggtttcccctgtgaaaaaagaccccttataaaaacggccttccatgtcaaggcaataccgttaaaaggacattgccccaacgtgacccaaccctaaaaaatttttaggtgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacagtggtcagatcactcacattccacacaaacaagcggagatactgaccatatggggatgagtgtggcacgtatttctccaccagtttttctgatgggaggatagtaggattccatggtagggagggatggtacattgatggcatcggggtccatgttcaggaaggtaacttggctgcaccgcgagttagtagtagatcaacgattgagatgaacccctctttgcgctacgacatgcttgcacaatcaaggagtgaaacatacaatgaggtagctacaattcttgtctgaatcataacataagtatgtggctgcagagctaacttgtaaccgttttccaggttccttatagcatggtgaaagaaccagttccaatggggccagggccatggggtggcgaaggaggccggccatgggatgatggtgtctacactggtgtgaagcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggaggatacaaaaaatgacgtttagtcaaagtggggaaacccccaggatattagaatacaggggttccnctggaagatcctttgcgcttctgttctaacctgcgttacagaaacgggcgccttttctttgggaaggggggtttttataaacacctgggttattaatggtgaggggtgccccacctgtg

SEQ ID NO: 34424 - DNA, 3723 bp, Oryza sativa
  unsure (1)..(3723): unsure at all n locations
nggagaatggaccatctctccgcttacgaagaaaactgtttctgagcctgaggttaatgaaggtagaggatgatgaggaggattatgccctttttgtactgtgttcatgccctagctcaagggcggcgtccagggaagctattcttataggtggtaatctctacttataaaccaggtttatggtgctttgcatcccaaccgtagagaaagaagattggccccctctgaaggttcaaattcacaagcagaaggcttggttgttcgggccaggcaacaggagaagaacacaaacagcaaatcaagagataaaggtgcaagtagctaccgtgggagatcaaagtccagaggcaggtataagtcatgcaaatactacaagagagatggacatgatatctctgagtgttggaagctacaggataaagacaagagaaccggaaaatatgtaccaaaaggaaagaaagaagaggaaggtaaagccgcagttgttactgatgagaagtctgatgcagaattgcttgttgcttatgctggttgtgcacaaactagtgaccagtggattcttgatactgcatgcacctatcacatgtgcctgaatagggattggtttgccacctatgaagctgtgcaaggtggtactgttttgatgggtgatgatacaccatgcgaggttgcaggtgttgaaacagttcagatcaagatgtttgatggttgtatcaaaacattgtcagatgtgcggcatattccaaatttgaagagaagtctcatctctttatgtactcttgatcgcaaagtgtacaaatattccggtggagacggaattttgaaggtaactaaaggctcttttgttgtgatgaaagctgatataaattctgccaaccctgtcccatgtgcgagggacaactatattaggtaatattgctgcagtttctgattcattatataattccgatgctactaatctttggcatatgcgtcttgggcatatgagtgaaattggtttggcagaattaagcaagcgaggattgctagatggacaaagcatctggaagctcaaattttgtgagcattgcatctttggcaagcataagagggtgaagttcaacacatctacacatactactgaaagtattcttgattatgtgcattctgatttatggggcctgctcgtaagacatactttggaggtgctcgttacatgatgactatcgttgatgattattcgcgaaaagtttggccttatttcttgaagcacaaatatcaagcttttgatgtgtttaaagagtggaaaactatggttgaaagacaaactgaaagaaaggtgaaaatccttcgtactgacaatgggatggagttctgttctatgatatttaaatcatattgcaagtctgaaggcattgtgcgtcactacactgttcctcacacacctcaacaaaatggcgtagctgagcgtatgaacaggataattatatcaaaggcctgttgtatgttgtctaatgaaggtttgcctaaatagttttgggcggaagctggttccactgcttgttatcttatcaatcgatcacccagatataccattgataagaagactccaattgaggtatggtctggttccccagcaaattattcagacttaagagtatttggttgtactgcttatgctcatgttgataatggtaaattggagcctagagctattaagtgcatttttcttggttatccgtctggtgtgaaagactataagttatggtgtcctaaaaccaaaaaggttgtgattagtagaaatgttgtcttccatgaatcagttatgttacatgacaaaccttctactaatgttcctgttgagagtcaggagaaagcaagtgtgcaggtggagcacttgatcagttcagggcatgcaccagaaaaagaagatgttgctattaaccaagatgcatctgttattgaagattcagattcttctgctgttcagcagtctccaaaacgttctattgcaaaagataagcccaaaagaaatattaaacctcctcgaagatatattgaagaagcgaacatagttgcttatgctttgagcgtggcagaagaaattgaaggtaatgccgaaccttctacatattctgaggctattgtttctgatggttgcaatagatggataactgctatgcatgatgagatggagtcacttgaaaagaatcatacttgggaattggtgaagttgccaaaggagaagaaacctatccgttgtaagtggatcttcaaaagaaagaaaggtatgtctccaagtgatgaggcaaggtacaaagcaaggttagttgctaaaggttatagccagattccaggtattgatttcaatgatgtcttttcccctgttttgaagcatagttcaattcgcactttactcagtattgttgcagtgcatgattatgaactagagcaaatggatgttaagactgcatttttacatggggagttagaagaggacatttatatggagcaacctgaaggttttgttgttcctggaaaagagaacctagtatataggttaaagaaatctctttatgggttaaagcagtcacctagacagtggtataagagatttgactctttcatgttttctcagaagtttagaagatccaattatgatagctgtgtttatcttaaagttgttgatggttcatctatatatttgcttctttatgtcgatgatatgttgattgctgcaaaagataaatcagagatagaacagttgaaggcacaattgagtagtgaatttgagatgaaggatttgggtgcagcaaagaaaattctcggtatggaaattactagagaaagacattctggcaagttatatcttagtcagaaaggttatattgaaaaagttcttcgtcgtttcaatatgcatgatgcaaaaccagtgagtactcctttagctgcacatttcagattatcttcagatttatgtccacagtcagattatgatattgagtacatgtctagagttccttatttaagtgtagttggttcacttatgtatgctatggtatgttctcgtcttgacttatcacatgcattgagtgttgtcagtagatacatggctaatcctggcaaagagcattggaaagttgttcaatggattttcaaatacctacgtggtacatctagtgcttgtttgcagtttgggagatctagagatggacttgttggttatgtggattcagattttgctggagatttggataggagaagatcgctcacaggttatgttttcactattggaggatgtgctgttagttggaaggcaagtttgcaagcaactgttgccttatctactactgaagtagagtatatggctatttctgaagcttgtaaagaagctatttggcttagaggtttgtacactgagctttgtggagttacgtcttgcattaatatattttgtgatagtcaaagtgcaatatgctttacaaaggatcagatgttccatgagagaacaaagcacattgangnnagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactg

SEQ ID NO: 34425 - DNA, 3350 bp, Oryza sativa
  unsure (1)..(3350): unsure at all n locations
cgctgtcctttgatataatctcaatgatagcacccnnnnnnnnnnnnnnnnnnnnnnnnnnnnnnnnnnnnnnnnnnnnnatcagggcaccacgccggcgcttaaaaagatcgtgttcagcaaatcatcgtcgcaagacacacatatgtgatcctctcgaaatttgggttgatcctcagatttgttgtgaggataaaaaaaaacatttcgacagtgaatatcttaattgggatgtgcttcgattatgcacttgtaaataaaaattcgaaacttgttggaaactgatataaggtattcttccatctttgaagaggtatatatatctccttattattttagtgataaaaaaataaattgactaaactgattagaagataaatttatgattagtaatgatgaagctttttttattcttggaaagtacatagaggtatatatgccacatattgttagttatgaggtatatacctcctgaccgacatatatacttgtgctttaaaaatgaaataaaaattaaaggatatttaaaaaaatgagttttcaatcttattctaacctttaacatttgttttggtaactccgtttataaaaagagatcttaagtatgaagaggtatatatctttaaaaaataggtggaaacctcaaatggtatacaagcactgactctgttactatcttcatatgtaaagacacatcggaacaaatgggttcgtaccagggacatctagtttccaaaatttagaacgcgattgggagccacaatagacagtagccctccgatgcaaatgatgcgcaacagcgtcgagacggtcaacgataatggatagaaaatgatgttctagagatacagcggcgaagaaaatccgccggtggtgacaccactcgctggagctccggcaactccccgtcaatctcggcttcctcaaggcgagcatcagatctgactattttttttatatataaaaatggaatgactagtttaactatcttcaaatggcaattacttctatgggcaagtgggcccaaactaattctgtgatccatttcacaataggccagtttggatcactgcaattgtggcgatccagatcagggttcaccaaagcgttttaggtgaggttaccatcaccccatagtaaagcggttatcacggtacccgcgcggttatcataaaaacagtggttacctcgaggattaccacagttttaacaactgagaaggttaccacacgtgataatcgcgtggttttgtaaaccctgatgcagattcagtgggccttaatggccactacattagtttgccatttgccaaccatacaagagtgagtccgttgagctttcgtggggcggagacgatgtaatcttgtctccaattatatcattttcacatggaacatttgttcgctaagaaatgtatagtatatatttggacaatggattttgagtcaaactcatttcttgaccacttataatgtgttatgtatgcttgggtcatggattttgagccaagctttttttttaaccacttatactgctaggacggtagcatccaattttgggcaaaggatgtatgaaaatttttccacctcctattaggttgttatgaaatagttatactttgttgggtacatcagtattgtgacgagtcaaatgcgtgttactaaatatccggagtctaatgttacactttcttttctccaataagatggtatggtagtgtagtgttgaactgctaataactattcccttcggtttcataattcttgacgttttaaataaggttgaggtcaagtgctagaacaatatatcgatttattttacaaagtgctacaataagtaaaaatatttttattgtattatatattataataaaaatatagtcaaaatatattttaaagatcgtgtcattgttcaatatgtcaagaattataaaactggagggagtaaagatcactctacgtttacctcgccaagtgcctagtgcctataaataggataaccgctacttctctagacaaacccgcactccaaaatcagtaaaccttgaccatctcttccactgactactagaaatcggtgataaggagagttagaacatgtgttgctggttcgacaaaccaaatactagatatacactgagaatgggatgcatggggaattcgagaagaacttccgtgatgtgaataggatccaattgtagcagcacggctcactgtatttgatgacaatgtggttgtatagtcaaaggttgtgctacactgcccccatcccattttgggtgcataggctaggaagtggttggtgctgtcgctacctgtcatggattgtgagtctcacctcgatcgaccgagtccacatgcccaacgcttgtccacttccggccaaaacgacggccgaaaccttttaaggtgcttgagatgtaccagatggaggtacctccctcactacttaatcacccaccattgatcagttaagcacaacttaggaatagaaaacaatatattataaaagtcgataattaattccttttacatgtaacagtctctctctttttttgcatccggtttgttacttatcttcgattctgtcgttcacatcttaacacttgtccaaaatccaatttccctaattaattcttcaggttctcatctaaatttagagtccaaagaaacacatataatcctctttcgtccatacacaaagacaaatatggctcgatcaactagtttgatgaatctttgtatgtatacaaaattcttggtcattgtggatcatcagtggtggtggtgttttgtccgtgcggcacttgctgaagaaagatgttcttatcagcaagcagggcttatcgatcctaattcttttactgattaattagaaccccacctctaatatgtatgaaagtaaagttactaatctaaccttccacctaaacatcgagttaatacctaactcacttttttaataccttctgagacatacttcttccttccctaaatgtttgacgtcgttgacttttttaaatatgtttgaccatttgtcttattcaaaaacttttgtaaaatatgtaaaactatatgtatacacaaaaatatatttaacagtgaatcaaatgatataaaaacaattaataattacttaatttttttaaaataagacgaacggttaaacatgtttaaaaaagtcaacggtgttaaacatttagggatggagggagtaccttttatcacagaccgttagatggcaagcaatcaatagacaccataactcccaagcacaggaggaagtatataggtgcaggggtaccaattcccagtttggggcgntggaacaggactctacttcaagaacag

SEQ ID NO: 34426 - DNA, 7363 bp, Oryza sativa
  unsure (1)..(7363): unsure at all n locations
ccgcttgattgcgantctnnnnnnnnnnnnnnnnnnnnnnnnnnnnnnnnnnnnnnnnnnnnntgtgactttattctatttgtttaattagaagaactttggcacaggccgagatgcaattcatctcccttttaattaaccctccaaaaaatgtctaaccaagtcgttttatatgttgcttgttgaacctataaatgaaaaatgcgtacagttgaaacatatactagataatgagttgcacttgtgatttgtcaacgagaaactgacaatcaccaaagagacacattccatattatcaagcaatcttaagttctcagcacttcacatcaacgatgaacactacattgtgtaagatcgtaaagagatttttccaccctaaaagctagccaatgaggtgagacacattggtgtccctcagctgttcaccgtacactaacagttccttaggtatacggatctcgcaggcacccacggtccatcgggccttcacatactgtgtcccttggaccagagatattgaactagccagtctctgataccaattgaaggatcgtaaaaggtttttctcatcctaaaaactagccaatgagatgagaggtccccccacttatatattagagcaattttatgtaggatcgaatcacaataactaagccaaccagaggggggtgaatggttggtatacccaaaaaccgaaaacttttagcggaaataaaagttactctcgaattcgacggaagtcggtctgaccgagattgatatgccggtctgaccgctcggatgccgccggtctgaccgctcggatgccgccagtctgaccggtatagatcaaccggtctgaccgccgaagtcgcctgccgcacctgctacctccgccagtctgaccgccttgctcccgccggtctgaccgccgtcttgccgtcggtatatcgccggttggaccgccgaaactcagtgaaacacaaatcgaagaactcttaaagtggatgacgactttattgattctatctgtgtttacaaagtgcaccaacagcactccttacaaaaatttcaactaaactcgaaaccctaactcaaaactcaactcaattgctctcaaaagcgataccgggaagcctcacgctcccccactatttatacccaaggtaggcagcctaaagccacgaaccaaactcatacttagagttctaaataccttaggaaaccctctagtacaagaaacaaactttacataaccaatcgtaccaaagttggactccttccaaatttaactccgcatcccatacgcacacaatacctccatcgtatgccatatggaatctccatcaaccacgtgcatcaactctagcctaagtatcccgcatgatctctgaccaccacgaacgtcgtcttatccccaagccgactcccggtccatcaccgcaaatactctcccgaggcatcgagtcacctacacatgaaataaacaaagaaaccatattccgagaacaagctatctccaacttgactcattagtagcaaacaacagtattacatatgtatagtatccatctagaagccataatcatgaaataatcacggatatccaaacaaacaacccgaaaccgaaaccgacacagagtcagccggtcagaccgcgggctggccggtctgaccgcgcgcataccgccggtctgaccagcacacaattcccggtctgaccggtcacataaaatgacagcacctgtaattcacctgtaaattcaatcatctccaaaaccacttcgtaaataaattccaaatatcaaaaccaataatctccaatgccaattgttcatcacagaataataatcaaaaacacctttgattttacattttatagtccttaatgaggtactatgaggtaccaaaaatttagtgtaagatttggtacctcatagtacttaggtaccaagaagtaccaaatttacaatagaaaaagtggtacctcctcaagaaccgtaaaattgttctatatattaactctcttactcttccacaactaatatgaaactattcaacacattgtaatacaattgaatgaatagcactaagttccaagtcacactcgatcactcaatattccaagtcacgctgatcgctcaatactcaaaattcgaaccctggtcatttctacgagaaatcagcgtaccggcggtggttcgacgacgagaagtgatagcatgcccttaagttaagaatgggattcatggggaattcaaggtgaactgcgtcgatctgagtatggtccagttcatgttagctgatcgcattccagtcctgtacaactcccttccgttctctagcaacgacaagggaagtgatcgttgctgcagtcccttctggtatgtgtgtcaggctgtgagccgatgagagtgacattgaccatctcagcagctcattggtaggaaaactcagcagagtacgtccgcattgtgtgcatatgcacttctgttatggccgaaatttaagtcctttctacgttgattatttggatttgccgatcggagatgcatgtctgaaaactttcgcatgtgctccatgtaaaaccttgggatgtgcttcggtcctgaagcttgaatagaaaattagtagtctgtcacttctgtcttctgagaaacattgttggtttattagcttatcagccacaccaaatttcaaacgcgatacttctcatccacggaagaaatgatgctgggcagatttatgtaattaagtggccataatagtttggttagtagtagcgttcatcgattatttcaccatcgattgaaccgatgatcgtatcaatagaacagatcgatttacagatcatttcgaggccacaacaagattactttcacatgcttggagagcacactagaaacaagaatggatcatgtcacagctgaatcaaattgaaaccactcaagttacaacatccatttttgggcagcaaaaagaaagcaaagacagggaaatttttccacctctcaactaggctgtgaagagatttgcttccattcagcaagtctcccgttaccaaatctcgggccttcaacctgcctgatcggacggtgggaaatatgcggtacctccagttacatactttccaatgagatggtaccggctgtgttgagagtggtggaagtgtaattttgtcttttcacatagataagttttctccagctgaaataaccctagtttcgattccccttgtgtgtggtagcagcggcggctgcgaggtagcgaggtcccatggccgcaacttggtgatgggcgtatgtggctgcgaggtagcgagggcccgtggccgcgaggtggtggcagcggcggcggcaggtgggtgaacgaccatggcggcgacttggtgacaagcacggtggtgccggccgcggtgacaaggtggtggtggtgccgccggtggttggtgcgtcggcggccgaagttgcaaggtggtggtggttccattgccgcagacggtaaaaggatgggggcgagtgcagggggaggaaaaatagtgacagatgagaaagaggcggcgcgcggaggggaaaaagagcaaacactctgaatagatgagaaagcggcgacgcgactccagagatgcatggtttcgcttctcttctatgttttccaatcataccccccttacgatggacggccggatttgtttctgtacctcccgatacaatctgctacacggcataaaacctcagctgtgaaatatgatatgtactttgattatactttatcgtatgagcaattttacggtccttaaggaggtaccatgagataccattttttctattgtaaatttagtacctagatactatggagtaccaaattttacactaaatttttgataccttatggtacctcctaaaggaccataaaattgctcttatcgtatacatgtgacaaattaaatcgtgtgttactgatgttcatgactaataatgttttcctttctcctcttggccggttggtgtagcactatagtgctagtactaacttatagggtcactccatgtatacccaaactgccaagtgccaatttataagcgtagtagctgctactcctttggaaaaaacccagcactcaaaaacagtaaaccctgaccatggtcttctccctctgtcagtgagaaatcggcagtgagaagagtagaacattgcatcggtggttcgacgatgaaatgcgattgacttgagaatgggaagcatgggtaattcggaaagaacggtgagcttaacacaatccagtcccgctcaagatcattcttggtgcacgaacaatgtagcgattggtgcttgttccactcatctgcctcagtgaagagccggttcgattggtttgtgcgatgatcctaacttggcgcagacctcaacaaagctagcatttcatacggctggtcacattgatgccaggacaatgctatttatctctagcctcaatttacttccgaagggactcgtgttaagctgtttgtatttgtttaattagaagagggctatgacgaacaagcgggatgcagttcatttaatttaatttgggctagagagcaaagcagtgccccttgtaataagatgatcggtttgtcaatcaatcggattgtatccggtagaaccatcaccacagggaacatatatccagtgatcttgctcgagtccaacgagcaagttgttctctacgctgcttcaggatttgcaattacaagaactttcaacatggtccatgtaaaacttagatgtgcttgagttccaagcctgtaatgaaaaattaaagtacctcgtggaaaatttgaaggtaccaaaatttcaaattaaactatgaggttaggtttacactagaaaatatagtactttaggaccataaaattaaagtacctcgtggaaaattttaaatttgaagattttctacgaggaaataccaaatttgaagtactaccaaattttgatgtagaaagtttgatgtactttaatttggtaaaccatgtatcttcaaattttgagtatgtcgcaataaacctcttgtggaaaattagatgtgcttgagatacctgatttattggcctaaatggtataatcataggttctgggaggtaacaaaaattttaatgtaaaatttagataccctgtgatactttctttctcaagaactgtaaaatttatcaccaccgtgtaccattataatagcccgtgatactttcataagttcataaactgtctatagatagcattatattatattatattatattatattgggcacttgaataaactgtacatgggttggtgtatcgcttaggccccggttagttcgcgaaatgaaaatttctggatgtcacatcggacgtttgactggatgtcggaaggggtttcggacacgaatgaaaaaactaatttcataacacgcatggaaaccgcgagacgaatcttttgagcctaattaatccgccattagcacatgtgggttactgtagcacttatggctaatcaaggactaattaggctcaaaagattcgtctcgcaatttcctccctaactgtgtaattagtttttgtttttatctatatttaatgcttcatgcatgtgttcaaagattcgatgtgatgttttttggaaaaactttctggaaactaaacagggccttcaagttccaagttaatacccggcattcaatttacctgcctacaccttcaccaataaccatctatatgccttactccatattaagggcagagttaacatataaaaaaaattgaagccaggcatccttcctttatttttctttcttctttcttttaggatgttttctttgtaagatgacaagagttgagtgttctattgggggtccgatgacaagatgctctgagaatgggatgctttgggaattttagtcatactgatttgtcaagttatgtacactggaagcttatttagttcgatgtgcttgagattggtttgtgcgattttcttgctcaaagtttgttgcccttgtcaatttttgttttagcactacgaggagaggcttaacgaaaacatggtgtaattaacatagtttctacaataactatatgtgtatcttcttttttttcagaataaattcataattaagtctcattcttgtaataatatgattgggtaccggatattgtctgtgtcatttacgaaggcccgactgaaatcacagaataaccagccgacctagttggcatggcacttaaagttcaccttgttattccacatgcctctgcaccttcatactccctccatattttaacgtatgacgccgttgacttttcgaacaacgtttgatcattcattttatttaaattttttgtgcaaatataaaaatatttgtgccatgcttaaagaatatttgatgataaatcaagtcacaataaaataaatgacaattacataaattttttaaataagacgaatggtcaaacgttgattaaaaagtcaacggcgtaatacattaaaatatagaggtagtagtatccataaaagaagctactacttgtcctcggaaaggatccaaattagtgacaaatttcaaaaacttgttcatatgtttctgtttgtgtatgatggtagaggtggtaagtgttaagcgctgcatcagtggtttaacgatgagatgttctaggaatgggacgtgttgggaattcacatccaacatggaactaaaatcaactctcaattcgagatgccatgcttacgggttgtcgcatttggtgtagatttcatcgatttcattcctctacgattctaccactgtcattgcttgtgtgacttggggagccaacccttttcccagcttctgggtgtatttcgatttatttcctagtcatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggtcgccttttcattgcaccccccatcttcctctttcatccatccgctcttacctcttccacgctttattcgcatcttttcctttcttccttccatcctcttaccaacctatccttcccctttcttacgatccctttacctttgtccccttccctttctcttattcgcttacattgtctccttcttccgattatatcaaccattccctcctctcctctccttgtctccactctcgcttctctttacgtcccttatcactcctcctctctccttatctaccttcctcattcccttctctctcttattcttcctccg

SEQ ID NO: 34427 - DNA, 1811 bp, Oryza sativa
  unsure (1)..(1811): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagattccaatgatccattcatttttggactctgccccacctgtatgtttatttatcatcatgatgcctgctaaaaaaagatcttagaatccttttctcttataacttgggtgataaatcttgatgaaacctaagtgacttatgatgttttctttgaggacactgtttgtaatttcactgacttaaatttccaaaagcagtatcatcttccagtcagttgagtcttttcaagaacagatcgaagtccataaccataagatttgctatccttagaatgaagcaactatccctggtgtacgtacagtagaaacacacacacacacacacacacacacacacacacacacacacagagagagagagttgtgcctccagttccaacttccaaatgatattcttcattgtgcactaatgagatgttaaattaaagttccattgcttctgaacgaccttacaaatgaatttactgtttagagccagtttaaggcattcttcagattatgtgggaatctgtgtaagcttctactgccaaaacagctgtgcaagtgtttaaatatatcgttttagttgagccttgtgtctttgatagttatattgattcttttttttttgtaaaacagataagaatcctgatattaattattgttcttccagtactacagtgttcaacgttagggaattatcttaaactggtgctctggtaaaattcgaaaggtacatatggctatgtgcctcataagaaactcctcaggcaatagggatgattcttgggagaaacaaggattttgttcctaaaagtcactcatttggtcttgtatagttgtatctaggtcatgtttcctcttgtttaattccctcaggtttcctcttgtttaatgctttctacatgattcttgaaatacatttttcacttttaactgctggttctacctcattttcagtggtaaaaccatgccagtacttccagttaatgtggtttggattgttgtttaagtgcttgttggagcttctcagctacaggtgccatggagggaataaacaagatcaagacaggttctctgatcagcctttccgaacaggaactaatagactgtgatagatcctacaatagtggttgtggtggtgggctcatggattatgcttataagtttgtggttaaaaatggtggaattgacacggaagcggattacccatatcgtgaaacagatggaacatgtaacaagaacaaggtaaaattgaaatgtgtacattcaacaaatgttgagataacctctgcctgccatactagtacaataatttgtctgcttaaaatgcagctcaaaaggcgagtggtaacaattgatggctacaaagatgtgcctgccaacaatgaagatatgttacttcaggctgttgctcagcaacctgttagtgtaggaatatgcggtagcgctagagcatttcagttgtactccaaggtaaatagtgcataatttgttggtttatcctctcatgaacagatgtatgtattaccaattttaaacatttttgtacttgccttttaatattttgttatgcagggtatcttcgatggtccatgtcctacatctcttgatcatgctatattaattgtgggatatggttctgaaggtgggcaggattactggattgtggaaaatttttgtngtgaaaagtggngtatgaaaagctatatgtt

SEQ ID NO: 34428 - DNA, 10846 bp, Oryza sativa
  unsure (1)..(10846): unsure at all n locations
nnnnnnnnnnnnnnnnnnnnnnnnnnnnnnnnnnnnnnnnnnnnnnnnnnnnnnnnnnnnnnnnnnnnnnnnnnnnntgtctgtggcataaaccagatgccgtcattccctacgaaatcaagcccgaatcctcctcgttcaccagggccaggtccaaccaaatgcagccttcttacctattgccctgaaggatccacctgctgctgctcctggcgtgtcctggggctatgcctttcctggagttgttgtgaactggataacgcagtttgctgcaaggataatcgctattgctgccctcatgactacccggtttgtgatacggccagccaacgatgcttcaaggtacgtagaaaacgattttgtgcatccaatatgagctgcctcaaaatcttccatggttatgttttctgtacttctcttccatttcactttgattcatatcagattccagtttttgtttttttttactgactgtagagtagatctttaggatttatgaacaagttattgttcacgttatcagatgaactttgtgtattctgagaactgagtgttctttcttgtttcaggcaaataatggcaacttctctgtcatggagggagggagtaggaaacaacctttctccaaagttccttctttgggtggtttgttggaactgttggatcagtgagcctataattcgagccaactatcttcgagtgagtacagttgacatgagcatcgaatgcgatctcgccttatctttcttttagtacctcgttgctgaccatcccctttgacagatacactgatgtatggacaatgctaggctcagtcagtagtcagtggttgggttgctgctttcttcaagtttcctgccgccctgatgctcgtcttgcacggagatattcagatttactgtgtattttggtgaatggtaaatcataatttgccctgtaatgttgttgctgtacatgtcagactagcctggattatttcactcaatttgtgctagtgagaaccacttgctacgtatggtagattgataataaagagattgtgctgagtccatgcatctaaaactcggatactttttttttttactgaaaacagttggagagacttctgctgcgctatattaatagatatataataaaactcagatacttctcccttgaattattagttcgtttctgcatatatttaagcttaaaccaaacatctaaactattaaaatatcttccatcagattgagttgtatgaattctcttaccaatgcaatcccaaatgtgattaatgaggaaaagtttttttttcctctttctgaataaacccgagttcatactgtacaaagttcagctgtattgggcgttcagtccagcaaccggattcaaaagtcctgcttaagatatcatctgatcttccgcaaccagtctcaccaagattatgtaactaattcatagtctttaatctcttcgttccaaaataaataaatttaatacttaattctttatttcaaaataaataaatctaatacgagatatgacaatcctatccttttgagtagctgaatgtgttgtaagatttggaggctgtgttcagacctttgtttcttttttcttttggtttggattgccgctgaggctgaacctatgatcatttctagtaaaagaaatgggggttttgagtcttgctcaaaagaaaaaagatatgacacattctattatcatgaatctacagtaaccactaagaaaaacatcatgttaaacattaaggttccgttcttttctccaacaagagttggataaagattaagattttcgtggcacgcttttttaaactgttaaaaggtgtgtttcgtgcgaaaaactttttatataaaaattactctaaaatatcatattaatctatttttcaagtttgtaataattaaaactcaatcagtcatacgttaataccatctcgttttgtgtaaaaaacttcatcttaacaccgcctaagtgtaaaattacaaatgagggccggtgacgattaggggattggttttcgtcggatgtcgaaggacagagtagtggaggtgctcgtctccgccgagttcagtcggcggagctcaccggcggcgacgggacggggaccctaacttttacaaaatagcccctacttggatcctaccaactctaacttttgcacaatagcccatatatttacatagtagcccccctgtatgatcctaaatattacagcatagcccatactgacccgatcacaattcgcaacggacaatggctggtgccctacattttacaaagtagccccccttctgcttagatcctactagtaactttttttacaaaaatgaccctcctgtaaagtagactggctcgtcttcttccccttccatcctccccaaaatcgtcgccgcggatggagtcgtcggcgccgccgctcagccgcaagagggggaaacctatgggctatggcgccggatttacgccaccggtggcgtggcggcctctccgatcggttcacaccgtcgaccgccgctttgctttcgagcgcgcgattccgctgcggcgacgcccgcgccgatgtccaaatgtcctccagttcataaaggtgaggaacaaaaaaaaaaaaactcaccagattcgttttcgcatggttagcgtttgcgggctagaaggcatagaggtgtggttgcgatttgctaatgggggaggaagagtaaatttgatggcattgccaatttgccatggtgcgatgctatggattcgggaaacaaatctattctttggttccatttttcttttatttattttatgttcttagtgcggccacttagtaaaatcaagaaccgagtgaagtgacaatcgatcaccgcccacatctcataagaggaatcaagaatcctgcaagttattgtatttctgctaaagattctgcatttcttgtccacggccttgccccttaatctctcttcacgccggaccaattccatccacagacatacaatgagacacgcgtgaaaaaaaacgaggaaaataacatttctgatgtagaattgatattgtaaaatatgtttcttgttttattctatatcgattgcttctttaattctacatcgttaatgcagggaatcatgcaaagtcagtcaggcatgggaggtccggaaaaggagaatatcagtggttgggaaaagacttcttttcttttcatgtgcgtgaattgtgaattggatccagtaggtcagcgaatcgagttccctggttgctttcaagtctcttgaaccgtttatgcggctgccagcttgcgatagtggctggtttccgggcgtcgtttgttctggtcatcctataaattggcaggtgtgtgcttcttgttttcttaataaacccatcctgtattagcagattggtaatagcagaaggaggtggcccaatcttaaattcttaattcaagtgtctgggcctatttgggcagcgagatatggtacattcttgtttgctcatgatcttgtgtgcttagttgtgtgttaaattttataaacagatgtatgccggttgccaacaatgcaaaagtgaaattctaagaatgcatactatctgcagaaatgctatgatagaattgtccagaatagagctagcctaatactattgtgacaaataggacttggagtaattttcaagcttgcaaagcctcgggcagttgcttaatcatgggatcatagtgacatgtcgaacttttgtttacgaagtttgcaattggacaactctagattcctagagtttcttcggttcaagaacagaacccacacatcattgctatgatgctatctttttttaattgaaaactctgctatgtgaatttcatgacagtgttttggtttatctagcgatgaagtgcagaaatattattttcttgatgaactgtagtttctagaactcaaactcagatgtcatggtctaatgaaactttggtgtccatgtctaatagagtatcaaaagcagcgacgggaagagccccatagtggttggcccttggggtggcacaggaggatacccttgggatgatggtgtatactcaacggtacgccaggtcatcatcacccatggtgcagctattgactccataaggattgaatatgatctgaaaggaagttcagtctggtcagagacacatgggagcaccgatggaggttctgaaacagataaggtctagtttactatccctgctgcagcttttttaatttttttagcaagattgcaacactccgaaatttgcacaaatttaattggtactgtgcatgtctttagatctatataataaatataagagatttattacgttccttgaggagctaccacattttttagtgtaaattttggtagctcttggtggctcctatgtgttgagataccaggaaacagttgtacctcctcaagtaccataaaatcactacaagtataaacacctatatacaattctggtaaagttggaagatagttttaggccttagctttatgtatgaatctcatgtttattttggcgcataaaatcgatgacatgctgacttgtttttaatgaagttggtaaaagtttatatatcaaaggcctactttgatatccattctactttgaagaagcataatttagttttcatccctaaaacaaaattattgattttatatgtataatctgcaggtgaagctagatttccctgacgaaatccttgtgtctgtaagtggctattacgggtcagtctgtggaactccagttatcataagatcattgacatttcaaagcaatcgttccatatacgggcctttcggtactgaagatgggacacctttctcactcccagtaagcagtggtaaaattattggttttcatggaaggtcagggtcgtatctcaactcaataggcttttatctgaagcaagtgaatgtttcagatcgatcaaattctccagtcttgcctcagagtagaagtattacaagtgcatataacaaaaatggttatagctttcctgagggtgcttcaggatatgacatggtccttgcagtgagagataggggtgacagctatgctgtttatactagcaattaccctaatcagcagtatacaaatccatccccagattacaatgatggaatccgctggaataaggtgccacaaactagtccatcactgcagatggtatcttttcctagtggttacggagatagaggaggtgcagctctgagtagccacgagacctatggtccttggggtggaagtggtggcaccatgtttgatgatggcatgtacaccggtgtgtggcagatcaatttgactcgtgcagtgggaattacttctataaaggtactttatgatcgaaatggccaagcagtgtggggaaacaagcatggattcagtggagctgtttcaccagacaaggtaaatatgatttcagtactgcatttcttttaatttattgtgatgctgcatacatgattgtgatgaagtggaacttttgttcttcagatagtatttgattttccctcggaggtcttgactcatataaccggctactatggcacgacaatgatcatgggtccaacagtggtcagatcactcacattccacacaaacaagcggagatacggaccatatggggatgagtgtggcacgtatttctccaccagtttttctgatgggaggatagtaggattccatggtagggagggatggtacattgatggcatcggggtccatgttcaggaaggtaacttggctgcaccgcgagttagtagtagatcaacgattgagatgaacccctctttgcgctacgacatgcttgcacaatcaaggagtgaaacatacaatgaggtagctacaattcttgtctgaatcataacataagtatgtggctgcagagctaacttgtaaccgttttccaggttccttatagcatggtgaaagaaccagttccaatggggccagggccatggggtggcgaaggaggccggccatgggatgatggtgtctacactggtgtgaagcaagtctatgtgatgagaggcacctttatcggctcgatacagatcgagtacgacaggggtgaccaatccgtctggtctgcaaggcatggaaccagtggccacataacccatagggtgagtactgagtgctattatcaatcaagttccgttgtcaaggaataaaattcatgaaacatacaacaacaatataggatctgttcatcattcttcggtggcatgtcaaacaataacctctctccaaatgcacttgcagattaaactggactacccacacgaggtcctgacatgcgtatacggctactacaacaccaacagggaggaagggcccaaggttctgaggtcgatcaccttcatcagcaaccgagggaagtacgggccattccgagaggagttcggggcatacttctcgtcggcgaagaccgaagggaaagttgtgggcttccatggccggagcgggcaacacctggacgccattggggtgcatatgcagcactggatgggagacaggaggcctgctcccaagtacgtgctatcaaagtacctcttctgattgagctatggatgaaaacttgaattcctttgaaacaaaaagtgaatacttgaattacatgtagtttagccaatagtcatatagataacagatgggctggtttcgatttgagctttggaggctgtaacattttgggatatggaacagtttaagcctgcggatgagtccgttccttgtactcaggcaggcaggcatatacttaatgcatgacgatttatgagtaaattcaaatgaaattcacattttctgattcttttgcttgccgtggagaattggagacctgttttcaagacttgtgtcatttgtgtggtccactttctccgaatttgttgtggtcaccagattagctgcactgcatgtctgcatctctgcagatctcatgttcatgatttgagacctcccggccacttcaggacgggcatccaatgttgaattcagcaggaaagtataatgcagtaatgcacatgaaatgctttgaaatcaagtgctgtgcaaaactgaaaatgaggcaacatcaaacaagtggaaatgaaaatgttttcttttttattgaagtggaaatgaagttgacacgctgcttaggagctaactagagagtcttcttaggaaagctttagcttcgttttaatccatcaaaaaagctaaaatgtttatggtacttttaattctagaataagctgtagctaatcgaatcaaaaactccccaaacatacccattatcacatatcgcagccgcccatgtttaggaaggttgtcccttcccttggtacaagcaccgaaaaaatgcccatccgatccgaccgttcgttctagatcggttccagatcggacggccaaggacagagatatgggacaccgctcattacaacaagggtctaaattgtacggccgcattttttcgtttatgcttatgtttattattcaaaatttaaattttcaggcttaaatttgaaattgattttagagttttttcatcaaaatttatttttcagtctttgcttttagattgctaagaacacgtatataaaagttttattcacatattatttttcatttgtaaatataccgtttggccaattgggggccggtaatttcgcacagaatagaggggcatattcgaccattcgtcacgtcaccagctaggataaagtttcgattcctctcccaacgacaatatctttgggaaggcgagccatggccaaggggagcacatagtcagaacaccgcagagcaagtgtgtgtcctgcctcgcgtgaaagataagcggcgctctgctctgctcgccgaggagagagagaagagagagagagagagctagagatggcggcggcctcagcggcggcgcaggcggagggaacggtgatcgcgatccacagcctcgacgagtggaccatccagatcgaggaggccaacagcgccaagaagctggtaattcaaccgtcgctctcctcctctttgttctttcctgtccttttttctttttttgctaagttttttgagttttgtgatcaatggtgtgcgtagctggcctagggtttacttaattgagattatgctcatatccaattttgtgattggggtacctgaggagaaaattttgcgtaatcaaagttgggttttccgcgtctggtttttttttaggattagggtttctctcctccccttccggtggggatacggatctactgttctctcacccgttagaggataattgcagcataaacagttacttctcctttaaactaaccatgtttttaaaaaaacaaaaaaaaagaagaatcatagttattgtgagaggaaaacgaacaagttgttcatatgctcgtagttggattggtggaaagtagatgatggtagcagcaatgagaaatcgtgggtaactcattagtccttcgttgaggtgtgtaatgatgtttattttccttatgcccgctgattctgtagacggtagaggacacgactattacaaaatacttagcttatttcagaatttcaggtcggtgtttacttcgattataagaaataaattatcacaatttgggatcgacccttatctgtagtgcagtgttgctccaattgttcctgcaggaggtcaaatttgcatgattaacttaaccacactagagcctaaaatcatggcatactttaggagagtgctgaggtcaaatttgcatgattaacttaaccacactagagcctaaaatcatggcatactttaggagagtgctgaggtcaaatttgcatgattaacttaaccacactagagcctgaaatcatggcttactttatgagagccgtatcatgttgcttcagagatgcagatgtttgataagtgaagtttgcaattttgtgtagacttgctgtcctaaggttggtaatagagtccaaaggttgggaactattacagtcacttcatgtatataactatatatgtttttcgataacattttagttctgattgcagtcatttgaattgttgaaatgttgaattagcaataccacaaaagtgtgttaacctggttttcgtcataacaggttgtgattgacttcactgcatcatggtgcggaccatgccgcatcattgctccagtttttgccgatctagcaaagaagcacacaaatgctgtttttctgaaggttgacgtcgatgaactgaaggtattgctgttccccaaattttatatttttatgtagtacagtagtacggttgctgtgttggttttccccttatctggctttatcctaatgaagatttatgtaacaaacagcctattgctgagcaattcagtgttgaggctatgccaacattcctgtttatgaaggagggagatgttaaagacagggttgtcggtgctatgaaggatgaactggcgagcaagcttgagctacatatggccatgtagtgttatagtggattagtactgatatcctaaataaaacgggccttcaggctctgaaaggattagtgcctctgtctgtggtggttttcatatgcttctagtatcaagcattgttcttaccgttgtctagttcatggataatgccttgcttgatccaagtttgtgctttgaatattccaacaaaataatataacctgtgttttgcatatgatggttttctttcaggtgagatatcagaatgttggatccttgagagttgtttagctttcatcatgattagtgaagaaagttgcacatcaccattgtagtaatgtggcaaaccttgttaacttgtgaaaaaaaatgaaaagagtaattcatttggagtctcatttaaattgtttcggtaacaagagtagctcatgtcatcctcaaccatctcaagccactaaaccagtactccattactgggtggtccaaccctataagatcgtgactgtaatttgcacaattgattatttgtgttgattttgaaaccaatcttctctggttaaaatttactatttgcagtcttgcttctttgcctggtcacctccatcccatgcatcatacggtatgtagtatggggcatatccttttcttcactgggtgccgtttcactggtcatttggtcggcagtcttgaagctgctcctcactgatccaggcgtaaagataagctgatctgattgatatctgccaaactcacagacagaagaaaggttttagttctaccaagtactgtactagtagttttgtgcaaccatgagagattcttgtcttccatggagtgccaccgccaagcagcagctatcttgcatcctactccacatcccatttttgttcttgcttcaatccctatctcatcaccttctcgcatggatcaaattcgataagaaatggagtaatcaagatcagtgaaagctaggggagagcttgagcttcttggccggcaatggcgccggcgcgcgggttcgtggagaggctgagcacggtggaagggcggctgctgcggctggaggtggtcgtcctcgccagcgccgtcgtcctggcggcgctggtgctgtacggcgccacccgccgccggagcagcgacaagctcctccgcggcgtgatgtggatggcctactcgctgtcctacgtggtggtgtcctacgccgtggggctgatccaggacgggccgttccgcggcgagacgttcgtgctgtgggcggcggcgctgctgctgatccaggcgagcgcgtacgcggcgccggtgcacagccgccgcgagttcagccagcggaagnnnnnnnnnnnnnnnnnnnnnnnnnnnnnnnnnnnnnnnnnnnnnnnnnnnnnnnnnnnnnncgagtgct

SEQ ID NO: 34429 - DNA, 3606 bp, Oryza sativa
  unsure (1)..(3606): unsure at all n locations
cggagaaaaatgttgtggaganaatctcacagtgggtgtgttgttgggattataacgagacgcgccgcgcagaaagaagatacgggcgacggatgtgtgagtttgtgggcccagaattcccgagacgggggcgaaaattgtagagaatacaaaggctgatttacccgccatgtggttaaagtgttgcgnttaaattggcattaggatatcccccgcggtggggganggaaacccccgaccccacggaattaggggcaaggtactctctccagggcggggccccatggtgccgccgaccctgtcccattgttgaaggaaaaagccggcaattcgggggtcccataggccggggtgccgggtgatcgaccgacaggcccgggtcaagcgggttggagaagaaacgggcaagggccttttcccttggtgttccccctgttcaaagttttttaaacgccgtgtttccggttttgtcccgggggaaggccggccttcccaaggggcgggggacctcggttttaggtgggcctataccggccggcccgttagggggcccaaccccgcggttccgggtctcaaggggggagctcgtgttccttttcgaccaagttctacacccgcaacttgtgcttgtcggggccaggacctacgtttgcatcgccgccgccgtgccggggatcacaatgtggacggcgttcttcggcacgctcggcccggcctaccaccccctccgcatcggcgtgcgcggcttcgaccgctccgtcacggtgctgatcgtcgtgatcaccgccggcctcgagctctgccaggcggtggccggcttctccagcaactggaggtacgtcaagacggtgtaccgctgcgtgcgcgacgaccagccgtggacgaacaggcggcacggccacctctggtggaaggagagcatcacgccgccggcgacgaggtactgggacgacaaggtcggccagtacgtgctcctcaagcggttcggccaccggccatggaacatcctgtcgtggctgacgctctacctggtggagccgcggcggcaggggcagaagcgcggccggaggaagcgcctgccgcaggaggtccggcgagcggtgctcgtgtcgctcaaggcgagctacggccacctcaccaatggcgtctccacgctgcggaggcacggcctgacgccgcagctggagtgggcgtgcgcgttccccaagctcaccgaccagatcctggtgtggcacgtcgtcaccacccgcttagactggacgagcgccggcggccatggccggagccgccgccgcgacaacggcggcgacgtgaacagggtcgtggcgacgaagctgtcgaactactgcgcctacctggtcgcgttcgtgccggagatgctgccggacccgagctacaacgcggagcagatgttcgacacggcggtgcagcaggcgagggaccacctgggcggctgcaggacggagagcgccgtgctccagaggctgcaggagatcgaggacgaggagcggcgcggcgccgtgcgcgagagggcgggaagcgccaccgtcatcgagaaggcggcgctgctcggcgggcagctgaggcggnccgtgnacgaggcgcggcggtggcaggtgctgnccgagttctgggcggagttcatcctgttcctcgcgccgtcggacaacgtggacatccacgccgaggtgctcggcgccggcggcgagttcatgacgcagctgtgggcgctgctctcccacgccggcgtcctggaacggccggccgtcgccgcgacgccgtcgccaccgacggtgtgatcagattgatcgatggttatgttcgagatcgtgcaagctagataggggatgcaaatttagttgctccatccatgaattcattttatattttgaaacatcattgaacgatttagtaattagtttggaacaaagcgtctgaaaggaaaattttctggcttataagctaaaaaaagacctccgcgataaaaaaatttaagatatgacctttacaaatttattcttagcgattcaaaagctagagctagatattaaaaacagaaaacataatttaaattataaattcaaaactggttacggcttaacaagcatgatcatataaatattatttcaaacactaccaaaataataattctatgaataatttgtttcaaatgttaccttattacttccgccatattgctcgtttgaatcgttgtcgtccattcgcctctgacttgaatagttcagtgtacttaaaaaaaatgttgacacgtgtgcctaattattttttcgtacaagaccatccaaaagcttgaaatgcagcggcaagcaaaacaaaaagcaaataaaaaggtgaaataaaagtaaaacaggcaacctagttcaaaaaggaaaatgttcctactttatatagtttttttaagagtaaattgcgcccgcggtacacaaacttgtaaggtgggtgcaatttagtgtaaaaacttgaaaaactctcgtttcggtacacaaacttgcgtagtgcatgcgaaccaaggccaagacatgacttcatcactaatcttattgagttggcttgtgattaggataccacatcagcgcatacacacgttatgggagcgtgagctggctacacatatttgcaaataacccctcatacatctttcgattcctccgaatcttcttttgtgttgtagcccacgatgatgcccatgctagagatcagtttcatgatagcctaccaccaattgagttaccaccaaaaggagataaatcaggagattgatatatggatcaaggtggaaggccgcgaattggatccaggcggtagggctttgctgggagacaacacgccagccacgtttagggcagcggtggcaggacgttgccgccggcgctgaggcaacatggtgccagggctgcgaagtaaaggtgcacgatctcctgtatacagtgagtactttagtttatcatatcaaaaatgagattgtctttctcaattccaatttttgtggagatttcttcctcttattgtcgatttattaggtattgcaaacgagaaggactatcagttgttttaatttatgccaggagctagttcatggtacacaaaagctgtaatttttgttgacatttatggtatagaagtgatcatgggaaattagtatttttggagagcaatttgatcattaatgtgctgctagcttctgttgttaactatgctttcttcctggatatacccttaaacatctgaacctaaagtaaactgttctgaagatgaataattatctgtgcacaatatatgtagattccgaagatgaagaattcagcattgagatgcaccacggaggctttttttatgggaaatggtgtaaaccgggcttatgttgatggtagagtaagctggtttgaccattgtgagtcagattcttggtcactgttgtgggttgatgatttcattgaagaactaggatatgagaaatttgataacaccaaaatttactggttgcttncctgcacaccattaaatgatggggtgaagaggtttaatgtgatgcagacactaacaggatcgcccctcttgtacctaaggtcccatcatattgtttgg

SEQ ID NO: 34430 - DNA, 830 bp, Oryza sativa
  unsure (1)..(830): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcatgattaattgagtattaactattttaaattttaaaaatggattaatatgattttttaaagtaactttcatatagaaaatttttaaaaaaacacactgtttagtaatttagaaagcgtacgcgcggaaaatagtgtgcattctcactccctatcagctaaatgaacgcagccttacatcgtgaaacggatgaagtatagcattagcagtagcactatttctttggacatccacgcctcgatctcttcctgggtctagtagtcttctcttcttccacgcgcaggcgcagccatcgtcgtcatcgccatcgccgccgcggcgcgcgcgcgcgcgcccgtgactgacttccgtagggggggactgaggcacgccaccccgcgcgcgcgcgcgcgcgcgtgcggccgcacaaccacgaacgcgctccgaagtcttccttccgggagggcacgtgtggttggggtataaagggggagagaggcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34431 - DNA, 798 bp, Oryza sativa
  unsure (1)..(798): unsure at all n locations
cgtgtcctgatgaactctnnnnnnnnnnnnnnnnnnnnnnnnnnnnnnnnnnnnnnnnnnnnnnnnnnnnnnnnnnaaatgcttcgccgcacgccggacgccacccaatgatctcctttgccggaagaacgccgtgcgccaccatctccttcaagttttcctctgtcacatcagagggcacccactgactttcaaagctttctctctcctctgccatggatgcaaattggatgatgcgatttggtttgaaatatggccgggaatggataggagatcgatgcggtggttgcgcggaagatttttgtggaactttggaggatggattggaggggatttgtgaaccctagcttcaccgaagtgatttcgcactatagcagtgagtagggaaagtggcaagagtttcggcggggaagacaaaacgacgctatgccttcggtgttatctcattagggtatcgggagtactaatgggcctgggcctaaacagtacttcagcccagttttgctatcagcgtggttaagttgtgatccttaggggcttaggcatttgtttttgctttggcaacacttgctcacgacaatatagcccaatgctgttaaaatcctttttgacgcagttagataattctgtggaattactacaatgcaaataaaaaggtgcctgacagaaaagtgttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34432 - DNA, 975 bp, Oryza sativa
  unsure (1)..(975): unsure at all n locations
nggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcaagttttcctctgtcacatcagagggcacccactgactttcaaagctttctctctcctctgccatggatgcaaattggatgatgcgatttggtttgaaatatggccgggaatggataggagatcgatgcggtggttgcgcgaaagatttttgtgaactttggaggatggattggaggggatttgtgaaccctagcttcaccgaagtgatttcgcactatagcagtgagtagggaaagtggcaagagtttcggcgggaaagacaaaacgacgctatgccttcggtgttatctcattagggtatcgggagtactaatgggcctgggcctaaacagtacttcagcccagttttgctatcagcgtggttaagttgtgatccttaggggcttaggcatttgtttttgctttggcaacacttgctcacgacaatatagcccaatgctgttaaaatcctttttgacgcagttagataattctgtggaattactacaatgcaaataaaaaggtgcctgacagaaaagtgttatactgattttgtaggcctttttagcctgcaaaaactatttgggttttgttgaggtgactggtttttgaatagtcattctctcggcatgttatatgcttattttgattatgacgtgagtcatggcctaggtcagttctgcgccatccagccgggataaccatcgtcgctgacgtaatatcccagcgcagccccgctatcatttattttcacaccggcgcgacagttccgggtatccccgatattattcggattgctgannnnnnnnnnnnnnnnnnnnnnnnnnnnnnnnnnnnnnnnnnnnnnnnnnnnnnnn

SEQ ID NO: 34433 - DNA, 996 bp, Oryza sativa
  unsure (1)..(996): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattaaaagtttggaattacaggccatgacacggctcagacccagactgaacatggattacaggtaacaagcattattttttttgattgcaagactgtatacaggcgtcatcacgttaccagcgaccgttggcgtagcggcgatggtatagagaggctccattcaactcactagccaaattggtgtagtccggtatttgctgggggtatacatttgtaccaactgcatggttcatcgatggattaggagagccattcagccaaggctttgatggactcatgtcagacaggccattagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34434 - DNA, 741 bp, Oryza sativa
  unsure (1)..(741): unsure at all n locations
gcggccatgaatgcaatganatcgcctgcgacgatgctccttagactcgagaattcgtacccccatttttgctgtgtattttaataagagtctgtgctttattatttgtagttgaatacattatgtgaattagtgcaccgaatcatgggcatgttttgtatgtatctattgtttgctatgaatgcactacccttctgtaaccggccaatgatcaggctaggactggtactagcgtcatagtggcgtctatgttagttccatttcgtgaaaccttgatttatgcttctgtcattgcttgaagtccaaccatgtaatttaatttttcaaacacccaaccgcaaccgctgacattttcatgaattgcttcggtgcttgctcaaaatcgatggcaaagttggacgaagagtcggaggagctgcaccagaagttcctggagaagacattgaccttccaacctttggtcaaaagtacaaaaagcttcgggccggctaccacaagcaagcgttgctccatcttgcccgcaagacctcacttcgttgaaatccattcgcggtctgtaggacgaacaccctgttgtatgagtttcccatttcttcatcattctatccttgtcgtggtgtctgtccacttggcttgttatcagtgccgctttaatattgtagggcttgtgaaaaccgcagggttgattgcatttgtaatatacgattgtattcgcatcatggaaatttatgtatgatcatt

SEQ ID NO: 34435 - DNA, 1960 bp, Oryza sativa
  unsure (1)..(1960): unsure at all n locations
ttcattttggcgtgtttaattagtataaatttatcataataaacataaaattctagtttatcgtgcttctaatggagttgttcagttgagaggttgagattgaggtcatggctttccaatttcggattttcggtcagctcttttttcttggatatactccatatacacaacagtgatagatgtgtatattttttctcatcatcggctctttcaatcttaaaacagttttgtctttggtttatatagaattcgctagtgtgtgtactgtgtaaaattctttcaatcctacaacagttttgtctttgtcttttgctttctctgattctacaaaatgcttttgattgttcggcgctttgattcattttcttctagatgagtaatgtaatatgttcttctagggaatgttctttaattcccaggaaaaaaatgtcccagcttcttaaatagagctctctgtatatgatgttattaattatagctccatagtgcgcttaatttgaaatattgtttagcacttatgtcgtgttctcttctatctttcactcgacccattttttataatgaaaatggttaatttacaccgataggcacacggctatatatatataagcatatatagttttttttttcactcttgaagtcagcaatcttattcagttaatttaagaccgtatggaagagactcggcagagaggggtgttttctctcttttggactggatgaccagagataaatagcagattttcttgggaaaaaaaaactaaagtaggacaggttttgcatgcatgtgtgaaagcactcgtggaaaacttaccctgttctcgcatgatttgatgtgtagttgttatacatatagataaccatatctacattattgcttctggttggatcttctcataaaactgcatctttctccatctttttctacaagctcagtggacttccaagtatcttctctgctaatttcttgacactgccgttctttccacgtttgttacattattgcttttgacatcactattttaattaattagatcttgtagacaacaccctggacgcttatcaggaaacagactatatatcgttcaaagttttttgttgaaattttaactcgtaaaaaccatctggttttagttaatctcatcgatattattttcttcattaaagcaggaataagaaggcatgtagtttgtacatgcatatatatactgaaattaattattacagctttcagagatcagcagcagatttgtcatgacaattacatattcttcatgcatgagtaatatatatatatatatatatatatatatatatatatatatatatatatatatatatatatatatattcaattctgttgcttttgtcacgaatagttgttagttttaaccgagcgtgcttaaactgaccattatttttaagcaacttcaaaataaaaaggtttaagtccaactcattcataaattatttttttattacaaatctaatggtataactttgatgctaaatactaactagatttcttaaaaatattgttggtcaaacatagctaggcaactcaatgaaaactaacaactatttaattcaaattatttttaatggatatggtatatatcggtatacagtctaattaatttgtcaactgaacttgggttactgatggttctaaccattgtgtatacatatatgcaaacaaatttagtcctaattatatgtcgtaacatgagggtacgtactgtgttgatcgttttgtgttatgaactaatcacatggaaagaagtgcatatatatatctaatgtcaagagtgttgttaactgataccccacatatatataccagaatgtttacagtgttaattaacacatggcaaaatcaagcaaaaatacaannnnnnnnnnnnnnnnnnnnnnnnnnnnnnnnnnnnngcgggaggtgaatntcaattcaatggcacgg

SEQ ID NO: 34436 - DNA, 1182 bp, Oryza sativa
  unsure (1)..(1182): unsure at all n locations
cgcggcaatggataagcgntttgagaannnnnnnnnnnnnnnnnnnnnnnnnnnnnnnnnnnnnttacacggcccaacagaaagcccacctatcctctccccacggcccaatccgcgtccgactccgcgtcgcctctcgcctcctctctctcttcttcttctcccccaaatcccaattgcttattctccttcgacaagccggccaccgtccatcgctgcttcgcttgctcccacccgaagcaacgcgaacgcgacgcgctccccttcccgccacctcgcgggggtgagaccaggccttcgcgaccctcgccggccgtccctgagcgccggccgcaccggcaactcggtttcgaggctgatctcggcaggtttgtgtctgccctcgatccaaaaccggtgctgtggtttggttcacgatcccgttaaagttgtcgaatccggtcggcgattgtgattcaggtagaggaattagttttgcaagacaggttttacaaggaattttttgggggggagtgggggacacgtttttatgctgttgttctgatgacttcttgaaagtcacacccaagttagttagttatcagcagctcatggtaatcttcagtgatggattaaccgctctacggtatctaggcaatttgagagtagaagcaagccgtagcctacagaacattttgccatccaaatgcttggcattttgatttgattacgcaggcagtaattttggagtagaaaacgcgtcctaccgaacatgagacttatcacaagtatatcgttttttgacaatagtcaataggaactctgcgttgaggggtttgatttcaatttgttctagatttgatccattcttcttccttttatttttctgatgcaaccaacaattagtctggcattggcgttagcgattaccatctactagttattttccgttagaatctatatgcatgtacagcttattgattaccaccaactgttggaacatatgtaacctgctatttctttttatgcagattgctctagtacaatgagctggagatttcctctttttgggtatgttatttttactgaaagcaatacttttttcgntggtcttcttatgtctggtcctaaccctttcctcgcatagcatttgtattctataaactgagcttcctctttattttgtagaaagaatgtatttgt

SEQ ID NO: 34437 - DNA, 751 bp, Oryza sativa
  unsure (1)..(751): unsure at all n locations
naccatctccagctgaggctgcagggataattgctcggttaaaggacaaaaggtcagcagctaccctttttttgataagttgcttgtagcttcctgtatacgaagtttcattgtattatgccttatcttatctatactgtgggttaaaattgcaacagccttgttactttttaccatggtattttacatattctagtgtttatattagtactaaaagagagtcactagaatctaactaataatattagagtaatgaatttttaattgcaataatgatatcatggctgatattctatattctatcaattggtaatgaatgaagaatccctagcttttcagagggcacgacaatttgtgcaattcagaagggatgtatataaatgctaaaagaagtgattatgtatggttgggttgctttttataatcgccacctttactacatgtgtttttcacactattccttgtgagcatgcttgtttggaatgcaaaactgctgtatataatactgtccttttttctgcagtgttgatgagttgcagaggctgttgaaagacaaagaggcatataatgctttcttcaattcactcgatcaagttaaaacccagaccaacgtaagttttgttgctgagtacacaggtgtttgaaatttgtattggtggctgtacttagatgtttnnnnnnnnnnnnnnnnnnnnnnnnnnnnnnnnnnnnnnnnnnnnnnnnnnnnnnnnnngagttacataggnggcgg

SEQ ID NO: 34438 - DNA, 1412 bp, Oryza sativa
  unsure (1)..(1412): unsure at all n locations
nnnnnnnnnnnnnnnnnnnnnnnnnnnnnnnnnnnnnnnnnnnnnnnnnnnnnnnnnnnnntgagttttctcgtttcttatgcgctgaaaatatccctatgtaccattgattctaacggagtcggccgcactggagggataggcacatttagttccggataagtgagtctagcaagccattggaacttaccctgcaaggatcacatcatgtggtgtgcatgtagaatgaactaaagcacagatttcagtggcagagtgaatctgcgaggggctaacctgagcagcggttgggtaactgttgccagccaacaccaaagctgctcatcttgaattctcgggacatcccattctcaaagacattttgcatcggtgaatcgccgagacaaatgttctaccctctcaccgatgctttttcacatattcaggaaggtgatgggcaatgtttacatttactggtagtgcctatcattcttctcaacctgcgctagtttatttataggcgcttgacgagatacactaactatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggttaacattaatccacgcgggttcctccttgtcgccttgggtaaatattccctcgggaaatcggggccagagaatgggcttttcgcctcctatatttaaataggcgaaccacgccgggtggcggggggcaaaaatatattacacacattctgcgataaggcgcggttctccgtacacgccctactcgcgattttgttggtaatacgcgaaacacgcggatacctatctacctcgcacgctctatctcttctgtaatgtgtataagggggacacgtactcttatacctctcgctctttttttttctatcttttatcatcttncaagcgagaagagtgagggtgtcaaagngagttttttttttcttcatcgtgtctccgcgcgcagagcttactctcaaaaacgtactatttttaccc

SEQ ID NO: 34439 - DNA, 1621 bp, Oryza sativa
  unsure (1)..(1621): unsure at all n locations
cgatatatattgttcgttggtggagagacgtacatgaaatatgtctttttgttgtaggcaagacaacaaaaacgtggttgtggtgttgaaacaaccccctcttgatgagagttgaaagaaagagaaaatctattttggtgttggtggatgacccccacatgtatggtggcccccacacactcctaatattttagagggggccacgaggaaatattttctccgtgtgctcaacatatatccccaaagcctccttcgtcaaagggtttgcgccaccccactttagaggaccctacacgtttaaatccacgtgtgtattaaaaaccccctctccaaaagaaaagcccaagttcggtaaagcaggttaaaaagaaagccaaagaatctcaagggaaaccctggtttataaaatcgtggggtttcgccccctggaatgaacggaaattttgttatgctccacaggggcggaacctaagaaaaccccaccacgcgcccttttcaggttcggccctttctggcctttgccaacatttctttcggcgtaacccatcttttgggaaaccgtattacggcctttattaagttaaaccgcttccccaacagaacgccaagcccagcaatcaattagccagaaaccgaaaaccccccattcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaggatgaactccgcccagaactcggccagcacctgccaccgccgcgccttgtccacgggcgccctcagctgcccgccgagcagcgccgccttctcgatgacggtggcgctgcccgccctctcgcgcaaggagccgcgccgctcctagtcctcgatctcctgcagcctctggagcacggcgctctccgtcctgcagcagcccaggtggtccctcgcctgctgcaccgccgtgtcgaacatctgctccgcgttgtagctcgggtccgacagcatctccggcacgaacgcgaccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34440 - DNA, 1198 bp, Oryza sativa
  unsure (1)..(1198): unsure at all n locations
cgcgagtgatttcgcttgannnnnnnnnnnnnnnnnnnnnnnnnnnnnnnnnnnnnnntagagcttatgaaagcaatagatcaatatactataaagaaccaagttgctatctatttaaatgccctaatcatatttactactgtacacaaaacataaactgcatcaatgacaatgagaccaaataacattgtgaagtagcgtgaaaagagatggtaaatgaatctggattccttgttgatagagcaaatattaattcaaaatttgagtttgtagaggaaagtcaagatgacacttgaaggcagcatggaaagagaagaaataatggattaacacatattaagcatggtattaggcgtacatgtcaatacttttccggtggacattccgttttgcctattggaatgaaacattttgcactggacccatggaccataccagtgtagattgattgattttaattaaaaatgtaccggcaggcatacagctatcttttttgtacatattggagtatacacaacatttatctagccatgactgtgtttgcaaacatattttggtgcgagttaaaaatagagaaacaagtacgaagctatgataaaggagcattacaagaaatcatgattgtctgcatattacaattctctatattgcaggtttgccctctagctgtgtagtaggttgtcacaagattaatacaagaactgccggtctgtgcaattagtaatggttgttttgaagcatgccgattctcctgctattcaaggtgaagcacaagtaccctaatgcctagaagcgccaatttccggcagaatttaaatgccgacatgaacagccttaccgatggaaatggattttcgcctggtttttggttttttctgagaaacaaaagtttcggagatattggtgaaacaaaatgtgtttttaggattgcccctgttaatatatttccgggaaggggggagcaaccctatggggagaattgcgcccaataatattctttaaaaggaggttttccgccaaacccctttggtcaaaaaactggtttaaaatggaaaggagggggtacccaaacactttttggaaataacggtttctaaataaccctggggctcttcttaaggtccaacacccttttttagaaaccttatctgtttggactaaaacacttacaagacaattccttttttgaaaatttgta

SEQ ID NO: 34441 - DNA, 1617 bp, Oryza sativa
  unsure (1)..(1617): unsure at all n locations
ggccaatggcaacctaagcaaggccaaccctacctgaattaaagggcaattccaagaataagggccaggaccttgggagtcccgataattacaacaagttcggatccgcgtttttgaaaaaccaaatgttttgtggaaccttgttttccaaaaaatagaggccaggaaatgggnggggcttcaaccaaaggcaaccacatttggcaagttaaaatgccaaatattggtaaaaaccaaaagggcagaaggccacaaggtggggagaaacaagtgctgttccaagttcataaagggccaaagattaatttgtatgatgtgcacaactcaaacacatagataatcgcattgttggattctcgctagtggtgtttcagaagtgaaaagcataatctatgtctggctccatttccacccctcaaaattatctatgcccaagttgccgctaatcaatctccacgccaccccattaataatatgcctatctagatgcgtgtgttgtgcacactcgaattccgcgctgtatcctgaatttttggattggacaaagtgatgaccaaactaaaaggaaatggttgtagcgcaaatttcccttacgaaaatcgacaaagaagacaaggtgaaaaaacataaatcacacattccaacgctggagcatgcgatgcagagcgccgcttatctttcacgcgaggcaggacacacacttgctctgcggtgttctgactatgtgctccccttggccatggctcgccttcccaaagatattgtcgttgggagaggaatcgaaactttatcctagctggtgacgtgacgaatggtcgaatatgcccctctattctgtgcgaaattaccggcccccaattggccaaacggtatatttacaaatgaaaaataatatgtgaataaaacttttatatacgtgttcttagcaatctaaaagcaaagactgaaaaataaattttgatgaaaaaactctaaaatcaatttcaaatttaagcctgaaaatttaaattttgaataataaacataagcataaacgaaaaaatgcggccgtacaatttagacccttgttgtaatgagcggtgtcccatatctctgtccttggccgtccgatctggaaccgatctagaacgaacggtcggatcggatgggcattttttcggtgcttgtaccaagggaagggacaaccttcctaaacatgggcggctgcgatatgtgataatgggtatgtttggggagtttttgattcgattagctacagcttattctagaattaaaagtaccataaacattttagcttttttgatggattaaaacgaagctaaagctttcctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34442 - DNA, 1120 bp, Oryza sativa
  unsure (1)..(1120): unsure at all n locations
ccgctgnattganattgatatatcnnnnnnnnnnnnnnnnnnnnnnnnnnnnnnnnnnnnnnnnnnnnnnnnnnnnnnnnnnnnnnntaaattcaaatgaaattcacattttctgattcttttgcttgccgtggagaattggagacctgttttcaagacttgtgtcatttgtgtggtccactttctccgaatttgttgtggtcaccagattagctgcactgcatgtctgcatctctgcagatctcatgttcatgatttgagacctcccggccacttcaggacgggcattcaatgttgaattcagcaggaaagtataatgcagtaatgcacatgaaatgctttgaaatcaagtgctgtgcaaaactgaaaatgaggcaacatcaaacaagtggaaatgaaaatgttttcttttttattgaagtggaaatgaagttgacacgctgcttaggagctaactagagagtcttcttaggaaagctttagcttcgttttaatccatcaaaaaagctaaaatgtttatggtacttttaattctagaataagctgtagctaatcgaatcaaaaactccccaaacatacccattatcacatatcgcagcccgccatgtttaggaaggttgtcccttcccttggtacaagcaccgaaaaaatgcccatccgatccgaccgttcgttctaaatcggttccagatcggacggccaaagacagagatatgggacaccgctcattacaacaagggtctaaattgtacggccgcattttttcgcttatgcttatgtttattattcaaaatttaaattttcaagcttaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccgcggaaaagccg

SEQ ID NO: 34443 - DNA, 791 bp, Oryza sativa
  unsure (1)..(791): unsure at all n locations
tacggggngggattannagnanagtnctgccggggaggaagccgaagaacgcagatgatttattacccctcccaataacattgttactgggagtgttatagcttatgttacattttagatattttgtacaggggcctatttaacattccaccaccacagcgatggcgatgatacaaatcaggacagcgacgaagggagtggcaaaggcttggaggatgttgaagctggagcgaagttgttgaagctgggcctccaattcctcgttgcggttagctaggttagcgaaatgcgtcacggtacctgcaacggactggacgcgggatatttaagtaatgtgcatgtatggagcaaacgccaatgaggaaatagtttagttatagattgtaatgaagtaatgccaagaaactaaaaagatcataaaacatcgtactgttcaattcctacatgcaattgaaattgaaaagtgaacagtacatgcaagaaaagaacaggataacaaacacatcaaaggtaggctatctatatatgaagaagggaaattaattcatattttgcaacaattccaatggtatgtatcacctcaacttgaatttcatccctttccattgaaatatatgattgtaacaattgtaatttattttgatctttgcatggacagattctttctattcaaaaattaacattttaacttttagaaattgtttagcatcgtaacacatacttatataacatcgaactactaatgggtaacatgaagttgttaagccccttgacgaaaaaatataacttgt

SEQ ID NO: 34444 - DNA, 718 bp, Oryza sativa
  unsure (1)..(718): unsure at all n locations
nnnnnnnnnnnnnnnnnnnnnnnnnnnnnnnnnnnnnnnnnnnnnnnnnnnnnnnnnnnnnnnnnnnnnnnnnnnaatcctgagtcctcttgtcaaatccagaaagcgcatcatcgaggtcttgttgtgcaagaacggttcgcatttttacttgccaaagtgagaatcttgtgtctcggtccaggagcggtagatcatacttcaaactcgccatgggaattaatcctgaatttgctagaaagaaattagggtaaatctagcaaaaaaatgcgaaacctggtacgcttctcgtgtgcacgtagcgtagatctgaaacttcctggtacacaagcttgtgtgcgcgtagcaattccacgtgaatagaaaatcacgtgacaggaacctgatcgcttccatcgttgacttccttttcagcctcgggaaccgtgcgatttagttggatgtattgacgccgctgctactcctggacgtgcgcgtagacggcttgctgctgctgcttgccaatcttctgatgcgtgcgccgtttccaggacgtgggctgctgctgccctaatttcgcgcgggcggtagggatgacgccgatcagatcgatccggcgcctcgacgaaccggcggcggctgcgtgacctgtagatcgatctccaaagctctcataccacttgctatggaaatagatgcacaatggagacgcgaaatttacgtggaaaaccccngcggn

SEQ ID NO: 34445 - DNA, 1531 bp, Oryza sativa
  unsure (1)..(1531): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacccaaagggatctttgggacaagatttattgaggtcggtgtaatcaacacacatgcgccattgccccgtcttcttccgaaccaggactggattggccagccagtcaggatgtaggacttccttgatgaagcctgctgctaacagcttggtcaattcctccttgatcgcatccttcctatcctgtgcgaaatggcggagtcgttgctcgataggtttagcatcttccttaacatgtaaagagtgctcaatcacctctctaggaataccaggcatatcagatggtttccacgcaaagatatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctctcggaattataagatctcaggggtttctttttggaagcctccttcggcgctttatcgtgttgaccctgggcttaatcaggaaactggccccttttttcctctgggagacgtggccttttcttatagcttctctgagggaattacactcggggttgtggcttgttccaacagggcgtgtgtacaaaacacccgttatacatcccgttgtgctttattgtggaaaattgtgctgcgtgtcaatccgggaggaaaagatatatttctttgctcgcttctcggtgtaaggattatccccngcgggct

SEQ ID NO: 34446 - DNA, 735 bp, Oryza sativa
  unsure (1)..(735): unsure at all n locations
cggcgtttgatgatanatcnnnnnnnnnnnnnnnnnnnnnnnnnnnnnnnnnnnnnnnnnnnnnnnnnnnnnnnnnnnnnnactaatccgaatatattgtgggcctaaaattcggatcacatatttaacaaaaatgattcctataagaagagaaatcttgccgaagtcgttggtgaagaagttgaggctgccgaaccggaacgcctgcccgggagggaagacgaagtcgtcgatgccggagacgaaacccatcgcactaatcggcgaagaacttgacgctacccctatctggcgcgccaattgtcgaaacaagattttggcaatactaaaagggggtggctatcaagctggaaaagtggatgggttgagaaacaaagaattttatactggttcaggccttcttaacaagaagtaataccctactcctgtccggggattgatttgccgagtgtattattgatcgtatgatctgggagcagatcgtgccctaagaggcacctggacccctccttatataggggaaggggtccgtattataaaatacagtccatatccctaacggaataggtagttacagataagattcaatcttaaccgactaagatcccgggtatttcctttaacatacaagtttggaatttaacccaagtccctttaaagatattcttatctatacatggcaccccatacccagtcggattataaatgccgtgttggtatggggtatccataatc

SEQ ID NO: 34447 - DNA, 2310 bp, Oryza sativa
  unsure (1)..(2310): unsure at all n locations
ggcgaagggagagaggaagggttcatcccccccaccttttttttacatcgcgccccccaattaagtacaccgacgatatattaatagagcgccgcccttctcacaaaaaagagagagagatgtaggttcttgttaagcacgagggcgataaaaagagagccccgagatgttttcccaggaaaaccaccgggtgtttttatatatcccgggcggggttccgccccttgatgttgagaggtatttttttttatgcccgcgagggggcggaaccctatgataaccgcccaacaccgcgcctttttaaggttcggagccctttgaagagcctttagccaaaatttctttccaggattccccccttattgttggaaaaaccagttatccgccttagaggtaaattaaaccgcctcgccccaacggaaggtccaaggcgaagaaatcagtaagcaaaaacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgttgtcagtagatacatggctaatcctggcaaagagcattggaaagttgttcaatggattttcaaatacctacgtggtacatctagtgcttgtttgcagtttgggagatctagagatggacttgttggttatgtggattcagattttgctggagatttggataggagaagatcgctcacaggttatgttttcactattggaggatgtgctgttagttggaaggcaagtttgcaagcaactgttgccttatctactactgaagtagagtatatggctatttctgaagcttgtaaagaagctatttggcttagaggtttgtacactgagctttgtggagttacgtcttgcattaatatattttgtgatagtcaaagtgcaatatgctttacaaaggatcagatgttccatgagagaacaaagcacattgatgtgagatatcactttattcgaggtgtgattgctgaaggtgatgtcaaagtatgcaagataagtactcatgataacccagctgatatgatgacaaagccagttcctactactaagtttgagctttgctcaagcttggtgggtgttacagtatagtcctagagactatttggcgcgcggtgattttacctacatgaggtatttttggtgattgatatttttatgctacaagaggaaattcatctcaaggtggagattgttaaatatgtgatccgaattttgggtccacaatatattcggattagttttctagtaggagccctattaggtgcctttcttttatcccctatatatactcttgtaagtcatacgggaaggggtgacgttcccattgtgatttccctatgtttataatcaactcctctatagtgatcattgccggtcggcgcccgtggtttttttccgcaaggattttccacgtaaaattcgtgtctccattgtgcatctatttccataataattttgtcaaaaatatattgtttaacagtttgaaaagtatgctaacgaaaaaacgaaaaagttgaagtttggagttgatcagaaaaagaattgggcataggcaaacccgcatccgcagccgtgcatgtggtggcgcggcatcagggcaccacgccggcgcttaaaaagatcgtgttcagcaaatcatcgtcgcaagacacacatatgtgatcctctcgaaatttgggttgatcctcagatttgttgtgaggataaaaaaaaacatttcgacagtgaatatcttaattgggatgtgcttcgattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34448 - DNA, 2331 bp, Oryza sativa
  unsure (1)..(2331): unsure at all n locations
agtgatgaggagtggggacaacaaaagcaccccaccgcgagagggtgtttttgtacaacgttaacaaacagcctaccttgtttgtcagagaagtagggctctcacacagagagagaaagaccacaatattttttttttctaagaaaaccgcagaaagaggcgcccctttctcaaaagaactagatacccgcgccaaaagagacctcagtagtgattgaccccgttatacacaataggaggcatccacaaagcgcgataacgtttgtgtctgccgcggtgatgcgcccaaaaccataatatttagcgtaataagangcacaaggggcgaggcttataaggagggagtttggtgaacacacacgcccaattgttaaaccgggagcagcacttaccgcgatatatatattacccccaccaagctttaactcattgaagaaggcgcggccccctctccccagaagggaaataaaggcggagccagggatacccggttatagcgccagatgtccagaaccagaaaagagcgcctagaagagagccttcgaagggaggaaccccctggtattctttaaagcacccgacggagttttcgcccccttggaacttgaaggagcgattttttgataatgctcgccgagagggacgggaccttataagaaaagccgcagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatatccttttcgccaagactctggacgacatgcaaatccctcgcacggaattgaagccaagtaatgcgcccttccacggagtcattcccgggctgtcttctactccactcggctagattactctgtcggttactttcggcactcgagagaactttcgcacagagaatatttgcttcgaagttgctgattttgagacagcgtaccatgccatactcggacgcccggcgttagccaagttcatggctgtcccgcactacacctacatgatgatgaaaatgccaggtccccgaggagtcatatccctgcggagtgacatcaagcaagctgtcacttgcgacaaggaaagctgcgagatagcccagacccgcgagattgcgctcgctcgagaagaaattcgactggctgcgttcacactggcccctgtggttgttgcaagagataatccgcatgagtctcagcttggaactgcctaggtagatgcgggtctccaaacctgctggggatttcttgtttctgtgccccttgctggaagaaaattaacatccttccaaagttgcggatatgcatgaccggtggttgtttggtggtatgtcgagtcattccctccagagatgattgtcaacatgcccggtagcaatccatggttgccagctattacgtgcttctggcttttccaaaccagactttcattcatggctaccagaaaactggtcattctttccgcaggagggagtggccctgacataattggggcatatgtcgaccaatggctgtgaaaagggagaccccttgcccacacgaggtgactgaattccagaattcctgaggttgtcacccgccctgcttacccaagaatacggtaccgaagtttgtgggaagtaaaccgggccacaagaggaaggaacatccctgaactcnggttggtccactattgaggccaaacaatgtgaaactctccttttatatgggccaagtgttttgggccggaaacagggcacctaaaggtttggtttggcagcactcaaaaatgggggaggccctcttggccgctcttttgggttaaatatgaggtgaatttgggcatttcaaaaagaaaactttcacctggtatttggggcggcgaggttacatttgggcccctgagagggatctttcctcg

SEQ ID NO: 34449 - DNA, 1786 bp, Oryza sativa
  unsure (1)..(1786): unsure at all n locations
cctcccccttcccgggaatccaccccctacctttttccatgataggtttgttttgtgtgaggataataataagtgggatttgtgggtttgcttgttgtgaagcgcttcaatttgcgggaaaccaacccccacatgccgtgggagttctcgaaggccaacatgaaaaaggggctgttgttagtctcgttcattcatttcccggtgatttatgatttggatggaaacagtggatgtttttgaagttagttgtggcagattttgttcagttttgtngngggatggncagnantggngggtagggnnccannnnannnngnnnnnnnnnnnnannnnggggggggggagcgaggaaaaaaccggaaatgagagtcggtcggtcggtagcgcggctatggacgatgacgggggtgacgaggaacgtgaggtttgcgttctttgctttgtggactttcttcccgctttccccttttcgttttacccgctgcactgcggctgtgcctgtgttgcatcgtgggatacatacatgggatcaatttggaaagctttaagattatgccgagtagttagtagtcaacttacgagaattcgtataggcggctgtgcctgtgtcgcgccgtgggatacgtacttgggacctgtttgggaagctttaagattctgccgagtagttagtggtcaacttacgagaattcgtataggatgggctttcgagcttctgacttctagttttatttttagcttctatagctatagattctcagaatctgaacgagaatatgtatcattggaggagttggagattctaggagaaactatagttgctagaagctctcctaaatagggcttgaaccagatgacggcggaggtgacgtgagattgtgagagggtatgtgagctgcttatcatgaaaaattctttgttttgtccttccatttttgtattgtgtttggcatgattttcaggtggaagcagatgcatctctcgtacacaagtcaagcggctacttgggctctgctgcatctatactaccaactgccattgatgtttgaaagaaagtgaaaagtcactagaaactaatactagtcgctcacaatcaatggcaccgctagcggcatcattgttttttgtatgtcaaggtagaggtgggttgtttttcattggcaactatgtgtacgtgattgtcataacaacctagtcctatattttattctatctattttctgtgtttatcaaaataatcacaatgttaggtttacatgaacactactccataatttcactattaagatgtgtatttttttagatgttgaacttagtccatgctaacactgataacagtttaatccatacatatgcagagagctagagatgttgcgtttctacatttcttcaatcacttgtaaataggtatgtgtcatgatagataattgaagtacaagcgccaaaaggattggtagcactgtgtgtctatcattacctatgtacttaaaaagattgtccattaatcctgtattatcaatgatatgttgaaacaaatgcttaggcaataattggtgtacaactagaaagtggtcatattccccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncag

SEQ ID NO: 34450 - DNA, 743 bp, Oryza sativa
  unsure (1)..(743): unsure at all n locations
gcgccaccggatttgacatcaccatgcnnnnnnnnnnnnnnnnnnnnnnnnnnnnnnnnnnnnnnnnnnnnnnnnnnnnnnctcgctcctgtaggctgtagtcctatgtgagttgtgactgaactgaactccacggcaggaagcatattcccgccatcatctccggtggttgacggccttttttgtcgatgattactctataataaagccatctcccggttgggcgagcatcaatggcgaagtagtgagggtccagtgaccactttctcctgtgggatagagctgaaacaaaggaaacatcactttctcctctgggagtaatacatatccggtccaatgcactagcagtctagcagcagcagcactaccgctgtccggttgttgcttgcttgctcgtcagctactactactagcttagctagttgcagtgctggattcttgacggtagctttactactactttacggtatcagcaatggcccatttgaatcaaaaacctacgaacgcatttcgtagggattaaatcctatatgaattttcctaataatccattgattcaaaagattgaggtttttcaaaattctatgaaactcctattggatggttcattgtacatagattttagagaaaacttactgggtcatcggatatagattttagaggaaacttaccaagagctaccatcttttgaaaaaattccttttgaagttacctttctcaactaaatcctgggattttcttgc

SEQ ID NO: 34451 - DNA, 740 bp, Oryza sativa
  unsure (1)..(740): unsure at all n locations
cgcgtcccgggtgaagcannnnnnnnnnnnnnnnnnnnnnnnnnnnnnnnnnnnnnnnnnnnnnnnnnnnnnnnnnnnnnctaggatttagtgatcaataatctgccttcttgcaggtgcaaactgatgctgaagagttactcataatcaagactagagaatctcttctagatgccttgactgaacatgtcaaagctaaccatgaatacgagtaaacttcattcagtttattgatcttgctgtacaatctgtctgtttactatagtttacttgtaacttttctccctgaaatcttaatgtaatttggttggcctattctttcggccggcccgggagaaaaatgttcctgtcagatttactggtaacttgttcatgcagtgttcctgaagttatcgctcttcccataactggtggtaacaccaagtacctggagtggatcaagaacagcaccaaggcaaactgatctggcattcaccctgttgtatacgcgcgctgcagacccgcagctcaaaaatattcaacaacatgaagtaactgatcggatgttctctgtttggcctatgtatcacagtgacatttgctgcaaggaatatatgtgtggttgccatcttgtgaggtctgatgaagtactggngtctataattctgcttacaataaaaaatggattagtactcatacttgtgaattgctgcccttgattgggattctctatgaagtttttctagcgatgcaatgatgag

SEQ ID NO: 34452 - DNA, 746 bp, Oryza sativa
  unsure (1)..(746): unsure at all n locations
ccgcgcctttgttgttatacaaccntcnnnnnnnnnnnnnnnnnnnnnnnnnnnnnnnnnnnnnnnnnnnnnnnnnnnnnnnnnnatggcgctgctcttccaggccgggagcttgtacaatggcgtcttctcctactgccttccgggctacaggtcatactacttctccggctcgctccggctgggcgccggcggcgggcaaccgaggagcctccggtacacgccgatgctgaggaacccgcacaggtcgtctctctactacgtgaacgtgacggggctcagcgtggggcacgcgtgggtgaaggtccccgggggatcaggcaaacgaacaaaccaacagtcaacggtgcaggacgctactgaaattcagcacgaagatcgtcgtccatccgtggcaagcatcgttccccgccatggctatgtacaaggtttagccacttatcagcaaattaattagcaggagaagcaaggataaggaacatagacagatcttcctacatctattaatgcatctatctcgtgatcgaattgtcggtgagagtaagcccaaaaccctcccctgtttcctcctaacacaaacagaacaaatctatactccatatattaatctaacacatatctgctaatcttcgggaggccaactgtacgtcagtttgctactccattttatattacaagttatttcaggtttgtcctatgttaaatatcaactatatttgtagaaaaaaaagtagaatatctatagt

SEQ ID NO: 34453 - DNA, 746 bp, Oryza sativa
  unsure (1)..(746): unsure at all n locations
agggggccgtaatacttctcaatgccagtcgngtttaaagcggcttggcaatcccactcaacgcagttcgcttgtaaaggcaacaactccatccacgtcgtcgtcgtacgattctggtaaatggtggggattgtagcctcttcccgcacgccgttaattaatagtttcgcgaaagatcgatggaacgcctgcgatgtgggaagcgggaacattcagctcgacgctccctgtgtcggtcaggaggcgagtgaacgaattgctcgtcgtgatccctgctcctacgactggttccggcgccgacgacgctgaggctcggttggtgataaactgcatggttcatcgatggattagaagagccattcagccaaggctttgatggactcatgtcagacaggccattagaataggcatccaagaagggaaattgtctttcccttgtcccctggaaagcactcatgtcataggcccttaagtatccctcgtcgtaatatggctcagtcaaattaaaccgcccaggactgttagcagaagccatttcctgatctgccaaattgcctcttaacaaaaacggcaacgaaagaccaaatgtatggtaatcatgaccaatggactctggcatactgccattgctctgttcctcctcaagcaaatcgtttatgatgtcaaggtgcggaaattcttctgccactgnnnnnnnnnnnnnnnnnnnnnnnnnnnnnnnnnnnaggcgagtcgcattcaaggcg

SEQ ID NO: 34454 - DNA, 1275 bp, Oryza sativa
  unsure (1)..(1275): unsure at all n locations
agcgctttgattgccctgacgaccacnnnnnnnnnnnnnnnnnnnnnnnnnnnnnnnatttattttactcctattatagtgtagaattattctctcaatcccctctccaatctctttctcggattaaccgaacaaggcctcagagggagaggccgccggactcgtcgtcgtcgtcgagcgtggaggtgtagacggtgtagagcgaccagatgaggccgaacacgccgaggaggatccaccccagcaggttgttgctcagccccaggctcagcccggtcccctccgtcgacatccgctcgtccaccagcgccatcgccgccggcgccgacgacgacgacgccgtcaccgccgccgcgagcatcgacgtcgcgcctttcacggcggcggcgggcgtcgcctccttgccgtccctggaggagtagccgcacctcaccctctcacccctcctcgctctcagctgagccacccctgcacgcaatgggcaatggcagcttccatcagtgaactgaatgatctccgattcttttaccaaaattcttactcgctccgtcgctaaacatttgacgccgttgacttttaaaacatatttgaccgttcgtcttattaaaaaaaattaaataattattaattcttttctaatcatccgattcattgttaaatatacctttatgtatacatataggtttatatatttcacaaaagtttttgaataagataaaatggtaaacatgtgctaaaaaatcaactccgtcaaattttatgggcacaggaaggtttctattgcactgtggaaaggtttgtgaacttacctgacgggcggtcaactacggttgttccgtccggngcggcagcgcggataggcgcccaaggttcggctttttccttggtattttgggaggggggcacaggcccctccacttttgggggttttatggagaagcccccggggccaccggggaggggttccggcaaacgggttagattttctggggctgtgatacacaggcgggggggggggtgcggggctttacccctgtggaacatggggcgccgcccctctgacgcgcggagtttcttcttaaaaaaaaggggctgttttacgcggggaagacacccccgccctctatttataaataaaaaaaacnggggggggtaggtccggcaccccattcaactttctgtaaacacccccccgtgtgggttccccacgagttataagatgtgttttatatgtttgcgcggggtggggggtcgcaccaccatatatatttatca

SEQ ID NO: 34455 - DNA, 753 bp, Oryza sativa
  unsure (1)..(753): unsure at all n locations
cgtgtgtagatagatccntnnnnnnnnnnnnnnnnnnnnnnnnnnnnnnnnnnnnnnnnttttttttactattcaaatcaaaatcaaactagtagcatccacaaaatttgttggctgaaaattcactgaagaaatggtaccagtgactacaatttagtttattactagttactccctccatctggacagagggagtagttagtaccgtgtaatatacaccatactaaacacgtggcgattctaggttattgaccagaaaacaagtggaggaagcccccacgataattttcaattaaannnnnnnnnnnnnnnnnnnnnnnnnnnnnnnnnnnnnnnnnnnnnnnnnnnnnnnnnnnnnnnnnnnnnnnnnnnnnnnnnaaagccagataaggggaaaaccaacacagcaaccggactactgtactacataaaaatataaaatttggggaacagcaatacctttaggtcatcgacgtcaaccttcagaaaaacagcatttgtgtgcttctttgctagatcggcaaaaactggagcaatgatgcggcatggtccgcaccatgatgcagtgaagtcaatcacaacctgttatgacgaaaacccagttaacacacttttgtggtattgctaaattaacatttcaacaattaaatgactgcaattagaactaaaatgtattcgaaaaacatatatagttatatacatgaagtgactgttatagttcccaacctttgactctattaccaccttaggaca

SEQ ID NO: 34456 - DNA, 1232 bp, Oryza sativa
  unsure (1)..(1232): unsure at all n locations
cgccttgattgctaatctgcctgcgannnnnnnnnnnnnnnnnnnnnnnnnnnnnnnnnnnnatgtcgagggaagttccttagtgccatatcaatatcaccatgctccttgtaatgttcacccaattgttcgcactgacagattagctacctgataacttgaacttgagctatgatttcaagaacatcatcaacaagaaagccatcctgaatcttcgacaacttcataaattttttccatccccaatcatgctccttcttccagaacttatgcaaagtatctacaaaatttacttaagacctgaagctcaagaagataagaatggtagcttcctaggaagagaacaagccaaattccactcaccggagtattttactttcttaggatctatattgcctacagctatagtgaactgcgcaaaatgactccaccctgaaagtgtaatactaatatgagatattaggtccatggtgcaccattagatagcagcaaagactacaaaaaccaaacctgggagaagtttgtcatgattagcaacacagagaaaaagtgataggtggttggaaacatcacatncttggaggtatacaagaatatacctgaaaatagcagccggacaaagtagggataagtaattgggcgtatataattaccaaatttaactgggaagagacaaggagcttttagaattggtctatgggccttagcaagaatccttgagccaacaatatttggtggtcatgtaagccaaattcctatattaatattacatggttgaccaagatgccagatggtatgtgtacaggtggttcttttttttttacataaaagcttaggcgagataaccgtggtaaaccccaaaattatttaatgaaataaatggtggcaattagaaaagtgaacctacaggttcccaattgtggtggggaacataggcacagaaagcgacttgttttcaaaacttgggaaaactttttaatttgagaaaccgagaacaatttttatgcgccaaatggggggggttactttctccatatcaaaattttttgaaaaagtcttaacaaaattttcgggttgtttatttgtttgcgggaaagaaaccggggaggaaatggcaacccttctttggcccaccaagggaaaaagagttttgtaaaaactcgtgttcggaaaggttttaaaaaaacatcgggcntttttttgggaaagaggctcggggatttcccctttta

SEQ ID NO: 34457 - DNA, 1003 bp, Oryza sativa
  unsure (1)..(1003): unsure at all n locations
cggagtaagagcctcnnnnnnnnnnnnnnnnnnnnnnnnnnnnnnnnnnnnnnnnnnnnnnnnnnnnnnnnnncgatttggctgtcgttttcaccacaagagcgtcatctccccgtaggtctaggcgggatccgccctggccccgatccagtctagctctagggaagtcggtgtcatactccagcctctcggcacggtttcgacgaaacagttggacggctacctcagctcccccggtgtcgactcacgaccaacggagatcgtagagtacgacgacttcggctaccgctacgactaccgcaacctcgacgacttcgacgaaggctatgaagataactacacgccccctctacttcggcattttcatggccgacaacgagacggaaaaacagcgtcaagcccgagaagaagaagaacaacgcgtgcgacaggaagccaaacgtcgccgactggaggaggagcgccaagcacaagagcgagaacggctgcagcgtgagcaacaggagcgcgagcgagctgcaaaggaggcttggaggccgggcgacgagcacgagaactcatcgggcaacaagatgtcgaggggacggcggtttttcgcaccccgcttcaacatcctccaagcctttgccactcccttcgtcgctgtcctgatttgtatctattaatcaactcgtatgatctcttgtttggagttctttttgtacaaatatttttgtaggagtatcatatatttacagaatctctcctcatttaatgttgtgttggatctgtctccttgaagtgcttattggttgagttgaattatttattctattgactggttattttcttcctatctgatcaaacctttcactggatcaacttcagagctcaaaatggatattttagcagaaacagcacatttgaagtcaaagcaattagatttagatgataggcatgtgcttagnnnnnnnnnnnnnnnnnnnnnnnnnnnnnnnttcgaagcgatgagtcatcatgggcg

SEQ ID NO: 34458 - DNA, 726 bp, Oryza sativa
  unsure (1)..(726): unsure at all n locations
gcgcggtgaagaacctctnnnnnnnnnnnnnnnnnnnnnnnnnnnnnnnnnnnnnnnnnnnnnnnnnnnnnnnnnctgaatcattcactgacaaaatcctacagaccattcctattggctatagttaaacacttaactcaactagaacacctatttgcaagcatccaaaatgacagaaaattatagatctcgaagttaccatgcactgatatgctgacaagaactttttcttttgtgattgccaacccccattctccaatgcctcttactattaaggctcctaatttcctagtgtcacccatcttcagtaggacgaagaagtgaacagaaacaaggccagtgcaataaggttttgatttatgaatgtctgctaagcaagtccaatataactatagctaacgtgggttgtaacaactaacaaatgttgaggtacatcactttctgaaaattgaagtattgaaaacaggatatagcacattaaaggcggaaaacagttgatcatcgaaagctcataaaaaagggacttacagcattcattgctgcaactggcacccatccaccatgctgctgctgggcaagatcaagcattggaataataccagactgcttgtagttgcttggatagtgagacaatatctcattaacctgaattaagtattgaaatagagattttaggcccgataaccaaaatagctgataccattgatataaaccgtattcacaaan

SEQ ID NO: 34459 - DNA, 849 bp, Oryza sativa
  unsure (1)..(849): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcaggttgttgctcagccccaggctcagcccggtcccctccgtcgacatccgctcgtccaccagcgccatcgccgccggcgccgacgacgacgacgccgtcaccgccgccgcgagcatcgacgtcgcgcctttcacggcggcggggggcgtcgcctccttgccgtccctggaggagtagccgcacctcaccctctcacccctcctcgctctcagctgagccacccctgcacgcaatgggcaatggcagcttccatcagtgaactgaatgatctccgattcttttaccaaaattcttactcgctccgtcgctaaacatttgacgccgttgacttttaaaacatatttgaccgttcgtcttattaaaaaaaattaaataattattaattcttttctaatcatccgattcattgttaaatatacctttatgtatacatatagttttatatatttcacaaaagtttttgaataagataaatagttaaacatgtgctaaaaaatcaactacgtcaaatatttagggacacaggaagtatactatagcactggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34460 - DNA, 820 bp, Oryza sativa
ggaattaaatataaattcttcttgagtaatttagatttatcttgtgagaattacctcttggttaattcctaattagcatacgggattattgttccctataaacagctaaaatatagtgattgctatggtgagttataaacactaaagtagatattaattgcttagacgtggtgtttgggtaattattatgcagtaatttctgcgtatcccacagtacgttgaggtgggtgtagaggtggtgatagccctcgagatcactaaagtcatccctgtccgggtacgcagtagagcgacatctgggaacagcgggttgccagtgcctgaagtattgcgttaggattaaaattaagctttccctagacactgtttctcactagtaaatcctctctatcctggcctattatttgcttggtgtccttggatgaaccagaggaagctctgatcacacacgttcccttggattcgatacccttggaatactccgtagaggaaagtgctacatcggtatatccgtgcgcttgcggattttatctgtaaccgtatcatataccaacacacgtacatgagtcggaggaggagcaagagagataccgaggcgaagattgcagatcttgagtacaaggtatcgagctacgagctcagcatgcaagaggaggtggcaaggaaggtggatgaacgcatggccgtacatcggtcccaggatccccagacgtacattccttctgtaatggtcaggccctcaggcaatcgtagcagctgcaccttaacggggcaggtagaattacagagcatggacgccatgcaaacttaagacgaaacc

SEQ ID NO: 34461 - DNA, 4440 bp, Oryza sativa
  unsure (1)..(4440): unsure at all n locations
atgaagttgcnnnnnnnnnnnnnnnnnnnnnnnnnnnnnnnnnnnaatcatagcttgcaactgcatatgtagggcttgggatccgttccatcaattggtccgcgggacatggaaagaaaaacttggatggaggtttcattttccagtgagtacatgcatgatccaaaattatattgaattgaatctctaattacagttaaaccggcacttcaaccatttttcccggtccaattacacacgtggggtgtgtttgcaaaccctttttcccaacccatctccctcatttttcgcgcgcacccttttcaaacggctaaacggtgcgttttttttaaaaagttttatacgaaagttgcttaaaaaaatcaaattaatccattttttaaaaaaaaatagcaaatacttaattaatcacgtgttaatggatcgctccgttttccgtgttaactgtgcacgttgggaaactggagtagcgaacacaacccatggtgggtcttttaactgaatcggatcggccgagtttccagttcagatgggaccgccggtctggtctgatcctcgataaccagtgacgatcctatatatactttcctcgggtactcggacctcggataaattaaccaattctaactaaattatatcatgttaattagtatatagataaaaaaattagataattaatatgtattggattcccgataataaaaccagtgttgtggtagacaagttcattaatacatcaacgtcaaacaacaatactgcagtgttcagcgacacagtaccagcagatttcatatctacatataagcacggctcatcactttgccatccaacaatgtgggcaatatagtatatatcgaggtgccacaaataaatggaaggtatccatgcagggacggtgacgatggcctgcagctggcttgttctcacggccgccatggctgggctagcctcttggttgatccgtttggtttcactaaaatggaacagcagccacccatgcaaagctgatgaaggcagcaggctgccgccagggtcgaggggccttcctcttctcggcgagtcgctcgagttcttcacttcgagcacctctcttgagctgcccgtcttctttaagcgccgtcttaataggtaaataatatgtgttctctccattaatctaaaatataagcatttctgactatatatacatgatggatggagtttcaacgtcgtctagacaggtaaatatacatcttcttcctccattcctaaaccaatatcttcttcctccattccaaaacctcagcgaaaaatgtttaattatattttaaaacagagaaagtttaataatgcacgtaagcatacatcacgacatcacgtacagctccgccagtttgtttccttggttgaatgcaaaactgtgctaacatgatcagaacgtcaatatcttgagcgcccatcgacgcgagaaagttgcatcacaatatcaacatcaacatgagaagatgaaattattacgtagctaaaaattcgtccacttttaaatgatatatccttaacatggcattcaaagagagcatgtactgctaccgaattgatttttctggacgacactttttaggacgcaagtggaccaaaactgttcctctcagtaaaaaaaaaaaggccacatgcgaaaatgtatttttacatgcggctgattaagtggtccatctacgaaaattgacttattttcccaggcgagcctcctaagcgaccacatacaaaaatgcattcttgtagacgggtctcttaaaagcctgtctaaaagtctaacatcccccctctcttctctcttagcatcttcaaaattttctaagtctctcaccttatctcctcatctctcattttttccttagcatctcctctctctccccactcattttatcccccctctctctccaaaacatctcctggccactaacctctcctctctctccccaacctctcgggcggcagtaggagtgacgtcggcgaggacgagtggcagcggtgacatcgacgagggctcggcctccaaccgtcgtctaccccgccacctctcctctctctctctgtgtgtttcttctctcccaccagaggtcgcagggtgctggccaacggatccattggctgcaaattcgaccggcacgaatctagcggtggttgcgatggcacgcacgagggctacggcaagctcgggcggtggcatgctcggcctcgtacggtggagagcgcagcggtgtcggatcgggtgatggggaggactgctacagcagttaggaggtgtggtgacaacagatccgatggtgttgagggcggcaacggttcggacgcgcagcgacggtgacgatgacaacgagtagtggtggattgcagtgatgacgatgaggagttgtcgggcctcggcgacgatgagtggtggcagatgtggttttcgggatttttatttttttcgtgatttttattttcacatgcggatgacataagcatctatacacaaaaatcgaaattccgcgtgcgactacaccaaccgcatgaaaaaataatgatttttacagacacttcagaaaagatgatcggtccaactatataaaaaaataggttttaatcgcatgaaaaaaatagatttttaagtagtgtacataagtggacatgagcatttcgtgaaggacaagacggcgaccaccagcgcgtgagcaggtagatgtaggccgaccccacacgtaccatgcacatgtcgttagcttggccgagaatgtccattccctgtacgtcgtgtacaagggacatgtatggcacggtcgctctcgtcacgggattatttgcgcccgctgcgcaagaagacggagagatggagaggcaggaggagggggagaagagaaccgacatacgggcattaatttttatcgcaagccaacgaaggatggggtaaattagtattaggcagatgaattttgttcggacatgttttttcccaataaatataatagttgagtggtttatattatatactatatgagacccgtgctttgctgtaggagtttaataatatacttcttccgtttcacagtgtaagtcattatagcatttcccacattcatatcgatgttaatgtgagaaatgctaaaatgacttacattgtgaaatgagggaataatagtaatagtagaaatagcgtgtaacatagctagacaacgtaaggttatagaatttttgatcgatcatttcaaaaggctataaaccacttaaattgatgtgatttatgataatttaaatagtatacagtaaaagtaaaataaggtgatgtatttttataagagaaaaaaaggaataatttggactatagattaatcaactaagggctagaaacaattaaagtgacgtggtttaatgagagcgtatagaaaacattaattaagtggggataaagtatatatgatattctagaaaatgatagagagatatatgttaaaatattactccctacatccaaaaatataacaaattttagccatcaagatttgtccgaaaaaataacaacttctccaccaacattctcttcccaacctgtcggtgatatgggcccggggatatcatgtttagagggaggaggccgccccaaacccacgtggcgtccctagaggagggtggcgctcgggaggagcggcggccgccccctcagcttagggtatcgaatttggagcaaggaggctgccccctaacccacgtggcactcccctgagggggtggcgcccggggtggagtggcacctgcccccttcttgcttgggagtcgggcccgtcccgatcaagactagagggaggaggctgccccaggcggcacgtggccctccaccgaggggggatcgggcccgaggtagggcggcggccgccctctcctgtgactaggggtcgagctcccccgaccccctctctaggtcaccacgtgcgatgggttatgtggctgcctccaggcggacctgtcccaatcaagactagaaggaggaggctgccccaggcgccacgtggccctcccctgaggggggatcgggcccgaggtagggcggcagccgccccgtcctgtgactaggggtcgggctccctcgaccacctctataggtcgccacgtgcgatgggttagatggccgcctccaggcgctcacctacccgcttttatggcgatctgagcggttgcgccacgccgcatttaatgtggcgtgcagtgcactcaaccgatctgtgataggtccgtgaccggtcgaacgaccgatgggacggcggctgtgtaccctcgcccagtcaatttgaacccagcgtgcggcgtgctccgtaaaatacaatcataacaatgagggacttaacagcttctcccnccggtcagagctggggggcnnnttcaacannnnngnnggntnnaacgtcatgcgggatcgtatgagcg

SEQ ID NO: 34462 - DNA, 1950 bp, Oryza sativa
  unsure (1)..(1950): unsure at all n locations
aaaaatttggggggtggggggggttaatttcttcccccttttaaagaaggttaaataaaaaaagnaggncccatacctagcggaaagggggatcgaactctggatcccgaagccaagctttctctaaccctaggttgtacatcggagattcaaaggctttccaagcatagaagaatcatcatacacacaggagtagggtattcggcttcatagcagcccgaacctgtataaatcccttgtgtcttttgtctcaaaaacctcggatctcacccgctgcccttggcggaactcaaaaaaggggggcctcacggttccctggtggagaagatcaccctccgacttttggcgcgttaggtagggggcgcgttcgtgatttttgaggttctttcgagcgctggcatgataagcatcgcgccgccaatgcaggggaaagcgcagcctcttcaagagtgccgtgccaccccaggcagggggctaggccccccgcctcttccccgggtaaggctggcggccaggtatttatggcgagtcttcggaatgtccaatgacccccaaaagtttcggcccagcttcacagaaaggtaccacggtagcgtcaacacctccgagtccctctagaaccacacgacgatcatataggcggcgtggggtgatgaccgggtcaaggcaaattttttccccatggccctctagggccaagcgcggggatcactcatgaacctgccacccgccttggtctactcctgggagggctcttgcagttgagctccgggtgccgtcgaagcccgggaccccctgtgctggctctttcgtaacggctagctttggtcccgccggctgcatacagtgcccggcccggctcaactgatcgtcctttcaagcttcaagcttcccaaaatggttaggaacacatggtgggaggccctttttgagctaaaggtttgaaaggtcgcgacatgcaagcaaggtttgtgtttgcttcattcatacaagcgattctttgctataagtgtgggggctatgattcctagttctatcctagccctgcgtcgagctctgggcgccgttgacgcccggggccccctgtgctggctcttccgtagcggctggctttggccccgccggctggctacagcgcccagcttggcttgatcgtgggtaaagattgttggctatggaaaatttagtcctcgcactcgcgcgaagataatcatttgcatagaattattgttgcttatatttatttctctcccatctcttcctcgcggtcccgcagtacccatgtgtcgcgcgctcgtttgccccccttggtaacaaaaagtttgtattcgcttcatccattcaaacgattctttgctaaaagcgtgggggctacgattcctagctctatcctagccctgcattgagctctagacgccgtcgacgcccggggccccctatgctggctcttccgtagcagctggctctggccccgccggctagctatagcgcccagcttggctttatcgcgggtgaagattgctggctatggaaagttcagtcctcacactcacgcgaaaataatcgtttgaatagatgaaatagaacacgaacagaggttaacaaaaggcaggggcaagtgaggtacgcggcgtaaggtcacgggcccgagagaatctaacaacatttgctgtgtatataaaggaaataagttcacggcctaaggtacgggctaaattcctgagcccacggcacctcggaacagcggaaggaagtgggaagtaaggctggcgtgtgaacgtggctaaactcccaccggccaacttccaggatgatagaacagaagaccggaccacatatcattagactaggagagtggcgtcaccctggccacctagggaagggtttggtcagggctaacgccgggggctactgttcgtgatatgggcccagggtatcattgttagagga

SEQ ID NO: 34463 - DNA, 3325 bp, Oryza sativa
  unsure (1)..(3325): unsure at all n locations
cgctgtcanattgatgtcattctnnnnnnnnnnnnnnnnnnnnnnnnnnnnnnnnnnnnnnnnnnnnnntcgaatgaccgatgggacggcagctgtattccctcgccctgtcagtttgtcaggcggcgtgcggcgtgctccgtcctgtcccatcacaataatgagggacttcacatcctcttaccccggtcagagctggtccaaccactctaaactgaccccgggcttccgttttctggtgcgaacgagaacccgaaagtcctcatccattgaatggcaaatgacaagggcgccctacatgatttgatgggccccgcgcagtagctgatgtgcagatagcttcttggctaaggcacaagacatatagttaatatagagaatattttcccttctccctaggtagcactcgcagcacatgtgtatccccttagagtataaaaggaggaccatacctagcgggaagggggatcgaactctggatccccgagccaaagcttctctaaccctagcttgtacatcggaaattcaaaggctttgcaagcagagaagaatcatcatacacacaggagtagggtattacgcttcatagcggcccgaacctatataaatcccttgtgtctcttttgtctcaaaaacctcgaatctcacccgctgccccccgccgaactcaaaaaaggggggccttaaggttccctggtggaggagatcaccctccatcattcacttctacctacttttggaaatgattgaaaacagatgattatattgtggacggaggtagtattgaaaatcaaaacctagttttggaaatgaataaaactgaagtggtgtataaaatgaaacaagacctctacaaaataataattgagatatcataccatatggaaatgaataccctccgtacacgtacctagtgccccaatagtaggtgtggcacctccatatacaggataagcgcatgttcaatggtagagacgagtatggtctcttaaacagtataagattatttagagaatgtgtctttacaatagttgagacgataaaggctctaatcattaactcaaaaaatattccttttgttaatattcttttcttctttttaccctcatgcaaccatatttccatattgtagtgattaagagtcgttgttaagccattgttatgcatgacaacgatgttttgtctctcctgtttctctttcttccatgttaacaagtattcctaattagcaacgctaagagaccactattgacaaccattgtacatgccctaagtctggatcgtgttggtacggggcatggtttataattatagaagtgtgccgataactttttaaagtggagtatgttacgtaggagtagatctcttcctccctgcactgatccaccctaccccttaaaactcactcatcgttttcatatccctaaaatttacccgatcccttttatactcctgaaatttcaacttgatcccttccatgctcctaccgttatattttccctcatttcactgttacgtttggttgcaaatgtctattttgtccttgatgttttaggtttgaatctaagcttaaaaaatgattgaaaattttgtttgagtacatagtatgtgcatttatgaaactaatgaaactaaataattagtgtataaaattttggcataaattttgaaaataaaaaatataataaattaaaatttttatttgaaattttaataggacaatggatttttttacgggagcattcataaaaaagttattgtgagcattggtagtcctatctttgtatgaatgctccttattttttatgactttttgaaaaaattaaatacatatttttatttcattatctaaaataatttttgcgagaaataatgcatcgcacaacaaactcataataatagtctcatgcgacaaacttttatatttttaataatgtaattcataaatttctatgttcatcgaaagggtaaaattgtcattattatagagattagacggtcaactaacgttcaactgacgggaggggtatggaagggatcaaaatcaggggcataaaagggattaactaaaattgtaggggtatgcaagggattttatctttaaaatatatttgggtatgcaagggattttatctttgaatatgtttgggtatctcataagcccaaactggttccaatatgcttttaacgcttcatgacggaatagctttaattttttcgattttgctatatctcacttgaaagattttttcttatctctcacttgattttctcactcaaatttacagtgcattttcttgtaagttacagtgtaatttataaatcttacattgtaacttttgtaagttacagtgtaatttttgaatcttcgcatgtaaattttaaattttatattggatttggtctttttcttgaggatatggtaatttagtgtccattatggtgtttcttaattgttttttgctttttattatatcacggattttaatccaaagattaaaaatctgtgtgatacgatcataaaaatcttttgaaagatgtataggtactccctaatttttttaagctgcatttttaagctccaaccctaaaatattcttggagttggatttgaaactatattaaggttagtagtgtagacatccttttcatacttcaggctcgtcaacactctattattttagggttgaagccatgccaaacaggaccaacattaagttgttgatgagcaacccggcctgaccatgctaggattgggccctaaatataaattaggaacaagttcaattaggtcccttaaacttgacagcgagttcaaatttcattcttgaaccgtaatatcagatatagcggtccctcaattgttaaaaccgatgtaatataaggtccaaggcagtttggatggccgtttcagctgacgtgacgcttacatggctaatttgactcggttttcatatgacatagtacatgaaccaaaattgaacaatttaaaaattaaaacaaaatatataggttcatatgttcaaacaataagattaaaaaatagtggaagctacatgccagtgggccccacttccttcccctcatcctctctcttctttatcccctcccgttctccttcttccctctcccctttctccttctctaaatgcggcaggtggcacatggctgaggtggcgggcagtggtggttgctgtgcgcgacctatgatgaccaaggaggggccttcactagacttgagcagcaatggaggagaggccttcggtggacctggggcggtaggtgcactggtcgatggcgaacccgatgacgctgtccatggccc

SEQ ID NO: 34464 - DNA, 3071 bp, Oryza sativa
  unsure (1)..(3071): unsure at all n locations
ncggtccagttttcaggacgaacatggtcgggcaagacctgatcgtgtgtctcgatccgaaggtgaacagcttcgtgttccagcaagaggaaaggctcttccagtgctggtaccctgattcgttcatgcggatcatcggcgccgacaacatcatcacgacgctcgggtcgtcgcacaagtacatcaggaatctgatccttcggttgttcggccctgaaaacctcaggcgtgcgatgctccaggacgtgcacagaacggctcaggccagcctgctctcctggctcgatcgaccgagcatcgaactcaaggatgcagtctcaagcgtatgtctgatggaatggctattacggattcaccccctttaattttttgcgattgcgaatatttcagttgaagtttttctcttctttttcagctatgtgtgaattaactctgactagagaaaatttgagtatgttccagatgatattcagcgtcacagccaagaagttaattagctatgactccttggcctcagatggaaagatgtggaaacaatttgatgctttcattcgaggtctactggcatttccaattggcattcctggcaccgcattctacaaatgtatgcaggtaaatatctactagtatatggtgatagatggttcagctacatgcatgttaacaaaaaggatacaaaacatagctggtaattggcagaaataaatcaacttgcagaggagaaataaatagaggaatttagccgctaagttatagcataattatatatccacttattattggtaaaaaaatatatccacttatcgatacagaggccggaatccattaccttaaaaaaaagttatcgcacagttttctactctcttcaaagttgacaatagtgtcctatatatatatatatcaatttgtaatcttaaaaggagatcccacatggagatggattcaattcttgcaggggcgaaagaatatcatgaagatgctgaaagaattgattgatgagaggaaggaggcatcagggcgacggggaagcattgacttcattgatgtgctgctcgaggagctgaacgaggagaagcctttaatcagtgagaacgttgcgctggatttgatcttcttgctgctatttgccagcttcgagaccacggcatccgctataaccgcagtggtcagatttctaacggataatcccgaggcattgcaagaattagcagtaagtacaagtcataaacttcttttacagtagatatatttccatcattttcaaacagtagtgatgtttagggttcattattaattaaattactagtttaggccagcatattgttacatgcaaataattcaggatacattttgttgaacaaaatgagattgatttgttgtttacaggaggagcatgataacattcagaaaagaagggtcgacctgaactctgaaatcacatgggaggaatacaaatctatgaaatttacatctcatgtatatgacttaaaattcctgaagcattatttatataaaagatcagccatcctcgcgcacaccctcatctccttaattattcgtaggttatacatgaagctttaaggcttgctaacattgctccagtgatgtttagaaaagccacagaggatgttcatataaaaggtaaaaaaaccattattattattaacaagaacttgtacaagagatacataacagaagtatgcatagagtaccaatttgcaaaaaaaaaaccattttataatatcttcttctgaaatatgtttgtctaatatgtgcaggtttttttatcccaaaaggatctaaaattatgatttgtccttccacggttcacctaaaccctatgatttataaggatccaaatatattcaatccttggagatggaaggtttgtaaaattcataacgtatgttctatcatgtttcataactaaccatgcatctatatatacactaaaatttatatgtaattttttctgtagcttgtactgtccgtttaaaaatatagggcgtatgtatttttaccacaaatttcttacactatttttcttacatttacaatgtcagtcataagaaagtacgtttgaacatcaatccataaatatcatttttatggcaatacctagatattattgaattagttggtcaatactcaaaattgaacagtcaagtgagtagtgtatatatgtatgtattttttttctatgtcatatagtaaaaaaaacaatattgagaaatctggagtgacttgtatagcattatgccatctataagttctcatttgtaatatgcatactgctctgtacaggatactgctgaaccaaccggtggtgcctccaaggatttcatggcctttggagggggactgcgcttgtgtgttggtgcagatttcgctaagctgcagacggcgatcttcctccactgcttagtcaccaagtataggtaaacctacttgtactcatctacggtacctcagtattgagatatacttttgtaaagatttacttagttcaaaatccatcagagaacttcgatcgagatcatttaaatttcatcggtattaaaagatgtactgttttgaaaaaacaaattctgttatacaagtaatgaatacattaaagattgacatctatagttgtttttctactatgtttaactctgttaaaaaatgatctttggtttatgctttgcagatggaaagcgatcaagggaggaacaatggtgcttggtccaggactacgattccctgaaggttttcacatccaacttttcccaaaaccttgaagtaccggggccagatacttctagcccctacacaatatatgtagctcagaagcaacgtttgagatctatattgttgatgattggtacttcgatgtaatttccattaattttctgctgttcccattagttcactgctgaatgagctatgcttattcttcactttgccataaatgttgtgtgatgtccaaatatcacaaataaatgtagatatgtttgagtnnnnnnnnnnnnnnnnnnnnnnnnnnnnnnnnnnnnnnnnnnnnnnnnnnnnnagctaagtgtctatatccn

SEQ ID NO: 34465 - DNA, 1886 bp, Oryza sativa
  unsure (1)..(1886): unsure at all n locations
natctgtatccgtaaaaaaatatatgtatccagactatccggttctgtatccgtattcttttttctccgggcaggcggacggttttcgtgtcccgaatacactttgttttcatccctaggaccataggacgaggagtacgtatgtcagccaggtggagccacgttaagggttttttctatagacctaatggtggtaaaaaacgggtccaccaaatttagggtatgtttggttagagggatatctctatatgggagatagtgattcagctttcgtgtgtgtttagctagtagtcaaaggtggatagtatggcctgaagatgaaatattcccctgaaatattggatgagcgtattcggccaaattggccagataagaatatccaccttttctaatctcgatcattagtactccgtaattgattagcaatatttaatttttaattagtaaccaaattatcaaaattagtattgattagatataattattctattttattggtaattagtataaattatgcttatttaagggtaattaacatatatacgctgcagtccaacagcactcatgggcccggaatgctgaaacccaatttgctcatggttaccatgttgacatgctacatgagtagttaagagacactactttagaggaaaaaaaatagtagcaaacgtagaaagggaatttggataatgctaaacctattagtggtaaatagttaaatttccccatctaatcggcaaccaacactaatccagtgcacgtcataccatacgaagacgaaggtacgtatgtccatacttgcttgattttctttagtgtctccctatttttttcctgtgcaaatgtccatgacaatgtcatgcttgtattttttttaatatggatttaatctataattttgcttttgcaaaacatgccaatattttcaatctacaagttccagtaatggtgctgagacccaacaaattaaggttgcccagaccccaacaggtcttaggcacatccactcggggaaaggcccaatcccaatctccctgcatctgcccggaccccaacaggtcttagtcacatccactcggagaaaggcccaatcccaatctccctacatctgccaacagtttttaggcacacccactcggggaaaagcccaatctccctacatctccccactcggggaaaggcccaatctccactcatagcctacatcttcccactttagaaaaggcccaatctccactcataggagaagggtggcttactcctcccaagctaatcaaggtgaccctaacaaattaaggttgtgcggaccccaacagttcttaagcacacccacttggggaaaggcccaatctctctaaaagactagtccaataggggaagtgtggctctcccttttaaggtggattcctcctcccaagctaagtaaagtgagattattcagaggctcatatggtcgctgcccgactacaactgaaccacttggtcctttgttgcgtctttaccagcgggtaatagtggaggatattctcataagaagatcacagggtgaattatcttaagcttagacacattaaaagttcatttttgagcgctgatgtacacgtactatataaaatcgattttgctatatctcactcgaaagatttttttcttatctctcactcgattttctcactcaaatttacagtgtattttcttgtaagttacagtgtaatttataaatcttacattgtaacttttgtaagttacagtgtaaattttgaatcttcgcatgtaagttttaaaatttatattggcttgggatttttattgaaaatatgggagttagtggccattatggtgtttcttaatgtcttttgcgttatgggatttaatccaaaaataaa

SEQ ID NO: 34466 - DNA, 1091 bp, Oryza sativa
  unsure (1)..(1091): unsure at all n locations
aggcttgtnngnattgatgnccnccttgaannncactggatatccngctnnnnnnnnnnnnnnnnnnnnnnnnnnnnnnnnnnnnnnnnnnaaatagagggacacaaagtgaacgtattccaatccatttcatccttaaggcttcctttgcattagtggatttctggaggaattttagaatacttcctatcctttggattaaaaaaaaccacaagaaaatcagagaaaactttcctttgctgtcgttttcgcaggaaaaaggaagaaaaataatctatccgctccgagctattttttttcccttcagataagatcgagaagatcaatcactaaaagccagtttaataatatagctaattactatctctaaaaaactcaaatctattaccaatccaatagttaacttatacaatatctagttatagatatatagtgcattgttaatacctaatatacttatctttctcacgtactttcttcgtaaaaaaataaacatcgaataatgatatatcctagtatagcgaatctagacaaactcttaggatttgtgggatagatagagtattttattagagcttatactgtagctatatataaatctatagtctccttttctctcctctcctttccatataagtacaaatgatatggcaacttgtataacctgtttccattatcttattgcacttagcatcagtagcaggaacaagaggaagaagcagagcacaagtgcacaacagcgcaccggcgatccaacatttgcttgtgcagcagcttagttctccccgccgtcatctagcgttacgacctcctcccgcagaagcacgccctgtgcatacaagttttccggtggcccagccccctcgagcactccgcagccaagagtcaagagtagagatgaaaatgcatcgaatacggtcggaaaatagctatatcatattcgttttcatattttttttctcggaatcgaaatcggaatcggaaataaggatacgaaaacggaatcgaatactatcgaatacagatacggagcgaatacagtaacgaaatattatcaaaatatcaagatcccttgaaataagctttttaan

SEQ ID NO: 34467 - DNA, 859 bp, Oryza sativa
  unsure (1)..(859): unsure at all n locations
gcatgcgcnntttgaattttgatatgcgccttgctccctgcatcctagaatgaggaattcggtatcccctcatataaacaaaaatatgttttgcgtgaagaaaaaatagtatcacgatttgtttcgaaaaacctctaggttttggggcaaaattaatgtttcaagctgaaaccccatgtttaaacttatacatttatttttttcgtatatttatgcataataattgcagcaaaataataagaggtatttctaagtaaatatatacatgttagccttatttaacgagcatcaatatgattgtttatatatatacgtataagtaactgattaatgtgtaactattagtagtcagattgtgtcgtggtttctcaatcgtgcaatgtaagagtaggaagaaataaagtatatacgagtgatatatattttgagtctagtaatgtgaatatatactaaaaatgttgtataaaataatgaaattatgatatttaatgtaaacatgggatttctagaaacattttacctcataccctagggtttctcgaaacaaatcataatacatgcactactggagaagtgatctttgttgggtcggatgatttccacaatagttagaaccgggactaaagattgtttttagtctcggttaaaaaaattttgatctttagtcccggttggtgtttccaacccggactaccgttcatccaatatcagaggcatgtcagggggccgaggatctttattcccggttgatactaccactttagtcccggttggtagtaacaaccgggactaaaaataaaaatctnnnnnnnnnnnnnnnnnnnnnnnnnnagctgcgagcaggcgtcatcatggggcg

SEQ ID NO: 34468 - DNA, 882 bp, Oryza sativa
  unsure (1)..(882): unsure at all n locations
ccacttgaaaaagggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaagaagaagtacaaccagctgctcctaccatcccagtaagtcttgtctataaaaaacttgaatcgaccaaataactcatgttgagactcaatctttaaaattccttcttgcaggccttagcccatctgttctctttcgatattaaagattatcttgatgaagaaacagaagaagacactactagcaagtctttagctcccttgtccgataatgtgaagaaaacccttgaagacatctctcatcggctagaggcatcatcattagacagcttagtggtaaattgtgggccaattaggactcggttacatgaggttcaagccctaatcccagatgaactagccgatgtcctcactccggctgtctaccttgagcagcatcaggagaaagccaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 34469 - DNA, 1301 bp, Oryza sativa
  unsure (1)..(1301): unsure at all n locations
cgcgtgcnttttgaatcnnnnnnnnnnnnnnnnnnnnnnnnnnnnnnnnnnnnnnnnnnnnaatcctacctggattttttttttttgggatggagggagtattgatttacctgttagtatgttggtagcttggaaacctaagttctataattatgctcaaatgtgtgtaatgcctaatcagcttaagatggtcatgtattcatcttgaacttctatcggcagtgaggcagtctgagtgatgggaaggaatcaactagtaaatctttttcttatagtgcaccattctaaacttgaaatggttttgtgttaccatacttagcacttatccactgttgattaagataaagttttctggcatcaccaattgctaatttgagtcaggtttaacatatcctcactcacctatgcatgtgtagggacataataaatacatggtttgtcacagagacaggacctaagttaaacaacacctgaatgctcagggtccataatggcataatgtagcttacattttatttacatagtaaatggattactaaatttcacttttcgggtcaatgcaacaggtcttgaggaagttggtggacgatgcatctaagtttttgaatgacaaaattaccaaagcagtggttactgttcctgcatacttcaatgactcacagaggacagcaacaaaagatgctggacgtattgcaggattggaagttctccgcattataaatgagccgactgctgcatcccttgcttatggttttgagaagaaaaacaacgaaacgattcttgtgtttgacttgggaggcggtacctttgatgtctctggtatgttatgtgctagaacaccaaactgtttacttttcttgcactattactgtagcatagggatctcgtggacctgaatcttatcatacttctatgacagaccttttttcctagatggatcgtactggaaaatagatgatgaattgatttgatcaaatggaatgtgaaatgctgttgctgtttcatatctgtgaaatcttttaccaaggttcacaactgtttagccagaaacatgagttctttatatggttcctccagaacttaatatattgtcttttatgaaggttcagaactatttagccacaagcatgagttctactttatatggtccctcctgaattaaacatatcgttactaaatatttgagttgagtagctccttgttctatcatcatacatatagaggctgccctcgagttttttaaatagatcaatatttagttaaaaagggacttntgaagagagatactcaaagcagatttt

SEQ ID NO: 34470 - DNA, 2490 bp, Oryza sativa
  unsure (1)..(2490): unsure at all n locations
gcgggattgatatacnnnnnnnnnnnnnnnnnnnnnnnnnnnnnnnnnnnnnnnnnnnnnnnnnnnnnnnnnnnnnctactaaagaaacattatcctgcagtattggaggttggagatggtgtgtttgaggtgctttccacatctggtgacacacaccttggtggcgatgacttcgataaggtatgtaattccatttttatttttaagagattaactactgccgaatctccattttggaatttcgtgaaaatacatcgcaactgttcgaactgttttctatggaatgttgcactatgcatttttgacaaatattatatgatgtggtgcctcttatgtgtattacattattctttctttggtaaactcacaatatcagtcaaccaaaatttctcaataggttgctcgttctatataattatgttattgcagttttatttctgttgggtattttactttggagccatgactcatgaaactcctgtaagtatgagctctgtgtgttttgtgctggaatctgacctcttcaagccttccatatattctttatgtaatgcccatgacctaaaaatatgtaatttgaacttttgaaagtcaacttaggcttcgttcgttcccgggtgatctgggagattgagagagaaaacatctcgttttccgcgcgcacgcttcccaaactattaaatggtgcgttttttgcaaaaaaaattccataagaaagttgctttaaaaaatcatattaatccatttttaaaatttaaaatagttaatactcaactaatcatacgctaatggctcacctcgttttgtgtatctttccaatcttcccaatctcctcaatccccttctcctcaaacacacccttagcatatcaaaggtctattggcattgtagtgtagctccatggacaacatacctatcagttgaactgattcttttactgacagtatgctatatttattgtttttttttaatttgaatgttatccttgaattatgtagaaagttgtggattggcttgctagcaactttaagaaagatgaaggcattgatcttctgaaagacaaacaagccctgcagcgactcactgaggcagcagagaaagcgaagatggaactgtctacgctgtctcagacaaacattaggtgagcttctttccaattgttctcacagagtattctattgctcatttggtgatttttcttcttaaataattgaatgtcttgaattgcagcttgcctttcataactgctactgctgatgggcctaaacacatcgagacaactctctccagagccaaatttgaggagctatgttcggacctcattgataggtaaaatatggacattctgctgatatataagcctattgcttaggaaaatgatttgcattttctcaaatttttttaaggcttgactaatatgtttcttattgataggcttaaaactcctgtcactaatgccttgagagatgccaaactgtctgttgataacttgacgaaagtgattcttgttggtggatccactcgtatcctttccgtccaagagcttgtgaagaagatcactggcaaggatcccaatgtcacagtcaaccctgatgaggttgtttctcttggggcagctgtacaggtcactttcttgtcctcacaagtgctttaatttgttgttctttgcagaaaatcatccataaaccttctaattacttcactgatcttaagtgcatgtttcctgcattatagtggatcacaaatcaatttatatgtatttaaaactaactgcccaaagcgtgttttaacactgccaagactgcatttatcttgttccgaatctgaaatctcaaatcaatatattttgtgtttcccttgtaacaccagggtggagttttggccggagatgtgaaagatgtcgttcttcttgatgttactccattgtctcttggtctggagacgttgggtggagtgatgaccaagattattcccagaaacacaacactgcccacctcaaaatcagaggtattctccacagctgcagatggacagacaagtgttgagataaatgttcttcagggagagagagagtttgtccgggacaacaagtctcttggaagcttccgcttggatggaatccctcctgcaccacgtggtgttccacaaattgaagtcaagtttgatattgatgccaatggtattctctctgttgctgctattgataagggtactgggaagaaacaggatatcaccatcaccggcgctagtacactgccaaaggatgaggtatgttcccaccttatttgcttaagcattgtgtgattacattcatcaaaagttggttgccagcttgctatattgcaactaggtacaaagttggcaagtttcttcttaacgtatgatagttttctgcatggttatctagttgtagattttcttttccaccatatgttgtgcagcttctttctttgattcccaatcccgttatttgctactggtgtgaaatt

SEQ ID NO: 34471 - DNA, 2516 bp, Oryza sativa
  unsure (1)..(2516): unsure at all n locations
cggttannaacgttgagcgctccnnnnnnnnnnnnnnnnnnnnnnnnnnnnnnnnnnnnnnntgtggtctaccagactgagaagcaactgaaggagctaggtgacaaggtacctgcacctgtgaaagagaaggtggatgcaaagctcaacgagctcaaagaggccattgcgggtggatcaacacagagcatgaaggatgccatggctgctttaaacgaggaagttatgcagatcggccaggccatgtacaaccagcagcctaatgctggtgctgctggacctactcctggtgccgatgctggaccgacaagctcaggcggtaagggaccgaatgatggagatgttattgatgcggatttcactgacagcaattgatagttctagcgattgaagattattgatggaaggatgatctgtggtggatggctgtgagggtctgatgggtgatggtataggaagaagggagtgaacaaattgttctttttgtttactatggatcccatgttcaataggctctttagtttgcaatttgatagcgtagggttttgccaacattttcctgtgatgttgaatgaaggattataaaaagtagccttcaaaaaaagaggaggcaaaggttttgatcgaagaagtagctgattgatatgaccttgttccttgaaaataaaaatatcattagttccctgtgcattttacctgctagaaactaaaattagcgcgtggaacatattgtccttttttattttgtgtgacttcctgcatttcaaatagaatgagaaaggttggaaatgatatcattttttattatttttacgctgttgggaatttaactatgcagtgacgaccgactgatagaaattgaaaaaaaaaactaaattttatactccctttatttacaagtgatcatcatatatatttttttggggattcctttttcagaaatgattagcatatttggtacctctcccaacatctttttgttctttgatgcactgatcaaatggactgcagatcatttttttcctttttggtgttggtgtaaacatctaatataactgatcaattctaaattgagggagtatgtgactagaaacaaaaaacaaaaatggttggaaatattatttttatgaaaacgatattggtatggtacagaaattttcgcagcgttttcatcgcaactttcaaaaggataactcaagttaatgtcacataagcacatttcgtccagttcgtctgtagaggtgtttttgggtttgatttttcagtagttttgacaagaaaaacaactatgcctgaagatcccggtttaatgaagaatttaattaatgattgcacgattgcgtttatgcagaaataacaaacatggtcacggataccaaacagttaaaaacattggaatgaacgtgaatgatgagaaaacagatacaggaaacgtacaactaatgatctaacaatatattatgctatctaaacttcgtcagttccacagctctgcatcgagtatcagcctttggatccctggtgctgccgaaggaacatagaagacgatactttctccgtttcacaatgtaagtcattttagcatttcccacattcattttaatattaatgaacacagaagacgatactttctccgttaaacaatgtaagtcattctagcatttcccacattcactttgatgttaatgaacacagaagatgatacttcctccgtttcacaatgttaataaatctagatagatatatatgtctacattcattaacatcaaagtgaatgtggaaaatgctagaataacttacattgtgaaacagaggaagtaatttgctaaagcattttgccagaaaacaaaaattaggaagcatctcttaaatattctaatgttccaggtcactacattattacagtgcacagcttagcatatttcaacagtaaatcatgtagtgaaaaacagatgatggaacctccagagagtatccagatcagttctttgcagtgagggcattctgctccttgatccgagctcggttcaccagcttgacgaaccgtttcaggtcttcataggggagcgtcttggcatctttcctccgcagctcactcagcatagggcgcttgtcgagcaggtgccacagccactcagggtattcagaatctggctggagtttcggatcagacccctccttgaggatatttgccccaaacactgttgtactcttaagttctttgctgagcacaggggttttagcagcatcggccgcaccctttccgcccttctttgccttgcttgcaattgcaaatcctcttatgccaactacttgagctgcatctcttgggattacaccatgtttcagtactcttctcaatgccattgccattcctggatggaagcttttaactgcatatatcggtaaatatcagtgctgttgaaaaagtttctgcaagcaaataatatnnnnnnnnnnnnnnnnnnnnnnnnnnnnnnnnnnnnnnnnnnagcacgatgctctcatcccgcgcg

SEQ ID NO: 34472 - DNA, 1420 bp, Oryza sativa
  unsure (1)..(1420): unsure at all n locations
acggcnattgtagattgacttacnnnnnnnnnnnnnnnnnnnnnnnnnnnnnnnnnnnnnnnnnnnnnnnnnnnnnnnnnnnnnnncagtatacctagtgcaagaacaaccaagactaacccatgcaagctgagagttggaacctaaaatgatcatacatttatgaacgaactgtcatcaccaataatattttccctacgagcatcacaatatgcaacctggtgaacagagaggggtgtagtaactaagaaggttggcatgctcctatacaattttgttcatacaaaacatgttcgcctctcttcctttcactttgatgtagatagtggagagcacaatgcttcacaaaagatggggctcacgttccataattttggctcacatagcacttgtgctagaaccacaaaaaagagtaattaacaagggatctccatgtaccatgcactataaataagaagttaaagatgttcacagggcagtgaagataaatgtccagctaacgaagcactctacgcatcacaaaattcagttcagttgtaaagaaagaaaaaaatccacatggaatcaggggcggatccaacttgggacatgggggttcagtcaaacttttgggtgaacaaacaaaaaaacaaacaaactgttactagctagttgtattaagagaggtttaaggctctcaaattaacaaggaggaggagaagagcttctttcagatctagaagagaagctagtagggttaacgaacgcaagcgaattcaaggtcccagtggggtgggggagagagatgaatcagaaagaggctcaccaggatcccctcccctactctcctcgccagatggagatcggcagccgcgactcgtcttggcggcggcgcaaggagcggaggaagagccaacgagacgggagatttctctcttttacgcgatatactcgactactgcccaaatgggccgcccggcccggcagcgcccaagcacgaccggacctaaggcccagtcaaggccccttctctttggacagtgccttataaggctgcactaagtctattttgggtccccaactatttttctttgacttatataaggctgaattgagtctatttaggctggattttccggattgaaactacaaagcggtatttttgtttgaagctatgggatcaaagtccagtgtcctcgatgcaaactttgtctgatgaattgacaacaattaatcagataatacagttgcatatgaaaattactagttatgtatgtgcgcagataaagagatacaaaaccacacatcaagtgtttattctatccatatactgtcaggtttatattggctgtgtgtgacggggcaaatatcgatcggttgtgtgtggcggggcgacttatgactacaaaggtggagatattagggatggggggagagaaaa

SEQ ID NO: 34473 - DNA, 1878 bp, Oryza sativa
  unsure (1)..(1878): unsure at all n locations
naaagaacgagtgatgagtgaaaccacttgctacactatatggggaatagatagaggtagagaaatgggagaggtttatcctctctttctcaaaaaaaaaaagaaaagaaaagaaaggacccaaccgtgatcaaccactgcctcgattcccttggtcctccgagaatctcgccggcgatggctgggagttggttactgcgccgcgttctcccaccccagctggttatttatagtgcggcggcactcctccattctcctccattccctaatttgtataatggttctctttgcaaaaaatgtgctggtgaccaaactaataggagaatggttagggagtctaagattcaggaggtctcttgtggataggaaacatttggaatgggttaaacttaatcaactttgtcagtcaattgaactgactggggaggaggataaagtggtttggaaactgactaaaaatggcattttcactgttaaatatttctataaagcaatgatgattcaaaacactggctttcaattcaagaatatttgaaatttaaaatttctcctagagagaaggttttcctgtggctgatgttgaaaaattgcattttaaccaaagataacttgctgaaaaggggatgaaaagggaaggaggcaaaaaaatgaaactgtggagcatctttttaaaatgcccaatttcaagactcatttaaaacatagtgagttgtgtgtttgatttgaaaccaatccataatatacatcacttgtttgggaggtggctttaggattttcaaaaaaaaaaaaaagataaaaactttgtggtggtgggaattgcaggcagctattgtttggactatatggaagttcagaaatgctgcatgtttcaaaaaataaaagaacacaagatcctttagagctgatatatgctgtttgctcctggatcaatctttggtccattttgcagaaatcgggggacacacaagacaggcttcaacgggacgcggctttgttaaagacggtggtcactgacttctacaacacaagatttggatagaatccatatgtgatgcggatacaggggataggatgaagatttatgccttctagtggctgcagtttctgttttttttttctctgctgaatcttgttcccttttgctgtaagactgttaaagactttgtattcttatttcgttaatgaaatgggagaggtctatcctctctttctaaaaaaaagcccaaccgtggtcaaccaccgctgcgattcaaaaatttcaactcaaattttaaaattcaaaactttcaactcagaattcaaaaactttgaaatcaaattcaaaaattttcaagtcaaaatttgaaaccttcatatgaaaatccaaaacttttaacccaataattattcattttttattaaaaggctaaatgataagattagagaagggattagacgacctaagcatatacaggagtatcgctaagcgctaggattagtgcgcgcagctagcttaccgttgtggcgcgtgcgcgcgcactggcagcccccgaggtttatcctttttttaaaaaaaagacaaaaaaagagggaaaaacaaccgtggtcaaccaaccaccgccgctattccctggcgcaccgggaatctcgccggcgatggccggtagtttgttacggcgcctcactggctatttatagactacagtgcggcggcagtggcactgatcccattctgcgtcgagctgcctagctatcgatcttcgtacgtaaatacgtctccctcgtctccggcgagccaccggccgtgagagatggcgccgccgtcagccatgaacacgtcgagggcggaggagaaggccatcgacgactggttccccatcacctcctcccgcaacgcca

SEQ ID NO: 34474 - DNA, 7554 bp, Oryza sativa
  unsure (1)..(7554): unsure at all n locations
gattactcgctgacggaggcgacgccggcggggaggacgttcaacttcctgagcgcgctgggggacgtggcgttcgcgtacgcggggcacaacgtggtgctggagatccaggcgacgatcccgtcgacggcggagcggccgtccaaggggccgatgtggcgcggcgtcgtgctggcgtacggcgtggtggccgtatgctacctccccgtggcgttcgcgggttactacgtgttcggcaacgccgtcgacgacaacgtgctcatcacgctggagcggcccgcgtggctcatcgccgccgccaacatgttcgtcgtcgtgcacgtcgtcggcagctaccagatctacgccatgccggtgttcgacatgctcgagaccttcctcgtcaagaagctccgcttcaaacccggcatgcctctccgcctcatcgcccgatcactctacgtctgtaagtgtgctagcatgcactaacacacacacacacacacacttgattagtgatccaattaattaattaattaccccctccaaaacgggagaatttaccttttgccatcctctcaaaataccagttctcaaatgccactctcctaaaatttcatttccaaataccacctgggtccacatgtcagcctcttttcccattcaaataaaagtgacgtgggactggatggtgtgtgaggctgatatgtgggcccgggtggcatttggaaatgaaattttgagagagtggcatttgaggactgacattttgagaggatggtaaaaagtaaattatcccctccaaaagtattttctattataatacatagaaatattaataaatatatgattttattgaagtacttttttaaaactaatttacacatacggttttcatatttttaagataaatattttagaaattattaactaatttaattaataattactctctctgtcctcaattataaggcctatattttttttacacggtttttaataacatactttaactagtatcttttccatttcatgatccaaacaaatataaaattagcatcacataaaagtactttaaaatataaatctattttgaaatataaatctattttgaatttactgatataacatgcataaaatttactgatataacatgcataatatttagtatagatatagttagtataattattaataaaactactaagtttgatttttcttaaaaatagagtgtcctataatttaggaccgagcgagtagttgtcaattagtctatcatatgttgttaattaggatctaataaatcttaatttgtactaattttggagtattgaatttcgcagtgttcaccatgttcgttgccatcgcggtccctttctttggtggactgctaggcttctttggtggctttgcgtttgctccaacgacctacttcgtaataatctctaccattaatttctttattattagaaccttcattaaaaatgtatataatttaaaatctctcgtgcgtattaatctccgttttttctaactgaaatatgaacaattgttttttcagttgccatgcattatgtggctgtcgatcatgaagccaaagaggtttggcttgtcctggtgcatcaactgggtaagtagtattatccattaattatttagcatgtgcatggtcaattaactaacttgataattatcctcatctgattgttaattatatatcttgttaattttaattctttatatatttttggtgcctcagttctgcatcatcatcggcgttcttctgtcggtgttcgcaccaatcggaggtctccgctcgatcatcgtgaatgcccagagttacaagttcttctcttgagtgattaattgagagaaaaggtgttttaccgttcaattaagtgtgttcttaattaattaggggattgttttagataatgcacagagttctatttaattaattagatgaaagagaaattcgtgtgtccctatgagacatctgtgtggattgatatagtagtcgatcaaatgaaggcatattatttatttggcctttgtttgtcgatctagtactctagcgttaatttaattcgtgtcgagtttatcccaatttttgatgatgtttgtgctctattatcacgtggtgtggcattcgttttaagggtttatgattggttcaaacttcgtcctagtttttacacgatttgaacttgaaatcaattactttcaattcgactcttgcgcgagtctcactaaaaaaagttatcgagtaagaatatcgagtaagaaaaaaaaggatgttgctgtaccacgggaaagcatggcagatggcgagaaccaggtacatgaacaattaaccaaaacatcataaacatcatatgtacaaatcagcacaaagaaacttcagccacgctacaagcagttcgctgggaggaggtaaagtctcttgtacactcaagtaatatattgcagtaggagcctctccaactgtttttccgtcaaaaaaaaaacctgaggagagccgacgctgaaacaaaatttgacccaacctcacacctctgggaggagagtgccgatgctgaaacagaatttgacaaggtttaagagatcacacgatttcaaactgaggttgacgataattgcgccccattcctttggtagggtactttgccatatcagatatccattgcctcggaggccgatgaagcattcttcttcttgttctttcttttcttgtccttagggtccttcccctgcttggcggaattgctctcctttctcgcagagggtggctgtgttgacaacaggtgctgatggatcgccgcaaacgggtcgagctggaactgcggattggtcagcacagcattcagttgggcagcctcccgttgcctgaaaggagagacaaagccagtcaaaaaccataagtggaaagaaagcanagaacgcaagtggaggggcagatgaggcaattacactaaagcctgcttcgatttgcagtccagttttgcttcggtgtgcagatttgaggcatctgtttcaggaaggaactcagagagcattgagagatcatatgctttcagtttcttctggcggctcctctgtttagatttctgcacaaagaaatttaaataatcacaacccataacactgatagtgcaaagtaaagcaagtgtaacttccagaaaactacaaatggagtagcccagctgcaataaaaagaatcagttgtaaggaaggacagtgtggagagattaaaggccaagaacagaacggagagactaaaggtctcatttcagcatctacaagtatatttactctaaaatatagatgcattaacatatgaaatgaacagaattaatgttcgcagtttgtgtctagaatatatgaaaccacaagattgtaactatatgttgggaaattcatgagtcaagagccaactggtcttggcatttgtttttccatatggagttaggcacgtatgggtttcctaggatcctagtcatcccatcacagtaggagggaatacaggagacagtggatcatcagtgcaagtacaaaaagcatattagggttccaagcaggtcccaagtacaaaatccattctcatatctgtttatggatatggtgtggttattttgctagtcttcacatgtagacaagcatttggatgacaatataatactttcttacgcagataatttttagcataccacaaatacacaggacaagagactaaacatagctagcgattgagaaaatcagacttacaaatatatacttgaccaatacatacaatttggaatttatccttgaaatatctaagcattggttgcgttatacgcccacgccactcatggagcaaaacaataacagtaaaaacaagctgcaacaacagaagctacagaaaatattcaattgcaaccaaaggtgaaaagccatacacccatagaatctgctgaagtctgattcaagctagaggcatgtagatattttttgccagggcatggcttgtttctgtttatactttacagctgtcatgtgaacaagaaacagctggtctagttcacgtatggtggacaccaacacccctagtttggatttgttcagcaggtttattagatgaacgctccataatattttttggttcaattagtgaacaaataaggccataaggaggacaatatgcttaatattattgcatagtgtaattgattccccttagctaggtgttggctgtgttgagaaggattcaaaggttatggtcatcaaggccatgttaaaaacagagaatagctcctgatttctttgctaaactttttgtggcttgtgctagtgatgcattacattataccagggttacaaacatgacaaaaaccagtgagtagtaaccagtgcttggttttcttgcaatagccatacccgctatagtgaactggaacctagacaagcaatttttcgtctcgtgctattagaggaactttttgttcaaataagttttgccagaaagtgcctggttctgctcagtactggatgggttggatgtgcagagcacattccttaagaggtaaattccacctagcaagagactagctgaagagtgcacccacactatttaaaaacccagtcttgcagaaattatttactattagtatccgggaggtcctatttctttcttagctacaacctacaaatgccacacagaggttaattggggaactgtgcacagtaatcagtcatgaagcatagatatttcagttctgagtgtaacctaaaaaatatgggattacgaattgagatctagcatgcaaaactggtgtattaagtcaatagaaacagaaacgacaggacatgatactaggtagttcgaattgtcaaaaatccattttttgggcaagatagtattcaatgtttgtgtacgaggaacacacaaatttgcaatgctgaagagaattaaagaacactataataataaacgagagggtctataagcaccttgcagatagtctttgtagcatttagggaggttactgcatctttcacttctgagaaacaaaaacaaaaataaatcaattatactataaaccacagtaaacaaaaaaacatgctattccgcaaaatatagtcaacgactcaaggtagacaagaaaaaggtaggaaaatgaaacagagtccagctagcagtaagcccaatcataaatcgtaatctatcaatgtttcgactttcgagtgcagtaccacaaactaagctactatctactttacaatatacatgttctgtaaacacaagtaatctacaaaataaaaggtatactaaaaaggctacaactatttatagaaaacaaaagaggttttattatcacaaaacactaaaaacaacaagcatggaacatgaacgaagaagtatttttattcatggataagatatttccaagctttcactattcaagaaaaaaaaaagcattgccccttttacagacatattaattttcttggaataaactaataattagttgtccttctttacaaaaatgaataacaagcatttcagaatagcagtgaagtaaaacataacaagccaataccaccatcctctggtcttttgaatcaatctctatacattaatcaacatttgccttatacactccctccatccaaaatataaggcctatcagtttttttacatgttctccaacattgtattttggaaattaaattatcttacaacatattatcagcaattacaaaggtaccgttgtatacgaaataccacatgcatgacattaaacatatacattgttagttcaattactagccaaagattgcaaatgttgatttttcctggaataagggagtacagccaaaaaataatggaaaggcacacctacttgtgtagaagctgagcttcttctcaagcttctgtttggacttcagttcatgcttcttaggtgacccagtcctgaaagcaggggcggatccaacttgggacatggtggttcagttgaacccccaaactattcggtgaacaaacaaacaaacaaacaaaatgttactagctagttgtattaagagaggtttaaggctctcaaattaataaggaggaggagaagagcttcttccagatctagaagagaagctagtagggttaacgaacgcaagcaaattccaggtcccggtgagagatgaatcggaaagagggctcaccaggatcccctcccctcccctccccttctctgctcgccagatggagatcggcgcgccctgccctgtgtgttggcggcggcgcaaaggagcggaggaggagacaacgagagagagagacggcagatttctcttttcttttacgcgatacgagacgccagggcccaggcacgacccgaggtcagtcgggccggctgtgccgtgcccacgggctgcatccacggcccagtctaggcacaataagactcgggctatgccagccgatccaaaggcacgatagtccatcgtgcttttctacaaaataagtctttttccgtctcttatctctttgggttgtgtcatatatgatggaataagtctatttatgtccttctctttggacagtgccttataaggcagaattaaccccaactatttttctttgaccatgccgtgctgggcagccccaccatgccaaggcattggcccaagcacggcccaattattgggccaagctggcacgagcccgacaataattgtgtcgttccatgcttggaccaggccaaatggtcgggctgtcgggcctcggccttatggccatctatagtctactccaactttatcttaatatttttactattttaaaactagttaatagtatttctttatgatgactggtgacccacatatcatcaaaaattaacaaacacagttagcgattgtgtcgacaacaaatttctcagaccactagcaaccactaactgatactccatgcaccgtcatcaccgctctttctcctgagccaccatcgttcctcctctttgcctttaccgtcatcaccgacatttctttttctcctccactatcgttatgcacactattgttatggttgcattgaggtcggggatgtcgggcgtgaagggactgggaggcaggagttgacctaacaaaaagcgaagacgctatatccgtgctccttcttgctatacctagcagttatcaaacggagggaaaaagaaaatggagagagagagatagtgtgcggagtgattgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngg

SEQ ID NO: 34475 - DNA, 2324 bp, Oryza sativa
  unsure (1)..(2324): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtatatatatatatttacatataaatttctaagtagaccacccttccctgatatatgcgtgatctatagtatcgtttattttaaaaaagaaaatacctagtcaatatgagttagaacattctagtttaacaattaaaaaataacttcttaaccaactgtaaagctaactttgtgtggcttatatatgcaataatatgcggaggaactcataatgtcatgaaagccagtaatatctaagcacttaaaagatgttatggccatgtaacatgcaatagttgttccaattttagtgaaaagtaggaaacaatgttccttttatatttcttgtttaattttatacaactcttattttaagttcaaaatataggtgttatggatctttaaattgttggtttaattatgaatagagcaattagattagaaaccagatgtgtggataaaaaattgtgtatgttttaatattattgattatttctccttttagtttgagagctataaaaatatcgaggaagggcagaggggaaagtgcgagccgaaggggactagtagtgttgtgtttgtgcgcatgtgaggaggagggcaaagttttctgtgtgtgtgttgggggggtggttctttttttataaatgatttaagtgaaaatcgatgatctattgttttgtttctaaaattttcaaatatttttttttctaattattaagatgtaacacctagcggcttaagattttcattaaaagtagatgtaatggttgaaaataatggatctacatatttaactcgaaacatgtggtcaactgtttttttcctataatttctaatattttatttttaaatttaagatgtaatatgtgacatatgtgatactgttagtgctctatagataatgtacgagatttaagatgatatagtaattattatcaattttttatttttctatttttttgtttggttgacacacgtaggtgtctacaaatgatgtactatttacagcgaaatatgggtaatatggatcttgaattatttatttatttataaataaaacaatagttcaaacgaacttgaaaaccagatataacttaaaagatagtcatttagttttctaattgctgtttgtttatgtattaagtttttaattagttaaaatttagaagaagaaagaattgaatgagaggggagaggagagagtataataagaatatttattttacaagtttaatgtgttttaattactatcgatttattgtatgaaaatagattaaatgctttattgattgattaagatgtatcttttttttcttttcataaatatatttatatgtatacactacaaatttaataatattattttgacttattataatgtcggattgagaggagtattttttgggaattaggttcatttagttttttcatcatatatatagtttaattactgttaagttatatacagtgataaaatctatatcactctttttttccataattttattattttttgaattggacacaaaggtcagaaaatataaccaaaagttacatattttattcatagttgaattatagtgaatgtgggcccttaaaagtaaaataatataaagaatgtagtccgtgcataggtaagatataaatcaggttcgacattgaaatcgaagcagattcggcaaagagatggattcgaagaacagagtatgcatcggctgcgaaggcatcggctggagtctgcatcagctgagatggatcggatagaaaacagccgatagaggtggtgcaaccgattccgacggtgatggcttcaaggatgtttctagaatcaatcaacgtgcttaacaaggattgccacgatggagataaagctcttagaaaggcaattctatctattaattaggatatcttacgtaaattccttagagatatgtttgggtaaaagtctaccgtaaaaacttatggtatcttagagtttgttaaagataagagtcgtgtccggcaaggacatattttgtatctcgggtataaatatgacccggacccatgtaatcaaacaacaacagttcaatacaatctcggcgcatcgccaccctttttactttcgttctatttcgatgagttcttacttttcggttgagctgcatcgattcgatcttcaactagagggtaacttgtcacttggcatggcnggattgcgttctcgggatagtggttccatttttattgaccctttaatcc

SEQ ID NO: 34476 - DNA, 9670 bp, Oryza sativa
  unsure (1)..(9670): unsure at all n locations
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttctatctttatgatactctaatcttgtttatgtaattcgtcgatttatcatatatctcacataatctctggcaatatcgctatctaatctataattggctaacatctgtcggtagaggtcagccgattagattagatatcgacgttgacttacattatataaggtatccaccactctatgaaacttccaacggcttgattgtctagatattgtccttcttttcatacttatagctgcatcagttgagtttgatcttatgagtcgtgattagaatctcaatctctagcctgcttattggtcgccgattagggtagaatcggggtttcagccgatcttatctgatttaactatatttgtatctcatatgcttgattgacatgctagatctgccctttatgctaagatcttatagcattaaagtatattaggcattttgttcgatatattctgcttgttttaatatcttaatatagagtggtatcggagtattagccgatacatgctagatctatctgatcggctatgctataaatgtctatataatcagtactttaatgtatatttcgacttaagtgatttatactgtctcggcatggcgaccgatctatcctaatcacttagtttaaatatacatcgaatgatcgattatatgtcgttaatatctatagccaattgagtagatttagttttactttatttatacacaactgccgatcgattccaatatgacatcggcatcggctcgaagataaatgatatgccatcggcaactagccgatcggctatcgtatatggatttaaccgtggttttcttgtctttctttcttgttgattacaggatcaaatcaactagcacgctcacgaacctaaaagcaagattttggacctgcactgaagttaagtagatcttctaggccagtgtgtgtttttcacatcaacagttgtgaagtcatcccttctttcttccagctgcgcgcttttcaaactgttaaacggtatggtttttacaaaaaaatatatatatatatacaaaagttgctttagaaaatatattaatctatttttttaaaaaaagataatattaaattaatcatgtgctaatgagttgtttcattttgcgtgctagggagattagctcccaaccccatggaaggaacataggcggttcattttacttttagaactgtagatctaatttaattatcatgaagttacgttggatgataaaatctatattattattattattattattattattattattattattattattattattattattattattattattattattattattattattattattattattattattattattttcatattcttctaatggtttgaaatgcatgcaaaagtcagaaaatatagcccaaactaacgtatttcttttcaacttttaattatagtgaaatttggtcttcaaccgtgaatttggtcataaacaatctaaagacatccatggattaaaaaaacaattatatgatttagatgtcgtagttacttgattttttaacaaataaagtatgaaaataggataaagaattaatggaaaatagaacagggaatcgaaggaagggagggagtaagtacataatgctcggtggggccgggtttaggagatgatttttaaaaaaaaaaattataatagttgtaaataatgggtccaccgaattgaatgaaaatcgacggttattttttaaagtgcaatgtgacggcttagaagcgtttataggatgccacgtgatgacttacgagcgtttgtagaaagtttaatggacttttagtatagatatatgatttttcaataaactacctcttattctaaactgctcatttcaattttattttattttcttattacacaacaaatgcacacgcaaactacatcactacacatagtcacatacttaggcaaatgtgcccctaacacatgcttaaaaagacataaacagaaatcagcagcatatctctgatcttattaaaaagacattagatttgaactctgatgggtaaaatcatgctgaccccccgagaaatccgaagtctgaaaaacagaaattccccaaaagatgaaacggaaagaaggcacgtgaatccatgttgaaaattttacttgcgtatgaaatactgaatggggaaatgcatgaatgggtgacagcaattcgatttctgtgtccacattagacacccagaggaaagcattatttttgtttaatttaaagtacttgacaacgaaattgttaagaaatatatatatatgatctcatccatccgatggaataggcattgcggttgccatgcctcccgttaccacaaccggcagagaagggaataaggctaccatgccccttctctccttcggcacttcttgacaactggcgcgatggttcgcgctcctgtggttctgaccgtatccccttgtataaattgaacgctacaattaatgagaatcaaacctcactcgcactttgtaccgcatgaaatcactccacttcaacagttcagtcaagagcagttcaatttccccgcaaaaaaagagcagttcaattctgcatgaatgtttgatctgttagagttcactttaggatcatctagctttagatctactcgggtagtcctcttgggtgtttgaacaaatatagagatggaaagagagggtttagagaccgaccagtaaaggtggaggaggaggaagtgccggccatcgtcgttgtcgtcgcgtgcttgtcgtggacggtggcgacggtgggcttgacggtgatggcggtcgtggcagcggcggtcgtaggcggcgatgacgaggcatggtgcagcggtgatgcttcccgtcactggctacgccccctcgatcggttagggttttgtgggtggagttggcggcggaaccgaacctcatatcatgtgccgccccggcctccaccctctatttatatggcgcaaggtgacgggggcccaccagtcaatgggctgggcgcccccgatcagggcgcgggtcaaggtccccttgtgtcgttgggctcaaggggagggagatctatctaatattctcccccttgatctcactatttcttttagcttttttctattccatcatagatttgcacatagagcatgtttcatcgtcacggttaatcactgttggatttgacagctactatacacatctctattcagaaacatatactttaacttttgggccctgtagtccaggattcataaggcttctcttaaacccatgccggctacatgttccttgaacacgttgggtggtaggcctttcgtgagcggatccgcgagcatcctttctattctaatgagctcgagactgattgtttgatcccggactttgtccttcacaacatagtactttatgtcaatgtgtttggcagcaccacttgactgattgttgtgagcgtacattactgcgggttcgttatcgcagtataactttagtggtttctcaatactgtcaaccacctttaaaccgggtatgaacttctttagccagttcacctgccccgtggcctcatagcatgctataaactcgacatacatagtagaccctccagtgatagtctgttttgagcttttccatgaaatagctcctcctgcaagggtgaacacgtatcccgatgttgactttgcattatcttttgcaaaatcagaatctgaataccccactatctggagcgattctgatcttctgtaggacaacatgaggccttttgtaccttgcaaataacgcaagactttctttactaatttccagtgctctgggcctggattactttgaaatctgccaagtaacccagtgacaaatgccaagtcagggcgtgtgcacacttgcgcatactgtaggcttcccacagctgacgcatatggctttattttcatttagttgaactcatactaattactgggacattgccatgccccatacttttcgcctttgactataggagtaggtgtagcactgcatctgtacatgttgaatttcttcaacaccttttctatatatgccttttgagaaagtcccaatgcatactttgttctatctcggtgaatctctatgcccaaaacatatgaagcctcaccgaggtctttcatgtcaaagtttgaggacaagaatttctttgtttcctgcagtagactgacatcactactagctagtagaatgatatcactactagccagtagaatgtcatctacatacagaattaggaaaatgaatttcccattcttaaactttgtataaatacaattgtcctcaatattctcttgaaacccaaatttctttattgtcccatcaaacttcaagtaccactgtctcgaagcttactttaatccataaatgcatctctttagacgacaccccatattatcgtttcctttcacgacaaaacctttcagttgtgccatgtatactttttcctccaaatctccatttagaaataccgtttttacatccatctaatgtaattccaaatcataatgtgccaccagtgccattattatcctgaaggaatctttacaagagactggagaaaatgtctcattgtaatcaatcccttctctttgcgtgaagccttttgccacaagtcgcgctttaaacttttcaatattccctctggagtcatatttggttttgtagacccatttacagcctaatgttttggctcctttaggaatctcttctaaatcccagacatcgtttagtttcattgatttcatttcatctttcatgtcttctaaccattcagatgagcgtgcgcttctcatggcctcttcatatgaggtgggatcatcctcaatatgtgactcttctatattataaacttcatagttatcacggatagccaatcttctgactctttcagaccttctaggggcctcctcatttggcacattctgtacctgagactcttgttgagcctcccgttctggcacattatctatttgaggctattgcagctcctcctctggtgtggcaataatttctgttgagtcctgtagaacaggttcctcattttcattcattgttgccacaggaggggtaacaacaggtgctggtaccgcaacgtcatgcattgcaggcacaacatcagcaggtagagagaagaaaggctcctaagtcgacgaagcgggtacagacacccgcctcttctcaagatcaatttctcgaactactgagctccccctaatcattttgtcttccaagaagacggcgtgtatcgtttagacagtagaaacgataaccctttgatctagaataaccaacataatgagattcatttacaaatgtaataatgttctcacctttctttgccatgatcattttcaggaagtcaggataatctttatagtagttccttttcttgcagtggagacactgatccttttcaactgtgaactgttgttgctgaggcagatgctgaggctgttttgcttttgaggagggtgtcttgtagttcttttccttgttatctttaacaaagttaatagagccaccattggactcttttgattcttttctcctcttgcacacaattagcgatgagcttttcaaaattccatttctttggacttattttgtagttgacaacaaagttgtcaaagtgctttggcaatgaggccataaccagatggatcagaaagtaatctaagatgcccaaatccattggcttcaacttggaagccatgttgctcatcctaagaatgtggtctcttacaccacctccatggtacctctctgtcacaagctgctttatcagctgtgtagcataaatctttgaagaaccagtaaactggctctttattattttgaggtactcaaagacggtgtcacactttgggattaagcccaatatagttggctcaattgtgttctttaccgcagccaaacatttcttgttggctaaggaccatttcgcatgctcaatgtcatacgacattatgaggggagcattgtccctctctctcttttgccagtcagcatctgactctttttcacctctgacaagtgcagcaggttctatcggatatggggtggtcaacacccagtccacctttcctaagataaaagcaaggtcgagtttttttttccattctgcgtagttatctcccttcaaggtcggaatatctttaatgcaacccataggagtagccacctgaaataatcatgtacagtgagaacaaaattaacattaaaatgttatgcattaaatctacatcaccgttaggcaaaaatagagataacacataaggccataactataacattgcaattaacaacgttggtcagaaaattacaacatcatagtacagaattaatgttcctaaaattaaattctcccgttggttcgaaatttaaatttagaaacactaatttttatcaatttcatctatttgcagcggaagatctatataaaattcatatgaacagtagcaaattatgttatttacactatgtaaaaattacacctttggttcaaaatttaaacagaggtaaggcatgcaaaatcgattaaaaaatctattgaaatttgcatgaaaatagacaaaataaaaagaaagtcgctaccgttccttttcttcattttggcccatcaaagaagtcggcccatcgccgggcgtgtgcgggcgcccccctccccccaggccgcaacctgggcctgggcctgaaagccgccgncgcgcgcctcccatcttgggctcaatttggcctggctgacgccggccatccaatcgctagggtttcgatcggatggccaggcggagagatcgggcggtaaaataaacccgacccccagccgccggccaaaaaccctagcctctcttttctctctcgcgcacgaccgcgcgacgcgaaggtcgccgccgccggcgaccttcgcgtcgccgcgccttgcaccgccggcgtccgggcagcgcctcgccccgccgccatcttttctctttcccctcaccatctctagccctccacccctctaccgagtgaagtgagagagagagacggccgaacgagatggcagcgccaccgggggccccctcgccggcacgtgcgtgcacccgctggtgcgcgcacggccgtcgaggggctccttgacgacgccctgtgccctcccccattccccctttgccggcgttgacgatggccagcgacgaagtaaggatttagggttaggttttttggtttcttttatttctttttctttggatttctttccccgaaccgatctaatcgctagggtttggctctgataccatcgttagagttcactttaggatcatcgagcttttgatctagtcgggtagtcctcttgggtgtttgaacaaatatagagatggaaagagagggtttaaagactgatgggtagagatggaggaggaggaagtgccggccatcgtcgttgtcatcgctcgcttgtcgtggacggcggcaacagtgggcttgacagcgatggtggtcgtggcagcggcggtcgtaggtgcgacgacgaggcgtggcgcggcggtaatgcttcccgtcactggctgcgccccctcgatcggttagggttttgtgggtggagttggcggcggcagcgaacctcgtatcatgtgccgtcccggcctccaccctctatttatatggcgcagggtgacgggggcccaccagccaatgggctgggcgcccccgatcaggacgcgggtcaaggtccccttgtgccgttgggctcaagaggagggagatctatctaacatgatctggctttctccaagacccaagccaaaaaccgattcaggctctttttccaagtcaaaccacataatctagttctgcttttatattcttttagcgtgcgttctacacatagcatcacaaattttatctaacatacatagtagtatagtactacttaaatagtcggagactcgcattagtaataataaatctctgaacttgctaaacttttatgaaaagcccaactactgatcacatgccagtaatattcataggcataacagtttttttttaattatgcataggaaggagaggaagaagaaaatagctagtactaattaagacgatgcagccgatagagaatcattgtgtataaaactagaaaaccgtagtgtttggtaacctactacgcgttcttctcatcccaccgatcgatcgcgcgagcttgctatgccgcaacatgcaccgtccgatcgaagtgtttcctgcatgcttcactgcgatccggccgtccacgagcacaatcaagcttgattaatttctgctggtttgtttgcggcaatgaggctgacgacgcgttaatcattttgggtgacgttaccagctgacgtatgtgatcttcatcttgtgttccaagtttcaaaagcttcgctcgatcttgagcttttgatatatcgtggctctcaattagctcttgctgactggcagctctaaatcaacgagcacaagcttgttggctatagctcttatcctcttggcctcttggcgagcaaaatatatctaatcttagccgtttagtgataaaatcctttcaaaagtagtagatgtaaatcctcaatcaagaaaaagtaacgaaaattaacccaaaatcaaggcaaatcgatcgatttgtaggcaacgcaaaaacagatactccgctctaagtagtaggagaatcttctagtatagggcgtggagctagcatggaacaattcgaagaaattaatcaagaaaccggaaactaaccaattatgtaattaacaacaaaatccatcacaagaagagcaaaaaaaaaagctgcagaagcagcaaaagtaattcatataattggttgaggaattattagagaatactactcacatattgttgagtacccagctgcgcacggcgtgcctcgcctgatatgatccagcaaacgatccgccgccgccgccatcggaagcgagaacgacgacagagcaagaggtcgagctagcgtgcaaatggccgcagtgttgctggcacgcggcaatagtcgaggcggcggagtcaacctactaggtaggtagtgtggtctcaactctctctagggcagacgatagctgtggttgcagagctggtggtcgtggtgggcgagatagatgactaatttgcagctagccgcgcgtgtgggccgccgcgcgaccaccccgcgttttccatttcggcccaggtgacgccggaccgtgcgcctccactttccgtcttgggttttcttatttcagcccagctcgcgcgatcagttcagcccatctgtctaaattttgtatacatatggatataaactttgaatntataagtatacaaactttgcatatgtctttacattttttatacatcaaaagtatgcgtatacataaaatacactcacacacacatatacacgtatgatatgtgcatctgcttcctccgcacgccaccaccttaaattgctccctgtacagtgtcaccaccgctacttcctttgcacaagcaccg

SEQ ID NO: 34477 - DNA, 3200 bp, Oryza sativa
  unsure (1)..(3200): unsure at all n locations
gtgcgccaacggcacgctcccctcctcctgacctattcattgctacttctcccttcgcacacatcgttgtcgctcctactctctccacgtgtgccgcngcccccttctccctccacatgcaggtgacgtcgctccctcgttccccgcccgtccgctacaccagcctcccaatatgaaaggggatgagaagaaagttggagataggattgttgtgtactcatgggcattttggtacttttggctaataaatacatgctttttttttgtttttttatatacaaaaccttaacgtgtaatggaaacacggtcaaatgataacttcaattttaaaaaataggatcaaatgcaaacatgaaaatgtgaggttagattggtagaataaggtcaaataagcaattatcctaatttattattcttcttagagaaaggtacctgaactaatttaatggttcacttagcccactaaagttttttttttgccttatcttacccctaaactgttaaaaatgtttcactttgctccttaataacatgtacattttcttacccgtcatacaagttgcattttaagctaaaatgtaccagcggtattttaagctaaaatttgttaggagccatagatggcaccattaacgaagttcaaaagtattttcaaattttttttcatcgatgtttgcttgaacttaattttgatgtttgaatcactttcaacctaagtaaacagtaagaattctttttttacaaaaaatgttgaaacctaaattgtgaacgcatctatgttctaccaaatttccagagcaaaattgacttagatagagagagtaaaaaatactgctaggggggttcgaggtgtaaaatgagaaaaaaaagtttaggtggttaagtgctatgatgaaatggtaacttttttttcttactctttattacgagccacctatcttgtcgtcatctagtccaccactgttctcacaaattaaggattattaaagcctattagaaacatatattgtttgtatggactttgggattaattagttagtaaacaaatgttaaaaaataatgtaaggttatactctctccgtcccaaaatataataagtggctattaaggagagaggtaaaagaataatgcatggttgcctctccttgggatgaatggagtatagccgtataggcctggacaaattggggctataacaaagggataatatggttaatttagtggtaaaagtcacattttataatactgggttgctttatttgggataaggtttaaactattttatgatgcaaggagcagtatttttccaatgccctagctaagctagggcctattctttttagatgacgcagcatattctgataatataagataacttacttataacaatgaattaaatattacattatagagttaacaaatagcttcaaaaagttaccaagcaaggctaatgaataattatttttctggagcattgtactttgaagcatggcaccaataatgatgtattgataatcagccccagttaattagctcattccaacagggcagtcattcagagccacaggcaaatcttcccaaaatataagaccatgaaacgtcaggacaacaacaatgaaggaatagaagtaaaaggaaaaaaaaaaggatcgatatttgaaccttggagccctagactttaattagtaatccatataagagctaagtgtataggttgacaaggaattaaaatacttaaaaagaaacatacaaaatatgtgaaaaaacaaatttccaaaaactatgtcgaattcaagctgggagtgctaaaattgacaaaaatggttcctaaacttcctatcgtccgttcgacaagaagcccaaatcccaaacgctttaactaggcgggtctcaccgaatctttatctactcaccaaacaccatcaacacatatatttctccaccacacactccaatcttatcccatctctcccttatctctctccactacaacactacctcatcacgagcagcgacagggctcttgtcctcgacggctatctccttagcttactcaagggcagcttggtcagcctcggcttcctcaacgacaacgtggcataacatcagcggtcacttgttcccaacagctacgcgatgagcttgaacttggcttccacaatgatccatgctttcatcaagtgtggcgccgcataattgcagcatactagtgtcgagttcggcgacagtcagtcactggagaggagaaataagtactttagactgtttttttttatgtttcagccaatatgtttttgatgttcctttgtattggatcaaaatcttgcagtgaggttttttgtattgtttcatattctgtccttgaagagtgagattcgtggatgtttcaaacgctacactaaaatgttttaccatatgattcaattatgtttcaccaaaatacacaatgattatagcactttgcctttgcttaagcattggagtatttatgtactccctaccattgcatgtggctgcaaggtcagtaatcacagtaacctactctactagaaaatgcatttttcccgacgtggaggtcttattttcacagtcggacatgactcttggagccaaatgaccgtctaaaaaaaatataaatcggcatgacgttcgctgtccgcctgcgaaaatctattttcgcacgcgcctctattttcacaggcacaccttatgtggtctgcctgcagaaatagtacctaccaaaaaaatctagtcatcctcatccgtatcctctcctccaccatccttatcctctcctctccaccactcgtttcccttccccttctctctctctctctctcccccacacttagaagaatcgcccggctccctcctttcccacgtncacgcgcccgcgncttccttcttgacgacgacgacgaccgcgacgccgccgacggctccatccactctagatccgcgtgctgccggctccctcctctcccacgtccgcgccgctggctccctccaggacgacatttgcgcgccgccgcatccctcctcaccgccggtggcctccctcctcgacgacgatgacgacgactgcgacgacgccgacggctccctccttttccacgtncgcgccgccggcgcccttcatgacgacgtccgcgcgctgncgnatncctcctcgccgncggngggnctccttctcgacgacg

SEQ ID NO: 34478 - DNA, 818 bp, Oryza sativa
  unsure (1)..(818): unsure at all n locations
cgctgtccnnattgttgacactctgnnnnnnnnnnnnnnnnnnnnnnnnnnnnnnnnnnnnnnntggaacaaataatttatatacttgttttaataatctctactcgctccatccgcaaatataagagattttaagtggatgtgacactcatagtacaatgaatctggacatattttatgtccatattcattgtacaggaatagaaaatctgtctagattcattgtattatgatatgtaacatacatctaaaatcctttataatatgaaacggacgagttaataacctgaaaaaaattaagcctaaagctagctttgtcgcattggttcaataatcgtatctccacggtcactctctccgatgttttgggcagttcagaacatataatcaaattagttgagatggttttgtgtttgtgcttattaaagggcaaaaagtgaataaacttgttttgcagggataaacgagaaatttctccaggtcctgatatagatgtaacctcgcccgacatggcctggcccaggcacgggctaggcacagcccgaggcgattgggccagcacagcacggccggcacttcaggccgtgccgtgacagcccacgggctgcacctcaggcccaagcacggcccaccagtagttgggccgtgctgtgccgacccgaaggaacgggcggcccatcgtgccttatttaaaataaatttatttccccttcctcatctatgggctgtgacacatatatatagnnnnnnnnnnnnnnnnnnnnnnnnnnnnnnnnnnnnnnnnnnnnnnnnnnnnnnnnnnnnagtgtcatcatacc

SEQ ID NO: 34479 - DNA, 699 bp, Oryza sativa
  unsure (1)..(699): unsure at all n locations
gtgtcccaatgaatgcnnnnnnnnnnnnnnnnnnnnnnnnnnnnnnnnnnnnnnnnnnnnagtggattttgtcctacgtggcagtctagtcagcaattttttatttaaaaaattagtggggcccacctatgatattctctcccctctctatccttttacccctctcacctatctctatctctcttttgcgttggaggctgacaaatcccacgtgtcggcggaggccaaggatgagcggtgcgccacagttacgagcctcctcaaggcggaggccgagaatgaggcacacaccaactgtggccagcccgtcaagctcaccatctgggcctcgtcctcctgtggttagggaagcagcagctagcgctggacttgcacgagaaggcagccatggcgggggaaataagacggcggggaagaggggacaacgcaatggggcgcctgaagaggacggtggcatggaagcggaggagagggcggcgcggtcgaagccgaagatgcagtggcgaagatggccatggtggggaaatacgatggtaggggagacagctagacacggcagggtgcctgcaaatcccggcggcatggaggcggagctccttggccgatgactggcatcggcgagctgtggaacattgatctcgaggccgtttcccctaggctcgagctctaccaccgaccgacaagtccaaagtcctcctg

SEQ ID NO: 34480 - DNA, 1095 bp, Oryza sativa
  unsure (1)..(1095): unsure at all n locations
ccgctcccatttgatgacttgcctgcctcnnnnnnnnnnnnnnnnnnnnnnnnnnnnnnnnnnctagaagatatgcttcgcgcatgtgtcctagattttgggaagacatgggataagagtctcccctatgccgagttctcctacaataactgctaccaagccagcatacagatggcaccgtacgaagcgttgtatggccgcaaatgccggacaccactattgtgggaccaagttagggaaagccaagtgttcgggaccgatatcttgagagaagctgaagcgaaggtcagaatcattcgggagaatctaaaggtggcctagtctcggtagaagagttatgcagacaaccgacgccgtgacctggaattcgcagtggatgattttgtgtaccttcgggtcacgccattgcgaggtgtacacaggtttcagacgaaagggaagctcgcacctcggtttgtgggtcctttccgtatcattgctcgacgcggggaagtcgcttaccagttggagctgcccgcctccttgggcaacgtgcatgatgtgttccatgtgtcgcaactcaagaaatgccttcgagtgccgtccgagcaggccgacttagagcaaattgaagctcgcgaagacttgacctacgtggagaggccagtgaaaattctggacaccatggagcgcaggaccaggaactgggtaatccgtttttgcaaggtccaatggagcaaccacgccgaggaagaagctacttgggagcgtgaagacgagctgaaggcagtccatcccgatctcttcgccagttcttcggaatctcggggtcgagattccgtttaaggggggtaggtttgtcgcgtcccaaaacgactctaaaatatatccattaaatgatgcctagaataatagaaatccgtgtgaaagcctccaacaattaaaatgtgcaaagttaaaagtcaaacaaggcttagaggatttttatatatttcctaaaagcctaaaatgcgtaaataaattttagtggaattttcagagcacaaataatannnnnnnnnnnnnnnnnnnnnnnnnnnnnnnnnnnnnnnnnaagcaggtgtcatcatgggggtg

SEQ ID NO: 34481 - DNA, 744 bp, Oryza sativa
  unsure (1)..(744): unsure at all n locations
gcgtcccntttgattgttatgcnnnnnnnnnnnnnnnnnnnnnnnnnnnnnnnnnnnnnnnnnnnnncacgtagcggacaccatgtgagctgcatattcccttcaagaacttatcaatcaaggtattctcgtagttttatgttttttgacttgtacatattccgcaagttgctgcttaggtttcactaatagataacctctcatcatgtgaaggtggcgttgggaatgaccatcccaacggacccttcagggacttaccattgcaggccgattccagcaggatactcgagggtcaaagttgagctggtggaagccgcgtacgaggtcctcgagttggactaccctggaggagacggtgagacgcatctacgagacacaagccacgccattatactatggcgcaagcggtacatcttcctccctgggcgacaatcggtgtctcgtgcaccatctcttccggctccgccatctcctctgcaccacctcctgcaccatctcctccagttcctccaccacctcctcctgcaccatctcctccggctcctccgccttctccacctccaccgtgtctgcctgcacctcccaagacaaggtctcgccaagctccaccgcttgcccgcacaagggcaacgaagaaggcgaaagttgacgccaccaaaaacaaggagccgccgtacgattgcagtcaagaggagcttgacgcttaagtggcaggagaagtgaagagctactcaagcctgnagt

SEQ ID NO: 34482 - DNA, 702 bp, Oryza sativa
  unsure (1)..(702): unsure at all n locations
gcgctccnttttgatgacatgcnnnnnnnnnnnnnnnnnnnnnnnnnnnnnnnnnnnnnnnnnnnnnctcctaatgtttgttataacctaaagaaccctgtgctttctttttatgtattgttattgcttctttataggcttgtagctttacttgtgtgcttcgcgtagtcttcgtcgttccggaggttcctgaagcgtggtttgcggtcgtcgccgaaggttcggaagaatatccattgatagcttgatttatctcaaatttatgttaggggtgcccatcgatccgctagaggtggaagcggttttgctcgatatttcttgggttttggttgaagattgaagcctacaaggtaaatattcattatttctcaccccgattcacacccgctcgttgaattgaattgccatgtggtaatacatgtaaaatgcactagtcattaatttgtatggatccataagtcattcatagatctgtctcgggtgctatgctaaatttgaattaatcattttttccatctatgccatcatcgntaatgtttcacattagccaaatatttttttgcattgacgaaaaatagaattttttttatcttttcgttagccatgactatctagttaaggtgacgtgaatgtgtgcaaaaacctcaattttatcgtagggtaaaatgggcatttcttcgttgttttattctaatgtgcctg

SEQ ID NO: 34483 - DNA, 1285 bp, Oryza sativa
  unsure (1)..(1285): unsure at all n locations
gactntgtcaagttcttcttcaactcgaactggaacacgacagacaacctcaattataagatacaaacgggcttggtctaccatgtcaatattggtgggcatcatcatcaccggcttatcttcgccgctgccgactggtgtctccgcctacacggctggcctattatgccaccattgttgggcgtctacgacttcaccgttgtctcgctttcgctgccgccgactggtgtctccgcctacacggctggcctattatgccactgttgttgggcgtctacgacttcacctccggcctgcctctgtcgccgccgactggtgtcctcgcctatacagttagtgggtcacaccaccgttcatgggcgtccacgtcttcaccaaccggctagacatcgccgccgccgactggtgtttccgcctgcacggccggccaattatgccgccattgtcgggtgtctacaccttcaccgccggccgccatcatcaccgtcgattggtttcttcgtcttcacggccagtgtactccaccgccgttgcttatggcaaccatgtcttcactactggctgcagtcatcgccgccgaccggtgtttttattgccattgatggacgattttgttcccacatcagccacctctgccatcaccaagggaaagattacaaagctaagtcatcattaattttctttatatgatattttccttttcctctgcctcactacatcaactggttcgccgttgactagtgagtcgggggctacagatgttatatcatattttttaataattttcataatattcatcttgattgcttgcgacatgatctgagtacaaaagcgcctatcgagttatggagttccatcttcctatgctttccgtttggtttgccaatggatagttgcctttgggccgattcctagcacccgggggctcgttggatggactgaataacgcaaggtgctaagtattaatcagaagaaatcaaaagcatagagataatataatttttttctgctcttaacaattgcaaaagtacccgagtagtaaactctgatccgtgaaactttgttccattaatgacgaactcatatcactcatatgcatgtttgggaagtgcttaggccgactcccggtgcttggtggctatgactagtcgggcagagtgtttaaacgtaatgagtcatctgctcggagaaatcaaaattgacaagagaagannnnnnnnnnnnnnnnnnnnnnnnnnnnnnnnnnnnnnnnnnnnnnnnnnatcaacntntcaaannntcgcac

SEQ ID NO: 34484 - DNA, 5415 bp, Oryza sativa
  unsure (1)..(5415): unsure at all n locations
nnnnnnnnnnnnnnnnnnnnnnnnnnnnnnnnnnnnnnnnnnnnnnnnnnnnnnnnnnnnnnnnnccatgtcttcaccgaccggccgcctagtccgccgccgactggtgttttcgcctgcacggttggcctattatgccgccattgttgggcgtctacatcttcaccgaccggccgcctcgtccgccgacgactagtgtttccgcctgcacggctagcttattatgccaccgttgttgggcgtctacgtcttcaccgaccggccgcctcatccgccgccgactggtgtttccgcctgcacggctggcctatcatgtcaccgttgttgggcgtctacgccttcgccgaccggccgcctcgtccgccgccgactggtgtttccacctgcacggctggcctattatgccgccgttgttgggtgtctacgtcttcatcgaccggccgccttatccgccaccgactggtgtcacagcttgcacggctggcctattatgccgccgttgtttggcgtctacgtcttcaccgccggctcaccttcgccaccgtcgactggtgtctccgcctgcacggctggtttattatgtcgcggttgtagggcgtctacatcttctccgaccggccacctcgtatgacgccaactggtgctatcgtcttcacggctggccacgtcgccgccaccgcaattaggcgtcatcaccttcaacgcaagctgtctacatctgctgccgactggtttcttcacttccatggctgcatgattctgctagtgttgattggccttatcgtcttcaccgccggtcgtctcgtctactactgactagtgccgtcgcctctacggctggtttatactgctaccactactgatggacgtcattgttttcattgctggccgccttgtctgacgccgactggcttggtcacctccatggctgcacgttttcgtcatcattctacttcttccatcgccgactggttatgccgccgttgactggtgttttatcttcacaactattcatcttcgcaacgggtttgcttctgttgccgccgactcgtgttcacttcatcacggctatgcaactttgtcaccatggtggagcaacctcatttttattatcttcggcattggcaaactctattgcctctacttcgcaagctttgctacttcgccaaccacgacatctacaggagcctcgacatcttggcatgcgtcaacaagtataatgccatgttattttactacaacaagtggtgttccaatattcaagatttctactcggacatcttctatgcgtatattcactcaagcaatgactactcgacgacaagaagctacagttctcgactctatgttcagttgtttcccaactaaccaaagagtcggggactacacaaatacaaggctcaaaatttgacaattcgacaagctttatgtcaagatgaagcaattaattaatcagccaacgattcaactttgggagtcattagcttcgtcttcgcttcagagcaggtgttctacttcagcaactccgattatttcaccgacaattttggcttctccacgttgctacaatctactccaaatttctcaagtatcaagtttgagatttaatctacatattcgggagtttagagctatcaaccaagcaactcagtttcgatgagttggacaacagcattactttcctccaagtgaagcatctgcaacagctataacaccaagttctattgtcatctttataaatcaaggagcgttgcatcaatcttcgtcatacacatgctcacatcaagggaactactcgagttttgatgtcttctcaacaatttgatggattattgtcactgacatcatcaccagcacctcttcttcatcggccctgacgtcttcgccgttgctaatggatggctacgttttcacctccggcagcttctatcattgacgactagttatttcgccttcatggttgacctactacgcaaatgctgatgagtgtcttcgtcattattattggctgctacaccgctattgactgggtcaccgacatcgtcatcatcatcaacatcctgtcaagcttatttaacatagccaaccctactgctattgaaggacaagctatatgctcaggggcttactagctcaaacacaagtatcataccttcaatttggacttgttccggatacatgcaacatgaattcatgatcatgggtctattttctatgctcaaagactagactatttattattccccataagggttatcaaccgaatacttgcgccagtcgggattcaattattatatatatattggagtatctcataagggataatcactcagatcagaagctattcatatgagttacatttggtctatataacccggaagatttattactcgagagcatgttacatgcgtcatcctttaaagggtgtcgaaggcatattttttggcctaggcctaatatgtctgcagcccatattttcaagtgtggcctgtcacgttcttttagggacttaggcactttttgcttaggccaaagtgtgcgtgatctagtgcccaataccttaaaatccttttataccgcagttactcaactttttaggagttggtacaatgcatcttaaaaggtgtcaaacagtaaagctttatatagctgccccgctgacttttttatatagtcatggcgctgtttgggtttataaagcaattgattggatacaacatcaatgctttttgccacgtaagtgtgcatttttattgaccaatattatggcttaggctgattatatattttggtcattttccagacgattgataaatccttatgagtttatttactcggattttataccacatatgccatatatttccaggtgtggtgaaaccatgtgtcttttagggactcaagcacatctgttaaagcagtgtgcgcatggtgtatgcccaatactttggaaatttatttattcacaacatacaagcttctttatagctgttttgctatgtgtattcaatgatgtagtcagctttaggttgcacgcatcatattttacaaagcagtcggtatatcactcggatcatgttattcagggattcacgccacatatgctatatattaatattaagtcacttggttgactacaattatcaaaaccactcagttggtgcatctattaggtacatctattcgatgcacctgactttatttttcagccctccacaatcttcatatttggtaaaagtattcgggagatcatggcgaagatgattgaagcactcagctttggagtaatctagttcgagagaagattatctttccgactgtgaaggtctcaggggctactgtggagattatgggtaccccatacccacacggcatggttatccgactagttataggggatagcttatatctatggaatatgtaaccgatcatgacttgggtattacgtttccttttatattatggagcggcctaaagtcctgatttgataatattgtaaaatagatttaggaaaccgataccgtattagttaaggtttctatcttgtaatcctgccccccatcctatataaggtggcaggaggccctctagggagcatgagacaaactgattgtcagatcaatatacacccggcggattcaaatccctaaacaggagtagggtattacctctcattgagagggcctgaacctgtctaaatcctttgtctccgcatccatccacttttaggtctcgtgcgctacccccttttcatattgccgaaaatttgtttcgacacaatgtctcagcaaggcgaaccaatgtcgacgacaactagtgggtcctcaagggcacgtactcctaggacagggaacaaaattcctaaggaacggttccgcataacagcggtggacgccgtagggttgctgacatctccaaggaaaatattgagccgatttaggtctatctgcggggtcatagggaggcagaaattcagtattctgcaagacgacttcaagctcgtgccggccgcagagaagaacattgcttggctaacgttcaaggagagctttgattatcctacggagcataaggaccgtctcaggcgggctgctttcaaggttatgggcactgcttggaagaacttcaagactaagctagtcgacgagttcgtctacaacccggcaaatccaaatccaagagagaaatttccttggatcacggaacaggtctgggaggaattccatgcaaagaagtcgacccccgagtccagagctagaagcgaggcatatcgcttgctccagaccaggaaccagcatccgcaccggcttggtaccgccggatatgccggtaaggaagaggaatggtagcgtgaggatgaagaagcggaggaattgtgcacaccgctcgtgtttggcgatatcccacaccctcgggctaggaactgggccagggctaggtaccagaaaaatgatgatggcacaatcttcatgccaaatgcagaagatcaacgagtatacgaagctatagtaagtgtctagtcaaactagatgttcgcattgtttcccatcgtgcagtttatttgaccccactaaattgtaatgcagaaggagttggttgccgagcaacaagcctcacaagaggcctgctctcaaagacgcaaagacgacctcctcacgaaagcgttgggcaacaaggaacaccgtggacggacacggggcgttgggtcttctgttccctggaagtatggatttccagactacgtgtggcagtacaagaagcggacttccaacaaggcggagaaagatgcacgccttgaagccaagatccgggagtcgatacgagctgagctgacatctgaattcgatgaaaagctcgagtcgatgagggccaagattaggcaagagatccgagaagagcaacagatcccccaggccgccgctgctgctgcgcacaaagacttaggaagtcccaccgaaaaacgtagcagttgcgcatcaactgagttggcggaaaatccaacatcggtcgacagcgccgtggaccacataacggtaaccgtgaacttactcaatacatgaaagacgtaacgaatccatatgatatataatattctaaaaaaattgattaatctatcgcaggaaccaacgagctgcaccctcacagttagggtgatgccgaccttcactgttccagcagccgagggacttgcgtaaaagccgacccagagacaagagtgcatggagcgcaactcagggccgactgtgcaaaagttcaagtcgactcagtgaagcccgaatacgagctgttccttctgaagtatccaccgaacgacgaggtcctctcactaggaaatgcccgtggtaccttcatccaatggcccaaannnnnnnnnnnnnnnnnnnnnnnnnnnnnnnnnnnnnnnnnnnnctcctg

SEQ ID NO: 34485 - DNA, 771 bp, Oryza sativa
  unsure (1)..(771): unsure at all n locations
acatgttccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctagcgctcccgggaaagagaagtctcacacacatattaaattatggttcaagttaagttctctctctcacacactcatggcagtcctaccaatggcgacaccgatgtagggcacgcctctcggccctacctcaacggctgtcccaccgtagcgcacctgcctcactcaggggtgaaccatctatgcagggatactgcctccgttcggctatctaatccgctaggtctatacccatacgagaagtgcggttgtacgggggtcgtttcatgtttaacttcatggctcggtccttaattgaccggggacggtactagcctttcccagataccacccaaatcctccgtccgccccagtcgaaaacaattgtttaattttatttctcctttcacaaatcatgtcatcaacatcatgacaatgtggcgctcatgtctccacatgccgcatttgataaatatgagtannnnnnnnnnnnnnnnnnnnnnnnnnnnnnnnnnnnnnnnnnnnnggatatcagnttcaaggnttaactct

SEQ ID NO: 34486 - DNA, 1989 bp, Oryza sativa
  unsure (1)..(1989): unsure at all n locations
ctaccggatgtcctcactccggctgtctaccttgagcagcatcagaagaaagccaacctaagactagccgaacgtcgggagcgcaaggatattgagccacaatccaagccaatcggcagcttgtgcacgaagagaagtccaagcttgatcagctatctgagggcccgatcaaatccaacattgatcggctcgaggctcacaagattgagctcttggcacaacttgaagaatgcaacaccgagctggatatggaacacaaaaagctggccgatcttccaaaatctgtcgaagaacagaaggcaagactaaaatcggctatcaagaatgttgctgatctcaccaagtctttgaaagtcattcctagaaccgacactcaagatgcccaagccattgaagaatttatgcatacaggtacatagttgttccatgcacgtacaaacgcatgcgatgaccagtaattgctggataagtttgagcattgatatagctcgcgtgtgcccgtagccatacgtcttcattaaaaaatactcgagctgaccaagtgaaaattgctgcttgtatgtactgctccgtgtttttgattttgcatgttgagtcagccgagtccgagattgatccaatcagctgtcttatgcaactagccagccgtggttgtctctcgtgacgatcagatcagctgtcttatgcaactagccagccgtggttgtctctcgtgacgatcaggggactcggagggcacagccaacaatcagtgcaggcaagacatagattgatttaattagtagttaaatctgaggccaatctaataattggtagattggaacggcgaacctggtcattgttgtaactacaaagtgtagctcccgaagcggagattttttgcggagatacaggagatatcggtggcgatgacggttgaagcttccaacttgatgacatagatctttgatcgccgttctctcgactgggtaaaacccaagtcggagaaggagagattgttgaagtcgtcggcagcgaggaagtgaaaactcacgaatcgaagacgaagccgacgaatcatgaaattgattccatcacactcgttgacaggaaactcggcgaacccctacctggcacgccaactgtcgaaacaaattttcggcaatatgaaaagggggtagcgcacgagacctaaaagtggatggatgcggagacaaaggatttagacaggttcatgccctctcaatgagaggtaataccctactcctgtttagggatttgaatccgccgggtgtatattgatctgacgatcagtttatctcatgccccctagagggccttctgcccaccttatatagtatggggggcaggattacaagatagaaaccttaatcaatacggtatcggtttcctaaatctattttacaatattatcaaatcgggactttaggccgctccataatataaaaggaaacgtaatacccaagtcatgatcggttacatattccatagatataagctatcccctatgactagtcggataactatgccgtgtgggtatggggtacccataatctccacacattgtctacttttttccaaaaaaacaaaaaaaaacacaattgagtgctacaatctattacaatctattaaccacatttcacaataatttcattaatgcaccacatttcatcccaacataaataaaccacatttcaacccaacataaataaaccacatttcatcccaacatgaataaaccacatttcatcccaacataaataaatctcatttcatcccaacatgaataaaccacatttcatcccaacatgaataaaccacatttcatcccaacatgaaccacattgcatataaataaagttaaatgatccacatttcatcgatcactacaatcatctatcaccaaattcataaatgcaccatatttcatcacaacatcgacatnnnnnnnnnnnnnnnnnnnnnnnnnnnnnnnnnnnnnaacatgat

SEQ ID NO: 34487 - DNA, 724 bp, Oryza sativa
  unsure (1)..(724): unsure at all n locations
agggatgtagncctgattngcccactgananccagctnnnnnnnnnnnnnnnnnnnnnnnnnnnnnnnnnnnnnnnnnnagtggtcacgaacacaaactcagtcgatgcaccggaatatatttggtgtccatgccatgattgcaagaaagacagacaacttccagctaagcgggtccatttacatctccttacaaggggttttatggacaacttccttggcgaggaggagcaaggtgagggaagtgccggcaactgtcacgggcatgatgcagatgtcggctacgaggaggaggaggaccaaacatgtgtcgatcacggtgaacctaatctagatcagatgctgcgacacggggagagatttgacactgatgataaggaatatcacaagttcacaaccatggtgaaggactccaaaactccaatttacaatggatgtaagacggagcacagcaagctccaagtggtcctatcgctgcttcacctgaaggcgagcaatggatggtccgataagagcttcactgagttgctagagctcttgaaagaaattcttgctatggacaatgtcttgccagaatcgacctaccaagccaaaaaagttatatgtctccttgggcttgacatacagaaaattgacgctggactaaatgactgcattctgtgtcgtggagaatatgcatatttggagcaatgctcggtatgcagggcttccgctataaagtggga

SEQ ID NO: 34488 - DNA, 1085 bp, Oryza sativa
  unsure (1)..(1085): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatgtgtcttgtgggtaaagatgtacacctctgatcagagtataacctattcgaatagacgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggtgcacggccttgattaataatactgtgtagctctaggatcgtctttttaaaattggctttgggcaactaagtgacttttaaatgctgtttactgcaaaacctaacccttatattattaccccttgtctcattcttgctcaatctttcccccccccccttcagtaagagaagctttggagatgaagtcctaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccctggcttttcctgggatggggattaatacactagcgttcgggaaaatgtatttttctcgnnnnnnnnnnnnnnnnnnnnnnnnnnnnnnnnnnnnnnnnnnnnnnnnnggctaccataggttctacaaannccgtt

SEQ ID NO: 34489 - DNA, 719 bp, Oryza sativa
  unsure (1)..(719): unsure at all n locations
nggggggtagncctgananccgcactgagnatcgtgctnnnnnnnnnnnnnnnnnnnnnnnnnnnnnnnnnnnnnnnnnnagcagtagattagcactactagaaaaaagatttttccaggcggtccaaaaccattttcgcaggcggaggagaggaccgccgctaccatctcgactgtgaaaatagaccattttcgcaggcgggccacagcccggctgtgaaaatcatctcaggaaaataaaaaaaaccatggggcgccgccgccggcctcaccacgggcgccgacggcagcggacggaggggaggagaggaagtggccggcggaggcggcgaggagggaagccggcggcgcgcggatctggagccgtcgtcgtcgctcgtcgtggccagcggcggagggatgcggcggcgtgcggacgtcgtcgtggagggagccggcgacgcggacgtgggagaggagagagctggcggcgcgcggatctagagcggagggagctgtccgcggcgcgcggatctagagcggaaggagctgtcggcggcgtcgcggtcgtcgtcgtcgtccaagagggaggccgccngcggccaggaaggatgcngcaacgcgcggacgtcatgaagganggcgcccgccgccccgacgttggagaagaaggaacccttcgcgttttcgcagtcgtcgtcattcgtcgcgaggagggaggccaccgcggtgaagaggaa

SEQ ID NO: 34490 - DNA, 1115 bp, Oryza sativa
  unsure (1)..(1115): unsure at all n locations
agggtgtgaaatgtatcgcctgctagctgctgcgtagatgctggtannnnnnnnnnnnnnnnnnnnnnnncgattgagatttttcctcacatcagtgacctttgcccattgacgggggccttacccgatagtgatgatgctttcagcccgtcacagataagcgatcctgttctagtgtatgggcttcacaatttattttttttgaaaagtatgtcatgtttattttgtagtcgtattcgaatgctaaccatggttattttgagctacgatcgacgagccaaattttccacttcttccagattaaataagaccttggaacgtcgtgacaatgaatgaagaaaattaaaactaaatttaaagaggttggtgtcaaatccatattagggactcataatatattatatattccataaaaaactctgaactttagttaatgaaatgttatatattatatatttcaagtttttctttctttttagttttctgaactctgtactgaacatgtggtaatttgcattttgttaatgaaatggggagcttacgctctctttctcaaaaaaaatccataaaaaactataaaaaaattcgagcacaatttgaagcttgaaatcaaatgcctaaaactgtggtttggatcggactaacttttattgccaatgttttacgttgaactatctttatctaatatttttacttcggactagataaatctacctttattacagtttgaaccacaacaactcttttctcaagcacatcaacagcctcaagcgcacttacatccacatgctggcaatctctcacacttgtgttcaatctacttctttaccagagacgaagttgtatgtggctaaaagaaaatagagttaggatgtgtttagttccacgccaaaattgaaagtttgaagaaattgaaatgatgtgacggaaaagttggaagtttgtgtgtttaggaaagttcgatgtgacggaaaagttagaagtttggaaaaaaaagttagactctaaacagggccttaaaatggtgcaaagtgaaaatgttaccttaaaaggaggtccagggttcgnaatcgntcgggttggntttgncnaactnccngaagtgcactgccaat

SEQ ID NO: 34491 - DNA, 4113 bp, Oryza sativa
  unsure (1)..(4113): unsure at all n locations
agggaagtngnattganagccnnattgtannncattgtataccgcgctnnnnnnnnnnnnnnnnnnnnnnnnnnnnnnnnnnnnnnnnnnatggaaatttggataaatttgagacacgctctaccgatggaatgtttcttggttaccccgcacattcacgtggctatcgtgtacttgttttagagactaacaaaattgttgagacttgcgaaattacatttgatgagcctagtccaggtactagaccagaaattgcagttacattatcacaggtttagggggaggatggtcgtatttttgaagacgagagcgacgacgacgacgaagaccgggcgccaggctggttagaccgctggcacgcctccagtcagaccagcataggatgtgcggtcagaacggccaaggttgtcgggttctaattctgttgatgctgatcgggatggacctccagaggctacaacttcgaccagtgaaggtacagaatgtgaaacaacttcagaagacgctgcccctatgcatattcaatgatgacatccgctgaaacaaattattggtaatctaggtgagcggactacgaggtctaaggtaatgactcatgatgtttgtgcaaattctgtatttgtttattcttttgaacccaaagatgttactcatgccttaactgatgattcgtggattaatgtcatgcatgaagaacttgaaaattttgaaagaaacaaagtttggactttaattgaaccaagtgagtttttaaaaataaacaaaatgagtatggtttaattgtgagaaataaagctagacatgttgctcaaggttttactcaggtgaagggttggatttttatgaaacttttgctcgtattgctagaattttggcaattagacttttgttagctgttgctgcttcaaaaggttttaaattgtatcaaatggatgtgaaaagtgcttttttaaatggtttatacaagagaaagtttatgtcaaacaaccaccaggttttgaaaattctgattttcccagccatgtttttaaattgtctaaagctttgtatggcttgaaacaagcacctagagcatggtatgataggcttaaaaactttttgcttgcgaaaggttttcgaatgggaaagattgacaaattactttttgttcttaaagatggtgataatcaactgttcgtttagatttatgtggatgatatttactttggttgttcaactcacgcttgggttgcagagtttactgagactatgcacagggaatttgagatgagcatgatgggtgagttatcgtaccttttggattgcaaattaagcaaacacctcaagttatatttgtgcatcaaacgaagtatacaaaggatcttttgagatggttcaagatggagaattgcaagccaatttcaacactaattggttctataactgtgttggattctgatgaagatggtcaagctgttgatcagaaggagtatagaagcatgattggatctttattgtatctaactgcttctaggccaaacatacaatttgttgtgcgtttgtgtgcacgtttttaagcttctcctcgtgcttcacatcgtcaagcggtcaagcgaataacgaggtatttgaatcatacacttgagtttagaatttggtattctacttcatcttctatatgtttgagtggatgaaatgcgataagctaataaaactattaggtttatttggaaaaataaaatattctaaatataccttctcacccccgaaggggtacctccgatatagcgtcacgtcggtcactatcgcaggataggatccctttggaatccatccagtgggctcttcccgctagcgacaggaaaagtggtccacaaccagtgccttcttgtcttttgttgctcaagtctttaaccttttcttgccagggaatgtccctaacatcgagttcgaagtcagagttttccgttatccccaggggctgattttctagataggttcctatggcacttcttttgactgctacattaagggcaaagcaactacctctcgtaatttcaattactaaggcagtagagatctgtttaagcgagttctatgatggttgtccaactctagaccttacgacaaagaaagagctagaaaccatgttttctattccgatgctgattttgctggttgtagaattgataggaaaagtactagtggaacatatcaattttttgatacatcattgattgcatggtcttgtaggaaacaatctagtatagctcaatcaactactgaatcagaatatgttgctgctgctagttcttgttctcagattcgttgtctaatatcaatttcgaaagattatggtcttacttttgagaatgtacctcttttttatgataatactagtgctattaacattgctaagaatcctgtacaacactcacgtacaaagcacattgatattcgctttgactttttgagggatcatgttgagaaggaagatgttgaattgacatttttggatacaaagttacaacttgctgatattttcaccaaaccattggattcttcttgctttgcctttcttcgtgtttattattcaatctatgtgcttgtaaagatgttgcattataaatcatatgaaatctgaattttgattgttgatttgaacttaattgtaacatctatggttcatgattatactttagtgcatgcttgctatgttatggatgggttcatcttcttcttattgcaacacataacttgatgtgctatatgtatgctaagctcttgaatattaatgaacataattcctatgcttgctgaaatcattatcaaaagggggagaagagatacaagtgcatgtttttcaggtcaagggggaatttctttctttttaaagggagagaagttttttttttgaatttttgagcactccttgctttttaccacttttgtttttatttttccaaacaccaaaacattttatttatgggtttgccaacgtgttcatcaagggggagattgtaaaatcaaagtgtgtttgattcttattctgtgatgaacaattggcatatgagattattggtttgatatttggagtttattggtgaagtggtttttggagatgaataggtactgctggagatttggtcctgtcagaccgggcagtgggtgccggtcagaccggtgtgctcaggttatttcgttggatatccctggataatttgtgtttatgactttaagatggatactatgcgtatgtaatactattgtttgctaatatggtttcttgtttgattcatgtgaaggtaatcttgacacctcgggagagtgttgctggtgatggatcgggagtcaactttgagatatggtaacgtccggatggtcagatatcatgcgggacactcacactaaagatgaatgcatgtggttggtgaagattccatatgacatacggtggagatattgtgtgagtatgagatgcggtgtagaatttggaaggagtccaaatttggtacaattgaaatttgtaaagttggtttcttgtacgggaaggtttcctagtgggattaggacttcttatacgaattttgtccgaggctttaagctgcctacctcatgtatcaatagagagggagggtgtgcatcccggtatcgctttagagagcattgagttgagataatagttagggttttgagtttagtcaagattttcgtgaggagtgttgttgatgcactttgtaaacacatagagaagtaataaagttgtaatttagtttgagagttcgtcgatttgtatttgctcgggttcggcggtccaaccggcggaacaccagcagtcagactggtggcaacgcaccggtcagtccagtggatacacggcggtcagaccagcgatgatgacaggaggcagaggcgacttcacggcggttaaaccgggcgatctacaccggttagagcggcggcgcatggtcagaccagcggatctacttcggtcagaccaatccacatcggatccaagggtaacttttaattccgataaaagttttggttttggggtactacaaccattcacccccttctagttgnnnnnnnnnnnnnnnnnnnnnnnnnnnnnnnnnnnnnnnccgatatcac

SEQ ID NO: 34492 - DNA, 3071 bp, Oryza sativa
aattaatccatcaattttaatcaccactaaccagcacacccatgctgtcaaggcccaaccatcctgaacacccataccgggctgtacagatctatctccaaaccaggaatataccattccaaaccaggagctaaacaaattatttccatttatagcatcttttattacggtgagaagtgtgaaactaatcacgaaagacattgttagacccacccataaccgcggacacggctattcgaatagttttactctggccagaggtgtaccactgtatccacaagacacagccccacaacatgtcaccatgtgcctcaataccaccacggtacctcggaaaggagatgtgacagtacccctcgcacaacacaatccaccacagtgcaccgttcctggatcataatcacccccttataaacaaggcatggactccccagcgacccccgtgggcttatctccgccacttctcagtctggtgctccgcaatgaaccatactatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcaagtaattaattaaccaatcatgattggccatcgtgagctatcattaagccatcattaaataatagtgagtcataagttatcccaatagtgtgctaatgtttctaagcatggctaagcaatcatatctaatatctagctgaaccaatatatatagcccgactagtccagttataataacccaaggtatcaaggaataaagtaatcaagaacaaaagggctataacaaacaataggttaattccacccaatgacattcgaaaataaatgcaatagttgaatggaaacaatagctttaaatgggatcaacatgctcaaagggttatttgggatctgtgtaacttgccttgctggccttggaactcttcaaattcttctcctgcgaaaacgaactctccgaaaacgtcggaatctaaacagaaaggagcaaaacaccaaaacagcacataaacaagcatgaacagtacatgtggatatttttaacatgtatatctcaattttagaaaaattttgagacttgaaccaactaaatccgagctgtgatgaattagttatgaatttttaaagattaaatcagattaaaacacttatatgggtattaattgaattatgacgcaataatgaattatttttgaaaaggaaaagggaattattgcgtcagcggctagggttcgcggtgaaccgggtgcacggcggcggctcacggaaacgaacggccgagatcgatcctatccaaaatggacggccaagatcgatcggatccaccgtggctcacggatggacgacgacgatgacgtcagcggtgacgtcaccaccggcggcggctcgagcgtgcagctcgccggcgaacgacggcgcgacggcacgaacggagggcaccagcacgtagagggcgacgcggcgaactcaccggtgaccaaaacaacggcggaagatccacggacggcgacgacgtcgaggaagagcggcggcgacgatcggcttgacgacgacggcggtgtttcggcggtcgacagcgacggcgaaggggcggacgatgacggcgacgcgacggcgaccacgatggcgacctccccgagcaacggcgacgactggagcgacggcggcacacggctggagcggcggcgacgacggcggtgagaggtctcacggggctagggcgctacggacgacgagaaacgaaggcaagggtggcgacgggttgcggcgggcttgggggtccttatataggggttggaaggtggcggcgaaggtaagtctagggttcggaggagagagatcgatccgaatcgaactcgaatccacggatttccaaacgaaattagccgacgattccataagagaaaagatagaggggatcccggggatcatttcccctctattaatttcatcggaaacggaaaggggcggcgcggctcggctagggttcggccgggcgacgacgcgaggaagacgacggccctgacaggtgggccccacctgtcagcggcgaacgcacgcgcgggcggactgggccgactgggccgaggaagagagagagagggttttgggccgacttttggcccaaagccaaaagagaacttttaaaaccttttccaatttaaattattcatgaaatgcaattccatttattaaaaatacttccttagctcaaataaatcccagaaaaatctaggaattatagaattaagcaaagtttttaatgaaattttatctggccccattttatattggaattttttaattaaaattagatattctcttcttggcttttaaaataaattctaataattctaattaaacaacaatttatatatttaggatttttagggtgtgacaaacctacccccttaaacagaatctcgtcctcgagattcggaagaactggcgaacagatgcggatagctgacttcaattccccttctcgttcccaagttgattcttcttccgagagattactccattggactttgcaaaaatggataactcgattcctgggtcttctctcatctatttccaagatacggattgggttctcaacataggttaaatcctcttggacttctatctattcaagaatagcttcttcggtaggtacccttaaacactttttcaattgcgacacatggaacacattatggactcctgccaaagattgaggtaactccaactgataagcaacctctcctcttctactgacaatcttataaggtcccacaaaacgcggtgccaattttcctttggtgtgaaaacgatgaactcctcgaagaggcgtgacacgaaggtacacatgatctccttcttcaaaacttagatctctacgacgattgtcggcataactcttatgacgagactgggccacacgcaatctttcttgaatgattttcaccttttcttctgcttccctcaggatatccatcccgaaaacc

SEQ ID NO: 34493 - DNA, 1240 bp, Oryza sativa
  unsure (1)..(1240): unsure at all n locations
ctgtctgcagatgataagcagtactaaagttcagcttagaacccatctctacttgaagtttcttccaaaactttaagtaaactgactgcctcgatcagacactattttcttagggacgccatgcaaacacacaatccttgccatatacaattccgccaaccgtcttccggaatatgttgtctttactggaatgaaatgagccactttggtaagtctgtcgactattacccaaatagggtcatggcctgatgacgttctgggtagaccagtgatgaaatccataccgatttcctcccacttccattcaggaatcttcaaaggctgcagcaaacctgcgggtttctgatgttctgccttgactcgctgacaaacatcacatactgctacgtattctgcgatttcacgcttcatacttgcccaccaaaatctttccttgagatcctggtacatcttggtactaccagggtgaatggagtataaagtatcatgagcttctctcagaattgcatcttttaaatctttgttgtcggggacgcagattctctcgcccaaccatacagttccttgctcatcttccaagaaaccgatagcttttcctcttctcatattcttcttgatttcttgaatatcaggatcattaatttgggcttctctaacctgatcgattagagtgggctttgcttctaaggctgcaacgaaacctctactgacaattcccaaatttaatctttcaaattccttgcataactccaatggcagtcgtccttccgtagcattgcaatagcctttcctgctaagagcatctgctacaacattagcctttcccgggtgataatgaattcccatatcataatccttaattaattccaaccatctccgttgtctcatgttcagatctggctgagtaaagatatactttaaactcttgtgatcggtgtacacctctgtacgagtaccgaaaagatagtgacgccaaattttcaacgcatgaaccactgcagttaactcaagatcatgagtagggtagttcttctcatgcggacgtaactgacgagatgcataggcaaccaccttcccatcttgcatcagaacacaacctaacccaattttggatgcatcgcaatacacttggaaactcttctttggatcaggtaaaatcaaaataggagctaatattaagcgattcttcaactcttgaaaactctgctcatattcttctgaccacttgtactttacgtcn

SEQ ID NO: 34494 - DNA, 751 bp, Oryza sativa
  unsure (1)..(751): unsure at all n locations
ngagtgttctatgataaatttaaccttgcaaaaatatatgttatttcaagttgtatactaactaggcgcatgtcatagaaacatcgataaaaaaatcttaaataaatcaataatatatatattacataattgtatatcctttaataacatgcatagtaaaattacatttacattttcaaaactaaaaacaactccagttgtcccaaaaattactcattacttaaaaaatactgaattacatattactaaatttatcatgagtgtatttttatgtattatgtgttttatttattcatatataattagaagttgaagatcaaatatattcttttggcaccatttctatgtcctttatctcgtacttaggcatataataatacacgtaccaacgtacgttggagtgctcaatttcatgcgtggcgctatcggtcgaaaggacacggccggctgtatgttcggaatgcatcattctcatcccaagctcgtaaaactcgtgcaactactacgtgcctaattagctttgaagattttaaagcacctccagtctagattcataggagtacgattttcacctgtctttttccttttttttttttgggaagacagacctaggaaacctttattttttctcgaaccactactagaaaacactttttttttnnnnnnnnnnnnnnnnnnnnnnnnnnnnnnnnnnnnnnnnnnnnnnnnnnnnnngggatgaggttcatcatgagatctacaaatnnccgtg

SEQ ID NO: 34495 - DNA, 721 bp, Oryza sativa
  unsure (1)..(721): unsure at all n locations
agggaagttngcctgatancnccttgnanncactgatatcngctnnnnnnnnnnnnnnnnnnnnnnnnnnnnnnnnnnnnnnnnnntattttcataaattatactatattttatatgttataatatcagttagatatgtattataccaacactgttgtacatgttgaacttaattagcaccgtctagtctatgataaaacttattatataacatgagctaattatgcgtgatgttatttgtttctattagaagtttagttagtggttttcgtgttccgagtaatatttgtttccgtattcatatccgatcatattcaatcctatttgtattcgagatcattcgtatttgtttccgtatatgagttattcgtattcgttttttatctaacaaagaaaaataaaatatggtatgagtattatccatccatatccacttcatttttatccctagttgtacaacttcatcattgcgtaccacccatactgtttttttttggacaaagatgccttgtttgtgacattttgatttggtgtcatgatatatttttttatggttcgttttaaattcatcataacaacgactggacgatgctacgtactagtctttgtgacattatcgacaaatgaaactcatcattaatctatgattttttttatatatgggattttcgtcgtagaatgtcatttcttgtagtgcatgcatggtgcaatttactcttta

SEQ ID NO: 34496 - DNA, 724 bp, Oryza sativa
  unsure (1)..(724): unsure at all n locations
agggaagtnagttttgangccnnattgannnncactgatatcnnnnnnnnnnnnnnnnnnnnnnnnnnnnnnnnnnnnnnnnnnnnnnnagattgaatgtatggccaacaaacaaaaagtctcactgacatagaaatcgaagttgagagctaaaaaaaataaagaagcagaagaaatcacctgcgcggaaatctcctcggcggcgaactgcttgccgatggcggggcagtcgagcttgacgttgccgttgtcgtcgcggacgacgtggtaggagacctgcttggcctcgtcgtcgacctcggccatcttgcggccgatgaagcgcttgacggagaagaaggtgttctccgggttgacgacggcctgccgcttggcgatctgcccgaccagccgctccccgcccttggtgtacgccaccacggagggcgtcgtccgctggccctcggcgttggtgatgaccgtcggcttcccgccctccatcgccgccaccgcggagttggtcgtcccgaggtcgatccccaccaccttctcgcacgccacccgcatngncaccccccgcgcccggcccgcccgcggnacccgcatctgcaccgacgccgccgcgggcttccgccccacgaacagctgcccgctcctccgggccgcgaggggcgaggtggagggggcggcgccccacgccatggcgccgagctgggaggtgaaggaggccatggcgaggccagga

SEQ ID NO: 34497 - DNA, 2489 bp, Oryza sativa
  unsure (1)..(2489): unsure at all n locations
tcgggaaggaacgtgtaacgccggttggggggtgggttttcgtgaccgtctgactatgactggattgtgtgagtctatttgttgccttgtttttaattttgcacgaaatttgggggtgacaaaggtgctttttgaatggatttcgtgtgaatttggtggaatgggggtgatcggtttggtttgtgggaggttaattggttcgtgcaagtcaaataaaaaaaagaataaataaaaggaatatccctacactttacaggttatatatgatgatctgatatgtcttctattggaagaagtcgatgccgcgttcaagcgtctaggtgcttcttaattctcatttgttcaatttatatgtgacgtgtgagttcaatataaattcctggcaccaagatagctctagaggtgggtctaggaaataaaaacagtgtacatcacctggtagcagttttatatttaatactagcaacttgcagtagttaccatgcttaccaaaaataaagatttttgttttctcacttgtagtaattgtagcaaaagtggaggaatgcaagtagataatttcactacccacatgaaaatcccctttaattcatttctcacatggtggtgttgttgatgggctataccgcagacgagatttttacactatatataaggatcgttggaaccaggtatacgcaagatcgggtcaagtagacaaggatgaagatttatactggttcgagctctcaagtagagtaataaccctactatagtttatatggatttatagatggatttatagatgggatgacacaaagattacaatggagaatgggataattagactaatccgccgaccaaaagttgtcgagaatgatacaacgagatctattcagcaaatatggctctggcttcctctagaattcttctcaatgtgtctttggctatttataacttgatgcccctttctaaacacgggagccttgtatatatagcgtagatcatctttctctccaagtagaactcaaagtgataaaatagtgataaaataggatacgagcccaaggagatcttaccttctccgattaaaactcgaacaccttctattctgagaagataatttcattccttatccatcgtatttccttaatcaattggcactttctggtatacaatcgggtatacggtattgtcatatttcataaatccgtgtataagaggtatgtcttatcctcaacgctaacaagtataaattttaaaaggaaaaaaatgaaggaaaattttacacataaattttataaatacaatatttaatttatatatacaaactttgcttcaaaaatcatattaatcttttttcttcaaatttataatagctaatatttaattaatcacatcctaattcattgtcaagttttacgtatggaccaaaagctcacgtgaacttagataccgaaaagaaaaattgatacaaaaagaaaaaagaaacaacatacaccccaaaatatagtggaccaaaaataacaattctatcaaaattcacacacacaaacttgaccaaaaaaaagatgtactagcgtgatcgcgggcacggctaatcgctgattagtgttttctttacatggatgcccggattcccccaaacctctctattgagtagaccaaggatatcatgacctgacaaatgaccgtaggtatgttatagcgatggaacgagggaggccaactgttgacgcgaaaaatcaacacgcagcggcctgggaaatctgcttagctctagtgcagttccaaaagaattgccttcgggttctaattgccttcgggttctgagcgtgcctgatggtttgatcctgcaaccaacaagatagaaaacaacaaatagttaaacccatcgacgatagccaatcggcaagattgccgatgacatatcgtccgaggccatgccaatgtaacttgagttagatcggcaagggcagataaaaacttggagattgttcggtgtacccgatcggctgtagatgttagcgatacataatccgtccgataggacatgcttggatcgagtgattaggatagatcggtggccacaccgagacagtataaatcactctgtatccaaatgtgcccaaaagtagggattatgcatgctaacagcatagccgatagagcaaacctaacatgtatcggctagtactccgataccaccctataccaagataccaacgtggatgaaatatatgaagctaaggccaaactagaaagcatgatggactagcttaatatacttcaaaaggatgggatcttgatataaggggcggatttagacaatctagagccaaatgaggaagtaaaacaactaaatcaggtaagatcggctgaaactccgatactatctctattagcagtcaaagaaaagattagataaaacatttcaggacagtgcttannnnnnnnnnnnnnnnnnnnnnnnnnnnnnnnnnnnnnnnnnnnnnnnnnnnnnnnnnnnn

SEQ ID NO: 34498 - DNA, 3178 bp, Oryza sativa
  unsure (1)..(3178): unsure at all n locations
nagatcgaccttacccgatgtagcattaagcgtgaagagaaatgaagtttctaataaanccgatgagagcttgttcgagatggtagatataccacataatctagcttaatatcaaagcctaagcctatcggccgctttcgatgatagaggttagctgatgaagctcagatgatgagatcgatctatatcatgcgatatatatgataactcagcgacttgcgtcgacaagattagagtgttatgaagatgtaagcactaatcccgagaacgcaagccgccatgacaagatttacctcttcgtcgaagatcgaacctgatgcagcccaactcgaaagcaaaaaagtcatcaaaaataagggtaaaaagggtggcgatgcgccgaagtgtattgaactgtcgtcccttgattacatggggtcgggccatatttatacccgaagtacatgacaggtccttgctggacacgactcttatctctaacataattcaaaatacaaatgagtccttcaggtggaccattaccaaactatctttaaggaaaactagaaaatgtcctaattaatagatacaattgcccttttcaggactcctatccttgtgtggcaataacgatggaggtcttcatccaacccgacgacggttatggggccacctttcttgagattggtggcgccggctttgactttgtttgatccggtgtttagccgatatgtggtagccgataccactgtagccaatttgtgtggtagccgatgctgttcatagccgacgtgtactcagatttcccgaacgggctttttccgaatcggcttggtctccaattttgaatccaacccatggtactaccaaatttggtcgtcaacaccaacgcctcaatcgcctcgacggtcgaggcatgttggcaattagacgaacaaaaagaaagaagtgcgctggggaagagcacaccgatggggaagaaggattagaatatagcaggaagatttagattaatttctcttgttgatccgaaccatcctgattacagcttttataagacttagactaacaaactcatttaacaactttgtctctaaaaatatgaatagaaaacgaaaccctaatcagctacgactttgcgcacctgaacttcctcccatgcgaccattcttcggtgtccaattccttcacagcgtttgtgaaacaaaattccccacatgacacaggaggaggaggcacacatgcgctcgaggctcctgatcctgccgacgtcgtgtcacgcccagaaatttagccctaaatttccagactattttgtgtattaaatctctgtccaggaccagctagggtacacaaaatgacaagtaatatacagttcaaaacgtaaataaagcataaaatacttacagaaaaggcacttagtcctcacatcgaaaagaaagcagcagcagcggaaaaaggcgatcttagcggggctttagctccactccacaggcaaaacttaactggggtctgagccttggtcctataacttcgtcttcagctcagaagctctacacttctgaaaagggggaacaatagcaaggctgagtataaccaccatactcagcaaactacacaaacgatgcagacgtgcaaggggatacaaggatgtcttgtggctatttgcataaaggcggttgtaaaacattttattgagcaaaacagtaaaaactattgagtgattaatgtaacattaaatctccactgatcaacactacaccacgttgaacaggcccaaccaacccacctgaactacaatgcattgggtcaatttattaagggtgagactaatcatggtgaatctggtcgatcgcccataaccgcggacacggctattcgaatagttttactttggccagaggtgcacaactgtacccacaagacacaatccaccggcatgttaccgcgtcatcatgcgcccatgatgaacacgtcactatatcgagtgattgtaacaagacccttcatataaccccctctgaccaatcacaccacacctcaggtttcacccccactcctcgcaaggcagtgggcagtcccctctcgtgccatggtgaatccggaagccgatcaaccgaacacctcggctgactcaactccatcacgcccacccttgcctaggaacgtcagccagaggaaagctatacttcaagtcaggtagttacccattcccgcttgtggcaagcattatatgtcttccagtacattccgcgaaccggtccttaattgccatgggtgtgatcagcaaaaccatgcacccacagcccaccaataagtcacattttagttggttaattatggctaatgaatatggccgaatgtctcgagcacgcagctcgttctgatactaacaaggtctaatactacaattatcccatcaactgagctagtggtaattaagcatggctaagcatatagttctagctaggtcacataagtaacatgagctagtcgatttattacccaatgttgacaaatgacatatatcaagtaaacatagcacaagcgagcagataggtaaaccctattcccatgtaattagcaaaacatgcatatttatttgcaaacgataaaacatttataaattaggatcaacatgctcaaggggaatgtgtgacttgccttgcttcttcacttggatcttctgaactcttatcctcgtgaccgcgaacttccgaaacgacggattctacacgctgacacgcaaaacgaggaaaaactctaataaaaccaagcaaacaatacataaaaagtaaacaaacatgtagagctcaattttagatgaattttgcaagttgaatggctcaattcggagttcatatgaattagatatgaattgtagaagttttgagccattttaatgaatttctagaattattatttatttatttcacaattattatttaattgctcaaagggaaagggccgctgctgacgtcatcaaagggcggtgccgacgggcgggccccacgagttagtggcgcaagaggagcggcccacagtggactcggtccaccgcggcatatgcgcgggcgcaccacgtggacggccatgtggcagccaaggcggcaaggcaaggcgaggtggcgccgacatggcggagccacgggcagtcacggcgaacgccacgtagacggcccggatcaccccaaagggg

SEQ ID NO: 34499 - DNA, 2908 bp, Oryza sativa
  unsure (1)..(2908): unsure at all n locations
cgcgtcccnntttgaagtacatgcnnnnnnnnnnnnnnnnnnnnnnnnnnnnnnnnnnnnnnnnnnnnncctgaggaagagattggatgggttagggaggaaaacaggcgaccgaagcggcgggaaaacaatgccggcgatggaactcggggcggaagcggaactcaccagaatgcgaggtggttgggattccggcgggtcttcggcgaagaggagtggacgccgaggagcggtggagcgcggtggtgctgagggtggcggcagcacgaccgggcgaggcctgtctcgccggcggggagtggccggaggcggtggaaagggcaacggctcggcttgcatggtgggatggtagttgtggtggcgatttgagggagaggagcagctgccggggtggagctaggcacggagatgccgacgacggcagtggcgcggtttggcagcgacgggagcggcggcaagaggcggaaaaagcggcggcggctcgggctgcgtgtggacacggcgtcacggtggtggttcggggaaataaagtggatgccggggtgctatgtggtgcggcgaagctaacggcggtggcggattggcgcggtggagactagcggcggtggcgaccggctggagctcgatggcaagcggcggcgcacggctcgacgtggggagagcgggagggggggcgaggagctcgggaaggagggggaaacggaagaggaggactcgagagcatttttatagcgcgagggagcaacggggaggccggggagtggcgaatttggggcggcagcagccggcgacgtggagctcaacgtgggtgaagtggggacttgatttggcgccaaaaattggggaaaagtaggggatttggtggaggagatggaggggaaccgatttcgctcggtttgggcgtgagggcgcgagtgggagggcgcttgattcggcggcgacgtgggcagcaaaagggcggcatggcggtggtttcggctcagggagccagaggtaggaggaggccctgacaggtggggcctcgggtccacctgtcggcgaggggaggagagaggaggctgggcaggggggcttaagcggacttagtgggagaagggagccgaactgggctggtccaagagaaggaagggggcgggaaggagaaggggaaggcttgggccgagcccaagagggaggagagagatttttaattggttttctttttatttaattgattaattgaactttgtgactttaaaattacttcttgagctccgaaaattcgcgaaaaaatccggaatccggagagtattttagggcacaaagaatattacaaaatattcttggccaatgatttttaaaggaaacttttaattctcccattatttcacttgattaaattgatttaacttttatttaatttctagaaaatgtattattaaatgatttttaatcctgaacgaaaatcggggtgttacacgtcgtaccttctcctctccttgcccatgagcaggtcaatgatgcagttcatgtcgagcgcccgcacgtcccgcgctgcgttgcagcacgggtcgtacacatcgttgtgcggcggtaggacgcggtgcccgtggtccagcttcacccaccgccagcacgcacgcaggatgttcaccttctgggcgtgggtgcttttcctgatccttggactaggaggggatcttttggtgtcggctgcaccccagcttcagtgctcgcctgttgcgtgcgcaacaggttaggaggaagaggaggagaactgcgcaacaggttagggggaagaggggagaactcctgctgctgatgctgctgtgactctcccggatgccattgttgtagcagaatagtagcgcggtagcactacaaggagagatcaggtctgcgggactccaggatttgttacccttttaaagcgagatcagagattagcaccctacatgtgatggctagtctaattaaatgttggatatggatgcacaaaatctttccattcattaattaagtctagtaagagatagatatatacattttaagttaattaattaattaattaaagttcaggttaaccagcaagctagatgttgttggtatttctaaacgacatcactagaaatataattcctagtaatggcgcataaatactactggtatattatggttacaaagttcatccgcaagcgcataaatataccattgtagcatttcacccgagagtattctaagggtatcgtatttgtttaatcccgtgggaagattataatagagagaaccgtactaataatttatatattacttgtaataaccagagtctacccaggggttaatataattcagtgggtagagtgacactaagcagaagcatttatactctcattcataattatctaagctaagcagaaagaatatagaaagatctattcctatatctctagtatatatacatattatacatacaccctagttatatcataacttaaccaataccctctttctgatgctctcctggtacttcgagaagccacccctgattgccgagttccttacgacaatccgtcatgaccattcaaccggggctaaatacggaggagtaccctccccaagaaattaacttaggactatatacacgcgcggaggaatacctgtactgagctgtcaccatcagtgtgttgatgaaaaacatgaggcctgggagatctgcttaactctagtgcaggtccaaaactcgccttcggatatgttagcgtgccagttgatttgatcatgcaatcaacaagaaataaagacaaagaaaccgtggttaaatctataaacgatagccgatcggctaggtgccgatgacatatcatttatctttgcgccgatgtcatatatgtatcgatcgacagtcataaataaataagaaggaactaaa

SEQ ID NO: 34500 - DNA, 6947 bp, Oryza sativa
  unsure (1)..(6947): unsure at all n locations
nnnnnnnnnnnnnnnnnnnnnnnnnnnnnnnnnnnnnnnnnnnnnnnnnnnnnnnnnnnnnnnnnnnnnnnnnnnnnnnntttttttttgagaattacacagtacaacgcagacactcacaacgcacacgcactcatccctatgaacacacgtatgcaaaccctacccttatgagcatctttgaagactgggccggcaaattctggagagattgacgaagtcaccacaggcgccttggtgtcgacgggtacgtcgcctaccactgaaagcacaacgcccgtaaatcctgaaaaattcgctcccatgggaaatcgaactcaggacctcaggtgctactgaggctcttgttaccactaggctacaggccctttcacctatcaatcacttcttgagaactagataatataaataacactcacactaatataggtatgtatcctatgcacactattagcttaattaataaatactaacaatttttttaaaaaatatatatttactttcaataatattacagcaacgtagtctcattttcgaaataactcatacatgcctctactcgttgcactgaaaattactgtttttatggaaatttacgtgactatacttgataacgagtacgaaactgctaaatgactgtcgacagttttcttgagtgaaaactgtcaaatttttaggccgtcgattccgttttaagatttgtactgagatattttgctaccggatctaaaccctcttttcacaagctagccacatcatcacatgtttatggtaaatttgttcatgttatatctaaattgcattccagttatatgctagttatattatagttacactataattacattgtaattatattgtaactgtagtgtaactacactataactacattgttatctctatataaattaaatataaagttacatatattattttaataaatatatgtaccagttattattattatagtatagttctagtgaaattatatactatagttagatttgaaagtttttctctcaaaaaacactcgacagttttttagctagtccaacgagtaagtgaaaaatcaggcgacgagtgaaaacacaaaattattatatttttctgtgtgtatgtgcaagaagagcagatcgttagccctagagggcgctgggccctagctaggcccaccatattcgttggagatgttgcctgttcctgctggtgtgaccaacgattaatttaatttctgtcggttctatatatagttatcgacaaacatatctagggacctgaatgggttggtgtgttgagacctagctatgaccccgactcacggccaacctgagttgatcctgagagctagctgtgacggcgactcgaggccaactatatgagtggtaatgtactaatgtttggactggctggctctagtatgtaaagggacatacgagccggcggcctgtcattctcgtagcaagttttttattttttgaaaattacacagtataacacaatatagacactcagaacacacgtatactcatctttatgaacgtacgcacgcaaatcctatcctatgagtattttcgaagactaggccaataaatccctagagattcgtagcaagattctaatcaaagcatcagcatcagcattgtcctgtagccataatagtatgatacccccacccaaaaaaaatgttttagcttttaaaatttatccaaaaaacttgttccttactttagagtttttttttatcatatcaattagttgccttcaatttaaaattatctttatcgtacactcattggcaatcccactatctactacagatcatttaataaatgacactatagttttttttaaaccttaacttttgttaaataatttaggtcgaaaactattttaattttaagatggtgattaaattttggatactcgcagcacgcttttaaaactgctaaacggtgtgtctcgtgcgaaaactttatatatgaaagttgctctaaaatattagactaatccatttttcaagtttataataattaaaactcaattaatcacacgttattaatacctcgttttacgtgaaacacttaatctttatctttatctttattttcaggagattcaatcaccagttgaggagtattggattgagtcattgagagtacgtacctgactcccatcgttttgtccaataacttcaatcccatgcggcttaatgtcgtcaatacttggtgagcgggagccgatcgatccgtgcatgcctctactccttgcaaacggagtttgcaatatatagtacgattgaactctttgattgatcattttctcttataaagtgatgtgtgttttgacagttacggatgtgcgatgccttcaaactgggcgttaggtggtgttttgacagtctctgattgatcagtccatatttaatatttttaattagtgtccaaatatccgatgggagataggaatcaaaatttagtcactggatccaaatagaccctaaacgtggggttgacatgtggctgagagtgggagtatagataggggccagaatagcgataaatttaaataaaggtcaaatagtcctatagaattacacttattttgagataattgtagttattttgggatgaatttaggctgtgttcagtttcacgttaaaattggaagtttgaagaaattggaacgatgtgacggaaaagttggaagtttgtatgtagaaaagttcgatgtgacgaaaacgttaaaagtttaaagaaaaaagttgaaatctaaacaaggccttagtagatattaagaatggtactattggctcccctaacatataaaaatattactacaccaatgattccatcgtcccaggtgatacaactagatatgtatacatttgttcacactttctccacttcaataaataaataaataaataaataaataaataaataaataaataaatatatatatatatatatatatattttttttctacgttctttagcatatattgaggttgaaaagaagagatttgatacactcatttaaaaaaaattaaaaatgattgtcatccgactctgtatcggttcgcagtgcacacatggtagttgtccgactcagtccgcgagaagacgatgggctcgtgattgattcagaacgttgtaggtgtaatgcgagattggcagctccctattttgtgatgtctcgatgaatacaaagccatcttctcatcctacataacacagttctcagcctattttgggctggcctcctacgttcagatttgtttgagtttgattcaagaattttccacacatccaaatgcaaaacgcatcgaattttaaacacgcggatctcatgtatatgcaccactggtggagaaaccgtttgtagtcccggttcgtaaccccctttagtcccggttgtccaaccgggactacgaatccgggactaaagatagcggtctttagtcccgggtgaaataactgggactaaagatcagtcagccacgtggccggctgatccatctttagtcctggttggtaccattttttttatttgcatggccctgtttgctgcatggttgattatatacatatatacatatatatatatatatatacatatatatatatatatatatgtgtatgtattctatatatatgcataatatatatattacaatgcatatatatatatatatatatattacaattttaatataagattagtagcgatttaatatgagattagtagagatttaatataagattagtagcgatttaatataagattgttatacttagcatacatatatgattattacaattttaatatgagattagtagcgatttaatataagattgttagacttagcatatatgattattacaattttaatataagattattagagattaaatataagattgttagagatttaatataagattgttacacttagcatatatggctaggatgagttggaaactatgtcatgtcttccgtccgtatgccgtggtggtatgtggcacgtggttacacgtgaggaagacatgtcttgtgggtaaagatgtacacctctgatcagagtataatctattcgaatagccgcgccctcggttatgggcaagccaagcaatgtacccaagttagtgttttaattcttaaaacctgcttaacaactaaaatgtggaatggatggcctgggttggcttgggacgagctgggacccagggtcgggttgccagtttggtctgaatcatcgtaggccttgggttaaggcaggctcgtgtgggttcacggccttgattaataatattatatagctctagaatcgtgtttacaaaatagctttgagcaactaagtgtctttaatgctgtttactgcaaaccctaaccctttatattataacccccttgtactcccttgcatttattctgcacttgtgggtgtgtcttgttgagtatggtggttgtactcagtcttgctcaatttttcccaaactcagaagaggagttcctggaagatgaaggctttggtgtctagctcgtgcctgccgtcaagcgcctgtggtcgtcgccctagtcttccgctgtttcccgtttgtctttgtgtgtgctgggccttcgccgcccatgtaataaattaactatttacgcttccgcttgataaactctgaaatgtatcaacttttggtgtaccttgcctcctgggacaaggaataatacacgcacgtaaggaacgccggttgggttaatttcggtcgtgacaagttggtatcagagcccccttaaccctaggacgagccgtagatcccaagccttagcaatattttcaaaataaaaatcctttcttatttgtgaaaaccctctagtccctctctgtcctgctgcttcatttatcgtcaaaattcgacctttaaaatgttgcttttctcttttgttttagtttgtagatggccggcagcatcaaccgtcgtggtctggacctgactggcttcgttttggagctgcggggcatgtgcgttgtcctggggtatccgcatggagtggactaccagggcaagcagctcccggagtaggagggtgacgatgcagagccccacgctgcttgggaggtcactgcagtgatcctcactggctcacccgagaggacttcattggcagtcaccgcgggtggagattctttctccgccgcttgccagaacgccgctctcctcgccatctgcactcttcaccagcgctacccggacgagttgcagcactcgccctaccgctaccaccctcgccgcggaggagcccgtgactacgccaccttccgggatgctagctcggagtatgacgctaccatcatgcacctggcgcgcatggtggaggcgtacgacgcggctcgtatcgacttccatcagatggtgcgtcgcgggttggtcgagaacaacatgaagatcttggagctgcgtcaggagaatctgcagctgaagaaggacctggacacagtggaggcgcagctgtgtcagctcaagatcgcccagggagaggtctgtcgccgcaagcgccgccgcgtctgccgcagcctgaagatcaccgcccgcaagagtacctctaggcccgagcttgttcgtcagtccctggcgtggacctgcttcgtcgagaccccttgtgccgagcccgcgcccgtggttcctcaggaggagggagcctccggtgttggcagcacggaggatgcgctgctgttcaccttccgccctggcccgtcgcagcagtagacgagcagttagtaggcttgcgcgtgtgttcttctcgtttgtttttctactagagtcgtgtggggcatggttatgccggtgtgtggtataactgtgtcggagcctgtctttattttatttgcttaagcaacttgaaccttaatgaaccaatttaatagcagtaataaattcaagaattatggtagtcgtgggtggttagttttaatagtcagctctctctatttgccggtcctgtgtgggattttcagatggtgacaaccaggagaagtgctgctaccggtgaaggcagtcaccccgaaggcagcaatcacaacaaccatggcaggccacctccacctcctcccctgcctccaccaccaccaccagacaccaactccatcctcacccaaatcctcgcccagcaggccaacatgatggccgctttccttcatcacatccaaaatccgccacaacataatgctccacctccaccaccacccccacaacactctaaactcgccgagttcctccgcatccgtccgcctaccttctctagctccaataaccccgtggatgcgttggattggttgcatgccgtggggaaaaagttagacaccgtgcggtgcaacaatgaggagaaagtcatcttcgccgcccaccaactgcaggggcccgcgtctctatggtgggaccattttcaggctacgcagccagaaggacagcctattacttgggcccgcttcaccgccgctttccggaggacccatgtgcctgccggagtcatggcccttaagagaagggaattccgagagttgaagcaaggcaaccgctctgtgatggagtatttgcatgagtttaataacctggcccgatacgccccggaggatgttcgtgaagatgaggaaaagcaggagaagttcttggcaggaatggaccctgagctgtccgtgcgtctggtctccggggactatccggatttccaacgtctggtggacaagagcatccgcttggaagccaagcacaaggaactagagtcgcacaagcgtcgcttggcgaatttccgcaatcaacagggggctaaccaaagggtccgctacaccaatccctatccagnnnnnnnnnnnnnnnnnnnnnnnnnnnnnnnnnnnnnnnnnnnnnnnnnnnnnnnnnaagaggttntacaagnnntcaaanggnnntcaatgcccg

SEQ ID NO: 34501 - DNA, 1167 bp, Oryza sativa
  unsure (1)..(1167): unsure at all n locations
tcgggggtcgggtaaaccacgtaactgcgaaggatgtgctgacgactcaagacgtcatcgttggtacgttcctcattcattctatccctgctaccattttgttcgactctggagcttcccactcctttatatctgtgccattcgtggggagatatcagttgggggtagaaaggcttaggaaccctctgctcatcaccacccctggaggggttatgacagcaaagtattatagccctgccgttcttatagaaatctagggaattccttttctctcggatctgattcttctggacaccaagaacttggatgtgatccttgggatgaattggttggctcaattccaaggagtagtggattgcgcaaggcgcactatcactctgtattgggggccggaacaaccggttgttttctttgcacccccaacctctgtcggcagttcagaacttcatcagataggactgtcagaaatctccatcgtcagagagttcggagatgtgtttccggaagaactacccggtatgccgcccaagcgagagattgagttccggatagatcttgctccaggaaccacttctctgtacaagcgaccctactgtatggcagcaaatgaactggccgaagtcaagaaacagttagaagagttaaaagaaaaggggtacatacggccgagcacttccccctggggtactcctgtgatttttgtggagaagaaagacaagacaaagaggatgtacgttgactatagagccctcaatgaagttaccctcaaaaacaagtaccctcttccccggatcgatgatctgttcgatcagcttaaaggtgccactgtatcctccaagattgatcttcgttccggatatcaccaattacgtattcgtgaagaagatatccctaagaccgcattcaccacgtgatacggactgtatgaattcacggtgatgtcgttcggtttaaccaatgctcctgccttcttcatgaacttaatgaacaaagtgttcatggaatacttggataagtttgttgtggttttcattgatgacattctgatgtactcacaatcaggggaagaccatcagcannnnnnnnnnnnnnnnnnnnnnnnnnnnnnnnnnnnnnnnnnnnnnnnnnnnnngctataggttctcaaaagggtatcaaaaggcctct

SEQ ID NO: 34502 - DNA, 1018 bp, Oryza sativa
  unsure (1)..(1018): unsure at all n locations
ttttttttaacagagttaacaatagtagaaaaacacctatagatgccaatctttaatgtattcattacttgtataacagaattggttttttcaaaacagtacatcttttaataccgatgaattttaaatgatctcgatcaaagttttttaatggattttaaactaagtaaatcttnnnaaccgtgatccacgttgcatccgcccctgcatccacgaatctcactcttcaaagacatagaatatgaaaaaaaaaactcactgcaagattctgatccaataccaaggaacatcgaaaacatattggctgaagcataaaaaaaaagtctgaactacttatttctcctctccagtaacagaccgacgccagaatcgatactagtttggtacaaccatgcggcgccacacttgatgaaagcaaggatcatcgtggatgccaagttcaagctcgtcgtgttgccgttgtaaacaagtggccgctgatgttgtgacacgttgtcattgaggaagccgaggctgaccgagctgcccttgagtaagctaaggagattatcatcgaggacaagagccccgtcgctgctcgtgatgaggtagtgttgtagtggagagagataagggagagagagagaggatacgattggagtgtggtgtggagaaatagatgggttgatggtgtttggtgagncnnnnaagattccttgccaaagatngttttaacccttttaattgtccatttggggcttgtttgttttgtaaaaccattataagacccattgtttggatttctttaaactatcaccttaaaatcagcatattcttgggtataaagccctcccccctataccctaggttcctccccagttatataatactcttcctatccttgcccatttctctgttatggggtcgtctcaagatatggggtctctggtttaaatactactctttttttctgttgttaacattctgcctttttaaaaatttttatgagcctctctcttttagacattaagatcccact

SEQ ID NO: 34503 - DNA, 727 bp, Oryza sativa
aaaccaagaggtcgagccgttggtgaccagcgaagaatttggcataacggaattcatttcggaccccggtctaactgtggatcagttgattggaggcgcaccaatcccgatggcggaagtggcatacaagtttgaactccgtaaaccgcttgtcacgcctgagcagctgcagtccctaccgacatagatgtacaaattccatgaatggttcatggaaatgagcgccaagggtaaagagatgttcagagcgaggatcagaaaccccgacttcttgcaaggagaagaagttctgtgcatccatttcaagaatgtcttcgaactatatcatctagacgccctcgacgtctctcttctgagcgcatggattttgtaagtatctttgagttcgatttgtttcgttcaataattagttccttgcatagatgtaaacaataataaattcctttcatcattgtagaatggagattcaaagggcccgacggtaggggctttacgatactgggttcatcgaccctcagaaaatcaacaccgaaatgatcgacaagtacgagaaagacatagaggacaatctcgtccatctcctgacgcagcagcatttcaagacgttcatactactgtcgaacaacacatagtgagtttttattgtcgttcgaacaaatttcattcccatacatataacatgtacattttcatatatatctcatctcacgcatattccagattccac

SEQ ID NO: 34504 - DNA, 925 bp, Oryza sativa
  unsure (1)..(925): unsure at all n locations
cccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttttttgtcctttttccaaggaaaacagaaattaaattcccaaaagtgatcaaaatggatcaatcaaatgagtaatataaatcattaattgagcaatttcatcacgtcttacttttgcaatactgatcttataatatgtgcctctaatttgttttttttttgtagcaattgatcgaagttggatgtatgccaaaaatttgaaacgtcattctacagagtaccgaaagggcgtaataaattttatgaacgccgcggaggaggatcgaataagaagaaacagtgattatatgtgttgtccatgtgcagattgccagaacgagaatatgtttgatagcggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34505 - DNA, 862 bp, Oryza sativa
  unsure (1)..(862): unsure at all n locations
nnnnnnnnnnnnnnnnnnnnnnnnnnnnnnnnnnnnnnnnnnnnnnnnnnnnnnnnnnnnnnncttggaaaaggcatcgtgcctttaacaagccaagctctcccgtagtcggccgtcttgcaagcgaatccctccggatttttggtcttgcgacatgtcgaggggagagggatcgcgctgtcctacggggggccgaacggggccgagaggggtttggccgaacccctggtttggccgaaccagggagctcgctgatgggctccaaatttgctggggagcctggcactgttgcaaggggctacgcccacagtgcatttaccccttccatggtgtagtgctccaccgggatcaattgattcgccggtgtcggctctccgtcgaggttgtatgtggaatttgaggaggagccgatgaatgggatcaaagatttgtgtcacgaccggaattaacccaacgggcgttccttacgtgcgtgtattattccttgtcccaggaggcaaggtacaccaaaagtttatacatttcagagtttatcaagcggaagcgtaaatagttaatttattacatgggcggcgaaggcccagcacacacaaagacaaacgggaaacagcggaagactagggcgatgaccgcaggcgcttgacggcaggcacgagctagacaccaaaggctttcatcttccaggaactcctcttctgagtttggaaaaaattgagcaagactgagtacaaccaccatactcaacaagacacacccataagtgcagaataaatgcaagggagtacaagggggttataatataaagggttagggtttgcagtaaacagcattaaagacacttagttgctcaaagctattttgn

SEQ ID NO: 34506 - DNA, 897 bp, Oryza sativa
  unsure (1)..(897): unsure at all n locations
aatcaagccattccatagtgtccaggtgatgagaatatccaaaagtctagagttgtaaaaccacctaatgttgcctaattaaccagcgaagcatctacctaaaatcatactagtggtaccatgagtagagtgtccactagttggggttttgtttattctagggtgaacaaggaaataataccaataccaataataaggtcataacaaaggtaaataggcatggctaaataaaacagtgataacgcgggaatttaaataaagcgataatgcaataatttaaatcaaaataattttataaactgggattcaatatgttcaaggatgatgtgacttgccttgctcgctttcccaaacgtcggcttcaacctccacgaagagcggatcttccgaagctgcagcgtctacacgaccaacggaaaagaaaaggcttttactctaataaactccatataacagcaagaacaatgcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaagggtttattgcgtcagccgaggggaggggcgcgcggcccgggtccacgggagtggggcccacgcgccagcctcacggtccacagtggaccgggcgcaccggggctcgcaccggccggtgccgtgggccccacgcgtcagccgcacccgagggcgcgggcggctgacggccgggccccacgcggcagccactcggcgcgcccgaggannnnnnnnnnnnnnnnnnnnnnnnnnnnnnnnnnnnnnnnnnnnnnnnnnnnnnagctaagtagtctcatccg

SEQ ID NO: 34507 - DNA, 897 bp, Oryza sativa
  unsure (1)..(897): unsure at all n locations
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctttttaaaattggctttgggcaactaagtgacttttaaatgctgtttactgcaaaacctaacccttatattattaccccttgtacccccttgcattaatcatgcatctgccggtgtggcttgctgagtactgtggttgtactcattcttgctcaatctttcccccccccccttcagtaagagaagctttggagatgaagtcctaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccctggcttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34508 - DNA, 794 bp, Oryza sativa
  unsure (1)..(794): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgtcattgggtggtgagcctttcccatttaattatggccaaagatgactttattttcctatgggttataatttgactagcatggaccttatatattggattggttcagctagatgttatttatagttgcttagccgtgcttagaaacattagctcattaatgggataaatcatgcttcactatcacttatggatatttaatggaagctcacgatggtcaatcgtgattggttaattaattaaattgtcaactaaaacttgataatggtgggttgtgagcacatggttttgatggtcgtgctcatgacaattaaggaccggttcatgagtttcggttgtgaaacattaaccgtgccaaccacaagccagtatgggcaacggctttaccttttatatagcatggttcattgcggagcactagactgagaagtggcggagataagcccacgggggtcgctggggagtccataccttgtttataagggggtgattatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34509 - DNA, 1282 bp, Oryza sativa
  unsure (1)..(1282): unsure at all n locations
ccgcgcccatttataaatttgannnnnnnnnnnnnnnnnnnnnnnnnnnnnnnnnnnnnnnnnnnnnnnnnnnctaaagacgtgccgtagggggagccatctcctatgacccatgtaaaccatttttcttgatttcttcagccacctactgcgtgtatgttccatacagtcagagcatgccttctttcctttcacggtttgtccagaaagattacccagcgcgggataatcattaatggtgcagaataatagaactcgtagtgtgaaattctcctgaccatatgcatcccaagtttccacactctctttccacagaatctcaaggtcatcgataacaggctccaagaacacatcgatgtcattgccgggttgtctcggaccttggattaacaagcacaacataatatattttcttttaaagcataaccatggcgggaggttatagttcgcaatgagaactggccaagtgctgtgagtactactcatgtctccgaaaggattcatgccatccgtacaaaaacatatcctcatgtttctggggtcggcagcaaagtctttgtgttttcgatcgatattcctccattcaatcgaatccgctgggtgtctaagcataccatcattccttctctccgtggcgtgccaacgtactaactttgcttcattggggttggcaaatattctcttgaaacgatcaatgattggtagataccacacaaccttcgccggaccaccccgctttaacttctttccctcgcctgcgctcttctttcgcttgtatcgagaagccttgcagacaggacaagcatctaagtccgcgtattgcttgtggtacaatatgcaatatgtcgtctcgggcaatgtgttctcctaagtaaggaagcatgtccttcagtattcccaaaagttctgtaaaactcgtctgaccatccactactagccttcaacttcattaggtctaatgttgctgataatttggtgtgctttggcttgcatcctgcgtatagaggagtctccgagtcactgaccaacctgctgaacttcatggaatctctctcattcatagctgggtcatcaacgtcacgtaacatgtcttgcagcatatcacgggccacaataaccatttcaccgcccaatggagatgggacaacattgtatggctctttttatatccctttttaagactggttggacacattccgcttgagttgcaccattagtccccagaacttgtgtttcatgcattaaccaacatggggatttcttcatgaatccccgcggttta

SEQ ID NO: 34510 - DNA, 718 bp, Oryza sativa
  unsure (1)..(718): unsure at all n locations
cgcgcccttatttaattgtnnnnnnnnnnnnnnnnnnnnnnnnnnnnnnnnnnnnnnnnnnnnnnnnnnnaaaaaagtttctttatgttttgtgtagacacgattttgcttatggtattaattagtactgcttaatttttttattatacaaatacaatgtaatctttagaaatgagtgaggttgatcactaaaaatatatatagctaaacaaacatgtgatcatgacaatcttcagagtatcatttatatgtttgataaagatctatattttagcatctagtgtgtattcgtcacctattgttcataattgcacgagacacctttactaattttaaaaatgactttcagtggtaggcaacgtacccgtcgacagcgagctatacgtggtaacttcgtcaatgtcaaaatatgtcagcctagtctctcagaagtactcataggggtatgtgcaagtgtgcgttcattaggttgagtgtgcgcgtgttgtgagcgcctgcgtttgtaccttgtttctcaaaaaaatatcaaacactatttattgtttctcttttagtttaatggataaaacaattgagagaggacaacagtgttttgaacttgtaaggttaaggagtgtggtgaaatttatttttctaatttttctatgatttaagtgaaagtcgatgatggggtgtttcatttttttctaagaatttttaaggtttttcctgttttata

SEQ ID NO: 34511 - DNA, 1021 bp, Oryza sativa
  unsure (1)..(1021): unsure at all n locations
acttcggccaggcccgagaggaagaggggagaaaccttgggccagacttggcccaaagggaaggagagggttaattttaggtttttctttttaataaactctgataattgtttttgttgcttaataattatttccggtgctctgaaaattcgagtaaaatttgagggctccttttagaacaaggagaatttagcaaaaattctccgggccacatttgaatttttcttgtacgcattttagtgtttgccaatttcttttcgaattttaattaattctattattccttttagaaaatgatttttatttcgggatgaatttatcaggacgtgacagagacggcgaccgacggcaacgaccgaagcgacggcggtgcccgactggacacccgccggcggcagcgacgcaaagaaccacgcggaggcggtgctagagaaggtgacaggctagggcgaaggtggcggcgagaagaggaggtcccgggggtccttttataggggtctaggggcgtcgatggaggcccatggccagcggcaagaagatggaaggtctagggttagaggagagagattgatccgaatcgaactcaaatccgtcgatttccaaacaaaattagccggagtttccaatagagaaaaggaagaggagatcccgaggatcatttcccctctatcaatttgatcggagaaggaaaggggcggccggattttggaaggaggaggcggcttgcggcgcggctaggcgcggccagaggttgaagacgactgacaggtgggtccacgtgtcaacggcacagagagagagaggagggaggggcggcggactgggccagatgggccgagcacgcgcaggccggggagagagagagagacttgggctgactttcggcctaaagccaaaagaaggattaaaaacatttttctttttaaattattcatgaaatgatattccctttattaaaaatatttcctttgctcaataaatcccagaaaaatctaggaactataaaaacaagagaagtatn

SEQ ID NO: 34512 - DNA, 1815 bp, Oryza sativa
  unsure (1)..(1815): unsure at all n locations
acggcattgtagactgactaaccgcatagcacnnnnnnnnnnnnnnnnnnnnnnnnnnnnnnnnnnnnnnnnnnnnnnnnnnnnttaaggattttgaaacaagcaaaaaatttaacataattataattagatcattaattgattaatttattgattaactaattgctgaaatattctttgtagtattaacattaggaattgagctctgaaaaatctgagaaaatttaagagagcataattaatcatggagaatttaataaaaattaaatccagccatgcgttatatttaggaaattttatttcccatatttatcttcacttgtaaattaatgaacatttaatataatttctattattaatttattaaataatttataaatcttgaaacgaaaattcaggctgtgacaggtgccctctgaattgctccaaatttttgacaatcctgacaccccttgctcatctcccatcggctgctcggccagctgtatgcaccatattgataggaaaatgattgccatcaactttcatcggcctcttagaatcatcaaacttgatttttcctccctcaatagccgcttggatctgctgcctgaagaccttgcaatcattggtagtatgagacccggaattatgccacttgcaatactttttcttgcccaattcttcagccgatggaattgtatgaccagtagaaggttgaatctgcttctctcggagtagcaagtcaaaaatcttgtcggccttggtaatatcaaagtcatacctctcctcttttccagaattctttacccattggcatggtataaccattttgcttctcacccattcagctgctgctatttcagaatcatcatcatcatcattatccgatccatatatgtaaggacagatatggttaacctttctagagttcttcctggcctctgtaaacctctgttcatgcaaggttaccttctgtgtaagatgcgacaagctatcaaagtcttcagacgagaatttctccctgattggagtaatcataccttgaaaagccaaatcggctaactgggcatcagtcaaactcaagctgtagcacttattcctcatctctcaatctctgaatatactcatgcacaggctcatcatgtctttgcttgattgctgttaaatcagacaatttcatctcatgtaccccactgtagaaatagctgtgaaaatgcttctcctaatcagcccaactgttagatccacaagctcgctactcaagtgaagaaactccacaaggagaacatagagcttagggatcgtaatgcggagctaggggtagaacttgctgagcttaggaataattttgatacacttagtcgcggtttgtgcactaagatcaagcgtgcattcatagagatgggaaaggaaaatatgtattatgctaattagatgtttcctttcccatgaataatatagtagtaggtgcttgcttttattttttccaatcatgtaagcacttgctataaataatgtggctcattggtattaaccccaatgtttgccaaagtttgttttttttgttctatgtttaataaagttcaggttttgaataagtgtgggggagatatcccagcttctgacgtgcatatgctctgaaaattgttgaaatatctgatcacctggaagcactaaactctgcagaaaattgcagaggtattgggcaccagagtggttcggccgaaccaagtctggcccaacacctcccagttttcacaggtaagcaggtgagcacgtcttgtannnnnnnnnnnnnnnnnnnnnnnnnnnnnnnnnnnnnnncgcgcacca

SEQ ID NO: 34513 - DNA, 6659 bp, Oryza sativa
  unsure (1)..(6659): unsure at all n locations
ctttcctttttctctgttaaatatctgtgacagggattgaagtgagagaggaaacaagccaggaaagaatagcccagaactagagacaggaccttaaaggaactaactcttcttgttgatgtgctgtttgttttacttattctgcaagttgattaagcaaacaacctagcatggttacatcacaacccaccgatgcaaaccacacactacacacacaagcaaggaaacacacgactaacaacactatcctagaggacggcttaggttctgcgactggttcccaagatcttcactccttcacagctggcttcactgcttcctccacttcgctagcggatcctgcagtcttccggagcttcggcaaacaactgacgatgtcttcttcttcactgacctgaccatctagtactagttgaaatccgaagaaggaagggagtaaaccttttgcaaacagcattaagggaaggagaaaaaaggaactttcgcaaatagttttatttataaaatatgtccttaggttttatccacttggcttatcctacagtcgagatggctctgataccatcttgtcacgaccgagaaaaatacattttcccgaacgctagtgtattaatccccgtcccaggaaaagccggggtacaccacacaaacatgatataaaagacacatctttattatatcgataatatttacattattacaaaggtacttaaggcctgacaatcaaaaataaacagcagcggactagcgggcctacggctccatcttcacaggcgctcaactggggtataagccaggactccacctaggacttcatctccaaagcttctcttactgaagggggggggaaagattgagcaagaatgagtacaaccacagtactcagcaagccacaccggcagatgcatgattaatgcaagggggtacaaggggtaataatataagggttaggttttgcagtaaacagcatttaaaagtcacttagttgcccaaagccaattttaaaaagacgatcctagagctacacagtattattaatcaaggccgtgcacccacacgaacctgccttaacccaaggcctacgatgtaaccacgtgcacatctttacccacaagacacatcttcctcatgtgtaaccacgtgccacataccaccacggtatacggacggaagacgtgacatagttcccaacccatcctagccataaacaagagtaccgacccaatcccacctactgccggaacccccgggacaggtaggcaggactgagcctccagcagcaggacaccggccctgtgccatgacatctcgactaccgggccgcagctcgtgtagccttcatttgtcctagagatgtccatcgacccccgatttcgtccatctccatccgtgtacttttgtttataaccagactgagccacaaagtaagccttacccactacacatgtggaagtacggtagtgctttgcaacagaggcccgagcttaatccttatagtacccgaggtacgactaacaaaacccaaccacgcacctcgagcccagcctaaagccattttgggggttttgaatagagggggaggtgtgtgtccaattccaacataagccaaccattccatagtgtccaaatgatatgagaattcccaaagtctaaagttataaaaccacctaatgttgcctaattaatcagcgaagcatctacctaaattcatactagtggaaccatgaatagagtacccactagttggggtttgatttatcctagggtgaacaaggtaataataacaataacaataataatgtcttaacaaaggtaaataggcatggctaaataaaacagtgataacgcgggaatttaaataaagcggtaatgcattaatttaaattaaaataattttataaactgggattcaatatgctcaaggatgatgtgacttgccttgctcagagataacggccttccgaaccttcggcgacgaccacgaaccacgcttcgggaacctccggaacgacgaaagctacgcgaagcacacaagcaaagctacaagcctataaagaagcaataacaatacataaaaagaaagcacagggttctttaggttataacaaacattaagagacttgaacgggtcgattcggagctcgtatgaccaagatatgatcatctgaagtttaatgctgttatatggagatttgcggattattataatttaagctttgcaattataaaacatgtgtaagcgctagcctggaaaagacaggaaggctgcgccgttgacatgcggaccccacatgtcaacctaaaggactgcggtagaccgagtacacagatacggtccacgggtcgacggaagcagatcccgtgtgtcaaccgaggcgagtggccgacaaacggactccactagacaccacacgggctgcacacgtggaaaccatgcggctaccgagcgggcacactaacacggtcaccacacgcacaagcgaacgactaccgacaccagtacacgggtaccggggtcgacaaccgcacaacgggcacgggcgacaccgaaaggacgaggacggggcagcgagaggagagagatccttaccaccacgcgacgaggcgtgggaacgacaacgacgaacgggcgcggcggaggcggccgggaacgacggagacgaacggcgaggggacgacttcagcggcgatccttggacgaaggcgagacgcggctggcacaaggcttgacgacgtggagccgaggacgaggacgacgacggggctgctgcacacttgacgaaacgcgggcggcgaacgcgatcggcttgacggagggacgaacgccacaacgaggaggaaggaggaagacgacgcccgacagggaggcgacgagggcagccggcagcagctgcacggaggtgaggacggcgtgggacacgccgcagcgatgcccacgacggtggcagcgcagccagacgacgagccgggcgatcaacgggacgtcgacgacaagaacgaacggagacgacgacgatggatcgcggaggggtttggtcaaaggggaggcgaggccgagggcgaccttgccgctgcaatgccgggggtggagatggcgacgtcggccggcgcactggcatggcggaaggggctgccggagagggtgccggcgggaccgagggagaggtggcgcgggcgacggcgttccggcgaaaccgaggagcagccggaggagaggacgacgccgcgacgtcgacggaggagacggcgacgtcggtcggcgtaccggcgacgaacagcagccggccggagacggtgtagtggtggcgacgccactggacgccggcggggcacgtctccggcgatttccccacgaatcggaggcagcgccggcgaagaggaggcggctgcgacgccggggaaggcgacggcacggccgggcggcgctcgggcgaggagggaaaggcggctggaggcggccggcgcgggggaaagagaagggcgacggcgggaacgcgcctccggcggtcaccgcgcaaaacggagggcaggccgtgggagaggaggcggctgcggggccgagagaggtggtggcgcgaccagccgacgcacaggcaaggagacagaggcggctagaggcggccggcggcacgggagagagaggaggacggtggggagaggtggtgaggtcacgggagagcgcgagagggggctaaaacgatagaacgaaggatggggattccattttataggcgtggggagggagccggccacgggaggagcggggaacggcggcggaaaagccggccggcggccatggaaggtggccggagttggcgcgtccgttcccggcgtttgggggcgccattcaagggggaattaagggggaaagagagaggagggaaaggggattaattccccctaatcaagtttggaattcgctgtttgaatcgcgtggattttggggaggtttggcgctaggtttccggggagagagggagcaggccgtgcgggaggaggaagacgaccgcacgtgctgcgcgcgtgcggggagcggctcggcgtgggccaggtggctgggtggcgcggcttgggccgggcgggaaggagggaggggaggggcggcccagaaggaggaggagaggagggagtgggccgggaggggaaaaggaggcccaagagaaggagagggagagaaagagagggaggagagagggacttcggccacgggccgagagggagaggggagaaaccttgggccagacttggcccaaagggaaggagagggttaattttaggtttttctttttaataaactctgataattgtttttgttgcttaataattatttccggtgctctgaaaattcaagtaaaatttgagggctccttttagaacaaggagaatttagcaaaaattctccgggccacatttgaatttttcttgtacgcattttagtgtttgccaatttcttttcgaattttaattaattctattattccttttagaaaatgatttttatttcgggatgaattattaggacgtgacaaatccaccccccttacaggaatctcgtccccgagattcgaggaggctagcaagaagataggttgggcggtcttctcttcttgtctgacttcttccgctccgtcttctataacaaacttgcctagctaaacttctccactctggactgcttggctcgatctcctcttgcagatggaatcttctcttcacctgacttgtccttggttgcacctctagctgtcttcgactgggttgtggcacttgacaatgggacttcagttccagaacttctcataattcatatctttggcgtcaacctcatacaagttacccacttcacgttatgcgtcgatatcagcttgtcattactaggataccatgcttgtcatcatgagaataccatgcttgtcatttacttctaacttgcctccaactgcctcatattagctttcctgctctccgggtgctagctacttctgctattccatgcgagggtcgataactttgcctttgagttatgtttctcaacagaaccaacttatcctacatgacatgcttcgacgtcttccaaaatgactttactgctagacttgttatggtctgatcgtgatcctgccaaatctgaagcttcgttgttagatgtggttttaatctgacctctatagactatctttgaacatattacttggttcataactgggaatagctcccacgaacaagcagctcggattcactttctttacattcagtttacttcccactattatcttcaggttgtcctcagttagcattcaacgtattcctttacacctttaaccttgatgtgttctttccagatttctcttatcaatcacctttcgacctacttctttgcctgatcataaacacctttgttggtatcttctatcaataaccttttgaactttgtcaaccaagtactcttcactccgagagttgtggatgcttctggtgacgatgtggtcctttggtctgctgactttcagtgaaaccttgaagtgtttcgccaaaagctgtactgactgtctttgcctttgatccgaaaaagacacatctgaaactcttagtccaaacaaatgtctctttggttaatcgcttgattttcttttccattatcaggttggttattaactcgaggttagaacatagttcctctgaaatgagaccctaggtctcctttgacagtaaacaattatacacataatcccatatcagcatcttctgaaagagtcctcatagaacttgtttttattacacatttctcccatattacatgaatacaaggcactgccttaaacaaaaagggaaggtgcttaacatcggtacattgtatcctcaacaggaatcatccataaacatagcaagctcactgtttatagtcatgaatatattgatttattacatgattgctgcaaactttctattacacaatgataagtagcgaactgaaaaccacaaacgtggctgctcattttgattctggagagatatagctggcattgttctaatgactgcatcatccttgattggttctgtgatgatgtgataggactgcatattgctatcattcacaggagaagcttccttctgattgctggttgaagcggataacggtcttctgctttgtatcgccctcctgaggttgattgcccttcgctcggcctggagtaggtcggggagagacacaacttcttccatcgacgacaattctttgctgaggctgtcggcccagagaatggttggtgctgaaggtattattgctatgattgattgcagagtcaggtgcagcaggaggagcattggtgctatggatgatatcgtcgatgttgctgttggagctgactagctgatgagacaatcgtagggtggttcattggatttctgcggtcttggtcaacaacacactaagttggcaatccttgggcacatggtttgtaccttcgcacagaaaacatgtgaccttgcgggtgggacactcccctggtggatggtcttcttcacaatgagggcagagtgtgagacacatgctagcaacgtgtccaatttctccacaataggtgcatgcctttgattccatctcttcctcgccgagannnnnnnnnnnnnnnnnnnnnnnnnnnnaagctccagtcatn

SEQ ID NO: 34514 - DNA, 697 bp, Oryza sativa
  unsure (1)..(697): unsure at all n locations
ccggggtgaagggcaacgcggcgccgtcgagggaggatgncgatgacaccagccgctgccccggcaagccggcacaggcggctggaggcggtacagtggcggcaacgccactgttttgccggcgaggacgcgtctccggtggtttccccacgaaacggagggctgaccgggggagaggaggcggctgcgacgtcaacggaggagatggcgacgtcggtcggcgtaccggcgatgaacagcagccggccgaagacggaacagtggcggtaacgccactgttgccggcggggatgcacttccagaggtctccacgggcaacagagggcaggccggcgcagaggaggcggctgcgacgctggaggaggtgccggcacggccgaccggcgctcgggcaaggcggtaggggcggctggagggtggccggcatggaggaaagagaaggaggaggcagggagaggtggtgcagccacggggaggacacgggagggggctaaaacgagagaacggagcgagggggttccgttttatagcggagggaagcgagccgagcacgggaggagcagggaacggcggcggaaaaggcgcccggcggccatggaaggcggccatgaatggcgcagccgttccggtcaaaatagtggnnnnnnnnnnnnnnnnnnnnnnnnnnnnnnngtcagacgggagcgcaatcacgcat

SEQ ID NO: 34515 - DNA, 6441 bp, Oryza sativa
cagctaagctagggcattggaaaaacactgctccgtgcatcataaaatagttcaaactttatcccaaataaagcaacccagtattataaaatgtgacttttaccactaaatcaaccatattaattatcccaagaagaggcaaccatgcattattcttttacctctctccctaatagccacttattatattttgggacagagggagtataaaataaccttacattattattatttttgaacatttgtttactaactaattaatcccaaagtccatacaaacaatatatgtttctaataggctttaataatccttaatttgtgagaacagtggtggactagatgacgataagataggtggctcgtaataaagagtaagaaaaaaagtaactatttcatcatagcacttaaccacctaaacttttttttttctcattttacacctcgaaccccctagcagtattttttattctctctatctaagtcaattttgctctggaaatttggtagaacatagatgcgttcacaatttaggtttcaacatttttttttaaaaaagaattatcactgtttacttaggttgaaagcacataaaacagattcaaacatcaaaattaagttcaagcaaaaatcggttgaaaaaaatttgaaaatacttttgaacttcgttaatggtgccatctatggcttctaacaaatttcagcttaaaatactgcttgtaaattttagcttaaaatacaacttgtatgacgggtaagaaaatgtatatgttattaagcactaaagtgaaacatttttaacggtttaggggtaaactaccaatctaacttcactttttcaagtttgcatttgatcctatttttcaaaattgacgttgttgtttggccgtgtttccattacacattaaggttttgtcttaaaaaaaagcatgcatttattagccaaaagtaccaaaatgcccatgagtacacaacaatcctatctctaactttcttctcatcccctttcatatcaggaggctggcgtagtggacgggcggggaacgagggagcgacgtcacctgcatgtggagggagaagagggcggcggcacacgtggagggagtaggggcgacgacgatgtgtgtgaagggagaagcagcaatgaactggtcaggagaaggagggagcgacgtcaccggcgcgcggagatagaaggggcggcgctcgtgcgaagggagcagcggtggtgacactgcgcacagagggagcaaattaaggtggtggcgtgcggaggaagcagatgcacatatcatacgtgtatatgtgtgtgtgagtgtattttatatatacgcatacttttgatgtataaaaaatgtaaacacgtatgcaaagtttgtatatttagagattcaaaaagtttatataagtatgtatataaaatttagacagatgggctgacctgatctcgcgggctgggctgaaaaaagaaaacccaagacggaaagtggacgcgcgcggtctggcgtcacttgggccgaaatggaaaacgcggggtggtggtcgcgcggctagctgcaaattagctatctcgcccaccacgaccagctctgcaatgtaaccccagctatcgtctgccctagagagagttgagaccacgctgcttagtaggttgactccgccgcctcgaccagcaacgctgccgccatttgcacacgctagctcgacctcttgctctgttgtcgtcgttctcgcttccgatggcggctgcaggcggcggatcgttgctggatcagtcgaggcacgccatgcgcagctgggtactcaagaatatgtgagtagtatttctctaataatccctcatccaattatgtgaattacttttgctgcttctgcagctttttttcccgctgttcttgtgatgaattttgttgttgcataattattggtttctttccagtttcttgattaattccttcgaattgttccatgctagctccacgccctatactagaagattctcctactacttagagcggagtatctgtttttgcgttgcctacaaatcgatcgatttgccttgattttgggttaattttcgttactttttcttgattgaggatttacatctactacttttgaaaggatttttatcactaaacggctaagattagatatattttgctcgccaggagggtagttaagagctatagccaacaagcttgtgctcgttgatttagagctgccagcaagagctaattgatcaaaagctcaagatcgagcgaggcttttgaaacttggaacgcaagatgtagatcacatacctcagctggtaacgtcacccaaaatgattaacgcgtcagcctcattgctgcaaacaaattaaaccagcagaaattaatcaagcttgtgctcgtggacggccggatcgcagtgaagcaggaacgcttcgatcggacggtgcatgttgcggcatagctagcaagctcgcgcgatcggtgggatgagaagaacgcgtagtaggttaccaaacactacggctttctagttttatacatataataatgattctctctcggctgcatcgtcttagtactagctattttcttctttcctctccttcctatgcataataaaaaaaaaactgttatgcctatgaatattactggcatgtgatcagtaggtgggggcttttcataaaagtttagcaaggacagagatttattataattaatgctatactactatgtgtgttaacataatcgtaaaatttgtgatgctatgtgtactgtagaacgcgcgctaaaagaatatgaaagctgaattagatatgtgggttgacttggaaaaagaaccagaatcggtgtttggcttggctcttggaaaaagccatgtcaaacattcatgcagctaaattgaactgctcttgactgaactgttaaagttgcatgatttatgttgcggtacaagggtgcgagagaggtttgattctcattgattgtaatgttcaatttatataaggggatacggtcggtaccgcaggggcgcaaacagtggctgagctaggaaattttcaaaccagggcaaactacttagctaaattgaactgctcttgattgattattaatgtttagctaggaaaaagctcggagtatctagtatttgctaaaatatttctaactttaatcctttcaaaataataaaaattcaatggtgtatttgatggcgagcctgggcggctgcccgtgcaagcctggtggtggccccgcttctgggtgcaaagtgcaatccatcgtgccagttgtcaagaagtgccgaaggagagaaggggcgtggccgcctcatttccttctctaccggttgtggtaatggggggcatggccaaccgcaatgcctattccatcggatggatgagatcatacatatatatttctcaacaatttcgttgtcaactactttaaattaaacaaaaataatgctttcctccgggtgtctaatgtggacacagaaatcaaattgctgtcacccatccatgcctttcccgttcagtatttcataagcaagtaaaattttcaacatggactcacgtgccttctttccgtttcatcttttggtgaatttctgtttttcagacttcggatttatcggcggatcagtacacatagccgcagtttaagatagatggtgatggtgaagttgtatgtgtatgactttacccattagagttcaaatctaatgtccatgaatactatgcaaatgcaggtcgacttttagcatggttatagtaagatcagaaatataccgctgatttccgtttatgtcttttaagcgtgtgttagaggcacattcgtctaagtgtgtagtgatgtagtttgcatgtgcattgttgtgtaataataaaataaaataaaattgaaatgagcagtttagaataagaggtagtttattgaaaaatcatatacttttaatcgcagaaaaacatatttttttagaagtgtcaaataaatactccatccgtcctaaaataactcaacctaggatagaaacctaggataggatgtccgtatccacgtacatccggacattcccatcccatccccttctcctctcatcttgtttctcaagctacaattaatggtggatcctagcgggcgcgctctctctctctgggtcatgaatcttctgatagaattcctaccattgcagcttttcttaggctatgatgcgttacaccggtgagttgtacatggctcacctccattccataatgtgcttttatgcaccagcgtaaaatattggttgctcattgggatatcgacatatcgtgcttcgtttaggctgtgttcgatgcaggagttcccaactctccctctcattttccgcgcatacgtttttcaaactactaaacggtgtgtgtttttttgaaaaagtttatatacgaaagttgcttaaaaaaatcatattgatccatttttgaaaaagagctaatacttaattaatcacgcgctaatagaacgctctgttttccgtgtgtgggttatgggttcccaacacccaccactgaacacaacctaaatgttccctactacataaaagcacgtacagaccggcactataggtgccgtggaagtgctaaaactggcacctatagatctttttcacctctgcaagctgaaaacacaaaaaaaaccgataccaatatatagttgctagataattaaagaaccgacacttataatatattataggtgcgtataaaaactgagcagagctaagctgttggtccttatcctcttgaggcagataaggggaggaggactcggtctctccccggtctcctctctctcccggtctctctctcgctctcctctctctggctctctctctatctatcgatctctctctttgtcgcttaaagtcaacaaatagttgcatcaaaagctttaattttgtctgctttgatgtatgatctcagtcctttacttccttctggattgcttcagtacttcctttgaaattggaaaattgcattgagcgtgtgtggtgatacattctgtgtgtaacaaaatcacgtgtttatgaggaatcatttaattacttgttcatcaggcaggtatagacatagtaggaacaggttctggaaacatataacatgacactaggtaggatctcattgtggcatcaattttttttgtcgacatttatctgaatttctgaaccctattctttttgttcaatcagagagaaattggcaggacattatggtgcagagttcaactctttgcgggcatttgaggacagggtattcaatgagaccagcagcattgatgattatatttctaaaatatcaacgaagatggctattttggagcgaccgcagtcttcttcaggtatgcagcatcaagggcagatgggaaatcaaacgaggctgcctactacagttatgcaagaacagccacagccacagcagcagccgcatttgatgtcaaataatcatcaccaaacacatggaggatggcagagcaatgttgcaagggtacagatgatcactggtgttggagaagtgaattggagggaggaaatgtttcagaagatcagcgttttaaagaactctttcttttccgagcttacggattttgaccgtttacttcacaattgccaaaaaacagaagaacagttgcagtcactacctaaaaagcaagctgaccaatacaagcggataacaaagctcaaggatgcggttaggagtgctctggatttattgcagctccagaagagcagcatcgatgaaggcatgaaggtgaaattctgcaagtacgaaagctccatacatagcctactcagattctacagggaaacaaaagctaaaattaatgagatgaatgcaaatcgtcataacaatcagcaagagcaacctgcaggcctgccgaggcaaagaattactgacagaactccatcgtcagctcgtcggcaaaaccgcaatgacaacgtgataggccaatcagaggataaattgcgatgcagggttgaatcagttgtagccaagaagaagcccatcgaccgcctaatcaacgctttgcggcacagtgtagaggatgaccgtacggacgtcaagaggcagaaaacacggcatgttaacagtgccctggcgaacgagatcgacgccatgaacgccaagctgatcgataccgtggttagaatcgccggtgagaaagatggtgggacagagattgaattcagctacactgcagtgtctcttgcactagacatgaagcagctatttgcagcatatgggacgtcttctgtcaagccggtgaaactattcgtccctgctgattacccctcgaaggtttctcgtgggcttcgaccaacaaccatgattgggaatgaacaccggcgaagaaatgttggccagaatctggggcttggcaacgcgggtttttactggcgccctggtgagccccc

SEQ ID NO: 34516 - DNA, 6294 bp, Oryza sativa
  unsure (1)..(6294): unsure at all n locations
ngggagttgaactgaaccgcactganatcgtgtnnnnnnnnnnnnnnnnnnnnnnnnnnnnnnnnnnnnnnnnnncttgtaggacatgtatttctgaaaatggtaactatctatctttgaagagcccaacaaagcatttagagttttattggcaaacaataggttgagctcgcaggcttatgcaatggtggccaaacagttcaattcctaccatatatttccttctgaaacttttaccggaactgaactgttttagctgaaagcaacaacatgggacgtctgcaatgcagacaatcaactaatcaactaattaagcgaattttgcatgtgttcaaaataccggaaagattttgtgaggagtatgaacagatggtgagaaatttttggtagggacatgataaaggagaacggaaggtacactcgattggttgggaaaagttaatgagtcccaaactattccgaggacttggttttcgggacattagatgctttaaccaagccttactagcaacgcaggcatggagactgttcgataatccagataatttatgtgcttgggtgctaaaggtgaagtactatccaaatggatcactaattgacacggccttcccttcaagttcatcgccgacttggaagggcatcgagtatggactagagttgttgaagaaagacttgatatggatagttggagatgggcaccaaattaaaatctagaggagtcaatgggttgcacatagggaaaacccagtgattctgtagaagaaggcctggaatcgtctcacgtatgtacatgagctcatgttgccggaaaccaaaacgtggaatcagcctttaatcagacatgtgtcacgcccagaaattcactagtaatttccgaactaatttgtgcattaaatcctcgtccaggaatcagccaaggtacacaaactgacaatttaatatacagattcatcaaattaactaaaacgataaatacttacttaagaggcacttagttctcaccatgaagaaaactgcagcggaaaataaaatctagcgaagctccggctccactcccacaggcagctcaactggggtatgagccaaacgtcttctccttctgaatcctttttcttcaactgaggtttgatggttattgcaaggtgagcatatgacatactcagcaagccacacaacaaatatgcaagtgcacaaggataccaaagaatggtataatatagggcttatttgcaaaagcagcatttagcaaacttttgagaattgtaaaacagtagagcaattaatcatcaatattaatcaacactgtacaacacacccatgctgcacaggcccaaccatcctgaacaaccatacccggctgtacagatctatctccaaaccaggaatgtaccattccaaaccaggagctaatcaaattattatcagttatagcatcttttattatggtgagaagtgtgagactaatcacgaaagacattgttagacccgcccataactgcgggcacggctattcgaatagttttactctggccagaggtgtaccactgtacccacaagacacagccccacgacatgtcaccatgcgcctcaataccaccacggtacctcggaaaggagctgtgacagtacccctcgcacaacacaatccaccacagtgcaccgttcctggatcataatcacccccttataaacaaggtatggactccccagcgacccccgtgggcttatctccgccacttctcagtctagtgctccgcaatgaaccatgctatataaaaggtaaagccgttgcccatactggcttgtggttggcacggttaatgtttcacaaccgaaactcatgaaccggtccttaattgtcatgagcacgaccatcaaaaccatgtgctcacaacccaccattatcaagttttagttgacaatttaattaattaaccaatcacgattgaccatcgtgagcttccattaaatatccataagtgatagtgaagcatgatttatcccattaatgagctaatgtttctaagcacggctaagcaactataaataacatctagctgaaccaatccaatatataaggtccatgctagtcaaattataacccataggaaaataaagtcatctttggccataattaaatgggaaaggctcaccacccaatgacattcgaaaacaatgcataagttgaaataaatcaatagctttaaacaggttcaacatgctcaaagggttgtttgggggatctgtgtgacttgccttacaaacaagcgtcttcaattcgtcttcaggaacttctccaacgaacgaacgatcctccgaaacaacgggaagtctaaacctaaaacgcaaaacaaggaaaaacactaataaaaaccaaatgaacagtacaattaaagttcataagggtagagtttgaatttagatgaattatgagacttgaacgagctcattccgagttcgtatgaattagatatgaattttacaagatttaattccaattaaacctattaaagaaaagactattccaaattgattaaacaatttacaaatgatttatagctgagacagaagattaaaacatcctccggaaaaagattagatcatatttagtagatgacatatattaaaaaggaataatatgtcattgaaaagagatgacaaatttatattaattttggatggtcaagatggcgctgatgccagcgatgacatggctgccatgcaggatcgacgaccgcaagcacgggaacggcagttaccagcgaaccacggtacaaagatgcaaacgaagggcaccgggagagagaggagatcaaggcgacccttaccaccacttacgcgaccacagacggcgagggagatggcaggcgacgaggcggcgaccttgggttgacgatggcgacggctttccggcgacgagaggcagcaaccgaagggcggacggtcttcacctcggtcctgcgatcccgagggtggtgacggtgagtgaaggcggcgatggacggcgacgaacggcgcggctgaagatggaacagatcggcttcacggtgacgacgggcttcccggggtcttcgacgatggggaagtggaggccggtcttcttctcctcgcaaactcaacggcggcagcggcgaccgaaggcgacgaccacagcgacggcgcggggctgctggagcggcggccggaggtggagagagaaggcgagcgcggggagagcgattccggcgagattcggcgcaagggaacgggtggccggggtagctctcacccttgcgaagccgagggaggcgacggcgcaggtcggggtcgaccgaggaggcggcgcgacgcggctggagggtcaccggcgtcggcggcggctagggcaaggcggcggcggcgctacaagcgacggctcggcttgggacttgaggcaaacggaagaggaggccgaggggatgctatttatagccggaagagggagagatcggctcgggaacggatggaatcggcgacggattaggtagggttcgccggaaaaaggaaggatttgatccgcgaaattggaaagaatttccatataaacttttggggatttcttgggggaaatgaagaggagattgagaggattccattcccacaactaatttggaaataggagcaacggagaggacgaatttgatggggaggcggcgctgtacacgggcacggcagggaggatatcggccggctggaggttaggggcgacactgtagcagagggggacaaaacagacttatttccgggcttcatttcctcggcccgattgaaggaggaaggcaaatagaacttcgtcagagagaggaagagaagatgcaggctcgggttgggccggcggaagagagaggaaggaagggaatgggccggattcggcccgagacaaagaagtggattttgattgactttttaatttaaataattgctgaaatgatgtttcatttattaaaaatacttataatgctcaaataattccgggaaaaatccagaaaatatttggacactaaaaatatttaataaagttttatctatatcaatttaatgttcaaaattttcatatattttattcaaacacttactttaattattaaataaattctaaaaattcctttttttacaacaatttataatatagcgattttcagggtgtgacatagtccaggaaaatgatgcatccgaaattctgaagatcaaaatacctggaagggagatgtcggactttccagcatggcatcttgagaagacaggaattttcactgtcaggagcgcctataggttagcatggaatcaatcagggaaggctcgtgtggaatcttcatctagcacggcgacaaatggtgaaaggaagctttggaagaatatatggcaaacaaatgctcaaccaaaagtgagaatttttgcatggaagctagccaggacagattgcccacttggggaaataagggcctgtttaattcgcgaaaagaaaatttttgggtgtcacatcagacgtttgaccggatatcggaaggggttttcggacacgaataaaaaaactaatttcataactcgcgtggaaatcacaagacgaatcttttgagcctaattaattcgtcattagcacatgtgggttgctatagcacttatggcaaatcatgggctaattagactcaaaagattcgtctcgcgatttcccccctaactgtgcaattagttttttaaaaaatctatatttaatgcttcatgcatgtatccaaagattcgatgtgatgtttttgggaaaaactttttgggaaccaggattcttgtggttccggggaatccagctacaggagaaccaggaacggggagctctcccctgccctaagagaaagagaaagatagaacagagtggcatatgcccgatctgcgggatggctgaagagaacgggtttcatgtacggtggagtgcactctagctagaggtttacgggaggcaatgagaacacattggctattgccggttgaaacgagttttgcatatacagggccggactggctgttagtgctgctggatagttcgcagtgttcagaaaaggcacatgttatgtatttactctggagagtttggcacctgcgaaacaacatgatccatggcaaaggaagtgcatcaattgctgatttggtcagtttcttggttagctatgaaggccaactgttgccaatccgacaacaagaagatgaccacaaaggaaagggccctatatacatggaaccgaaccagatatctctctctacaagtatcagcaaactgactgacaaatggtgtcaccgccggagcgcttcgctaaactgaatggtgacgcaggttatagggaagaaaccggggatgctagtgtcgggtttatatttagagattgcaggggtttggtgctattggcggcccaaagaaccctgcatcaatgtggctcagctgtctaggcattggcgctagcatatatcttgagggactcagagcggcgactgacttgattcacatgcccattgtgttggagatggacaatgcataaattgttagggatttaataagaaaggaacagctgaaatcggcctgggcgacgacaattgaagatattaaaggagtgatgcaaagtgcaagtgcacaagataaagagagaagcaaatagggtagcacatgttttagcacaaatggctgtcttgagggactcagagcggcgactgacttgattcacatgcccattgtgttggagatggacaatgcagaaattgttagagatttaataagagaggaacagctgaaatcggcctgggcgacgacgattgaagagattaaaggagtgatgcaaagtgcaagacttgattcatatgcccattgtgttggagatggacaatgcagaaattgttagagatttagtaagacaggaacagctgaaatcggcctgggcgacgatgattgaagagattaaatgagtgatgcaaagtgcaagtacacaagataaagagagaagcaaatagggtagcacatgttttagcacaaatgacaatgagttgtaggtcctacgcggagtggaggttgtgtgctcccgcaagaattctagacttattaaatcaggagtgtaatcccttatttaagcattaataaagctctctttaccctcatttttttttgcatgtgctagaatcgatcgcagaatgaatacgaaaatgcgtgtgccatattccgttctactccagttgggttgaggccatggcttgcgtacatggtggatttgtgggcttctcgttctgtgccacaggaan

SEQ ID NO: 34517 - DNA, 3862 bp, Oryza sativa
  unsure (1)..(3862): unsure at all n locations
ccgcccctttgatatgctccgcgtcgatgctcctctgactcgaggagattggtaccccattcacattcatattccatcacagcacagtcaattcacaaaatcaagcccatattcattcacattcccaacccattcacatatatgtcattcacatccatttttgtctccaaaccgccgacatgcatcaaaacctgcaaaaataagttataaattggaacaattttatatgttactagaaatgcaagtatatacagagacgagctacctaggactttactctaaagaatataattgtattacaaagaatatttacaaaaatcaaatgtgtgtcgcatatgcattgcaaatgttctgccattctgagacgagctacctaggacttcactcttaaacatccctttcggtgacaagatatcatctagtatgaattgtgctatctcctctctaatgatttcgaagttgatttctggaatccttgaaataaattcctgcatgttcggcgccaagttagtctacatacttgtaaatttgtcgtcctatgtgtatataaacaattgaattacacaccttagggtcgagcaatgtcaccttgtctgcgaagctcctcatgttatggcagacatggaacccacactggttgctaacttgttgacatattgggaagtctttcttgtgaccgagtttgggatgcccatccttatgcctcccgcctcttgccacgtattggtcccatgcctcgttcaaggaagattcgatggccgaccaatcgtatatttctggcttgatattggagttaaggtagtgtaccaaactccacttcggcgttattaccagaagaatccaatgtcgcctgcgaaattattaaattgccagttacatactacagttgtacgcgttgagtatttgagtataagtacggtacacgcttactgttgattgtaggcgcacataatgaagtccttgtcttgacgggcaaataagcagtccttgatataggtcaccatgtttgctcgatcatttttcagcgttgtcacgttgacgacagctggatcgagtaaggcaatatggggtgctttacgatggacatgcttccaggttaacctacaagcaagacatgagtcagggtaagcgtaatttatggacagtcgctaccatatcgcgtaccaagaaatacttacaaggagtagcacttaaggaggttggtgtcgatcgctcgcaccctatagaggtcccatagatctttgaagtctacggcgatgaaggcagtaggcccgaggaacggctgaccatcgtgctggcccaacatggaggtctctctattcttcctccttgcattggacttctccctgtagtacctgtgcaactccttgcatgcagggcccatcttgaataaggcatcgtctccgaccaatggcatgcccaatgtgaattctgctggaggctttggaggagctactggtgccttgccaagatcaagcttctttggggctaatggcacctttatttttcctctccccgttccagcagcttttctgcgtgtgtcaagcttgggtggagaagatttcgccctcttgctccttttcgcagaaggggggaggtgcggcctgctgtcaacctccataccgtcgtcccaaaaatcagtatcatactgtaattggagatcttcatctctttgttcaacggcaggagggagagatacaacagtttgatggggatgcgtcggcggcggacgagaacttggcgctggccttggagttatattgatctcaatgttgtgcttgggccattgaataaaggtcccacgtgcagccccaagggtcagaatctcgtcattaggtgggtgtgggatagtgtagccaacccaatcgggcttcactaagtccacctgaactttggcattgccggcttgctgctgcgccccatgcactcgggtctccggggtaggcttgaaagcttgaccctttgcggcaggaattgcaaatcctggtgtcaccctaacgactagggtacacgatgtgggttcctgcgatagattcattagtgtccttagtatatgttgcaatgtattgtggtgctaatataatatatgcgttcctgcgatagattcattagtgtccttagtatatgttgcaatgtattgtggtgctaatataatatatgcgttattaagttgtttttaccgttatgtggtccaccgcggcggggccttcaggctgttctgtcggagcctcagttgatgcgcagctgctacgcctctgcgtggggctcacttgtactatgggaccgggagtggcatcggtcgacctatccctgatgcgtgccttcatccgagcctccatatctaacagctcggcagtgagctcttctctaagctcttctttaagctcctcccgaagttgggccttaatgcgtgcagctttctgtgccttggaaagcttgtgcttcttgtactgccacgcgtattggaaaaacccaaactttcatggaacattggagccaatgcccttagtttgtccacggtgttcttcatttcccaacgctttcgtgcggatgtcatcctcgcgtttttgtgagcatacctcttgggaggcctgtctctcagcattcagttcgacctggggtacagttaggacgcgttagacgaagaacaagatacaacataatgaaacttattctatgtgttcaatttacgattttctggtacaccgcttgatcttcgggatttggaaacgaaagagttccgtcactattcttcttcacccttgcccttgcccagttccttgcccgctggaccgggatatcagcaagcacttgcggggtgttagattccgctgcagcttcatcctcgttgtcccattctgcctgtttccccgtgtagcctccggtgccaagccggtgcgggtgaaggttccttgcctgcagatcacggtaggtctggcttttttctcgagactctttcgtttatttggcggcatggaactcatcccacacgggttgggtgatgaatgggtatttcccaaatggttctggctgggcggggttgaggacgtactccgtgtccagcgttgtcttgaaatttttccaacaattccccatcttgcggatagcctgccgcttcagtcctgcctcggcctctgtagggtatcagaagctttccttgaactacctccaggcctcttctttttcttcttgagggaccagatcgatgtggtccttcagaatagtgaagttccgcctccctaggactccgcatatcgtagggaactttttgacagctttcgtcggagccgtcggatatccaacatcgtccacctctgttatggtgtagacttccttagtaatcttattatgggtcctaggattctggctcgatgtagtcccagtagtggtcatcgacatccgtttagtatacaattgaaaaaaattctggactttctttatagttagtacccattaaaactaaaactcaatatgcaagcatgtcacatcatcacccactagcaatttatattcgagtccatttacaatcccatccatttactatgctagcccatttagaatcccatgcaaccatgccatatcttcactcactagcaattactattctagcctattttaaatcccatacaagcattacatatcatctccaatattatattataaagatccacaagtatgtgtcaaatcatctttctcgcatttttcttcacaacattacagctttcatcattctcgacaatatttatcatatactcatcagtgaatcccgcagctaagcgaggggtatccccgggttcaaaatcgataacctgaatcccacagctcctgggcgttggatatgggttttcatnntcatggacgc

SEQ ID NO: 34518 - DNA, 1748 bp, Oryza sativa
  unsure (1)..(1748): unsure at all n locations
cggctcccnggtgaacaatctctgcgcgcacccacgcgtggggagctctgcggctccaagcttattgatttacaaccctgcatatccatcccatttcctatgacccatttaatattattcttgtacctaaaaaaacacaagtcatgacatataataagtttggcctcagttttgctcagaaattatgcttcaattatcatcatttgcaactgccccacccccaaaagaaattaagaataagtgtagagggtctgtccttatgcaaaaaagaaacaagtgtagaaacccacatttaaacctaaacaagaacaagagtgaggccggcccaacaatgcatccattttgcaaaacatcccatactgccactcccccccaaataaaatgaacaagtgtagatacaaaacagccataaaaaacatacaaaaactcacaattcccccaaaataattcaaccatcacagcccacatcaattcatccatcccattggacccaaaatatcccaaaaatggtatgttcttgagcaatcatcactggccattcatccatcatagcccacaatatttcatcatcacagcccacatctaaacaattttcccaacatcccattctcccccaaattcacaaattcatccatcacagccatataaaaatttatcactagctaacacatataggaatgcacaagtcatcacagccatataaaaattcaccactaggtaacacatataaaaatgcccaagtatcacagccatataaaaattcatcactagctaacacatataaaaatgcacatgtcatcacagccatataaaaattcattattagctaacacatataaaaatgcacaagtcatcacagccatataaaaattcatcactagctaacacatataaaaatgcacaagtcatcacagccatacaaaaattcatcactagcacaagtcatcatatgtagacattagcatctaaacattgaatcaacaaataattgcactatcacattatcgaatttaaacattatcatcgaatcatcaaatcatcacatataacatgtacacaacaaatcatcacattatgcatcatcatcggtgaggagtacctaccttgcacggtggcgggctcggtgaggaggttgacgtgggctcggggacggcggtcttgggcggcaccgggctcggggacggcgtggagggaggcgccgggctcggggacggcggtcttgggcggcgccgggctcggggacggcgtggagggaggtggtggccgttggggaggccggatcttgagtggccccggcctcggggacggcggtcttgcacaacggcggcggtcggcaatcgatagagggaggcagcggcgtggaggaggtcgacgtggcggctagcacgaggtcgacggccactgggcatagatctggagaggaggatgtgggacggccgtggttggtgaggccggatcttcgagagaggaggaggcgacagcgttgaggacgaggaggtagcggtcttgaggactaggcggagaggaagccggcggtggcggtcttgggcgtggaggacacggacttggaggaggaggaggcggcgtcagcggtggtggaggaggacgaggtggcggcggcggtggatctgagagagtgagagtgtgagagagtgagaggcggcgtcggnnnnnnnnnnnnnnnnnnnnnnnnnnnnnnnnnnnnnnnnnnnnnnnnnnnnngagcaatcagatatactaatccgcgc

SEQ ID NO: 34519 - DNA, 699 bp, Oryza sativa
  unsure (1)..(699): unsure at all n locations
ctgcccgatttaaaattgctatgacatttgatttatcacatataatgaacaaatgtcttatttacatagttcaaaattcctattaattttttaaaatcatataattgacaattgcctttctcacatatagtttaaaattcctattaattttttaaaatcatataattaacaattggctctctgacatatagtttaaaattcctattaattttttaaaaccacataattaacaaatccatttcttcaaagagttttaactggaatggcatgaaacatatgcaattcattcattaaggctccaatacaaattaaatacatcattcacagtgatatgccttccgaatggtctaaacaaacgtaagccacttcgtcttcgggatcatcgtcaaggtcgatctgaggtctgacatgaagattcttgttgtattcttcttcatcgacaacgttgtccacccccacaattcttcgcttgccatccctaacgacgtgcatcttcttttttgcggggtcttttatgtagaaaatctgttcgacctgcttcgctagtacgaatggttcgtctgcgtatccaaccttggccaggtccactaatgtgaagccttccttgtcgaccatgacacctgtgcggatattcaggggtaccgaattcctcgcccctagactagcatagcacgccgcgtcganagcnnagcaatcaan

SEQ ID NO: 34520 - DNA, 869 bp, Oryza sativa
  unsure (1)..(869): unsure at all n locations
ttgtgtannaaggactgacgtgctnnnnnnnnnnnnnnnnnnnnnnnnnnnnnnnnnnnnnnnnnnnnnaaatttaaagactttggaaaggacgcacgaaacatatggtttggtttaagtacagatggcatgaatccttttggagagatgagcagcggccatagcacttggcccgttacgatatgtatctacaacctcccccgttggctatgcatgaagaggaagtacataatgatgccgattataattcaaggccccaagcaacctggtaacgacattgatgtgtaccaaagaccactggtcgaagatcttaacctgttgtggaagaaggaaggtgtccccgtgtgggatgaggacaaacagaaggagtttaacctacgaactctgctgttcgtaaccatcaacgattggcctgcacttagcaacgtatccgggcagtccaacaaggggtacaaggcttgcactcactgtatggatgaaacagaaagtatgtatcttaagcactctaggaaggttgtgtacatgggtcatcgtcgattccttgcagcaaaccacccggtacggatgaaaggcaagcactttgaatataaggcggaccaccgtacgaagcctaaacatcgcagcgggaaaacagtgtttgctatggttaaagatcttaaagtagtgtttggaaaggggcctggtagccagcctatagagagcgaagatggtcacgcggcgatgtggaaaaagaactctatattttgggagttaccctattgggaattcttggacatccggcacgcaatnnnnnnnnnnnnnnnnnnnnnnnnnnnnnnnnnnnnnnnnnnnnnngatatcaaaangtttatcaggttcaaattggactc

SEQ ID NO: 34521 - DNA, 1310 bp, Oryza sativa
  unsure (1)..(1310): unsure at all n locations
atcncaatatggtcaaagacataagcaatgagtttgggaagaaaagaaaacgtagcaagacaaaagagaagggtaggtggaagaaaaaatccatattttggcggctaccttactggaaagatcttgatgtccgtcattgcattgatctcatgcatgtagaaaagaatgtgtgtgagagtttggttggcctgatgttgaatattcccgggaagacaaaggacgggttgaacgtgtgccttgatctacaggacatgaatattcgcagcgaactccagcccatacgagatgcagagacaggtaaagtgtacctccctccagcctgccacacactgtcgaaggatgagaagatcgcaatgttatcatgcttgaaggatattaaagttccatcaggctattcagcgaggataagtaagtatgttaaattggacgatctaaaacttgttggaatgaagtctcacgattgccacgtgctaatcacacaaatcttgccatttgctatcagaggcattctaccaccgaaagtgcgtcacacgatccaacgtctgtgcgccttcttcaatgcaattggatagaaggttatagatccagaagatctagatgggctgcagatcgatattgtaaataccctctgtcacctggagatgtttttcccactgtctttctttgatataatggttcatctccttgttcatctggtgaagcaaacaaaactatgtggcccggcttttctaaggaaaatgtggccgtttgaaaggtacatgggagttctaaagtcgtacgttcgtaacagagctaaacccgaggggagcatcattgaaggttacacgaccgaggaagctattgagttctgtgtcaattacatgtccgatgccgatcctatcggagttccagcgtctcgtcacgagggaaggttgtcaggtgttggcacaatcggaaggaaaagaattaggcccgatcaagcgtcgtacgcgtaggctcattacgctgtgctccaacatatggcagaagttggcccatactttgaggagcacttagcgaaaatccgagatgagaacttggggcgatctgatgcatggattaacagagaacataattctcggttcaacgaatggttcaagaatcgtgtgacaatgtccacggatgtcccaaatgagacagtacagttgttggggatgggaccatcttggaccatagacacatggcaaggatacgatataaatggatacacattttannnnnnnnnnnnnnnnnnnnnnnnnnnnnnnnnnnnnnnnnnnnnnnnnnnnnnnnnaangtgtcttcatcacgcg

SEQ ID NO: 34522 - DNA, 629 bp, Oryza sativa
  unsure (1)..(629): unsure at all n locations
aatggataaacgtcgacatctnnnnnnnnnnnnnnnnnnnnnnnnnnnnnnnnnnnnnnnnnnnnnccatctaggtcttctggatctataatcttctgaccgattgcattgaagaaggcacaaagccgttggatcgtgtgacggacttgtggtggtagaatgcctcttatagcaactggcaagatctgtgtgattagcacgtggtaatcgtgagacttcattccaaccagcttaagatcctccaatttaatgtacttacttattctcgtgcaatagcccgaaggaactttaatatctgccagacatgatagcattgcgatcttctcatccttcgacaatgtgtggcaagctggtgggaggtacactcttcccgtcttctcatctggaacaggctgaagttcactgcgaatgttcatctcctgtagatcgagacgcacattcaacccatcctttgtcttgccaggcatattcaacaatagccccagcaagctatcgcacacattcttctctacgtgcatcagatcaatgcaatgacggacctcaagatcttcccaataagggtagccccggcccaaaaaaaaaataattgtgggaatttttttttttttttccccctttttttttacccc

SEQ ID NO: 34523 - DNA, 873 bp, Oryza sativa
tatctttgaggatcccatgcatatctggatcattcttctgagcctcggggatttgatcgagcaaggtaggcttggcttccagcgtagccaagaatccacgaccaactatgcttaggttcagggcttccatctgttgattaagttcgggtggaatgccacggacgtcaagagtgttgcaatggctttttcgacttagagcgtcggcgaccacgttggccttaccaggatgatagtgaattcccacatcataatccttgatgagttctaaccatctcctctgccgaagattcagatccgacagagtgaagatgtatttcaaactcttatgatcggtatatatttcgcagcgattcccaatgagataatgccgccagatttttagagcatgaaccacagcggccaactccaaatcatgggtagggtagttgccttcatgaggccgaagctgccgggaggcataggctaccacatgaccttcctgcatgagcacgcaccccaatccttggcgcgaagcgtcacaatacaccatgaagtccttgcgagtatccggtaagattaacactggcgaggaaaccagcttttctttgagagtttggaacgctttctcgcattgcgggctccacacaaatttctcttctttcttcaacaactgtgtcatgggtcgagcgattttggagaagttcacgatgaacctccggtagtatcctgccaaacccaagaagctgcgaatttgagtgactgtctttggttgcttccaatcagtgacggcggtcactgtttcggggtccacagcgactcctttagcagatatcacgtgtcataagaatttgactcggacaaccagaactcacactgctaagcttggcatacaat

SEQ ID NO: 34524 - DNA, 1459 bp, Oryza sativa
actgatagtagcttcggatccaagctgatcgatggggaacccccaagatcatgttgattatgctgtgcaccatgctttgatcaatcagtctggaatattagtcaacacggggtcaaacatagtgaaaacaatggttgatggttcaatggctgagtatcaggctaaaggaccggtttatctaccaggagaggtgttcccaaattatcggccattaatcactgataatcagccagctgtccattcaattcctcttaatgcaccatcggctcagccgacggcgccagtatcggctcctgcacctgctgcaccaccatcggcaccgggccagttagttaatccccggttgttggtgagagaacaaccacagcatagtggatagaatgtgaatcggctaacacaagatcaggttgcggctatgttcttacctcctcaacctactgttgatccgacccagcagcagccgattcagcaaacaccaccaaggcagcagattgtgcaaccgattcaacaaacacccccaatacaacaggttgtacagccagttcagcagacgccaccaagacggcaggttttgcaaccaattcagcagacgccattaaggcaacaggtcattcagcagattcaacatcaaggcttgatgaatgcatcggctgggtttacaacacctggtagtcagcttgggcagcatgctgcaaatcaagttgtcccagagcacttggttcatcaggtacaaccagatcaaacggtgatacctcaagttgttcccgagcatttggtgcgcaatattcagccagattttcaaaattaccaggggggcaatttgaattatcagtatcagcctccatcaccgcaagttcaatatcagcaggaagcatcgtctcaaccccagtttgttcctcaatacaatcaattcgagcccatgtcacaacaacctcaaggagcacctcaacaacaaccatgggccgatatgattgcggatgtgatgaaggagaagtttgggcttaggccgaaagacgctggaaatttgtaccggtagccttaccctgaatggtttgagagagtccctctacctaatcagttcaaagttccagatttttcaaaattctcagggcaggatagtacgtcaacttatgaacatgttagccgatttttagctcagtgtggtgaagcatcggctgtggatgccttgagggttcggttgttccggttgtctttgtctggatcggctttcacttggttttttttctttgccatatggatcgattaacagttgggctgattaggagaagcattttcacagctatttctacagtggggtacatgagatgaaattgtctgatttaacagcaatcaagcaaagacatgatgagcctgtgcatgagtatattcagagattgagagatgaggaataagtgctacagcttgaagttgactgatgcccaattagccgatttggctt

SEQ ID NO: 34525 - DNA, 712 bp, Oryza sativa
  unsure (1)..(712): unsure at all n locations
gcgctggtgagcttcgaactcgatcccccnnagactngggaattcggtacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctgacaccattgccaacttaacctacacacaggatcaacgatcttgtaagcaagttaaaccgattgttattaccagaatgagttgggcggtaatacttacaaggagtagcacttaaggaggcatgtgtccaccgctcggagcctgtagaggtcgaaaagatccctgaagtcgaccacgatataatttgttggaccaaggaatggctttccattgtgctgtccaaggatatcggtagctttacttggcttcctggcattagatttctccatgtagtataggtgaaggtccttgcaagcggtgcccaatgtggcaagcccgtcatctccaaccaatggcatacctagttggaactcctgtggagcgacgtan

SEQ ID NO: 34526 - DNA, 1904 bp, Oryza sativa
  unsure (1)..(1904): unsure at all n locations
aactggaccgtacctagaaagatgaagttgagtagtagtgttaaaacacgcggnagctattaggcgtgtaactcggcccacggcccacgcccagcccccaccacgtcgtatcccctccttttttttcgtttttttcttttttcccgggtgtatttcccttttttgcgatttttttctccttttctgattcttttttttttcgcgccaactagcaagtttttaatcatgacttgaaatttttcaaatctggatttgaaagttttcgatctcgagttgaaaatttttaaatctcaagttgaaagttttcaaaattttcaaatttgaacttgaaagttttcgaatctttagatggaagtttttcaatcccaagttgaaagattttaattccgagttgaaagttttcaatcccgagttgaaagtttttaaaatctcgagttgaaagttttcaagtctcgagttgaaagttttcaaaccctagttgaaagtttttaaaatttgagatgagaagttgaaagttttcaaattttgacataaaaaattcaaatttcaagttaaaaagtttttaaatctagattgaaagtttttaaaatttgactttccgtgtagatctgtatttaatcttttacttgaaaaaaattaggacacgaaaaattaccaagaaatcaaaactagttatgacgctaatcacagcgttaatcgtgtttttattccgcgctaatgacacgtggcctccccggggtgaaaatggcgaaaaaagcaaaagcaagcgatggcctgggaggttgggccgcgtgcgtgttgccggtgcacacgcgccaactaggaatctccgttaaaacatgggttgtttttttggaaaggccaaccaaaaacctgaaagcccataaccttaaatactcatgataattgataggaataagttcatttcaagtccctcaaaaccggtgcaatataggtcccatggcggtttggacagcggttttaactcacgtggcgtctattgactcgatctttttctgacgtggcattgatgtgacatatgaagcaaaatttaataatttaaaaattaaaaagaagggcccatatgtcaatgcctttccctcgtagcagagccagcggcctcaacaggggaatccagcagctgcggcaggaggatgaggccgacctatccaggcggagtcgtggcacccggaggagtcaggcggtgggggtggtccccctggtcgatggcggctgcggtcaggtccaacaacgacaagggatagcgagaaggcagccaacgtcccaggtagagcccggaggtgcggcgaaggggacgaggccggcgggagcaaataccggtaaccgagatccgaacaggacagcacggtggaggaaaagcagcaaagttgggggcgccgaagccatggaggctgatgccaacagtgacctgggtagagaaggtgtggaaggcgggacgcagcgatcctgctgatggacgacgcatgttggtgacagagatgagctgccgagagctaacgggggcctccaaatctcggcgatggtgcagacgagacagaatggagcagatcagcacaaatcctagcaatgctgcgaggcagcagacagagcgggatgtcctggagctgttcgtcggccgcacaccagtcaggtccaccgaaggcccctcctcgccggttgcccacaccagccgcgcactggtgagttgagttcactggattcagatcggtgccactccttacaaatggggctgtgccaccgcaacagggcctcaccaacctcaaggctctctccgtgctcggcagcgtcaccagnnnnnnnnnnnnnnnnnnnnnnnnnnnnnnnnnnnnnnnnnnnnnnnnnnnnnngnnatgagggtctacaattcacaaannnngacatca

SEQ ID NO: 34527 - DNA, 801 bp, Oryza sativa
  unsure (1)..(801): unsure at all n locations
natcacggaagcttnnnnnnnnnnnnnnnnnnnnnnnnnnnnnccgtgccagcgtcgcgccgcccaccgccggctgccgcgttttctgcgccagatccacgccgctgcggccacccgccgccggccgtcgcggggccgagcgccaaacacctccctaggacagcggatccggcccctcccgagggcggcgccactggatccgcaaccctcgtcgcctgccgctgccacccaccgatgtcgtcgccgcccatcgaagccgttgccgcagccgctccctaggtcgcggcagtcgagcccgctgccgctcccgcccgccgccgccacccgtcgttgcccgccacgccgctcgagcccgcccgccacccgccccgatccgcgctgctgtggatgagacgaagtgagagagagagagagagagtagaaagtgtgtgagagagaggagaggaagagaagataaggttggggtgaaaaaaaattgtggatttttttttcaatgtaaaaatcgattttttttgtatgtgtctgtttaaaactcattttaaggaactaaatcaacgtatatgaaaaagttgtcaaaattaaagttgtataacttattgagatctaccatttttcttttggtcatttctccatccgagtttgattaaactatataaaatttaaatattaaaatataagaaattcaaataatttttcggatagtaaatgatttcaaatgaaaaaattgtcaacaacaaagttgtataacgcattaacatctacaactttcgttttggtcattttttatatgactaggnttgt

SEQ ID NO: 34528 - DNA, 851 bp, Oryza sativa
  unsure (1)..(851): unsure at all n locations
tgaattngagcttnnnnnnnnnnnnnnnnnnnnnnnnnnnnnaagcaaatcgtctacttgcctcttgacttctgccaactcattggctgccattctataaggtctcttatggatcggaattgttcctagtactaaatctattctgaactctatatcccttttaggtggcataccaggtaaatcgtctgggaacacatcgggatactcccggactataggaatctcttccaaagtcatttggttcagacttgaccttaaagactcagaagacaatgcatgaacaattacaacttgaccatcattgctggtgagagttacttttctgttggcacagtctatcacacctttatatctggctaaccagtccatccctaggatgacatcaaggtctttggattctaacaggataagattggccagaaatgttacttcttgaatttctattctgacagaggggctacgttgcaaagagagtgcttgattacttggggtactaaccatcaaaggacgtctaagatcttctacttccatcccatgatttcccacaaaactcatagataaaaatgaatgtgtagcaccagaatcgaaaagcactgttgcaggaactgagttgacaaggaacgtacccaaaatcacatctggagcaccttgagcttctgcagcggcaacatgattgacacgggcctttaatgctggtgcggtagagttgctctgggcagggacaaccttcacgcgtcggggcttcggacacttgtcagagtaatgtcctgggtctccacagttgaagcacaccccgggcttgctgccttgctccctcttggcaggctggtgctgtgttggagctgcaacag

SEQ ID NO: 34529 - DNA, 6464 bp, Oryza sativa
  unsure (1)..(6464): unsure at all n locations
tggaatannnnnnnnnnnnnnnnnnnnnnnnnnnnnnnnnnnaacttcctaacactcaaaagcaaacaaacgcatgcacttacatcccaccactgatgtaaatcacatgcgagacacacacaaccaaacttaaacaaacaaaccaacacaacgatctaagacaacagcttgacaaggcactctaggtcttccgggcatcggagttgattgaaggctcgttcggctcgtctccatcatcttgagtagctccccactcgacctttgaatgggtgcgcttcgattcttctccttcatcatcacttacattgacgaccggaggatccgctagggctagggtaacttctttctccgccacacggacctttggcgccatttggtagcgagggacaaatagagctctcttccttgccgtaagacgaatcctggccttctgcggtggtgcttctcccttcaacgcggctagttccttctccaaacgatccaccttgtcctctagcttgcaaatcttaccacgattccggtcttcacgatcttgagctgctaacacagtctccgcgcgggtctcatccatagcccacagcatctcaaccaaatgccttgtggtagcatcattctcaatcctctcagtctcaaggtagctgccacggtcacttccctggggttggcgaggatggtagcgatactcagtgtcggccaactgatcactgtagcgatcgcggagctctcctatggcaatccttgccacctcctgacatgcatggatgtagtttcctcctccagcttcgaacatcactgatgggatatcttcactattactgttcaaggtgactttgactcggcacttttcttcgtgacgatcatgagaaatctaggcatacaaaggggcagtcccaaatcctatggcaaaggacatcgtacgcaactcctggacaaatccctcaacaccaaacaggtactcaggcttgtagcgcggcatctaaagacaagtgaaaggagggagttatgacatttatccaattaatagcacaagtttttggattaagtaaaaggtaagtaaataaagtaaaccaagcttgcaagataagttgaaacaaggtcacaaattttgtacttttgaacaacagattccaaaagaaaataaaagaaagttataaaatcaacatgctaaatttatttcattgcagcaagataaaacaatgttgtaaaacatttgctggtaaatgagccattagtaccgtaatagatgtacagtactaacaacactggaataacttttgaatgagaaccactaaaagagattatgaagtgcatgtgctattagtttggtttaattaaaaaaaaagaaagggaggagaacagttctacttttccaatagttttagagggcttctatgggtaaccatttggcataacctagggtcaaggggctctgataccaacttgccacgcccggaatttctatccaaaattccaaactcttatatgtgtgtgaaccctcgtccaagaatcagccgaggcacacaataacaaattgataatagagtacaattattactctaattaataagtgaataaaatttcattacagaggtagatagttcctctcaatcaataaagatctaagcagcggaaaaataagataaacggcgcagacgactccactccacaggcagcttgaccagggctacacctaatcctccacaccatcagcatcaccgtagaactcttcctttgatgaatgattgcaaggtgagtatatgacatactcagcaagccatgcagcaaatatgcaagtgcacaaggataccaaagaatggcataatataggactcattngcaaaagcagcatttagcaaacatttgagaattataaaacagtagagtaattaatcatcaattttaatcaacactaaacagcacacccatgctgctcaggcccaaccatcctgaacaaccataccgggctgtacagatctatctccaaaccaggaatataccattccaaaccaggagctaaacaaattattaccagttatagcatcttttattacggtgagaagtgtgaaactaatcacgaaagacattgttagacccgcccataaccgcgggcacggctattcgaatagttttactctggccagacgtgtaccactgtacccacagcgacccccgtgggcttatctccgccacttctcagtctggtgctccgcaatgaaccatactatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaaattttagttggcaagtaattaattaaccaatcacgattggccatcgtgagctatcattaagccatcattaaataatagtgagtcataagttatcccaatagtgtgctaatgtttctatgcatggctaagcaatcatatctaatatctagcttaaccaatatatatagcacaactagtcaagttataataacctaaggtatcaaggaataaagtaatcaagaacaaaagggctataacaaacaataggttaattccacccaatgacattcgaaaataaatacaatagttgaatggaaacaatagctttaaacgggatcaatatgctcaaagggttgtttggaatgtgtgtgacttgccttgctggccttggaactcttcaaattcttcttctgcgaaaacgaactctccggaaacgtcggaatctaaacagaaaggagcaaaacaccaaaacagcacataaacaagcatgaacagtacatgtggatatttttaacatgtagatttcaattttagaaaaatttagagacttgaaccaactaaatccgagctaagatgaattagttatgtatttttaaaaattaaatcggattaaaacacttatatgggtattaattcaattatgacgcaataatgaattatttttgaaaaggaaaagggcattattgcgtcagcggctagggttcgcggtaaaccgggtgcacggcgacggctcacgaaaacaaacggcggagatcgatcctatccaaaacggacgcccaagatcgatggacgacgacgataacgtcaccggtgacgtcaccaccggcggcggctcacggatggacgacgacgatgacgtcagcggtgacgtcaccaccggcggcggctcaagcgtgcaagctcgccggcgaacgacggcgcgacggcacgaacggagggcaccagcacgtagagggcgacgcggcgaactcaccggtgaccaaaacaacggcggaagatccaagaaaggagacggcgtcgagaaagagcggcggcgacgattggcttgacgacgacggcggtgttccggcggtcgacagcgacggcagaggggcggacgaggacggcgacgcgacggcgaccacgatggcgacctccccgagcgacggcgacgactggagcgacggcggcgcacggctggagcggcggcgacgacagcggcgcgaggtctcacggggctagggcgctacggacgacgagagacgaaggcaagggtggcgacgggtagcggcgggcttgggggtccttatataggggttggaaggcggcggcgaaggtaagtctagggttcggaggagagagatcgatccgaatcgaactcgaatccacggatttccaaacgaaattagccgacgattccataagagaatagatagaggggatcccggggatcatttcccctctattaatttcatcggaaacggaaaggggcggcgcggctcggctagggttcggccgggcgacggcgcgaggaagacgacggccctgacaggtgggccccacctgtcagcggcgaacgcacgcgcgggcggactgggccgactgggccgaggaagagagagagagggttttgggccgactttcggcccaaagccaaaagagaacttttaaaaccttttctaatttaaattattcatgaaatgcaattccatttattaaaaatacttccttagctcaaataaatcccagaaaaatctaggaattatagaattaagcaaagtttttaatgaaattttatctggccccattttatattggaattttttaattaaaattagatcttctcttctaggcttttaaaataaattctaataattccaattaaacaacaatttatatatttaggatttttagggtgtgacaaatagtttatattattgaccgaatacaatagatcatatataaagtggtataaaattaaaactaatttaaaagatgatgtttagagacctttgatttgatattttaatatattataggtctagcttaattgcatacccttccgtacacagtatattgtgcagtattatattttctttattttttatattatacgaaatctattttagacggtcgtgttttccaccagtaataagtacgcatttttttggctttattaatttttatagtacgtagatgtttttttttcttccggctaactgtaggaagcttcatttgtcttactaggtgataccccgcgctttgctgcgggattcactgatgagtatatgttaaatattgtcgaaatgatgaaagttgaaatgttgagaagaaaaatgtgagaaagatgatttgacacatacttgtggatctttataatataatattgtagatgatatgtaatgcttgtatgggatttaaaataggctagaatagtaattgctagtgagtgaagatatggcatggttgcatgggattttaaatgggctagaatagtaattgtatgggattttaaatggactagaatagtaattgctagtgggtgatgatgtgacatgcttgcatattgagttttagttttaatgggtactaactataaagaaagtacagatttttttcaattgtatacttgcgtacattcttttatgttttctttccttttcccagccaccggttccatattttatttgtaaaaaaatgtatcacatttttaataatagatctaatatggtttaaattagcggcctagaaatatttgtgggagtgccacgtggtgacaatagattttttaaaagtttaatggactttttttaatatataacagatagatagatagattacacgtgctactttgtggcttgtggctactaattgtggtgcatataaagcatgcagttatttttttttctttgggattatatgtgccgatcctaacataaaaccggaacatataggtctaccgtagatgcgctgccatgctataaatactgcgacggatcatgcaagatttgccatccaacaaaacgtgggtagtgagtagcagtagtagtattcagttgccgtcaatggaggattcccctgtggcagtggccatcccctggtttgccctcgctgccgctacggctgtgctagcaggagctgcttggctgataatccgcgcatgcaaagctgatgaaagctgctgcaggctgccgccagggtcgaggggcctccccctcctcggcgagtcggtcgagttcttcgcccggagcccatcccttgagttgcttccaggaattccgcaccccctcgagaggtgactgaacaatattatgcgtaatagtttgtgcgttccttcacatttcacttttttaagcttttcggtggcctccaacgtgcagttatattaattgttctggccttgcatatatatgggcctctttctattaatcataggctcccaatatactccatcggatggcctaatcagctaaagaaaaagctaaattttgaatttttaaacttaattttgagattgattttaagatattttcaatgtagtttcttttttagcattggcttttgagtcaccaagaacacatatataaaagttttacttacaaatgttgaatttgcatgtgtgaattattggcatgtccatgtggtgtttttagattacccaagtactatattaagtcacataaccaaattttgggacttatttagtcaataagaaatgtgagggactaaattgactctgaaagaagaaattaaagttcaaggatcatatatatagattgttcactctataatctaatggaccctaagagcaaggctaatatctaagccagctacgtgctagctctaattttatacatgtcatatataaatagctcaagagataacttttacaatagaagctctatctacttaagcatattttacttagaaattttattttattatactttataggaaaaagtacgaattaccgtactgaactatcgcggtcgatcgaattaccccataaactaaaataccagatattttatatcatcaactatttaaactagacaaannnnnnnnnnnnnnnnnnnnnnnnnnnnnnnnnnnnnnnnnnnnnnnnnnnnnagctataggttcacaaaanggnnntcaaangcccg

SEQ ID NO: 34530 - DNA, 2054 bp, Oryza sativa
  unsure (1)..(2054): unsure at all n locations
caccgcagacgcacgttcaagaagatgaggggggagagaaagaaggggtagggattttgacaagtgggccttagcgattttgttagaaaaaaaaattgctgactagactgctatgtgggctatttgaaccctaaaccactcgcaatagtgaggggggttctgtctgtttttttgagtttacgggggcaattcgatcgaggggtaattatactttcacctttattatatggtgggtcccactatcctatctccccttcctttttttttgtcctttttgctcttgaagagcaatgagtggtggatagggtctttggcccaccatgagttagagattgtggtagaaccggcgcttatttagtcgtctttttctttctctttcttcctctctctattcatactcacctaaataatctcattcgatatttcaatataagccagctgagtaggattgttaattatacctacctaagcatacgatattcatggatggatgtatatacatgctaattaattggcataaatggatcaattttctgcaggtacggcccaattttcaggacaaacataattgctcaagacatgatcgtgtcccttgatccggagctgaacaacttggtgttccaacaagaggagaggctcttccagtgtggtacccgaactcattcatgagagtcttcggtgcagatagcatcatcacgacgttcgggtcctcacacaggcacgtcaggaacctggtcctccggctcttcggccctgaaaacctcaggcgagcaatgctccaggagatgcagaaacgggctcaggccagcttgctctcctggcttgatcgtccgagcatcgaagtgaaagaagaagtctcaagtgtaagcatgcacatatatgcatgacctcaattatgatatatagtgtacgacatgatatatcattggatctaattgcttgtttagcacagtagttaaaagtctaattaatatatgttgtacattttttaatattatttataatcctggcagatgataatattcagcataatagcgaagaagttaatcagctacgactcttcagcatcaaacgggaagttgtggaaacagttcgatgcattccttcaaggattacttgcaggtaaacatataaaatatatagagtggctttacctttcaaataatgtttagatagaatatgtatatacacgatcgatcatgacaatcaattcgatcactgtatatatatgcagggacgaaaaaatgtcatgaggatgttgagagaattgctcgacgagaggaagaagaagacagcacatcaattggaaagcatcgacttcttcgatgctttgattgatgagctgaagcaggagaagcctgcagtgagtgagaacgtcgcgttggatctgctcttcttgctgttgttcgctagcttcgagaccacctcatccgggatcaccgcgatactcaggtttctaacggacaatccaatggctttggaagaactaacagtaagtgcaaggaaattaactactactctgatactacgtactagtagaactagctactgatgctttccttctgtatgtacattgctctgttgttggatatggacatatgctttctttcctgaaaatttaattagtatttgtggcgatgtgttagaaataattaagacttaattattaaagtattgtgctatatgcatttgctgataaaatgatactaattgatgccttcaggaggagcatgatcgcatcctgaaacgaaaggccgatccaaactcccaaatcacatgggaggaatacaagtctatgaaattcacatctcatgtatatgcatattacctttcagtctttttattactgcttgcttaatgcatatttgtaagcatgacttcatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgatgaggcaatatcatcaatcccatg

SEQ ID NO: 34531 - DNA, 2370 bp, Oryza sativa
  unsure (1)..(2370): unsure at all n locations
atgatatgtnnnnnnnnnnnnnnnnnnnnnnnnnnnnnnnnnnnnnaaatttttggcatacatccaacttcgatcaattgctacaaaaaaaaaacaaattagaggcacatattataagatcagtattgcaaaagtaagacgtgatgaaattgctcaattaatgatttatattactcatttgattgatccattttgatcacttttgggaatttaatttctgttttccttggaaaaaggacaaaaaaatcgccccctacagcctcccaccaaaatagtgaacagtgggatacagttacactaggtggtggggggtatttatactgtgcaacaaatatctgtaacggccctaaaacaatcaaccgtgacgggcatacaagtaatctctatcgggccttaataaaacgccgtcaaaaaagagtgtcatctgtgacgggcaataaacttatctccatcgggcctctagttggagcccgtcacagatgaccctcatctgtgacgggcttcttttagggcccgattgagatatggaaccctcatctcaatcgggcctcaactatagccccgcacagataagtgtcatccgtgatgagctttagttttatgccgatataccatggttgtgcgaccatatctcaatcgggcgaaacttcgggccggatgagaatacttccttgtgacgggctgcaaattccagtcttgttatgggccgtcacagatggaaagatctgtactagtgtataattaacatatgtaaataccacgtgcatgatttaaaacctttaaaaattctaataatcatatataactagcatatggatgatttcaatttgattaaaattctaataatcatacataattaacaaaaaaatctaataatcatatataactagcatatggatgatttcaatttgataaaaattctaataatcatacatatttaacatatgccatacaacaattgatttgtatggatattcagtacatccaatatagtttacatcgtgtacagaacaattacggcaatacatcagcggtgacggttgaccgcacgtactttctcctcactattgttccttccttgtgatcgctacgtgagtaaggggtgtcttcatttgataggaggatgctagggtcaattgtcactatgaaagggggttgcccatcaaactgatcgtaatcctcgtcagtcttgtcctctactccaacgatttttctttttcctgggagaaccacgtggcgcttcggctcgtcaggccctttgccctttttttctttgctagacatgtccttgacgtaaaaaacttgggttacatcattggcaaggacaaaaggttcgtccgagtatccaaccttgttaaggtcaaccgttgtcatcccactgtcatcaatcgttacgcctccaccagtcaacctaacccattggcaccggaacagagagaccttgagaggtccatagtcaagttcccatatgtcctcgatggcaccgtaaaatgtgccagttgtactatcgtgttccatggcatcgatacgaacagcactgttctggttcgtgctcttcatgtcttggaccctcgtgtagaatgtgtacccattgatttcatatccttggaatgtcgcgatcgagccagatggtcccctcgccaggaaggccagttgttggttaatcgtctcattacccatgagatattgtttcagccacgtggagaaagtatcaatgtgatgccttgtaatccatgcatcggacttaccgatgtttctggcgcgaactagagccaagtgctcctcgatgtagggagccaccaatgaagattgttgcagaaccgtgaaatgggctttatggaataaattgttgtctactgtcattattgctttccttccgagagtcctctttccccgtagtctcccttcatggcgtgattcaggtaccccgattgggcgaaggtcttcgataaattctacgcagaattcaatgatctcctctgttccataccccttggtgatgcttgcctctggacgagcacggttacgaacatacctcttcagaacgcccatgtacctctcgaaaggaaacatgttgtgtaggtacaaaggaccgaaaataccgatctctttgacaaggtgacaaagcagatgcgtcattatattgaaaaatgaaggtggaaatatcaactcaaagctgacaagacattgcaccacatcattgtgcagggcttctaatctatcaggatcgatgaccttctgcgaaattgagatcatgaaagcacatagctttgttattgttgcccggacattgtttgggaggggaaccgaattcctcnantctannggggcntgtggcccagcggagttgcattcaatnngggccgcatg

SEQ ID NO: 34532 - DNA, 3593 bp, Oryza sativa
  unsure (1)..(3593): unsure at all n locations
atgggcccattgaaatgacatccgctnnnnnnnnnnnnnnnnnnnnnnnnnnnnnnnnncgttgcatcatgtcttagctttatagtcgtggcattccattttccaatcctaccttaacacgggggagcaagcgttttaattaaaaatagatcatttcggaatttttttaaataggtccttgacatcagtgtcatcggcaccggccctcttgatatgagtaacttagccttcacggagagtgatggggacggtgcacgggagagtgatggggacggtgccaacgttataggcgctgtcatattggaccacatcgcctataatactgacactgtgaaatgagtctatttctaagtttttaagggtgtatttgtaaaataatttttcaaaaatgtctagaatatgaaaagccggcatagtgtcggtggccgaccgagagctgcgtgtttgtatacgcgcagtcggatcttgcgtcgacaaaggggggtcgataggtggatgcatgggtggtgccatcctacctgccgcttccagcggcggagccaagggccggctagcatgggcaggtgcctggactccgccgcatgcagccttgcattagatactaaatacggtgcttaccattagtctagctacacatgcatcattagattagcactaattatcatgattagtctttagccacaacccaattttacttttatccatgataaaatgttaaaatctataacgagaagtctctcgatttggtcttacacagcaacgcctggcgcggcattcgatttagtcgagaagcatcagagtttagaatttgagagaagcatcatagtgttaggcatccatatcttttttcccttcttaaaaattttctctcaaattacttatccgatctactatccgattacactattttgttcattgtaattaaatctttacaacaagtctcacacgattatattacgttgaaaaactacaaattacttttataatatatctaaattacttaaggtttcactaaattacttcttaaacatataaaagtaatacaataaagtctaaaagttatttacatatattataaaaataacttaagaaaaaagaaagtaactttgtcatgacattagaagtaaatccgttgtagggataaaaacataactctatctagaaactaaattaatcagcacaaattacggaattgactaaaaacaataataaaagtaatcacctcatagcattacgaatgtataggaagtaatttaatcaaatctaaaagtaatttatatatatgataaaagtaacttagtatataataaaagtaatttacaaatataatttttttattaaatataatcatgtaagatcttgttgtacatatttaattgtaacgaacacaacagtataatcggatcgttgatcagataaataatttaagagaaaaatttatttgaaatttagatggataatgaggatgcaggtggcgggtgctactacttaagaagggtaacgggttgatacacactgtattatttttgtaaaaagatggtcactagttagcacttacgagtgcatgcgctctctttagtcgcacgtaaaatattatatgtatttacttgttagtttgttatctatcattagatttgatcatgctaagaaaaaaaaaagaaccttctgcatccgccactggcggctgccatgcgtattggccggggcctggggtggcgtagtggggaaatttcatgctgtactacagtggagctgctgtcgtgcggggaattaatgcgggcagggtcatcagagtacggatcgatgatcgcccgagaattttttggttgttggattggagagacctcgcgtttcgtcgcgtgtacgtatgatattaaccatggacgacgcgagaatacataatgcggagcccataaccaaagtcatcgccgtttttaaatttcatcgtacaaccattatctatattgcaatatggaaacatcgtacatatcggtgctgcgatacgtacgattctttctacgactgttgtacgctgaaacacttctctcgtagcatttgttagggctctacaggattgaaaaaatctatgatagaaaaaaaaataaaggaatagaaatgaaattcgatcggccgggtagaaaaccaaggattacaaaatacaggactttggaagattttagactttggatgtgcctgggaactaacgtaggaagtaaacagcaattaattttttctgtcgtcattattcatcgatctaatatccttcacattactggagaatatatgggtgaacactcattttcatgcagtggtggctcaggaacaattcgttgggtggtcctacttggcgtcccaaattaccatgatgttactacatcaagtcaaatatgtcaaatacagtgaaaatatagttcaaatatagcaatatatatcagaacatcacaaattgattaaaaccaacattttcagttcaaagttacgaaagttacttcctctgtttcaaaatgtaagactttgttgcattgttcacattcatatagatgtttatgaatctagatatatatgtgtgtctagattcattaacatctatatgaatatgggtaatgctaaaaaatcttacattatgaaacagatgaagtacaaattaatgagataaacaaaaattgcactacaatgtctccattccttttcatgtctcactgcaatttttgcactacaaattaatgagccaaacaaaaattttccaatagcactactatatttgactactcactaagttgttgctcaaaaaaatatctaagtttcagttttcattcatatttttttatccacatttttcattcatcaacgaccaatctattcaaagtaaaaactaaggctactcatagtgagcaagaaataagtaactcacctatgcactaaacaggggccggcggcagggggctcgtgtcgctcatccgtctcgctggctcgggcatcatggaggggcagcagggtgcactggagcagatcagcagagccgtcgagcgagagggacccgatgccagcacagcggtgggggcagaatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34533 - DNA, 717 bp, Oryza sativa
  unsure (1)..(717): unsure at all n locations
atttgtcctgaagattaagactacttatagagctctatctcacttcacatgaattggttaaaacggttttatattgctatgacagtattttaaataattaaccaagctaattttgattccaaaatttcatatccttactcctgtaaaaaggtggctgcactactacagaaagggtaaaaggtgccggttcggaaaccctaataggtgccggttttccctatcggcacaaaggaggcggcactgatgatacttgtcatcggtgccggttctagaaccagcacctattacctaataggtgccggttctaagcaaaaataccacgtggctatcaaataggttcaaaaccggcacctatttggtcctaataggtgccagttctaaagcaaactgccacgtgggtgtcaaataggtgccggttttgaactcaaaaccgaccaaataggtgccggttttaagccaaattgccacgtggctgttaaataggtgccggttcaaaaccggcacctattaggaccatattggtgccggttcaagcctaaaaaccgacacctatttgttgggtcaaaaacaataataatttcagtgaattcatccattcaaccccaattccatataaacccaaattcatccctacagnnnnnnnnnnnnnnnnnnnnnnnnnnnnnnnnnnnnnnnnnnnnnnnnnnnnnnnnnnnnnnnnttgttatcaaaggccgt

SEQ ID NO: 34534 - DNA, 1107 bp, Oryza sativa
  unsure (1)..(1107): unsure at all n locations
tgccccttataaatcactacgnctnnnnnnnnnnnnnnnnnnnnnnnnnnnnnnnnnctctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatggattctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagccctgagcattcaggtgttgtttaacttaggtcctgtctctgtgacaaaccatgtatttattatgtccctacacatgcataggtgagtgaggatatgttaaacctgactcaaattnnnnnnnnnnnnnnnnnnnnnnnnnnnnnnnnnnnnnnnnnnnnnnnnnnnnnnnnngttagataaacaatgcgcgg

SEQ ID NO: 34535 - DNA, 593 bp, Oryza sativa
  unsure (1)..(593): unsure at all n locations
tttgatccttgcnattgacnncccnnnnnnnnnnnnnnnnnnnnnnnnnnnnnnnnnnnnnnnnnnnnnnnnnctttcttacgggcgggggngttagcggcagccgcgggcgcggctagtggagggcaacagtggatgggcggacggcgcccactggcgaatggaggtctcacagggagcttgacgcagccccttcttctcattggcaacgccgtggacatggccatgactacccgggcgcctctggttgacacttgacggacgcggtcgacggacgagaacggcttgacggagggacgaacggtctcgacgaccgggaactacgagaggatgactacaggaaccggcgaggaggcgatgagggcacccggcactacctgcacagagactaggacggcccggaacacgccgttaccatgacgacgagggtggtggtgcacttagacgacgagcccccaaggactaacgaccgaccggaggagtcttttttgacgacgagcggagacgactataacgaacacaggcggtgttcggatggaggggatgcgtcgcctatggcaaccttgactcttgaaagcctgaggaggagatgg

SEQ ID NO: 34536 - DNA, 637 bp, Oryza sativa
  unsure (1)..(637): unsure at all n locations
tgggtacnnnnntttgaatttcntttcgannnccnttgnnnnnnnnnnnnnnnnnnnnnnnnnnnnnnnnnnnnnnnnnnnnnttacggccaagttcggtaagagtgagagttttacagtcaagtaaggcgtggcaagccaacgttaagctgttgagtcgttttaagtgtaattcggggcagaattggtaaagagagtcgtgtaaaatatcgagttcgcacattttgttgtctgattattgatttttggcgaaaccatttgatcatatgacaagatgtgtatctaccttaacttaatgattttgataaaaatcattaggggattcatcagagctaaacattaataatcaatcaagagcagttcaatttagctaagtagtttgccctggtttgaaaatttcctagctcagccactgtttgcgcccctgcggtaccgaccgtatccccttatataaattgaacattacaatcaatgagaatcaaacctctctcgcacccttgtaccgcaacataaatcatgcaactttaacagttcagtcaagagcagttcaatttagctgcatgaatgtttgacatggctttttccaagagccaagccaaacaccgattctggttcttttncaagtcaaaccacatan

SEQ ID NO: 34537 - DNA, 9721 bp, Oryza sativa
  unsure (1)..(9721): unsure at all n locations
gtgatgaagactcttnnnnnnnnnnnnnnnnnnnnnnnnnnnnnnnnnnnnnnnnnnnnnnnnnnnnnnnnnnagtatgctgaggtaagttctcatcggctagatctccttttctcgcatcagattgatttcccctcccctcatcttgttttcttcttctctattcttgttcgcatctgtagcatctgtccaatctgattgcgattccaagtctatcgcatgaggaacattatttcctcggtccgattggcaatctagaccctactgacttcatcatcggcaaaaccaatagaatcccctttagattagccaaccctaatctaggtcactggaggaacaccttcaagttttggccgtctctcgagaaaaccacccctgagaagagttggactacatggtacaagcgtgtatcggctagcaagcaaacacattgggatgaaattggaatcggtcaagcacttgccctcactatagcaaattcagctaaagatgaacccttaatggccgccgccacctacttctggtccaatactatcaacacctttctattcaaccaagggccgatgacaccaactctgatagatattactatgatcactggtctagatgtatcctcattggctaatcccatgaacctgaacaccaaaaaccaatacgatttcaggaccaaaagcatatgtggttggtctggatatgtggcagcatatatgggctaaggatctattactcctcgagagcatgtggcctttttacttatgtggctagaaaagtttcttttctgcgaatccagctgtggccctacaaccaactgacagtttgcagccgaagctcttgtgtcaaaaagagaatttcctctaggtaaaatcctcctcggctacttataccaaatgctgaacaatgcatctgccaaaatagccgtcggctcggtggttggagcaggtggaccatggtggttgctacaatcttggctcaacttaatggtcatgaaagttgtcaatcggccatcagtgacagaagccgaattcccaaggctggagccgattgtagaagatggtgaagaacgcactcatcgtggatgcatgtcatatggagaatatgcatccacaccaaccgatgccggggcaaaactatcagctgaactgctcaaggttggttttgcagtttttatgagggctttcagaaagatgcccgggtctggtttccctatgaagacttagcagacattcagctcccgttggactttagatttgaagatatcaatcatgaaagataccaaaagtccagggaagttttctcaactgcaatcagcccatgcatcctacctgtcggtattcatcaaggaagaaacatccaagtctcttataaattctatcacccaatgagatcagccagacaacttggaatggaccaactcccaatcggcttatttttcgccgataagatccagtgccgaggagaaatttcattaaccttgatgatggattggctgcttaatctccaaggacctcctctgggcagcattgaaaatatcgagctggcgggattcaagagcaaaaactttgacagatgattgggtgaatggaagttgcatctattccaccaaccggcctcgatgtacatgacagatctcttccctgatgttatacctcaggtaaaccttgtcattattaatctgaacaattgtcagccgattcataacttgactaatcttttatttatattttgcatacaaccgaatcttcccctccacatcaaagcaacagtggcagagacactgaatatgccccaggtctgattcccaatggaggtgggccatctcctcccgtcatcggctatcatacccctaagacttgaactcttctccaaggcctaatcagagaaccagccgatgcaggaaagaagagaagaaccaggtcatcggctgtggacacattggctccagccccaaagaagaaggccaaactcaagaagcctaaaccaaccgatgacctgcctgccctagatccatccattgaacaagctctggatgaagaagaaatcggcgaggatattgaccaagccgcagatgaagtaagcgatactgaaagaacccatcggcttcacctaagcaaacttctccaactccttctgctccagtccatttttcaaaggtaagcagctttctttttgcaatcccctcacttatagccgattactcatagattttaaggttgcagaagaagaaaattgctatgaagaagaagtcggcagcaccaattcccaaaccggctccaccagtaagatattcttaattcttttaatagtcgatctcaaccgattttccttaatacttatctttttgcagcctcctcctccttcttctcctattcagcaaccatcaagcgatcacactccatcggctgcagggagttatcatgttgaagaagaagtacaaccagctgctcctaccatcccagtaagtcttgtctataaaaaacttgaatcgaccaaataactcatgttgagactcaatctttaaaattccttcttgcaggccttagcccatctgttctctttcgatattaaagattatcttgatgaagaaacagaagaagacactactagcaagtctttagctcccttgtccgataatgtgaagaaaacccttgaagacatctctcatcggctagaggcatcatcattagacagcttagtggtaaattgtgggccaattaggactcggttacatgaggttcaagccctaatcccagatgaactagccgatgtcctcactccggctgtctaccttgagcagcatcaggagaaagccaaactaagactagccgaacgtcgggagcgcaaggatattgaagccacaatccaagccaatcggcagcttgtgcacgaagagaagtccaagcttgatcagctatctgagggcccgatcaaatccaacattgatcggctcgaggctcacaagattgagctcttggcacaacttgaagaatgcaacaccgagctggatatggaacacaaaaagctggccgatcttccaaaatctgtcgaagaacagaaggcaagactaaaatcggctatcaagaatgttgctgatctcaccaagtctttgaaagtcattcctagaaccgacactcaagatgcccaagccattgaagaagtagaacaaatgaggcaaagggctatttcagctatccaacaatatttgtctcggtgactttctatgtaatagaccttagaaatttttgtaatcggctaagatactctggtactttattgtcttgacaatcctttgtgccgattaatataacttctaaatttgctcaaaaattttcatttttcgtatatatgtgcccccctaattttacaatgtcaaaagcattgctaaaattataaaaacaactaagggcgatataaccatatcgaccatctgtacatcggcaaaccacaaccgattacaatatgaaaaacaactaagggcgatataacaatatcggccatctcaaggcgatgcaaatacattggctatcatgtatcggcaagcatcagccgatcatgcgttaacccaaacacttgggtaatatttcttcaagtacttgccatttagtgctcttccataaacttctccatcgagtccttgcaacatgtaagctcccttagacacaactttatagatttggaacggtccttcccatttcggcgaccacttgccaaatttgctatcccgagtcccaatcggcaaaatcaacttccatacaagttcaccttccgaaaaatctttgggcaccactttcttattgtaatgccgagcaactcgctctttatccttggtaacctttgcaagggctcgcaaccgtgattgaaccagatcttctctctcatcggccataaggttataatactcatcggctgttaaattattttgcaactccgttctccttgagccgattctaacttcccatggcaaaacagcctcatgtccataaacaagcttataaggaggaacttggatcaatccatgacaagccatccgataagatcataatgcttcggccaaccaagtatgccattgccgaggataatcagaaatcttcctcttaatcaatttgatcaagctcttgttagatgcctcggcctgcccattagcttgtgcataatacagtgaagaattcaacaatttgatacccatgctatcggcaaactgaacaaactcatcggacacgaaaattgaacactgatcagttgtaatggtttgaggaataccaaatcgatagattatatgctcttgaacaaactgtatagcatccccagaatcaactttcttcaaaggaatcgcctccacccacttggtaaaataatcggttgccaccaatataaacttatgtcctttactcgatggtggattaatcatgctgatcatatcaattccccaacctctaaatggccatggcttaatgataggattcatagccgacgccggtgctgtcacgcccagaaattcactagtaatttccgaactaatttgtgcataaaatcctcgtccaggaatcaaccgaggtacacaaactgataatttaatatacagattcatcatcataataacgttacatacttacaaaagaaaagagaaaatagtagtggaattacggtctagcgaagctccggctccactcccacaggcagctcaactggggtataagccaaacgtcttctccttcgcaacttgtcttcaactgaggtttgattgattattgcaaggtgagcatatgacatactcagcaagccacacagcaaatatgcaagtgcacaaggataccaaagaatggcataatatagggctcatttgcaaaagcagcatttagcaaacatttgagaattgtaaaacagtagagtaattaatcatcaatattaatcaacactgaacagcacacccatgctgcacaggcccaaccatcctgaacaaccatacctggctatacagatctatctccaaaccagaaatgtaccattccaaaccaggagctaaattaattaccatcaattaccaaattattattaatgagtagtgtgagactaatcacgaaagacattgttagacctgcccataactgcggtcacggctattcgaatagttttactctggccagaggtgtaccactgtacccacaagacacaactccacaatatgtcaccatatcatcatgtgcccatgctgaacatgtcaccatttgtgtagttgtgacaagacccctcgcatagctcaactcaaagcagcgcacctttcatggatcgtagtcaccccctcaaaaaccagaggcatggactccccagcgacccccgtgggcttatctccgccacttctcagtctggcacaccacaatgagccttgctatacaaagtgtccagccgttgcctaggctggcttgtggttggcacggtcaatgtttcacaaccgaaactcgtgaaccggtccttaattgtcatgagcacgaccatcaaaaccatgtgctcacaaccaaccattatcaagttttagttggcaaattaattaattaaccaatcacgattaaccatcgtgagctaccattatcatgtccatcattaagtaatagtgaaacattagttattccaatcgtgtgctaatgtttctaagcatagctaagcaattatactaatacatctagctgaaccaatatataaagctcaactagtcaaattataagcccaaggtatcaatggatagagtaatcaatgcaaagtggccataacaaaggaatagtttcacaccacccggtgacattcaaaaataaatgcacagttgaaataaataaagaatttaaatataggatcaacatgctcaaaggaattgtgtttgggatctgtgtgacttgccttgcaataaaaggtcttccattaatcttcttggatacttccaacgcactcacgatccttcgaaacgacggaaacgacaagctaacacgcaaaacgagaaaaaagactaataaaaaccaaataaacaatacatataaagtaaacaaacatgtagatcataattttagatgtattataagacttgaacggcttcattctgacttcatatgaattaattaccaattttacaagaataaattttaatatatagatctttattttatacaacttttgcaacttggaccacattaaacccggttacaatgaattaggtatgaatttttaaacattaaccggattaaagcatttatatgggttttaattgaattatggcgcaataaagaattattttgaaaagaaaaagagatttattgcatcatcaaggacggtccacggtaaaccgggtccacagaagcggtccatggaaccaacggccaagatctaattgacctaaaattgaccgaatcggacggccgagatcgatccggtctaccacggcaaaggcttataaggcgctgacatcagcgacgatgtcatcgccggcggcgactcggcacaccacgctcaccggcgaacgatagtgcggcggcgcaaacggagggcaccaacgcgtagagctcggctcggcgaactcaccagtggcttggacaacggcaaacgacgacggatgatgaaggcagcgaggtcgaggcggcggcggtcttcgggtcgtcaatggcggcggtgctccggtgggaaacggcggcaatggagggctggccgaggttcttctcctcctcgcgaacccgatggtggcaacggcgatcgaaggcggcaactgcaatggcggcgctgcgcggctggaccgacggcgacggtggagagcttcgggtcgacggtgtcggcggcgctccggtgatctgtggtggaaaaggagaacgggacgaggacggcgacgacctcgcgatgatgatgaaggagactgtcacgaccgagaaaaatacattttcccgaacgctagtgtattaatccccatcccaggaaaagccagggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaggacttcatctccaaagcttctcttactgaagggggggggggaaagattgagcaagaatgagtacaaccacagtactcagcaagccacaccggcagatgcatgattaatgcaagggggtacaaggggtaataatataagggttaggttttgcagtaaacagcatttaaaagtcacttagttgcccaaagccaattttaaaaagacgatcctagagctacacagtattattaatcaaggccgtgcacccacacgaacctgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccgagggcgcgtctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggtaggcaggactgagcccccagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgcttcgcaacagaggcccgagcttaatccttatagtacccgaggtacgactaacaaaacccaaccacgcacctcgagcccagcctaaagccattttgggggttttgaatagagggggaggtgtgtgtccaattctaacataagccaaccattccatagtgtccaaatgatatgagaattcccaaagtctaaagttataaaaccacctaatgttgcctaattaatcagcgaagcatctacctaaattcatactagtggaaccatgaatagagtacccactagttggggtttgatttatcctagggtgaacaaggtaataataacaatagcaataataataatgtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcagagataacggccttccgaaccttcggcgacgaccgcaaaccacgcttcaggaacctccggaacgacgaagactacgcgaagcacacaagtaaagctacaagcctataaagaagcaataacaatacataaaaagaaagcacagggttctttaggttataacaaacattaggagacttgaacggatcgattcggagctcatatgaccaagatatgatcatccgaagtttaatgctgttacatggagatttgcggattattataattaggttttgcaactataaaacatgtgtaagcgctagcctggaaaagacaggaaggctgcgccgttgacatgcggaccccacatgtcaacctaaaggaccgcggtagaccgagtacacagatacggtccacgggtcgacggaagcagatcccgtgtgtcaaccgaggcgagtggtcgacaaacggactccactagacaccacacgggctgcacacgtggaaaccacgcggctaccgagcgggcacactaacacggtcaccacacgcacaagcgaacgactaccgacaccggtacacgggtaccggggtcgacaaccgcacaacgggcacgggcgacaccgaaatgacgaggacggggcagcgaaggagagatccttaccaccacgcgacgaggcgagggaacgacaacgacgaacgggcgcggcagagacggccgggaatgacggagacgaaaggcgaggggacgacttcggcggcgatccttggacgaaggcgagacgcggctggcgcaacgcttggcgacgcggaggcgaggacgaagacgacgacggggctgcagcggcacacttgacggacgcggacgacggacgagaacggcttgacggagggacgaacggcacgacgaccgggaacgacgagaggatgacgacaggaaccggcgaggaggcgatgagggcagccggcagcagctgcacagagacgaggacggcgcggaacacgccgctacgatgacgacgagggtggcggcgcagcgagacgacgagccggcaaggacgaacgaccgaccggaggagtcgtcaacgacgacgagcggagacgacgataacgaacacaggcggggttcggatggaggggaggcgtggcccagggcaaccttgacgctgcgatgccggaggaggagatggcgacatcggctggcgcacgggcacggctgaaggggttgacaaaagaaccttcgtgaggcgggaggcgagaccgacgcaagcgacggcgttcctgcgaaaccgatggaaa

SEQ ID NO: 34538 - DNA, 2869 bp, Oryza sativa
  unsure (1)..(2869): unsure at all n locations
ggaagcganccgagcacggaagaacaagggaacgncgcgaaaaaggcgnnccgncgnccatggaagncgcccatgaatggcgcagccgtccggtcaaaaatagtggacgattaagggaagattagggggaaaagggagagaaaggaaagggaattaattccccccaattaattttggaatccaacgcttaaatcgcgcggattcgagggaggaacgaactagggttttcacgggagaaaaaggaggccgtgcggaaggaggaaaacgaccggcgcgtgggccccacgcggtcagcgcgcgcagtcagcgcacgcgcggcgcgcgtgcacgcggctggctcggctcggcctggcttgggccgggctgctgggcctaggcaggccgggaggaaggagaagggagtggcctgcccgggaggaaagagagaaaaacaaagggaggggagagggacttggactgcgggccgagggggagagagggagactttggtccagacttggcccaaagggaggagggggattatttttagctttttctttttaataaactttgttaattgttgttgttgtttaataaatattttcggtgctctgaaaattcaagtaaaatttgagggctccttttagaccaaggagaatttaacaaaaattctccggaccacattcgaatttttctggcacgtattttagtgtttgtcaatttcttttcgaattttaattaattctattattccttttagggaatgatttttatttcggaatgaatttatcaggacgtgacacgcaccatctagagcttgtttcacttctccatccttagaagaaccggtcccaggaacatcagcaactaccttcactttgtatttctgaaccaatgtccccttgcaggtctccgtgaatgagctcaagaacttattccatgcttgctgcatcattgtatcaaggtctttttgctgctcaggtgtcaatttatccagagtgatgggcacaatgttggcttcatcaatctcagataaacctagctccgggatcttttctttaacagagccaggaccagccgaggacggcgatgctggcagtttctcggccatggggaactgctgttgtgattctgacttctaatgggtcccaccaggcatgccaaaagcgtgttgatgaaaaacatgatgcctaggagatctgcttaactgtagtgcaggtccaaaactcgccttcgggtatgttagtgtgccagttgatttgatcctgcaatcaacaagaaataaagacaaagaaaccatggttaaatccataaacgatagccgatcggctaggtgccgatgacatatcatttatctttgcgccgatgtcatatatgtatcgatcgacagttataaataaaaaagaaggaactaaatctactcgatcggctatagatattaacaatatatactccttatatcgatatatacttaaatcaagtgattgggatagatcggtcgccatgccgagacagtataaatcacttagatcgaaatatatattaataatgagactatatatgttcatagcatagccgatcagatagatctagcatgtatcggctaatactccgataccactctatattaagatattaaagcaagtagaatatatcaaacaaaagtctaatatacttaaatgcgatttaacatgtcaataaagcatataaaacaaatgtagttaaatcaggtaagatcggctgaaaccacgattctaccctaatcggcgaccaagaatcaggctagagattgagattctaatcacgactcataagatcaaactcaactgatgcaactataagtatgaaaagaaggacaatatctagacaatcaagccgttggaagtttcatagagtggtggataccttatataatctaagtcaacgtcgatatctaatctaatcgctgccctctaccgacagatgttagccgattgtagattagatagcgatattgccagagattatgtaagatatatgataactcaacgaattacataaacaagattagagtatcataaaaatggaagcactaatcccaagaacgcaagccgtcataacaagttttacctcttgttgaagatcgaaaccgatgcagctcaacccgaaagcaagaactagtcgaaataaaactaaagcaaaaagggtggcgatgcgccgagattgtattgaacgtgtgttaaattgattacatggggcttgaggtctatttatacccgagaattacacaacatgtccataacggacacgactcttatctctaacaaactctaagataccataagtctttgcggcagacttttgcctaaacatatctctatggaaattacgtaaaatatcctaactaatagatacaattgtcttctcaggactctatccatgcgtggcaatcatcttgaagcatatcaactcgacctgatgtcgtacaccaagtcgtactgtcggaatcgttcgtatcacctgacccagtctgactcggactttgccgatctcaatcatagccgatccgaactccatccgattcttaatctgtttccgcaacgatcctcatctttgattccgcttcgatctaaccttcctctccgatactgatattactaaatttagtcgttaacacatgccccccaagtctggaatatttggtaatgtttcggatttgccatatatcgactccgagcaagattcgcactctgccgtttcccgaccgttattccagcgctttaaatactaaccgtcgctctcgaaaaatcttcactccgtcacttccgttttcannnnnnnnnnnnnnnnnnnnnnnnnnnnnnnnnnnnnnnnnnnnnnnnnnnnnnnnnnnnnnnnnnnnnnnnnnnnn

SEQ ID NO: 34539 - DNA, 6016 bp, Oryza sativa
  unsure (1)..(6016): unsure at all n locations
cggggcattgatgattgaataacnnnnnnnnnnnnnnnnnnnnnnnnnnnnnnnnnnnnnnnnnnnnnnnnnnnnnnnnnnnnnntattaccaaatttagtcgttaacacagtggcccaccttgcttccgcagcatataactccaaataatgatatccagtaatctaaacatcacgcttaatttaccaaatactactttaatatcatcgtcatgacttagagtcatcataaatacgatcattatacccacaccattgcatctcccagataagctagcattataataaatgtaacttggatatataataaatttggtattcatatactcggaaagtaatacaataccaaagtactataaagaagaatattctaataaaagtacaagtcttacaaaagaaggaaaaactactagagccatacccgaattcttccgaagactccgaggactgaagattctattctatttctattccactatgctatagagactatactaaacttgagagatgtatgaagcttcttacttgaggtgtcttgaaatggagagagtgaggggtttatataggctggtaatgatggttatgatggttggaaaggtcgataatacccaccaaccatcattgggaatcaatcccagctgtctagccaaaccctgcatccatcggtgttgcggctggttcggccgaacccctgggctggcccaaccggctcagttcctggaaggcggcctcctctcttgttgctcacttcagacttgtgaattttggcccaattgatcgtgtcatttctgagttcttggcctatccttccacaagtctgattctcgacatcgtccgattgattgatcgtctattttgatgccgattttccttcattttatgtttattctctgtaagaggttagtaattctagtgctagtggaatatttattatttgaacacaaatatgcattgcaagcataactagttctcctttattttggtagtattgacgggcgaaattgatcgctaacgaccgtaaacagatatgcatgtatggagaatatggatctctagttgtccaatgtgttccatgtacaacgatatcttttcatggggatttatggctgttggatcaaaaaaaaagtgcagacgcatttgttatcgttgaagttaggggtgcaagtgctttcccatgaacccgcttataggcaaaactagtgcgtaacccgtgggtttgaatcgcgggttacctattaatgggtttatggatcgacccacttgcatacctagatgcggcaagtaggggcacgatgcgaaaagccatgaattatcatttatttgacctataaatgaactcgtgggtcgacccgcttgcatccctagttgaagtaatagaaaaccacccacatccacccctcatttaatgatagacaccaagtataatttgtggaagaagagagtataaggacatgcaagttaattaatattatacattcatgttaattttcaaattggctacatatcatttcactaaatagaaaaaccatcattctcaggtccgtcttttgcttaggtgaaataggattttcccatcactatcatcttctttaaccgatggtgatggagtagaactacttgttcaccacggtttcatgtgcaaaccctcatgaactggcagtgatactcgttttttcataccatgagccgagaagtgaggtaacatatgttcttatggaggaatcacttttaccacaacaagaaggccttcgacggaagagaagggtttttgttacaaaaccaaccccaaaattaacatcgaaaaccaaacatggaagaaaacactatagaaagattcaaacacaatgacgatacttaggcacgatgtttgttaatgtgatttagccgaagcctataccgccaagacatcgactacggatgctcatcaccgatccaacatattacagtgtatctgagttacaacaacctcggccggacactgctggcagccgctccctctcactatactaagtcgtcgtacggttataataggtctacccctctacttaagagtgagcataggatagagtccgacttttactatattcctaacacttgtacaactccaagtcacaaactgtaacctactacctacgcatattcaatacaaactccaccttgaaaaatacgccacaccaatatgaatttgtcccatgcatgaactctgtgaacccagacttgtgttgatcctttcgttgctcacatcgccccgacaagcctccactaggctcaccataaacaagagactccactatccatgtaatttcttcctcttaactccatatacaacagtgatccaccttctttcctatcatcacatatgtcttgccaagcgaaattgaattcctccttaaccggtacatacctgacttctagacatgaagagaaccatttctttcttccgtcttatgaaccgagttaacaaatccaatatccacacttctcgcatccatagattgaatctatgataatttgataaaattcaccattgctttgaattacccgaagaaattaccactataatgtttgctcttcctctttagtgatgcaggttccatatatccctattatgcaaacctgtagatcctgaatatgaatatatcatgtactaccgaacagacccattgaagcaatcaacgattttcccccactgttgtttggggcttctcgataattcccatgttgcttccgctgagtcatgccttgacttaaccagtcacctttgccttgctgcatcatacctccttttgcatgtcttgtggcccacgagacacaaacaaacgaaaaagcaagcatgtccttcaatactggagcagccacctgtttactaatctccatccaactaaaaactttcaattcaaatctgaaaacttttcaattcagatttttgaaaacttccaacttaaattttcaaaatcaatttttattactttttagaatttactgtagctcttagcttactacttgtaattcaaattatttattattttattattaaaaactacagcttagccctaaacgctgcgtttagcattaagtgctttgtttaccatctagaagggccatgtgtgtaggtcacgatgctttacttagtgccttctagaaggaccagcgtgtgcatgacttatatagatcgcacactgatgcgctgataagcacaccccatagtccacactccacaaccactttgactcggccaaacaaccacacggtcatagccctttagggtataaaaaaaaaaaaaaaaaaaaaaaaaaaaaaaaaaaaaaccctcgaggcttgcgagctctaaacaagccgagcttgagcttccattgagcctagcaatatataatttttgttgttatttaataaattaggagatcaaatatgttatttgttagcatcccatacaataaagtatcttgtattagcatcatatattaattttattcttttttcctattctatcaatatgatgaactataaatcaatgttttttaaaaaagattatccatgaaatatacattgtttcacttacaaatcaagctcgagcttgatcgacttcagaccaggcatgtctgaaagctcgaaagttttatagactcgacttgagctcggctaaagcttgtatcgagctcgaacctagtgtagacccccgtttttataacaggaatcaatcgtgtaaacagtatcatttctctggatcaagtagtctggtacacacgagttcatagctgaaataccaaatgcacatacatgagagtctagtgctaattattacatcataagcccgcaggcatggtcttaaatcattgaaccgagcggtccggaatacattccaaaagcagaggtagataaggtagcggaattcaagcagcggcatgccattgccacaggcatcgaccgtactaagacctactgagcgccatcgtcttcatctccctcctggtagtaggcatagggatcctccgaagtttcatctcccgcttctgattaattttatatttgcaagggtgagtaccaaccgtactcagcaagccaccacagcaatgatgcacatgacagaggaattcaaaggatggctatggttcttttgcgcaaagcaagttttgtaattcttttctcaagcctaagacctagcatagactgttcaagttttaataccagtgttcatattaaacaatgacggttctgtccaccatccattgtgatcccaaggatagcttcctgccattgaatcgtcatagttttctgaggatgtccaccttccctcctctcgggaagtggctccctcagcataaaattcatcatgcaatatcccatcccccacaagttaagaatttagagtctacccaagtgtaatacatgttccggtgctcaataaccgcgagcacggctattcgaatagatttgttttactcacactgcagtggatgtacactttacccgcgctccgcgactgcccaacacatgagcctcgtcccaacacatgagacgcgtcacggcaaagcctttcgataacctcgcattggcagtacccgctccatgaactttagccctcatgcactctaggcgtcatacgtttctagcagtgagaggagttctggcgctcccgggaagggaaaaacacacacattcctacgttgcttcttgtcgttgaacccagtccatcatgattgttctcttatgggtatcctcatgtagtattgccaagccagcctctgaccatccggaacgggcatccgccatccacctggccatccacctggccatccgaaccgggcatctgccagcagactgcttgccgcatcacacacctaaaagaagaccactacgcatggtactgcctccgctcagctatctactccgctaggtctatacccatacgagaagtgcggttgtacgggggtcgtttcatgcttaacttcatggctcggtccttaattgaccagggacggcactagccttttccggacaccacccaaatcctccggccgccccagtcgaaaacagttgtttcactttattttcctttcacaaatcatgtcatcaatatcatggcaatgtggcgctcatgtctccacatgccgcatctcaattaccttcccaaaggtaattgcccaagcatatagcatttgataaatatgagtatgcatgattctgtaatagcatttctaagcaatggtcatagttgactagggactcatacataatcatgggtacaaagatttaagggtaaacaataataaaggcatggcataatcacaagtaggatgttcatcattgcatgcaattttctttgtaaacaaaacaatttcgtaattgggatcaacatgttcaaagaatagtgatgacttgccttgctcaaagtcttgtgagtcttggccttcactcagatccgcaactccctcgggctctacaagtacgtgcgaagaattgatttgaattccattagaattcaaataaaatccaataaagaccaaatcgaaaagcgagcacgagaggcgattgttatatccacaatattattcgcggaatagaactattcaacctaagatattttgtgtttcctaagtggttttcctaagaattcaacaccttcattttagttcttaaataaatctaaattcctaccgtgaattgattactcatagaggctaccgaaatataatttaaatttcgcagttttacgactataattactctataattaaatcattaattattttaaattttttatttttattaacctccctcttctattttccccttttttttcttcctttttctctcctctctttctttttctttctttttctccctctctttcttttcctctctctctccggctcctctcttcctccctctctctctcggctgcgctccccggcggcaacggcggtgaaacaagaggcgggggggagggggggcggcggcggcaaccaccgcgacggcgacgctggcgacggcgatgcaagtgacgcggtacccggcgc

SEQ ID NO: 34540 - DNA, 4569 bp, Oryza sativa
  unsure (1)..(4569): unsure at all n locations
ncgcgaatggcaacggcgcggcagcggcnacacggaatgcgagtcgncggcacggggctcgggncaacgcgacgggcgncagtgcnnacgcgcggggcgcgaggcaacgtgacagcgacggcaccggcaacgcgacggcgacggcgacggcgcgcggcagcggcggcgagttagggcaagagaccgcaatcgagcacctatggggcaatgaacagtgacttttcctatttaaccccattttagcctatttattatataaatttgattctataaatcctaaattttgcataaatgaagtatactcgatatttgtgttatcccaaccaatggatccactctagattaattgtacccatattttatttttatataatttacttgattttaattagagttaattctcattccgtcgtatttaaatttaatcgatacaaatataatcgcggtaatattttattcatttctatcctcacctcatctttattttaaattatatcttgattatttcttttgccaatctaacttttcgggtttaatcctaattaatgattctttattcgcgatctatgaactccgaaatcaaaatccaataaaatagtcgaacaaaatcggcatgatgcaatttatttaaaaagtttttgaaggcccatatttttggagtttagatttttgtcggtcgaattttcagggtgttacacctaggcaggcgagcgagctcaagctccactcattgacaaccctaattgaaaccacctactaaaaccagtcggaccgcctggttttttcttgttccaaaaaccagcatggtttttcttggtcaaaaaccaatcaacgagggattagaccgaatcgttcgcttcactctttctacccgacttctcctcggcccgagcacacggcgccatctagcgcctaacgcagctttgctaccaaagccccctttgacgaccaccgagcaccaaagtcgtcacgcccccactgaaaatgccacctccattcccgacgctgctacccatcctagagggccgccatgcacggaagctatcgtcccgcttcattgcctgctaggcctcaccgatgagggtgcgaccatcactgtgggcctcttgctgaatgaggatcccgacgcccacagggcagtcccccgacgcaggagcagcgccgcctctgccgccaatacctgtcgcctcgacctcctggagcctgccacgctgagcaccgccacctaaacatcccgctcacccgaagctatgcaccattgctgtagctcatcactagcacaccacctttgcccacgaaatcaggattgatccgctcttcactctgttgtgtttgattgcaatcccatgaaacctttgatgagcttatttgggaaaaagtgactccaattccagaacgaatcgtactcctcgtccgatcccctctcgtgtgtaacgcggtctccctttctatctcttctgtcgggtgtattgaaaccgaacccgtgcttgactccttctctaccacgacctcttccaagttgagtcctccaccattccaaaccaggtttgctactatcagcactgctttagtctttgccaccggctggtactgtcactgcctccgttcttctgtcctgccttccgttgcatgtacaccgctaagtagcaatacaccgttaagtagcaatcctccatgcagcatcctatcataaacacatccaaactagcctttaggatccacccgccccggcttctgattgaaagccatcaatttagtcgcgaaccgaagccgacaaatcgcatgccatcttcccagccaccgaacgacccgagcacaacgtctagccgtctccatgtcgaacgcagctcaccaaaaggcctgggctaccctactgttggtattttttaatgacattactagaaatattcattccaagcaatggcgcagaaatagtcctggtatatttatggttacagaagtaatccgcaagcgcacggatataccattgtagcatttcagcatttcacccgaaagtattccaaggtatcgtatttatttaatcccaagggaagattgtgaaagagagaaccacgctaacatatacacatatatattacttgcctttatcaaagcctaggcaggggttaatttaatatgagggtagagtgacacgaagtgaagcttatagatttcctcagataaataattctaactaagtagaagaacatatagaaagaactcatttcctatacttctaatagagtaaagtgtacgggcggtccttaaacttgtagtggtgtgtcacctagatccctaaactcccaaaatgcatatctaagtcatagaacttgtcatagtttgtcatctagatcccaaatcaccacaactccttcaggatcctacgtggtgttgatgtggcatgccacacggacatgacgtggcatcattttgactaacaaattaatgggacccatttaaattttttctttttctttttttctctttttttccctttcttctcctttctctatgacccgagcagaagaaagggaaaaaagaagaatgagaagaaaacgaaaaagaaaaaaaatgaaaagaaaaaaaaagaaaggacacgtcacgtccacgtggcatgccacatcagcgccacgaaggataccagaggggatgtgtcgatttgggacctagatgatacactttggcaagttctaggacatgatatgtagtttgagagtttagagacctatatgacacaaccctacaagtttaaggaccgccaatgcactttacttgttcgaatatacactcaactttactctacacttgctagtatacaatcatgtggccattacctcctaacagtgccctcttggtgtttcgagagaccacccagggttgccaagttttttacgataacctgtcatggccgtccaactggggctaaatacagaggagtaccctccccagaaaattgtcttaggaatatatactaacgtggaggaatacccgtactgagctgtcaccatcagcggcccacctctattgtcccgcaacatatataaccagataatgatacttacgaatctaagcaccgtgcttacattaataaatactactctacacctctgcagatgatatagagcaaccgataaatcagacactaaacccacaccgttgcacctatctggtaggctacccacacaattataccaatacaaatgtaaagaacgagtagtactcatactaagtaaagtaccgagaatatataaagaagagtatttcattaattcggagagtattacaaaagagaatagataaactaccagagccataccgaaattcctccgaaagctctgaggactccaagaactattctatactacttccacttagcactaaactactaaataaagtatgaagaggaatcttgagattgcttgagtgcgttgagagagtgaatgagctcctccttttataggacagttatgggggttgtagccatgcgagatgtccattttacccctgcaaccgtcattaagagagcatctggagcgtacacatggagggccaagctggttgggtgctgccagggttcgaccgaatcagggcccaacaggcctccagcttcggtctgctcactgacaggtgggtcctttaggcggttgtggcagttaaagcagtttccaggactgttacacttgacttgtgggccctcttatccttaaacttgcttaggagtgaggtttcttcactttctctttattttatttgctaaattcctgcaacacattattctccaagtataactggaactatattattctgaaataaatatgcattgcaagcatagctaattctctattattttagttatattgacggtcaaaatttatctgtaatgaccgtcaacacctacctagagtgttcgattccactgaccaagaatgatgattgcctctagcttcaatcaacccgagtgtgggcctcacatctccctattgagagcagctcaccagaaagcccgaatcacccgtctgaagtgttcaacccaccgattcgatcgtcaatcacttctaccgctgtcaacccaagaaccacatctggtcatcttcatgttgaaagtagccatcaaatagttcagaccgccgcctgaagtgtttgacccaccgattaaattttattgatcgctgccgtgctccaccttacgcacatgtccctccctggacataaaccgcaagcggcatgtgtggggcaccccatcgcctctatccatggacctcccatagactctgattccacttggtacaaaaccagcccataaattaacatcggaaaccaaacacagaagaaaacattataggagattcaaagtttcaaacacaatgatgacactaaggagcaattgttaacgaggtttagccgaagagctgcaccaactcatatcccacactggcattgcaccctacacgggtgctcctcggtggtcacatcatgcatgggtgacctggtgtgccgccccataacttatgccccacaattttacttggcttgttggggtttagaggtacctttggactgtgtttgggg

SEQ ID NO: 34541 - DNA, 3038 bp, Oryza sativa
  unsure (1)..(3038): unsure at all n locations
tgtcttaggccctatttgtttcagcttaagattattataatctagattatagaacagattactataagctggattataataagtcgacatagaataagctgctagctgtttgtttctctgaattattatatgtttgttagttgttagtcacccaataatctaaaataagcacatttagagtagcttaccagattatagtaatttggcttatagattataataatctatcataataagctatatgtttgtttcagcttactcctaataatccagattataataatcttaagctgaatcaaacagggccttagacatacgatggggccatattggcattggctggctgggtgcggagcagcgggttctgactcgcggccaaatcgaggtatgccacgtgccatagctcatggtaatgagagcttcgtcacttccttgtgttaaccttaaaatatttcttccacatatatgatatacaataagaatcaaggatcataaatggaacataaaaagtctcataaataaataagttacaaactcattgatcgattctcacaaaacattttattcataaatcaataaacatagtatgtgatacaatcaactctataattagctctagagcatatcgctaacagcggggacttcagggacgacacatctcgttaagatgtttgatcctgttggcgttgtacctgctcctctcttcgctggtgaggagatcgacgatgcaatccatgtcgaggttctgcacgctccgcgcagcatcgcaacatgcagaatgtagatctgggaggatgatgtgggagcccgcagtcacataccccctgcactcgtgcaggatgtcctgcttctgggcctcagtgcatttccttatttttggttgttgatgagggggtttcttcttggtatttggctgcaccacagcactcacactaattaccttctctgcagcttgtgcgctagcttgttgcgcaacaaggaggatgaggaggagtcctccggctggtgccactctccaggagaccattgttgtaagaggactaggatgtagattactctgaaactttttttgtgtttgggactccaagatttttgacgcttttataaggagagtagagcatccatcctgtgatatatagctagtttcatttaatgttggagatggatgctcaaaatgtatccgtgcatttaagtctagtgatagatagatactctttcaaaattaattaattaatcgaagttcagggaaccagcaagtcagatatagtatatctctgcttcatttatgcatgggaatccatttctagagtattagtaattgtccatggtgcttctatatattgtgtattgcaggaagaaaagcatttccattctctaaattaataagatttttcataaccttcatgggtatttatgtgtgttggacagaaacaagatggtgcacatgcatttattatttttgtagagatgaagattactattcctttcttcccacagtttatttggtgcttgtggaaagaatgttgatgttacctagagtcctagagtgggtgtgaacatttgtttcctataattcttcataatgtattagtcttaagctagaacatccggtcttatggatagtcagattaccaatgttttcggcccacacgaaaatagcccatgaagggaaaatcacaataaccacactttccacaaagtagatacaacaaactagcaggaaaatagagcacaagctatcacaaccagccccccataaagagaatagcaacacatcagcaaaatggtttggatccaatgatcttgttgaaaggatactgttatcaccttgggggggtgtaggcattcttcgcagcggattagtctcatgccagaactttcggtcttatggatggaacatctacctcgatcctgaagctctggtcaataggtaaatggctcaccaaagggaaaccatggcaagcatgatttgcctagagtagatacaatagcgtgtcctctaacgctgtagagatgagagatgagtagatgacaagtaacagatagttggaaaggtagagggcaaagagataaaaaaaaagatagaggttcacgctcaaaacagaaagtgggagatatgtaccaaaaaagaactagagtatccaggagatgaacagaagagaagccacatctgtctatcccaaagttgggggattacaagagagagacgtttcgagtctccgatctgtttatcccaaagttgggggattacaagagagagacgtttcgagtctccgttagttacagtttccctcataaaaatgaaacgtcggaaaggagagcaatcgttgcctcgcccgcttgccttggcctcagccacggcccgcacttgtctcagcatgtgcatgtggcattctcaccaccacctcaaccgctcaacatgtgctcttattagcagtctatttaagttgaggtcttttctcattggttttcaatgtggtattgatctcttaacaataattgtgggcccataaaatttactatgattaatttgggtctacccactttaattctaacaaccacatcattcgagttgcaaattgatctctgaatattatgaaactaattgtgtactcaattgctgcacctaggactaacatgtcttggtcgaagcaactatatatacatatgtgtcttacgtgcatatagttttaactgatcgtgtgtactctcttaattgttgttggtaaagtttattggagcaagatcgcttaccatacatttggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34542 - DNA, 2112 bp, Oryza sativa
  unsure (1)..(2112): unsure at all n locations
gccacaattggnacctctcttgcatttacgcctgggtagcttccnnnnnnnnnnnnnnnnnnnnnnnnncaaggcaaatccaagagcaaaatatgatctatttttcaaatcatgtgaaacattgatatctctaatttttgaaatttcatgcatcaaaacctcacaatttttacaatcatcatcattaggaataagagatttcaatctagcaatttcagcatttagagattcaatcataaacccttgttttttatacatcttctcacacttcttattttttgcacttaaaacaaaaatagcttctttaagagaactcacctcattgtcttcacactctgaatccgattcaccatgtgccatgaagcaaataccggagatgttctttcccacgtcttcatcttctgcactctctccatatacatcgcttagtggctcaaaagcggcgtagacttgattcaacatctacttgagattctccttggttttccttcccttgaatgtgctcttggacttgggcttgtcgtccttgttcttgtctccaccattatctttcttcttgcctctcccaagcttaggacaatgcgaacgaatgtgatcaagtgctccacaatcaaagcaacaagttagatctcctcttttcttgtacatgacattgttcatagctcgagaaatcttgtagcagccaaagccaaatccctctcctcgaattgttctagttgctcatcggacatggcattaatcaaatcaagagcgatagaatttgacgaagaagcaccaacatccaaagaagtcgagagagaaaccaaagcactagaattagaatcaactttgcgataaagaatattcatctcatgagttttgagttttatataaagtgaatccaaagtcaaagtggacatatcaacagacttttgaatatatgcaatcttcatctcccaaatagacatgttaagaccattcaaaaagtggcgagaaatctcatattgtgagtaattagtgtcataagccgaatcaacagatctaagatcactcaaaattttattaaatctaccaagatagtcatccaaaccctctcctggtttcatctcaaattttacgtactcctttttgaaaagaccttgacgaagttctttaatttttgtagttccttgatgaaagtttttgaaagcattccaaatctcattggcggtttgaagatgtgaaacacgatcaaaatccgaacgagaaattctactcaataaaatattgcgagctttgcaattgttgttaaatttagttttcaaagcaaaagtatcaatttgttcaagaatcacataaggctaagaaaccttttgacaaacatcataatcttcagccataatgtaagattgcatcttatcacaccaataagaaaaatccaatccatcgaaaacatgggacttagttataaacttgttagccatggctaaaactttagatcggtcaaaatctaaagaagaaaacaagactttgataccacttgtaggatcgaatagcaagaagtaagccaaccagagggggtgaatagttgtagtacccaaaaaccaaaacttttagtggaattaaaagttaccctctgatccgatgtagattggtctgaccggagtagatccgccgatctgaccgcacctgtgctgtcggtataaccggtgtagatcgcctggtctaaccgcccagaagtcgcctctgcctcctgtcgccgtcgccagtctgaccgccatgtatccgccggtctgactggtgtgttgccgccggtttgactgccagtgttccgccggttggactgccgaaccagagcagatgacaactttattacttctgtatgtgtttacaaagtgcaacaacaacactcctcacgaaaatatcgattaaactcgaaaccctactattctgtcaactcaatgctctttaaagcgataccgggaggccacactcttcctctctatttatacatgaggtaggcaggctaaaatcttaaaacaaaacttgtccagaaggtcttattccacttagaaaacttcttgtacagaaaacaaattttcaaaactcaaatggtccaaatttgggattcnttcaaattcgaatttgattcca

SEQ ID NO: 34543 - DNA, 2110 bp, Oryza sativa
  unsure (1)..(2110): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattcagctgctgctatttcagaatcatcatcatcatcattatccgatccatatatgtaaggacagatatggttaacctttctagagttcttcctggcctctgtaaacctctgttcatgcaaggttaccttctgtgtaagatgcgacaagctatcaaagtcttcagacgagaatttctccctgattggagtaatcataccttgaaaagccaaatcggctaactgggcatcagtcaaactcaagctgtagcacttattcctcatctctcaatctctgaatatactcatgcacaggctcatcatgtctttgcttgattgctgttaaatcagacaatttcatctcatgtaccccactgtagaaatagctgtgaaaatgcttctcctaatcagcccaactgttaatcgatccatatggcaaagaaaaaaaaccaagtgaaagccgatccagacaaagacaaccggaacaaccgaaccctcaaggcatccacagccgatgcttcaccacactgagctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagattgacatgcagttcacaaaagagttttctcacgacatcagaaatgtgaggattgcactaagcactgatggcatgaacccgtttgataacatgagcagtcgtcatagcacatgggcggtggctgttattatctacaatatcccctcctgactctgtttgaagtgtaagtacatcatgatgccacttcagattcaagggcctaaacaacctgcaacgatattgatgtgtactttcaagccgatggtagaggatcttcatacactatgaacgaaaggcgtccgtatgagggatgcgtacaagcgagaacacttcacatgtcgggctattttgttagggacaataacagactacccagcacttggaaacacgtcgggccaaccggtgaaggacatgaaagcatgtaataggtgcatggcccaaacaggagccaagtggttgaatcactgtcggaagaccatgtacatgcgccatcggaggttcctcaggcgggatcacccgtaccgccgaaataaaaatgcttttgatgggacggtggaaacggatggacgtccaattttcagaaacggatgaactatggaagtgtactttatgtgtaatgcatttgaatatttgctattattatggattctattctatgttttctattatatgctcgatgacttgaggacaagaaactcttaaaatcatatgctcacctcatgttggaggtaaaatacaatcgcatttatatttttgcacttatgaattcttagatattgcagacttaggaatttttcaaattaatgttcacaatttagacataggaatttttggacttaaaaattttagacttacaatcttttgacttaggaattttaaactaggtatattttgagttaggatatatatgccaatgtttaggatttaaagacaggaatttttggatttacgaaatttgacttaggcctgtaggtttttatatattgtgatcaatggcttgtaggtttttatttgttgtgatgaatgtgaatgtgaatgtgaatgtgaaatgtggaatgtgaatgtgaaatgtggaatgtggaacgtggaatgtgaaagtgaaagtgaaagtgaaagtgaaatgtgattgtgaaatgtcaaatgtgaaatgtgaaatctgaaatgtgaaatgtgaaatgtgaattgtgaattgtgaatgtggaatgtggaaatgtggaatgtgcattgtgattgtgattgcgattgtgattgtgaaatgtggaatgtaaaatgtggaatgaggaatgtgaatgtcctgtatggatggggctgtagggatggggtcccgaattcccgagtcanaggagcntgtcaagnnggattgcatgcaattcaaggccgcccct

SEQ ID NO: 34544 - DNA, 1080 bp, Oryza sativa
  unsure (1)..(1080): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacaatgaatcaatgcacttggattggcttaactcactctccaacacctcactagataaactaagtgcacaagggtgtgagagctcttgcaagggttcaagataatgcaatggagtgccaaaaccttacccttgctgttggggagtgggtatatatacccccaaccacaaaaactagccgttggagtcaaaatccccaactctgtgctctgtcggtcagaacgccatagtgtggccggtaagaccggactacttaacggctagaaaactagccattacatggcaatcattgagcccagtcaacctggccggtctgatcgcagtgtagtggccggtcagaccgtccacagctcggtcagattgccaggggctcggtttgaccggctgcggctctagtggctctggattgccaagacgagacctccttcaaaatcaggatgtgcggtcaaaccgccatgtgatctgcggtcagaccggacgacatacttcggtcagacctccataagggctgcggtcagaccacagggcacttttcagctcaatcggccattagtaaaacggtgatatctcttgacttgagtctcggaatttgacgttcttggactctatggaaagcttattcaaagggctatccaacccatgaacaatccatccaagaaacacaactttgcttaggattccaagttgtctggccgatgacatcggatgataaaactcgtaagagacttggatatttctcccttgatggatnnnnnnnnnnnnnnnnnnnnnnnnnnnnnnnnnnnnnnncgcagacgtacgtacggcg

SEQ ID NO: 34545 - DNA, 696 bp, Oryza sativa
  unsure (1)..(696): unsure at all n locations
agtatgaaactagacatacngctnnnnnnnnnnnnnnnnnnnnnnnnnnnnnnnnnnnnnnnnnnattctcgctcgacaaccaaaaccatgcttaccacctgcgatgttgctgacacatataatagcaatggttcttgcggatgtgatgaagctaggaccccaccaccaagaaaaaatatcacttttatttttatcttgccgtaatttaggtttgttttgatatgctgcttgattggaatcaaattttcacctcttgctgctgctgctgctgtggaggggaagtaggaggactatttggtggctagattatgggaggaggggagggggtggtcttaatcaatgaacagtgagcagggctaccattaaaatttagctcctttaattaatccgtaggcacctgctgatggcgacctgctgatcgattactgatctttactgatgctcagtgtgctatgttctttaccggctccacatgattggagtgtgcctgtgtctggagaaaaaaaaggaggaacagagtatatatggttcgtgccagcatttatgcaataatgtggggacagttaggaggaggattgacccgattttgctttcgcaatatgaggccgcccttattgataagggaatctttccttatgaagataagtgcccttaatgttgagggcgcatgaattaaaggctcaataagaaacaaa

SEQ ID NO: 34546 - DNA, 801 bp, Oryza sativa
  unsure (1)..(801): unsure at all n locations
cagcgggtcaacggcaagcacggtccttttcttagccacttctcataggttgattccccatttggccccaaatccaggtcagtgtcagatccaggtcaatgtcaactttttttttaattattcaggtttgttgcatcatgagtctatctgattgagtttaataacacctgcagatttttcttgttcatccgaacggatatttggaacataggttttaaacgcatgtgcttctagagtcatcatctgtagatgcgggtaaagcgaagaaccggacagagcatctaatcacatatgggtcacagggtacaggggaatgagttgtttggggttcacatttaaattgttgatgacctgtattctcatgattcactttcaagttcagttgagcagtctctgtcttgcttgttttttagtgctcgctgtgattattttcttcatactcagcattcttttttttcttcttttgagaactctcaggttaatttggtttccttccattgttaacgtaaatgccatttgcatcctatcttagtaggatttgagaaccattcctcgaaaaaaataggaattacatatttgagttccttctgttgttaaatggcatccctcttcggtctngttngggtttgtgggggtcgggnttcttggggtctggggngcggcgctgcggggcgtgcggagtcagcngtgcctgcgtgnngaagaaacgtcannaagaaggaggcggaggagngattgaggagcgaacggggcgaggtannnagaatgaagctagcgnacccggagggaaggcctggccgt

SEQ ID NO: 34547 - DNA, 694 bp, Oryza sativa
  unsure (1)..(694): unsure at all n locations
nacgactgttntnttctgactgctacgcatatccgnctnnnnnnnnnnnnnnnnnnnnnnnnnnnnnnnnnnnnnnnnnnattaatcagatcatgtgcgtcttcttcacttgtgccagctgcaaagccatcaatagcatcgacattgattttggggtacagagacttggtcattgccaatgccatgcttgctcccatatttccagcctccttgatatttttgaagtacacatctagagcagtccttaacttatcaaaaatttctactgtgtccaaggagctcgtaccactattgctcaaatacatggcctagataattggggtagcagtgttggcaacttcgcctctagcttttttagcaacttcgactttgttgatcaagaagtcgaattgtgcctttgtcttccccttatgatctgcatacaacaccaatcaaggaatttagatgcaacagtattggctaaatttcatttatagttagtcagaagagttaccttcaaattctttgaccgccaaatctttctccttgggtagagcagcttcgtcttctaaggctttgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34548 - DNA, 77058 bp, Oryza sativa
  unsure (1)..(77058): unsure at all n locations
ncgtcgtcgtggtgtgctgggatcgtcgtggctccttctagngaagctgcaggcacgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgcgatgcattgaataactcaatattctattttgttctgcttcctcataacaggatacgtgactggaaaacagcaagtgagatgattgaatatttggattcttcgctctcatccatttctgttggaacactaaaccatgttttaaattttcttggaaaatgtgggaagacagagaacatgatgaaggtatagttggccttcagaacatagttgtcatttcagaacatgcttcattactctgtttttggtgtggtagtttatagttttagtggatatctttctaagaacatagttgtcattccagtaattttagtggatatctttctaagacccaaagaaagatatccaacttctgcagtgcaatggatatacatgcttcattactctgtttttggtgtggtatggtttttagttttagtggatatctttctttttaatgcaaagggatgcagttctcctacatgttcaggggggaaaaaaactatcgatctgttcatttctataaaagtgaagtccatatttggttagatatggaactaacggccttgccacactgacacaatacaatatatttctcccaaacatataatcatttaatatgtttgtcctcagcataatcaaatagatttataggattctccttttcagaggagttgacaaatattttatgatttcatctactcttacttatttggcagtgaattgtttttcttgaatgtctgaaggttcaagtatcaatgtactaccagtaattccatacttccatgtaccacctatattttcctgctgctccttgtccaaaataaaaatggatttagcaataagaacaattttatcttgactagttttaaatcatcagttcatcaccttctcacatcaatacacattgatacttgaggaagccatggaatcacaaacatgccactacacttgtaagagaaataatgatctgcatttacagttctgtttccctacattaattatttgattctcttatgcagctgttttacaagatggtgacttcatgttctactgtgggtctttctacttatgcggttgttcttagaaatctcctagttgttgggaaatggagaaagtatattgaggtaacaaggccccttctcatttttacatcatctgatcatctcagaataccgcttgcaacaagctagattcaagagtaataggtcaaaacctgatatttatttgagctttattttttgtgcctgtaggttttgcagtggatggaggactctggagttcatccaacactatatatgtttcaaaatgtccttccctatatctggagagaaaatggcatggattttgctgctactatgcaagaaaaaataagtatgatacgtcctactctaattatcatttcaagaagactatgaatttatcatgcaataatataatccctccgtttcatattataagtcgtttgactttttccttagtcaaagtttcttaagtttgaccaagtttatagaaaagattagcaacatttataacaccaaattagtttcattaaatttaacattgaatatattttgataatatgtttgttttgtattgaaaatgttaggatatttttctataaacttgatcaaacttaaggaactttgattaagaaaaaaagtcaaacgacttataatatgaaatggagggaatattttggtatctcttattttgtttctgttttgatgagcttgcatatattacgagccccatcggttgccctaataagccaaagccaaaatttgaattttcaaacttaattttgaagttgattttaaaatattttcaacgtagttcttttttagtattggcttttaagttgttaagaacacatatataaaagttttacctataagttagtttttattctctaataagccgttttggcttattagggaatatgggcaaccgatgggacctacatgaatcattgttatggatgactcatttgagcttaatcacaccaggttcattgagagacaagcaaacgtgagctctcgatgtttacatctctctgatgttaagcaggaaatacctcggctttaaacacaggtcttccaacacagaaacgcctgcctccttcagtggtaacacatatgtgctgacaaaaagaaatttatggtatgagaactgttctgtttttctctctttgccttcttctttttctttctttttcgcttttctattcttaaatcaaagttcaaacaattctaggtgttattttttctgaaatttctggttatcgcccagaatctatttccaaaatgaaactgggaatccctggtttgaagtccattaggcccataactgaaattgttggaaaattccttacgtgtcactagaaatttccagatcctgaaaccaaatccatgttttgagaaaactggcggttcccgaactagaacccaaaggaaaaggatgccaccagatttttgcttctcccatatatggcactcctttgtgaacctatgccggaatatgcatcgggcggtaacacagtttggcccaaacgtactacttgtcatttttattccaagtggcacctctactctccatctgattacacataaacccaaagaaagaaggaaactctacatccgtaattgacacatcccatttcttataaaggatggcaaggtggcattcacacatccaaagggaagcacctagaacagggcagtatgaggattgcatctctccacctctaatgctcatctgggtgatcgtgtcgctggttaaggtttgatatccatcaatctggcaaaagtttgcatttcttgccacctcaacataggatgggcaacgagtgcgtaaccgcacctctgatatgctcatctggggtggtcgagccactgctttgataattgatatgcatcattctgggaaaactttgcatttcttgccacctccatgtaggttgggtaatgcctgtgcagcctcacctccactgcgtacatcccagtgtggctgttgcagttctggtccacaagcctatactatgggcttggtgcctcctcattgctgtcacgagtgcataacaggagtgagcatgcacaaggtgtcctggcgctgtttccactccgtggtcagttacgggtgaagttgtgaaaaacagtgcccctggtaattcctgaccgactggctatagttcatgatttgttaccgaccgaacggtaatcgttcatgatttgttactgatagaaatggaaatggttactgacagacacaaaaatggaaatggtaaaaaaaaagagtaaaatccatcaccggtccctaaacttgtaccgctgtgtcatcccggtccttaaactcgcaaatcgaccgttcaaatcctcaaacttgttcgactgtgtcatctcggttcctaaacttgcagatcactcatttaggttctccaacttgttcagttgtgtcaccccggtccctaaacttggatttgaatatcatctggatcaaataggacggtctaaagactttatatttaaaaataattcataaatttttcatgtgaattctaatgaagacaaactttatatcaaacttgtagccctcgacgtgatctacaactttgtagttgatttttttttattttaagtcattttttgtcccaaaatgtaattgtgaaattaaaatttcaaaatctataaacatgcaacaatattttgagaccctaaatggttttaattcaaaaacttttcaactaaaaagttgtaggtcacgtcgagggctacaattttgatataaagtttgtcttcattagagttcacatgaaaaagttatgaattattttttgatataaagtttttagaccgtcctgtttagggaccgaggtgacataactgagcaagttggaggacctaaacgagtgatctgcaagtttagggaccaggatgacatagtcgaataagtttgaggacctgaacggtcgatttgcgagtttaaggaccgggatgacacagcggtacaagtttagggaccggtgatggactttactctaaaaatagaaacagaaatggaaatgattttgttgttttaccaaccgtttccttggttatcgtattttcgaggaaattaccctttttataatatggtaattaccctttttctaaatacacagtacttgtgtctcatgtctccgtttggcccatagcataaattgttctttttatgttcttgacttcttgtctctaatgatttcagatgagctaccaccatcatgagtgaagaacagagtatgtcgttaagtttgtctaatacaggatgggggcataaatcatcattgcgttcctcagtacagcatggccaatgtccacagcatgttttggcataagatttggaaatagtaccataaatgggagaaacaaaattcaagggcatattcccagtggcacaagggagattccctccagcctccaggtagataatgagtttgtactttgttaagatctactgaagcgttgttttggtgcttcaagaatgaggttgacacttgtggatgatatagcttgtaggtagctaatacagtgcatatatattctctttgagggtacatagacagtgtggatgacaaatggaatatgaaagaaaaatgcaaagcgtttctcatccgctcttttgcagctcaccccgccttcccatttgtctctacagaacgactaattcatcacatatgaacacaatgtaattgagcatataattaagtaaactctgaaaagtagcccggaaactgcatctcattttgatgattcaaggggagaaggtcaagatgtgcttcataggggaaatggggaattttgattatcaaggggagaaggcaagggtggagacgaactgcataccttcaaacagtatataaaattctgaacgtttgcatgatcatattttgcgtctccaggctccagcaaactaagctaaacgattcatgctcaagttggctttcatgcattagtggttaataaagcaaatgtgtattgcgaaagctgtattattatgtggcatatttggtctttgagatatgcacttctctactactttaaaatacagttgttctcctttctccgtgaaagttgtgattttatgtggcatttttggtattgccatatcagctggccctactagttagagtggtttcttcctcctccctctctctttcgactcgctcacccctcaccgagcttgaggccgccatggctcactcttttgactccctccctcaccgagcttgagtcggccatagagatctcgccatgctcgagagaagagggaggttggcggtggccatgacgaggttgacagtgagattgatgcggtgcccacccccttggccatgctcaagggaagagggaggttggtgacaagcttgacgcggagcctgctcccttggccgtgattggtgaaggggctgttagcaagctcgaagaagagggttcgccaagcacatagaagacggggttattggcaagctctggtgagggttgatggatgcggatcgacccaactgtatcttgatctggctacggctagttgaaatttggaggtatctctcctccccgatgtcgacgagagtacgagaccaaggtgtggttcttcaattctctcctccatgaagcctttgccgtcccctcctacccaagctccaccactaccgccgtcggcactctcctcgtcaagctcagggagctcgtagatggcttcctatccaagcgccactaccaccctagacccagcacccccaccccctccccctccttgccgaggttaaagagacgggtgccggcagcacggccttgatcccaagatgaactcgacggaggagtcgatgccgcagggcctccaccaccaagagtttgtcgtcgcccgcgccatcttcacctccaactcgagcttgttgagcagtgttactgccaacggcggcgaaatagcgtggagctccaagccgagagggtgggggtctctccacggatggagctcgctgtcaactttaactgctccacgaagagaggggagagcgagttagaggggaaggaagaagaagaggggtggaatggaactgactaatgggacacttccctttgctgatgtggatctttttaaaatgtggcatccaaagtgatgtccagctataccaaaaccatcctaaaacctctaaaggatgtaaatgtctggttttgatagtttgagtgtgttagaaaccaattttatagttcgagggtgtgtttttaacaaagcaaaaagttgaagggtgttaaatagacttatccctactctaaattccattgcattgcaatgcatagacatctacctaattgaaaagtaaaactcaaaaagcaaccagaattagccacatgatttgtcaaaaaatagcagttggattcacaaaatgacaaaatagcaaggaagaatcctagccattgaaatgaggaatcttctagaagtagtaaaatatagagagaaggaagagtttgagccactcattacctcttattggttatctcatgttggcctcccaaataggcctagggctggcttagcctggccaatcaacccaaacggtccttagactagataaccaattaaataatttcataagagggaaaaattattctacatataacactttaaatcagtcagcaacaatcaaaacaaagatatagaaaaaaaaagttaacatctcaaacaaatcttataacatagttacaattatgatgtgcaattttacttaaatgtagacccaggatatttggaatccgaggtagtagtgaaatttaattttgattcttacaataatatcacaagtttagcgtaattatagtaaattgtttattttcattacaatatgtatttattacatatcaaaacaacatagtatttgtattgaacatgcacttccgaccaaatacttttttcgaatattaaatcaagtaaagcaggaaacaacacgaataagatgaatataaaccctgagtctatacattaattattgatttagctgaatggtggaaaatttattgttaattgtaatagcagctaatagataggaaggttatagtcgcgcgaacgtgcgactagttgcatgcaaaaccttcttaaactacatggaagagattaacagtaaagaaacatgaatagtgtgtcatgtacagcaagtaattaagtgacatgaagaacatacagttgcatgcaaacactgcacgcatgatctattggattttcttccagcgagtgatgaatacattgccatatataaatatcagtgatgaatacatgctttggctaggttattagctttggctcgtattagatagtattgatgagaatacatatttatccactgaaaaagaaacattaattcatgatggaatattggaggaaagcaagaggggtttcttacccaccagattttgaagaaaatatgtgaagatagattgaacagatattcatgtcaattttgttatggtttaacaaacctgcgagtgggatagttatgatagaattttctgatatggttcatatgacagttttataaaaaaacattcgatcactccatattttcattaagaagcaatcgctctgtatgggggagaaataatatatctacatttttcattaagaagaaatctctctgtacagggaggaaaattatatatagtatttaaatgattggtgtgatttttttattatttaaaccgacccaattatatcatttttagtgttttaagtagtgggctttaggttttaaatattaaatagtactataagttgtaactttttatgtctcataattgtaatttcatcggaggatgatatactcaaacaaatattatcttcattgtccgcataacctacaaattgtgagcatattatgtccaattctatttatcctcaatattggttgggttctgattgaataaaatttaatggacaatgtaattgagtatacacgtatactatgatatgtgtaaaaaaacacatctcatttgttatgactaaggtgtatttcatttgatggattatattctatgtttatctcatttgttatgactaaggtgtatttcatttgatgtattatattctatgttttgttggagggatgttgttgaatggaataggacaatgtgttggatgggggttaggatagaataactacacttattgattgtttgatcaaatctacggttcgattgatcaatttatttggttgataatattgtaaaagatgacccagaatggttgggtaaaatttatgttatttctaattttcatagagatgttggtacgtaagtaaatcataatcttcctcgataatatttcattgcatgtccttatcttcttgttcatattttattttctcttttttattatcttgtttttatttgtttctattggttttgtttccatttctaccggattgggccaaccttgtgtaggtgcatctcattcattgttttgttttgtcaattaaataatatatcttcacatatattgcgtctccagcatatattgttacttgccaaagaaccacgctccaaaaccatattatttatatggaacggaactatacacatctttggagttatgagaatattagtgaaacatatatgcatctgttctttttaattgagcattttggacattgacaccgtctcaaatgcatgtgttttgccattatttttttataacagtatatttataaaaataacgaacatataaccatgtgaatatttttttcatgataaatctatcaataccatttttgtgtattaaattctaatacttatgtatgcttaatttaatatatcaaggtttgactagacgcattctataatgtcatctatgtgataacggaggtaatatcttgctgtctccaaacacatataatcccgtttatgcatccaaacagtaggatgtcaagaaagcatgaactggatagttctccattcatctcgtcggtccatccaatcaaccaaagatagtacgagggtgggatacctttagaaaaaacaaaaagggcagagaagggtagagatcaattggcgcgctaaaaaaaacataaaaattgaaacatgttacatgcatgatcgttctgcatttcaataaagtaagctagctaatgattcatgcgggagtagctagcgttcatgcgtatgtgatttatgaagcaaataagtgggcaaggaacataaacatgatgccatagcaattaaatgacagtgatagtatatagtggcatcatacagctaactttgcacacatgatgtgtttatgtcgtaccagtgatatataggagtgctagttttaggcatgattgaaataatatgggttagttataccgcaaaagatcattattaaatgtgataaaatattggagaaaaacaagagggttgcttactaaactgttaaatctgtttcttatcaatagtcatgtggcttacaaatcaatgttatagatgaatgtatactatatattgaatgaggcacaaattttttatttgagcctgtttatttgagaaggaaaactagagatgatggttaaagataggaagacagagaaatcaatgttatagatgaatgtatactatatatattgaatgaggcacaaattttttatttgagcctgttgatttgagaaggaaaactagagatgatggttaaagataggaagacaaagaatgattcgattgagaaataataacatgtaaaacatgtgctaaattatatatcaatttgacacaagatttaatttggttgatgaacacaaattacatatcaatttgatacaagatttaatttggttgatgaacgcagtagattagccactctttaatgatgtatgactgtctactcataaatatgttttgcagtcataaaaaatcaaattccttatagtgtgagtaaccagatttgatatattcatttgagaatgaagctttggctgagaaattataacctcataatattcaactgtataattttacctgttgatatatgttgattggtctgcatgttctgccccacaagtactgcatcaaactttcagttgatgaaactaatcaatggaaggggcataggtttggaaaatatgattgcgctggagtgattcttaatttgattattagccccgttcttttctgcttatttactgaattatttccacgtattatatgctctacgattctaaaaatatgattcataaggaaaaaattaagaccattttaccttgtatttcaaaaccagttatttaactccatatactatacaaattatagcaaacgatcgattccctcaaggtagcgattctaaaaatatgattcataaggaaaaaaaaattaagaccattttaccttgtatttcgaaaccagttatttaactccatatactatacaaattagagcaaacgatcgatcccctcaaggtagtattcaatttgtggttaatgtgccatatcatatcctactcttttgtgatctagctatcattcttgaagaatgatgacgatggcttgaatcttaaaaaacataccataacaatctgtggacagtcatagacagcgttggaacgattatgttttactgagtatgcgtatgttgacagaaaacacgaggcctgggagatctgcttaactccagtgcaggtccaaaactcgccttcggatgtatgagcgtaccagttaatttgatcctgcaatcaacaagaaatagaacaaagaaaccgcaattaatcctataaatgatagccgatcggctaggtgccgatgacatatcatttatttcaagccgatgtcatgcgtacatcgatcggcaaatatcaataagcaaatcagaactaaatctactcgatcggctgtagatattaatgatatataatccttatatcgatatatacttgaatcaagtggttgggatagatcggtcgccttgccgagacagtataaatcacttagatcgaaatatatattaatagtgggattatatacatttatagcatagccgatcaaatggatctagcatgtattggctaatactccgataccactctatattaagatattaaagcaagtagaatataccaaacagaagcctaatgtacttagatgcgacaagatcttaacataaagggcagatttaacatatagattaagcatatggaataaaagtagttaaatcagataagatcggttgaaactccgatactaccctaatcggcgaccagaaagcaggctagagattgcaattctaagcacgacttaatatatcaaactcaactgatgcagcattaagtatgaaaagaaaaataatatctagacaatcaagccgctggaagtttcatagagtggtagatatatcacataatctaagttaacgtcattgtctaacctaatcggctgccttccattaacagatgttagccgattataggttagataaagatattatcgaagattatgtgagatatatgataactcgacgaattatatagacaagattagagtataataaagatggaagcactaatcctgagaacataagtcgtcatgacaagttttacctcttattgaagatcgaaaccgatgcagctcaacccgagagtacgaactcatcgaaataaaagtaaagcaaaaagggtggcgatgcgccgagattgtattggatgtcgtcccttttttacatagggctcgggtctatttatacccgagaattacaagatacgtccacaacggacatgactattatctctaacaaactctaagataccataagtctttacggcagacttttgcccaaacatatctctaaggaaattacatagaatatcctaattaatagatacaattgccttcccaggactctatccatgcatggcaaccatcttgaagcacatcaacttgaacccgatgacgtacaccgagtcatattatcagaatcggctgtatcggctagcctcgtccgactcgaactcttccgacttgaccttagccgatttggactgcagccgactcttactctgtttccgcaacgatcttcattttggatcccacttcaatctgatcttcacctccgatgccaatagtgatagaatttaccaaatttggtcgttaacacatgccccccaagtccggaatattggataatgtttcggatttgccatataccgactctgagagaaactcgcacttgctgttttcctgtccgttatcgctctactttaaatactaaccgttgccccaaagaatcttcacgtcgtgatttccgttttcaccgcttaaacagatcccgtcctttctctctccggcgacctcctcaacacgcatggcgatttctaggcgattccactcccggccagatcttcacccgtgacgatgtcgacctccaccaatccgaccgccgcatcatcagccgaatacgctgaggtaagtccccatcggctagacccccttttccgttcatcagaccggttttcgctcaccttatcttgttttcttcttctctattcttgtagcatctttccaatcttgttgcggttcccagtctgtttcatgaccaacaatactttctcggtccaatcggcaatctagaccccactgagtttatcatagccgaaaccaacagaaccccttttaggtcggccaatccaaacacaagccattggaaaaacaccttcaaatcctggccttctttggagaaaagctggcctgtatggtataagcggatatcggctagcaaacaagcccattgggatgagatcggaatcagccaagccctagccctcacaatagcaaattcggccaaagatgaacccctaatggctgctgcaacttatttctggtccaacactctcaatgcttttcttttcaaccaagggccgatgaccccaacgctgctggatattatcatgctcactggcctagatgtaacctcatcagctaaccctatgaacctgaacaccaagaacacttttgagttcaaaactaagagcattgggggttggtcaggatatatcacagcatatatgggcaaagggccagtcactcctagagagcacgtagcttttttgctgatgtggttggaaaaattccttttctgcggatcaagctgcggtcctacaaccaactggcaattcttagccgaggccctagtaacgaagaaacaatttcccttaggcaaaatccttctcggctatctataccagatattaaacaacgcatcggccaagataattatcggctcagtggttggaacaggtggaccatggtggctcttgcaatcctagctgaacctggtagtcatgaaagttgtcaatcggccatctgtgacagaagctgaatttccaagtttggagccgattgtggaagatgatggagaagaacacacccatcgcagatgtatgtcatacggagaatatgcatctacaccagccgatgcaggagcaaagttatcggctgaacttctgaaggactggttcttcagcttttatgatggattccaaaaagatgcccgagtttggttcttctatgccgactcaatggatttcgaactgccagccgatttcaggttcgaggatattaatcatgagaagtttcagcaatccagagaaatctttactactgctatcagcccatgtatcctcccagtcggcatccatcaagggagaaatatccaagtctcttacgagttttatcatccgatgtcatcggccagacaacttggaatgggacaattgccaatcggtctgtactttgccaacaagatccaatgcagaggcgacatctcctcaactttaatgatggatcagctattgaacatccctggacctccgttgggcagcatcgagaacataaagctggcaaggttcaggagcaggacatttgacagatggtggggcgagtggaagctgcatctgttccatcaatcggcttccatgtacatgacagacttattccctgatgctatccctcatgttaatctttatttcttcaatcttgcttgaatagtcaatcaaccgatttgaaccttgactaacttttcttctgttttgcagacaacagaatcttctcctcctcaccagagcaatagcggcaaggtcattaagtatgctccgggtctaattccaaatggaggtgggccatccccttctgccattggctacaatgccccaaagacctcagcacttccccgaggactcatcagagaaccagccgatgccggcaagaagcggagaaccagatcatcggctgcagatacttcagccccggctccgaagaataaggctaagacaaagaaagctaagccagctgacgatctacccgccctagatccatccattgaacaagctctggatgaagaagaaatcgaggaagacatcgaccaagctgcagccgaaataagcgatactgaaagaacaccattggcttcacctaagcaatctcctccatccccttctgcttcagctcaattggcaaaggtaagcgactttatctgtccacttttgcagtcatttactttatagccgattcctcacaattttaataaatatagagaaagaaaattgctgtgaggaatagatcagctacttcaacccttaaaccagctcctacagtaagatacttttatcatctcattaactgatttgggctgattatatctaatatttatccctttagcagtctcctcctccttcttcccctcttgtgcaggcagaatcaggcggccacactccatcgactgcaggcagtcatcatgttgaagaggaggaacaattagctgcacctactattccagtaaggtttattaacataaatttgagatcggccaatcatatcttgatccttaatcatccatgatattgtctcttgcaggtcttagccgatctgttctcctttgacatcaaagattacctcgatgaaacagaagaagacaccaccagtaaagcgatagctctcctgtctgatgatatgaagaaaacactcgaagacatctcccatcggttaggagcatcactagataacctggtgaccaactgtggctcaatccgggcaagatttgcagatatccaagcctttctttcggacgaattagccgatgctcttactccagctgtctacctcgagcagcatcaattcaaactggagaaagccaggcagaggttatccgatcgccgggagcgcaaggacatcgaggctacaatccaaaccaatcggcagcgtgttcatgaagagaaagccaagcttgatcagttatctgaaggcccgatcaaatctaatgttgatcggcttgaagctcacaagattgaactcttggcacaacttcaagaatgcaatgctaaactggatctagagcacaagaagttaaccgatctcatgcaagctgtcgaagaacagaaggcaaggctaaaatcagctatcaagaacattgctgagatgactaaatccttgaaagtcattcctggaaccgatgctcaagacgcccaagctatcgaagaaatagatcaaattaggcaaagggctatatcggctatccagcgatacttgtctcagtgatttccatgtaatagtttgtagaaaactgttgtaatcggctaagacaccctaattactttgctgccatccttgtgccggcttgttcaaaaatttcaattctctcatttttctttgcaattctctatgtatgtgcccccctaattttacaatgttgaaaacattgacaaaattatagaaacgactaagggcgatataacaatatcggccatttgtagatcggcaaaccacaaccgattacaatagtgaaaagcaactaagggcgatataacaatatcggccatctccaggcgatgcaaacacatcggctatcatgtatcggcaacactagtcgatcatgcattaacccaaacactgggataatatttcttcaagtatttgctatttagagctcggccataaacttctccatcgagtccttgcaacatgtatgctcccttagataccaccttataaatttggaacggtccttcccaatttggcgaccacttgccaaatttgctatcccgagtcccaatcggcagaatcaacttccatacaagttcaccctccgaaaagtccttgggtactactctcttattataatgccggacaacacgctccttatccctagtaacctttgcaagagctcatagccgtgattgaaccagatcttccctttcatcggccataaggttataatactcatcggctgttaaagtattttgcaactctgttctcctcgagccgattcgaacttcccatggcagaacagcctcatgaccataaacaagtttataaggaggaacctgtatcgatccatgacaagccatccgataagaccacaatgcttcagccagccgagtatgccattgccgaggataatcagaaatcttcctcttaatcaacttgatcaaactcttattagatgcctcggcctgtccattagcttgtgcataatacggtgaagaattcaacaatttaattcccatgctatcggcaaattgaacaaactcatcagatacaaaaattgaaccttgatcagtcgtaatagtttgagggataccaaattgatagattatatgctcttgaacgaactgtatagcatccccagaatcaactttctttaaaggaatcgcctctacccacttggtaaaataatcggttgccaccaatataaacttatgtcctttactcgagggtggattaatcataccgatcatatcaattccccaacctctaaaaggccacggtttaataataggattcatagccgatgctggcgccctttggatcgctccaaacttctgacaatcttgacaacctttataatatcttaaacaatcctccagtattgtcggccaaaaatatccagcacgtcggagcaaccacttcattttatgagccgactgatgtgtaccacatatcccttcatgaacttcgccgattgcaacttttgcctgatcggcactcaaacatttaagcaacactccatcaatcatccgataatagaggtcatcatccaataaagtatatttcaaggccttataacgcaatttctgcgaagccgattgagatggattctgtaaatactgaaacacatcatatctccaatcatcggctgtaattgtagcaatctctatctcgatatcttttgtcattggcttatatcccgacgctctttgagccaaatcattagcctctatattctgttctcgatatatgtgcttcaaagtcaccatcctaaattcacttatcaacgttcggcacttttcataataaaccatcaatgtatcatccttgcattcatactcccctgccaattgactaatcaccaacaacgaatcacccatgatttcaatagcatcggctgcaacttcctgaagcaactgtaacccttttaagaccgcctcatactcagcctgatgattagtcacacggtgtttgatagcataggcaaattcaaaacttgccccccaaggcgcaattataaccaagccgataccataaccatgactgcatacagatccatcaaagaataatacccaaggcataatgtcaaccaagccgattgaatcatcacgatgacccacaataaaatcggttacagcctgtcccttaatcgcctttggtgattcgtgccgaagatcaaactacgttaaagaaaatatccacttgccaactctcccttttaaaatcggagccgatagcatgtacttaatcacatcggctttacataccacagtgcattcattggacaacaagtaatgcctcaacttagtgcaagagaaatataaacacaaacacaatttctccacaggagaataccttgtttctgcatctaagagccgacggcttaaataaaacacaaccctctcttttccttcaagttcctgaatcaagaccaagccgattgacttatcaccggccgacaaatataaccggaaaggaatccctttttgtggagggatcaatactggaggagaacttaaatattctttaatattatccaaagctttctgttgttttgccccccaagtgaattgctgatcagctctcaatcttaacaatggtgtaaaaggttccagttttctagacaaattagaaataaaccttcgaacaaaattaattttgccgatcatctcctgcaactctgtcttagttttccggaggcttaatctttttgatcgcattgatactcctctgaggtatttcaatccccctctcatgaacaagaaatcccaagaactggccagccgatacaccaaaagcacattttgtcggattcatctttaaaccatatttcctagtcctctcgaaaacctttctcaaatcggctatgtggtcctctatttctctagatttaacaaccacatcatcaatgtagacctcaaccaaccatccgatcagatcatgatatatataattcatagccctctagtacgtagctccagcgctctttaagccgaaagtcattacaacccattcaaacaagccgatcgcaccaggacacctgaaggctgtcttatggatatcttcttcggccataaagatttgattatatcctgcgttcccatccataaaacttagtatcttatgtcctgaagcagcatcaaccaactgatcggccactggcatcggatattcatcctttggggtagctttattcaaatccctgaaatcaatgcaaaccctcaccttaccatttttcttgataacaggaactataccagaaacccattcagcatatcggtaaggacgaataaaaccagcatcatacaaacgtttgatttcagccttgacaggttcaagcatatcggctttgcatcttctcggaggctgctggtgtggtctaatccctggctttaaaggtaatcgatgctcgacgatcgatcggctgagtcctggcatctcataatactcccaagcaaagcaatctctaaactctttcaaaagctccatcagcttggttctaaattctgaagacaaattcttactaatgaatgtcggccttggtcgatcacccagacctatatccacttcttctaaatcatcggccgacataaaaccctaaccttgcttgtcatcgagatcatctaccgtgtccttggcgtagacgcttgaaccctccacgacgccctcaaaataatagcttgggttcttcatcttcaatcggctgtatatcagaatcggacacttttagaaaatctccaacccaaatcttcctggataaacaatcaaggccatccatctcccaaagagctagatcggcactagcaacattaactgacctgtcggctggtacaatctcaaccttgtcgccttgccattgaatcaagcattggtgcatggtcgaaggaatacaacaattggcatgaatccaatcccttccaagcaacaagctgtaagaacctttcccatcgatgacaaaaaatgtggtagggatagttttactgccgactgtcaattctacattcagaacaccctttgtttccgattggttgccaccaaagtctttaagcaccatgtttgtcttgatgagatcctcagtagttctacctaactttctgaacgtagtataaggcatcaaatttaccgcagccccaccatcgaccatcatcttagacatcggcttcccattgacatagccatttatatacaatggtttaagatgccgattttctgtcccttcaggcttttcaaaaactgctcgttctggtgatagaaccaacttagccaattcctcttccagttcgtcaacatcggcttggtcaatcccgaattcggctggcaaagtaaagaccatgttaattggcgccgttacaatacttttcccttttgccaacctctttgcttcatcggctgcaatatcatcggctccaagaacttgattcttaacacgccactccttccttggctttgctttcctcagccgatgaccaatttcttgctcgacctcctgaaagcgctccctattcctcaacctttgaacccttcttttctgattctttgtaaaaatatcagaaggacaccactgagtcttcgcgttctcgtcttcctccaagtaatcattttgatttgccgggcccaacctttgatgaacgggaactctagcttgcttcagccgattgcctctattgtacgatcggcttgaactctctgtaatatcactgcactcaggacagtcttcaatagatggtagcctcataccttcgttccagtagaaccgaaagaactcacaattccaataaggatcgaaaccatcattatcttcttcataatgcctctcttgttgtttgtcgtatttcctctgatacttatttataattctagccgaattcacgcaaaaacctctcgctcgtcccacatcggctgtccgaccaacggtatgcaccatgttaacaaggaaaggattaccatcgaccttcatcggctttttggaatcatcaaacttaatcttccctccttcaatggctacttgaatctgctgtctaaagaccttgcaatcattagtagaatgagatccagaattatgccatttgcaatacctccttttgcctagttccttagccgatggaattacatgaccagcggggagttgaatttgcttctcccggagtagcatatcaaaaatcttgtcagctttggtaatatcaaaatcatatctctcctcttttccagaattcttttcccactgacaaggtataacctttttactccttacccattcggctgcagctatttcggagtcatcatcgtcatcatccgatccatacatgtaagggcagacatgattaaccctcttagagcttctcctggcctctgcaaacctctgttcatgcaatgttatcttctgtacgagatgcgacaggctatcaaaatcttcagatcagaatttctccctaatcggaggaatcatgccttgaaaagccaaatcggctaactgggcatcagtcaaacttaagctaaagcacttgttcctcatctccctgaatctctgaatatactcatgcacaggttcatcatgcctttgtttgattgctgtcaagtcagataacttcatctcatgaactccactatagaaatagctatgaaactgcttctccaagtcggcccaactattgactaacccatacggcaaagaagaaaaccatgtaaaagccgacccagacaaggacaaccggaataatctaactctgagagcgtccacagccgatgcttcgccgcactgagctaaaaatcggctaatgtgttcataagttgacacaccatcttgtcccgaaaatttggagaagtctgggattttaaatcggttgggaagaggaactttctcaaaccatttagggtaaggttgccgatacaattttccagtatctttcggcttaagcccaaattgttctctcatcacatcggcaattacatcagcccatggtcgttgttgacctgctccttgcgactgttgctgtattggttcaaactgattatattgcctcattggtaattctgttaatttggctgaataaattctgttaatttggctgaatactttgcaccaagtgctctggcacaatctgaggcatcgtcgtaccatctggttgtatatggtgaaccaaatgttctggaacaacctgattcagggcgtgtccagctgattgctcagccgattgattcatcaaagcttgctgcggaatcggctgtatagtttgttgtcccggaagtgttggctgaactggctacacaacctgctgccttggtggagtctgttgaatcggctgcacaacctgttgccttggtggcgtctgctgaatcgaattgacagtagattggaggggtagaaacatagcagccacctgatcctgtgctggccgatttaccgtctgtccgctatgctgtggctgctccctcatcaatagccgaggattaatcggctggcctggtgtcgacgctgatggagcaggcaaagaagtcaatggcggtgccatcggctgagccgatggtgcactcggaagaactgcctgagcaagcggctgaacatcagtgatcaaagatcgataattcggaaaaacacctcccggcaagtaaaccgggcctgcagcttgatgctcaactattgatccatcggctatcgtcttcatcatgttagacaaggtgttgactaacactccagattgattgatcaaagcattgtgtacggcgtagtccactcgatcttggaaattgttgaagaaatcttgtgctgtctcaccattctgattaagatttcctcgttgtggctcgtgagcaccatcaccttgaactgcatgtgccccctgagagtcgtcaccctgattctcttgagccgagccatctaaaactcttttcccttctccctccttaaaggtactggtctcaggctcatcgggaaccacctttaccttgtacttttaaacaaattttcccttgcgagtctgtgtgaatgatttgaagaactgttctcgtgcttgttgcatcattgcttcgaagtccttcttctggtcaggtgtgagcttttccggatcaatagccacaatattcccttcattgacttcgctcaatcctggtctttggattttctctttaacagtacccgggctagccgaggatggcgaaggtggcagcttctcggccatgaggaagattgatttctgacttctaattcgtcccaccgggcgtgccaaaagcgtgttgacagaaaacacgaggcctgggagatctgcttaactccagtgcaggtccaaaactcgcgttcggatgtatgagcgtgctagttgatttgatcctgcaatcaacaagaaatagaacaaagaaaccgcaattaatcctataaatgatagccgatcggctaggtgccgatgacatatcatttatttcaagccgatgtcatgcgtacatcgatcggcaaatatcaataagcaaatcagaactaaatctactcaatcggctgtagatattaatgatatataatccttatatcgatatatacttaaatcaagtggttgggatagatcggtcgccttgccgagacagtataaatcacttagatcgaaatatatattaatagtgggattatatacatttatagcatagccgatcaaatggatctagcatgtattggctaatactccgataccactctatattaagatattaaagtaagtagaatataccaaacagaagcctaatatacttagatgtgacaagatcttaacataaagggcagatttaacatatagattaagcatatggaataaaagtagttaaatcagataagatcggctgaaactccgatactaccctaatcggcgaccagaaagcaggctagagattgcaattctaagcatgacttaatagatcaaactcaattgatgcagcattaagtatgaaaagaagaacaatatctagacaatcaagccgctggaagtttcatagagtggtagatatatcacataatctaagttaacgtcattgtctaacctaatcggctgccttccattaacagatgttagccgattataggttagataaagatattatcgaagattatgtgagatatatgataactcgacgaattatatagacaagattagagtatcataaagatggaagcactaatcctgagaacataagtcgtcatgacaagttttacctcttgttgaagatcgaaaccgatgcagctcaacccgagagtacgaactcgtcgaaataaaagtaaagcaaaaagggtggcgatacgccgagattgtattggatgtcgtcccttttttacatagggctcgggtctatttatacccgagaattacaagatacgtccacaacagacatgactattatctctaacaaactctaagataacataagtctttacggcagacttttgcccaaacatatatctaaggaaattacatagaatatcctaattaatagatacaattgccttcccaggactctatccatgcatggcaaccatcttgaagcacatcaacttgaacccgatgacgtacaccgagtcatattatcagaatcggctgtatcggctagccccatccgactcgaactctgccgacctgaccttagccgatttggactgcagccgactcttactctatttccgcaatgatcttcattttggatcccacttcaatctgatcttcacctccgatgccaatagtgatagaatttaccaaatttggtcgttaacagcgtatacttatttctctctctacaaaaataagggatttggggtttaaatttattcacgaatataggagattttacagcactactttcccaatccatccaacctctacatttattctcattgataggcgtgatctttcctaattcaaacacacacagacattgtagcgccccaattttcgttcgagattaaaaatcattaaataaatcatttctagaaattatattaaaaattaaagcaatttaatcaagtgaaataaggagggaattaaaatttcctttaaaaatcatggctacaaataattttgtaatattctctgtgccctaaaatactctctgaacttttcctgcgaattttccgagctcaagaaataatttaaatagcataaagttcattaaacccatttaaattaaatggaaaacaaattatttccccctccttcactttcgaccccttctattccaaagctctccctctctctccttggcccattttcccctccctccttccctcctttctcttgggccggcctctctccctcggtccgcttgcccatgaagtctatttaacctccccttgccaatttcccctctctctccccgacaggtgggacccgaggccccacgtgtcatcttcctctttctcctcgggccggctccatggctgccgaaacagtcccacgctgccacctttttcatgcctccccgcgcttctctctcgcgtgggcccagatgccacccctctcctccacctcgcgtccgtcctgcgcccattttccccactccttcccaccaaatccagccaccatcctccccatgtcgccatgccacttcctcgcaggttgccgcccctaatcggccacgatcccattgacccgagcccacaaaaaggatgcccgcacctccctctccctttttccccatttgcccgagctcccttcaacccctcccgtgctgcccacgccgtccgccatttccgccaccctccggtgagctttggccgcgcgccaccaccactctagtcttcaccgctctactccgccgtcatcgccagcttcgccgccgcaagggcaagccaggccgccactccgttttcccccaccaccatcgaaaagccgccccaccgcgccaccaacctcagccgctcaccagtgtcgttcagccgcccaccaccaccgcttgggtcaccgccgcactgcaccgccaccaccgtgccaagctacatcttggcgtcccctccctttccccaaaacgccgccggaacgaccttcccaccacacacccgaggcagccgccacattcaccgcctccggtcgccgttttcccactgttacccgccatcccgagccacgatggtcaccccagcgtcgttgcactgtgccgtaccacgggcacccgcccacaccgtcgaaaacctcgccggagctccatctccctcgctcgccggtgagctccgccaccctcatcgccttcggccatccttcctcgctgttccggccaccccgcgcttccctaacccctttaaaccccatccccaggtcgcgaccgagctcgtacaccccttcctgagcgtcgctcgtcactggagctccgccgcctccctccggctcgagcttcgccggccgcctccctacagtgtcgttccccgatgagcgctcccctccctctccctctttctccgcttcgtcggtcgcatcctgggccagctcgcgacgcgccgctgccgctagtggccgtccggtcgggtcgctgccgccgcgcgccgcgtnctcgccgggcagccagttgccgccacccctgtcgcgcggccgatctgggccgtcggatcggccccggcctccatctgagccgcccgtgtgtccgcataggtggccagcacgtcggtgccccatcggcgccacgagtgcgccacgtggtgcactagcccgtgcctccgtggactcggtccacggtaggccaaggctccttgagtcaccgacaggtggggcctgcttgtcggctccacctaatcccctcggttgacaccataaatagctttaattgcgcaatatttcgagtaataattatagaaattcatttaaatggctcaaaacttctaaaattcatagctaattcataagaactccaaattgggccattcaacttgcaaaattcatctaaacttgagctctacatgtttgtttacttttcatatactgtttacttggtttttattagagtttttccttgttttgcgtgccagcgcgtagattccgctgtttcggaagctcgcgattacgaggaaagagttcagaggattcttttgaagaagcagggcaagtcacacattccccttgagcatgttgatcctaatttataaatgttttatcgtttgcaaataaaattgcatgtcatgctaattacatgggatcagggttttatctacttcttcgcttgtgccatattacttgatgttcgtcctttgtcaaacttaggtgataattcgactattttgtgttacttatgttgacctagctagaattatatgcttatccatacttaattaccactagttcacataatgggataattacatcattagacacctagtatatatcttgacgagctgcgtgctcgagacatctagccatgtttcattggttgtaattatccaactaaaacatgacttaatggtggtttgtgggtgcatggtttttctagttgcgcccatagcaaattaaggactggttcgctggatgcactggaagacttaccgcgcgtaccacaagcaggaatgggtaattgcttgacttgtagtatagctttcctttggctgacgtacccaggctagggtgggtgtgatcgagtatggatgggccctgcgacggcctatgctgcttccggattcaccgtggcacgaggggggactgcctgctgcctgctgggggaggggtgaaacctgaggtgtggcatcgattggtcagagggagttatatgaagggtcttgccacaatcactcgacatggtgacgtgtccagccgggcacggtgacatgccggtggattgtgtcttgtgggtacagttgtgcacctctggccagagtaaaactattcaaataaccgtgcccgtggtaatgggcgatcgaccagattcaccgtgattagtctcacccttaataaattggcttaatgaactggtttagttcaggtgggatggttaggcctgatcaacgtggtgtagcgttgatcagtgaagatttagtactaccttaattaatcaacagttttactattttgctcaataaaatgttttgcaactacctttatgcaaatagccacaaacctctctttgtctcccgttgcatgagtgcatcattggtgtggcttggtgagtacggtggttgtactcaaccttgctattattcccccttttcagaagtgtagtgcttctgagctgaagacgaagttagaggaccaaggctcagaccccagttgagttttgcctgtggagtggagctgaagcctcgctatgatcgcctttttccgttgctgctgcttcggttttggtgtgagaactaagtgcctcttctgtaagtattttacgctttatttacgtttgtacttgtatattaatttgtcgttttgtgtaccctggctaattcctgaacaaggatttaatacacaaaatagtatgaaattttgggctaaatttctgggcgtgacagacatcaaagtaatttgaacctcaatcttaactttgctaaacaatatagaatctcttatgtttgtgaacggatggagtatgacatgaatcattgttataaatgactcattcgagcctaagcacgccaagttcatggagagagagagaagaaaatgtaagctattgtggtttcaacatctctttggtgtgaaactcgaaagatattattatctgtgtaaaccaaggtacctaggcttcgaatttttttatcacaattttacgttcataaatcgagttcaaacaattatatatggtcattaatttttttcagttctgattattttttttccaaaacaaaattggaatccctgatgtgaagtgcatcaggcccataactgaacaggagaactatagtatgctataggaaaattccttatatatatgtcactagaaatttaccaaacctcaatatgcctccagattttttgttgaaatgtagtaattgatttgtcagttttattccaagtgacagctctactcatcatctgaacacacatagcctctgctgcgccgtagtggcatggaaaaaacacatcacaatagtacatgcatgatatttatgtgattttctttcaagaaggatgaatacatattatatatatacactagttttatttagctggttttggctggtaccctagaggtggaagaatacaaattatccatgatagaagaaaataattgggatattgaagggaagcaaaatagatttcttgttcacctgatttgcacttgtttgaagagatgaagagaccatgctgccaactactttggtagatgaacatgcaagaaaaatatagggtcatgtccattgcaaatgagctgagcttagctaggatagcctccaaaagaaccgaagccacaatggtattagcaagtgtttggatatagaacattctatcagctagcacttcagtatcaataaccttcaagagataagaagttgaggtagcaaaccttgagagtctctttattatcagatgtggacctgttggaaacttaacttcctcgtagttcttgtcgaaacattatctcggcttcctcgtagttcttgttgaaacaatatttcggcaaaactaaaaggggtggctgtaggatcaaggaggccgactagagggggggggggtgaataggcggttttaaaacttttggctaaaaccgaattttgtatgcggaagcgtaaatcaaaatggttttgcacaattcaaaacctaaatcaactagtctcaagtaagtgcacaaaaaagctagcctatgttaaggtttgcaagcttagggtgataatagcacaaataagcttagtatgtaaacttgctcaaatgtaaatgcaacaaataaatgagacaagagacaaggaatttttcaccgaggttcggaaactcgccggtttcctaatctctgttgaggcgaggccaactccaccgctcaaccacgaagccaccgcacgcccccttcgtcaaggggtgggcaaggtgggggccggcccacagagaggattacacaagcctcgatcactagggatagttcttacttctctccgaaggtggttaactccaaaccactctcaaccggcgccgggtcttctccacaatctcttcggagaggtcaccggcaacacctccacaaagccgtctaggaggcggcaacctccaagagtaacaagtctaggatgcttgccgaggatgatcaagtaccacactagctctaacaatgaatcaatgcacttggattggcttaactcactctccaacacctcactagataaactaagtgcacaagggtgtgagagctcttgcaagggttcaagataatgcaatggagtgccaaaaccttacccttgctgttggggagtgggtatatatacccccaaccacaaaaactagccgttggagtcaaaatccccaactctgtgctctgtcggtcagaacgccatagtgtggccggtaagaccggactacttaacggctagaaaactagccattacatggcaatcattgagcccagtcaacctggccggtctgatcgcagtgtagtggccggtcagaccgtccacagctcggtcagattgccaggggctcggtttgaccggctgcggctctagtggctctggattgccaagacgagacctccttcaaaatcaggatgtgcggtcaaaccgccatgtgatctgcggtcagaccggacgacatacttcggtcagacctccataagggctgcggtcagaccacagggcacttttcagctcaatcggccattagtaaaacggtgatatctcttgacttgagtctcggaatttgacgttcttggactctatggaaagcttattcaaagggctatccaacccatgaacaatccatccaagaaacacaactttgcttagggaaaaagggctcacactccaaaagatactccaccagacaaaaccatatgaggctacccaaacctataggatgtgctcacttctctctttgtttgggacttgagaaaactcaccacacttggctagacaagcccaccaaatacacctacatgcatatgaactaatatggtgcaagatcatccacatgctcgcttcatagacccctcttgatagtacggcgcctatctagcaaatccggtctacgccaaacaccaagaccaggaaaagactaagaaaacattcttagctacattatacctttgccttgcaccatccaacttgggatcaagcttgagccgagatcaacacttgtgaccattcgattcaaccatatttatgccgaggtcttaaccatcctttgtcaagactttcttctcatcacaagcttgacttcattcttttcaacatggcgatgtccttggcttggtgaccgtcaacacatggtgtcatgcatccattagcctcattacggtggaaccttgaaagtgtcaattaggcctagagggggggtgaataggctaattcaaaaatcaattaaaagcggaagatgtaattttcggatatttccaaaattttcggatatatccgaaaattttcggagtcagcacaaatagcagagtaaatcctagatctagctgcctacaacaagaatatgctagcacaaacagcaactagacctatagcggctcgaacaagcaaagctagtggagagggagaaagtaaagtcaccaaagatgaagctcacgaggttgttcccgaagttcgaatccttaaggggattctactctccgttgaggagctcactaagagccgggtcttagctaatcctttcctcaagaggttgcactaagcactcctccttccactaagggtatctcttccctttcggaggtgagatccgaccttcacaaacttctcccggccaaccacaagtagatcagtggctcgggagcgacacctagccgcctaggagtcctcaacctccaagagtaacaaatgaagcaaagaactcccggagatgatgcaagtgctcacaaatcttcacgaagtcaacaacaggcactcacacaaactcgaatccacaactctcacacacacaccaaatccatatcgaacacgggtgagaggggaaacaagaaagcaaggctcaaaagtgctagagagagagagcaagccaagggcacaaatgattggaatggaaccagcagccctcacaagtgaggggagggggctatttatagccacagcccagattctgcccgttatgcacaataattgagattttcggatattccgaaagattttcggacatgtccgaaaaattctagctcagcaccaacagtttggtcatggaaggatttttcggacattccgaaaactattcggacaagtccgaaaatttccagtaccaacaacatcgttctagatgttctcggaaaagtccgaaaatataccgaagcgaaattgactctactgatatttttcagaaaaatccgataatcagtttcggacaagtccgaaaatatacagaaccacttttgccttcgcagtcattttcggaaagtccgaaaatcactttcggataaatccaaaaatttccagaagcgaaaatctggttctgtgtgttttcggaaagtccgaaaatgagtttcggaaaactccgaaaaaatccagaacacaccaaactgaggagaaaccctttttttgaaaatagattttgagcactttgatcactcctcgtatgtcaatgcatcatccctcttaatagtgcggctttcctattaactcaaggaaacgaaaacgtacaaaataccatttgctcatttgccgcatcacatcacatcaacgtattcggcgggatatgcattacgctaacttattgaggacataacaaccttcacatttgcttaaataaaaatgttagtcctctctaatcacattgtaattaatcaccaaaatcattaggggcctagatgcactttcaatctccccctttttggtgattgatgacaatacgattagaacacaagagaatgaatataatttaaggtttttttgtgcaaaattttagtggaagctccccctaagagtgtgcataaaagcaagtggagagctccccctaaattattgcatccacattgaagctcacaagagaacaaatatatcacatatgctcattacatccaacacatcgcatgcaaaggaataattacatctcatcacaagcaccatataaagaggataaggcattgcaccacattaaaagataaaaagatctattacatcacaagcattcataattaaacaatagtcttacaaagctttaaacctaacataaaaaatcacaatagtctcatacagataaaaaccaactgtgctcgactctaaggacaagatagataatctaaagccatgatagatagtctccccctttggcatcaagacacgaaaaagagaggacgatgagatgacgactcaagcgaagggcgcctgagaaggatcctctggaggtggtggaggaggatagccatagccatggccatatccaaagaagtcgaagtcgtaaggcaacccagcaaaaggatcctcaatcgcttcatcctgtggctcatcgggctcggcctcgaaacccggaggagaaggagggatatcaatgtggtggtcctcataataccttgccttgaggaacttgacatcacgagccgttttcttcgccgaattccgcaatcggcggttctttttggcctccgtggagcaaagaccaaaaagactccgtaaattgtggaataagggagacggctcacgacgagccacagaggcagggcgctcaggagcaggaggcggcagagtggaagaggagggtatgtcccaagcagccgaggagcggggggccttaagaaggcgcaagtgaagctgagaatgagtcacatcatggcgaaactggagctgagtcacagtctcgatcatccgcataatgtgaagggcatagaccaaccccttcttgtactgaattgaagccatgcggatctcctcccacacaaagtgatagacatggaagcgatgaggagggggatcaaaacggagaagcacggtcctagagaggtggttaatgctgttagcatcactatccatagacacaaaagaccggcgaaacatccggttcaagtaggcaaagtacggcttgaggccgtcgaccttgcccaacaccacatttggatcatttggagtgtaaaggggaagcaattctgtgttggcaggaatttgaagattatgaaggtcatcaaggttgagcaaagaacgaagacggaagccccagatctcagccaactgctgataagaaacagaataccaggacccctgagtcatgcagtgcatggcacgataacgatcaaagtagacggtggcataaaactgagcaatgacctcgttgcaccaattttgctgcaacgtcatgaaggagcggatacccatgagatcacaattggcaatcatagagtcaatcaccggatcgttgtgtgcctgcaactcctcccaattgatctattgcatgggaacagtgggatgagctttggacttaatcacagactcataaaagtcttgctgaaagagggtccaaaaacgcggatccgtggcggtgcagcgaagggagcgcggattctcatcccgacgaggagcaacaacctcagacttgcaccgccaatcatacacttggcgaatcaccgccggatccctctcgggggtatgaatgcggagaggtccaatggggagggaggagggagtcaacccgtagggaaaagaagtggaaaggagagagaagggagtccacggggtgatatataaggaccccgagattttcggatatttccgaaaattttcggatatgtccgaaaggatacagaagagttgcgcacggttctgatgtttttcggatatgtctgaaaatttttcgaaaagtccgaaaaatcctgggattgcagcaattgaaagagggacaggacagagattttcggaatgtccgaaaattcctggaaaacacagttttgcaatgagatttcgctgggaattttgatgaaattatttttcaaacattttaaaggaattttgcaagggacaagcaccgggaattttgacaaaaacaatttttacaaggattttttataggatttaggaaggaagggatggtcgagcactagaggctccatttgaatttgtgactagcacacaatcaatcacacaaaacaatagccacaagtcaaatggacgatccaagggatcaaaagagagggaattaccatgagacaagataattcaccctcgagagagggaatgtgtgaatctatgaagttgtgctaggaccaaaattcattgaaaaatgagatccccatacacatagattcaaaatctccacaaaaaaatgactagtgtccatccatgaattgaatgaccattttgtcacaaagtggtatgcaaacctattctactaagcaaacacgcatgcaatagatcaagccacattccgagaatctaaaatatttagttcactcctgaactcacaaaacctagcttcatctagaggcttggtaaagatatccgccaattgtttgtcggttctcacatgttggatgtctaggtcgcctcttgtggaatgatctctcaagaaatggtggcgaatatcgatatgtttggttcgggagtgttgaacagggttgttggctatcttaatggcgctctcattgtcacataggagtgggattttggatacattgaggccatagtctctcaaggtttgcttcattcaaagaagttgagcacaacaactccccaccgaaacatattccgcttcggcggtggatagggcgacggagttttgcttcttggaagaccaagaaacaagggacctacccaagaattggcaagtacccaatgtgcttttcttatccactttgcacccggcataatcctcatcggcataaccaatgagatcaaacctcgctcccttaggataccaaagaccaaggttaggtgtgtgcactaaatatctaagaattctcttcacggccacaaggtgacactccttcagagcgacttgaaatcttgcacacatgcacacactaagtataatatcaggcttagatgcacaaaggtaaagaagtgagccaatgatggaacggtataccttttgatcgacgtctttaccttgctcgttgaggtcgaggtggccatttgatggcatgggagtgtggattggcttggcgttctccatcccaaacttcttaagcatgttcttcaaatactttgattggcaaatgaaagttccttccttgagttgcttaatttgaaggccgaggaagaacttcaattcacccatcatggacatctcaaaacgtttggtcatcatcctactaaactcttcactaaaagacttgttagtagaaccaaatataatgtcatcgacatatatttggcacacaaaaatatcattattatgtcttttagtaaaaagggttgaatcggctttcccgattttaaagcctcttttcacaagaaaattgcgaagacactcataccaagctctaggggcttgcttaagcccgtatagtgccttgtggagcttgtacacgtggttgggatacttcggatcctcgaagcccggtggttgctccacgtataccaactcgttgataggcccgttgaggaaggcgcttttgacatccatttgatatagcttaaaattgaggttagtagcaaaagcaagcaatatgcgaatcgactcaagtctagccaccggcgcaaaagtttgaccgaaatctaatccttcgatttgggtgaacccttgcgccactaacctcgccttgttccttattacgaccccggcctcgtcttgcttgttgcagaagatccactttgtgccaatcacattttgccgaggtcgctccaccaaagtccacacttcattccgggtgaaattgttcaactcctcttgcatcgctatcacccaatccggatcattaagagcttcttccacccttagaggttcaagagaagacacaaacgagtaatgctcacaaaaatttgcaatacgagaacgagtggatactcccttgttgatgtctcctaagatgttgtcggtaggatgatctctttggatactttggtggattcttgggcgagctaagttgatcggtgagggtggcacttgctcgccttcttcaccttgatccaagcttgagatagagggatcgtcggcttgggttgatgtaggtggctccacttgtgttaaggaagaggctccttgttggggcttcctaggacgtacgtccccaagagccaatcttttgattgcttcgctcggatacttgagagccattaattttgtcaaatgtcacatcacgcgcaatctcaacaatactagaggttttgttgaaaacgcggtatgcgcattcatttgacccatacccaagcaagaatccctcatccactttaggagcgaacttagaggatctagccttcttattaagaatgtaacacttactaccgaaaacacgaaagtaagagacatttggtttattaccggtaagaagctcatagggagtcttcttaagaaggcggtgaagataaaggcagttgatggtatggcatgcggtgttgacggcttcggcccaaaaattgtccgatgtcttgtactcatccaacatggtcctcgccatctcattgagagtcctattcttcctctcagctactccattttgttgaggtgaatatgcagccgagaactcgtgcttgatgccttcttcatcaaggaaactctcgatgcacgtgttcttaaactccttgctgttgtcacttcgaatgttcttgatcttgaggtcgaactcgttttgtgctcttcttgcaaacttcttgaagatagcttgtgtctcactcttgtcatgcaaaaagaacacccacgtgaagcgtgaaaagtcatcaacaataacaagaccatatttgttaccttcaatgcttagataagcaattggtccgaagaggtccatgtggagaagcaccaatggtcttgtagtggtcatcacattcttgacggggtgatgtgctccaatttgtttgccggcttgacatgcgctacacaccctatctttctcaaattgaacatttgttagtccaaggatgtgatcgtgctttagaagcttgtgaagattcctcataccaacatgggctagcctctgatgccaaagccaccccgtgttggacttagccactaagcatgtctcatgtttggctttacttgaggaaaaatccacaaggtaaagctttcccttgaggacacccttaaagactaccgaggaatcattccttctatagacggtcacatcaacatcggtaaaaagacaattataacccatagaacataattgagaaacggacaaaagattgtagtttagagattttaccaagagaatgttggcaatggaaagatcattagaaattgcaatcttacccaatcccataacctttccctttccatcgtccccgaaaactatgttatcttgtgaagtgccatttggatcaagagttgaaaacattgattcttctctggtcatgtgatttgtgcatccactatcaattacccaacttcttccaccggagacatattcctacaagagatcaatttctaattttaggtacccatacttgcttgggtcctctcatgttagtaacaagtgccttaggcacccaaagtactctcttgatagaaatattcttgccccttgggcctacatacttagcaacaacacgaccactagcattcttcctaagaacataagatacatcaaaagaacaatatgaagcataatcattaggaaggatacttttggccttaacaaaattgctaagaccttggggcctcttgatcatcacactcttgtccacctttccttttggtggagaaacatacccaagaccctcatggttgaagttgtcccttttgatagcctaggtactcctttagggccttactacccatatggcacttaagtaggccattgtgaaggagtcccataagcttctcatttttcttttgcaaagcactcaaggaaatagagttagtagcacaagcttcaatatcaatatcattgcatctcacacatggttcattgcttgggacaattttggaacaagatggctcgctagggagagagacactattctttaaggttacgaagttctcttcaagagtgaggtatgctttgtccaagccatccactctctcttaaagttgagcgttcgccacctcaagattagcatgagactctttgatttgcttgtaaagccgtaccaatgcctcatttttctctctctccttagcaagctcactcttgagttcatgagaccgctctttctcacgaatgagcaaagtctcttgcctctcaagagttgcatattggtcctcaattctctcaagcaactcactcaagtgtggtagggattccttagttatggacttgaacaattcgtcatctataacctcatcctcaacctcatcctcctcatcactaacaagatcaacattaaatgacttaagaagagaaggtaccttaggctcctttgccatgagacaaaccggagcatcctcatcacttgagtagtcgaagagtctcggtggtgatgagggcttgacggcaaacgtggcgactccttcttcatcacttgagcttgactcggagtcggagccgaagatcatcccaaggtgagcttggccataatgttccctcttgctatgcttgtgcttctccttcttctcatccttcttcttatcttccttgatgtgggaaccatccttgaggtgggggcaatccgcaatgaagtgcccgggctctttgcacacgtagcacactcttgcggagtgtcttccacttgacttgttggagtagtgcttggaagatcctcccttgaagaagccgcttcgcctcatgaacttgccgaacttcttgacgaagggagccatctcttcatcatcgatctccgccttgctcttgctcttgcgattctcttcttcttcttcctttgccttcaaagctaagtcttccttcttgatgcttgcggttgagctttggttgatgtattggatgacatccttggactcttgcacgagcatgtcaagggcaaggatgcatccgagcaaatcatgaggtgtgagagtcttgtagtccggacgctcaaggtagagttccttggagtgattgctcgaaccatcttcttgaccacaacctcatcggtcatgtccttggagccaagtcccttgatctcattgatgatcttgctcaaccggtcgtacatgtcgcttgggctctcaccatctaacatcacagatctctcaaattgccccttgaggatctccaccttggactcacgaacactatccgtgccttcatgcaagttccgaagcgtgtcccaaatcactttggcactctcaatgccatccacacggttgaactcacttccactcaaggcgctaagtattgcattagcggcttgagcgttcttgtgctcgttctcgtcgtcctccttggtgggatcttcgggattctgcaaaacatagccttttttgactattctccaaatagatgggttaatagacttcaaatgcatcttcatcttatgcttccaagcggcatagtccgtaccattgaagtacggagctttgccgctataggtactcacataagatgtagatgtagagggatagtcataagggatcttagctcccttatcaccatcgttcccatcccccgcttggcccgacatgatctctccaagcggttaagtctaattaggagattaggctctgataccaattgaaagtgtcaattaggcctagaggggggtgaatacgctaattcaaaaatcaattaaaagcggaagcagtaattttcggatatttccgaaattttcggatataaccaaaaatttttggagtcagcacaaatagcaaagtaaatcctagatctagctgcctacaacaagaatatgctagcacaaacagcaactagacctattgcagctcgaacaagcaaagctagtggagagggaggaagtaaagtcaccaaagatgaagctcacgaggttgttcccgaagttcgaatccttaaggggattctactctccgttgaggagctcactaagagccgggtcttagctaatcctttcctcaagaggttgcactaagcactcctccttccactaagggtatctcttccctttcggaggtgagatccgaccttcacaaacttctcctggccaaccacaagtagatcagtggctcgggagcgacacctagccgcctaggagtcctcaacctccaagagtaacaaatgaagcaaagaactcccggagatgatgcaagtgctcacaaatcttcacgaagtcaacaacaggcactcacacaaactcgaatccacaactctcacacacacaccaaatccatatcgaacacgggtgagaggggaaacaagaaagcaaggctcaaaagtgctagagagagagagcaagccaagggcacaaatgattggaatggaaccagcagacctcacaagtgaggggagggggctatttatagccacagcccagattctgcccgttatgcacaataattgagattttcggatattccgaaagattttcggacatgtccgaaaattccagctcagcaccaatagtttggtcaacgaaggatttttcagacattccaaaaactttttggacaagtccgaaaatttccagtaccaacaacatcgttctggatgttctcggaaaagtccgaaaataactttcggacaagtccgaaaatataccgaagcgaaattgactctactgatgattttcggaaaatccaaaaatctgtttcggacaagtccgaaaatatacagaaccacttttgccttcgcaatcattttcggaatcatatacaagagaggcaagtgtatatgtataagtaaagaagaactaatggggtttatcctatacacatggagaatgcatatagcaatgacaagacaaacaaaaacacaaacctttatgatctccatgttctcaaagtaaaggagactaaataagataatgctcaagtaaacattagtctcacacttatataacaataacatggaaatcatatatatgaacctatcaaaaagtaggagataagaagtgatacatattgctttttctccatgcatttcatccttgtcatgattaaggtctatctaccacatctcattatcgggaaataacctagttgacaacttatgtaaaagagaggttaatcccataaatatcggtttatcatctatcaccaaagcaacaattacacaaattgtttaatccaagatctttcaatcttttctctcttctgtgatagataataacccgatataaacaatatagagagataagatgaaagatgatttcaaatcaaaggtagaaatcttataataaacaaaatatagaataagctccccctcaagatgtgcatatatatggatataaaggaacacatatgcacataatcaatcgagattaatgagggagcttacactatattttggatccacaagagagaccaagttagaatatataaagtataatacatacatctcatcatttttattttcatatcaaaatgagtctagtcaaagaaaagctcataaaaccgttagtctcatttaattagatttgtcattaatcaccaaaaccaaattaaggcacttgaacttacagtggctatcaagctggaaaagtggataggttaggagacacgaggtttatataggttcaggccttcttgatgagaattaataccctactcctatccagggattgatccgccgagtgtattattgatcatatgatcaacgagaaaagttatgcccctagaggcatccggacccctccttatatagggggaggagccggaattacaagatacagcccatgttcctaacgtactaggcatgtaaagataaattacaatcataaccgactaggactatcggatgtttccttgatacacaagttaacataacaaccgggtcctttactaaatttattctatatgtacatggtacccctatacccagtcggatatacatgccgtgtgggtatggggtatccataatctccacagtagcccctgagaccttcgcagtcgacgagataatcttctcccgagccattaaacaaaaatcctgagtgcttcaattattgccgccttggcctcccgagtgcttgaatcaaaggctgtgaagagctaaaaaataaaaaattaggtgcattgattagatgcaccccgactaaacatatagtgaacatatagtgaaggttgaaacaaataaccatccgagtggttttataaataatattaccgaagtaattaaatattaaacatatgtgactccattcgaagagtttgccaactgatttaattaaatcattaagctcactatgaaacatagaagatatataaagatccgagtgataaaagcattctaaagatctatcgtctatttcagagctaaatacatcatttgtgataaaaaatccgagtaaaaactcataaggatttatcaactgctgaataaatactgaccgacaagtttaaccaacctaagttgtaacttgagcctatatcagaaaaatgaagcatataagtgctcagaaggaacaacagctttaaaaaccactcgtcctgattaaaccctaatagctttgtgaccttatagaaaaagtcaacaaaaataacatggcgtttttaactgttgggcacctttttgtatgcatcgtagtaattccaagaaatttactaactgcggaaaaaggattttaatggtatcgggctttatttattatgggcaattttgcctgagcaaaaatacgcctaagtcccaagagaccacaatcagccacaccgagagtgtatttgagctgaaaacactgtttgggcctaggcccattagcattttccgatacccatcgataaaaatcgcaccgaaggaaaccccatcgtcttcctcgccacaacagccgcgcgttccccattttttgctacagtaacaggcttgcgccgccaaaagctagggttcgcaactgtaccgcaatccacctccttcaaatcagcttccttcggcaaaattcctccgcacaacccctgcccccaatttccctgtcaatcttcgtgctctaaatctctccaccccattttcatccatggcggaagagagagaaaattttgagagtcaatgggtgccttctgacgtcatagaggaaaccctcaaggagatgatggcgcacggggtgttaccagccaaggagaacatcggatggcatccagcatttggtgaggcttttccgacccccgatactcacgagattgtcgtcttcacccatttcttctatggtggttttgctcttccaacatccagattctttaggggaatccttgaattttataggatcaatatctatcacctcaacctctactccattgttcatatagcaaatttcatccatctttgtgaagtttttttgggcatttggccaaacttcgccttattttgccgaatcttttttctgaaaccccaaccgaataagaacaagccctgcatcgttgggggatccggcttccagcttcgtggcaccctatgccagaagtacttcactcttcccttcaaaacctccaataagggctggcatgctagctggttttacatccaaaagccagatcctgcgctacacgaatattcatgctgccctctgaaatatcaagacatctagaactcacttcctatgggcgatgaagcttctcaagctcttgagttgctggaccgactgctgaggctaaaggaacaaggccttcaagaagagcagattactcagcacttcataaagtgtcgactggctccaatcaaagagagatctcgcacggccttcgagtacgacggaaagactgatcccaaccgagaagaccccaactccctcgaattcaagatcatgaaggagaggatgtataaaatcttctcatctggtattgtggtcagcttctcacatttgctgccgatcgtgccatacaacgccttcaatcctcctccagcggtaaatatctaaatgcttggacttttatcatgctattcttgggaataatctcaaaattgcttatccatagggaaatgccctaatgaaatccgaccctccaaccgctcaacgtcgttctccgtggcatcaccaaggccaagctaccgggggtccaaagattcaacccgtggcccaaaagagatgctattccgcccagtcaaacggtttctcgaaaaaggaagatgatcgtaagcgatgatgacgatagtgacgatgggccagttggcaagcagccaaaaaaggctattccaccgaagaagaaaacaaccagtcacccaatgccaaaaatccgaagatcttccaggtatgagttcatcaaaacattcggatctgtgtttgttgagatcaattggtaataccctcttgtaccttaggaaaccatcggacattgatccgactggtaaaaactctgatccctctactagctcgggagcggctgaagaagaaaagactagctctgctgctgttgccgggactaatacctccaaagaaaatccaccgactagcagtcagtcggcaactggtgaaactgaagctgacaacgagcccccgactggaaaccaatcggcatctgccgaggcgagcaccagccaggagcccccgactggaaaccagccgggtgaggataaagagaatccccagcagcaaaatgtagatggggaaaaaaatattcctgagacggaagagcagaccagcagacctcctctgaaccaagatacagatgctggacctgaagctagtacctttgacaaggtggagggacctgctcggccaccaccgacaattatcacaggtaatgctttctccagtgaacttatgtcaagaaaaacttcccttattatttcattgctgcctatatacttgaaggcccaatgattggcgacgaagaagaaattcttcggattaaatcaactgaagattctcggccacctattttggttaaatggtgggacgacgagatgcagccacagggtattgtgataaacaagcaaaaagaggacggtgaagtggctctgctgacaaggactctcaaccaggctactcgtcttttaaacgtaagtatactgccccagtcatatttcgtcatccattgaatttgttgaggtgaacatagtattgcgcagagaatccatcttcggaacgaggcaaaaaccgatacccttgaaaagctggtccctcatcttggtactctggaagaaaccagagccaaactgcatgaaaccaaggaggaggccaggaatacagaacatgaacttagggataggattgccgagctccaggatgccaactttgaattgagtggttcctcgaaaggtaaatattattcctgctcaactgttcaaacttaatcttagcaactgtataagttttgtgtgcactacagttcaagcagccaaaatctccgaactggaaaagcgaatcaaagccttagaagacgaagctgctctacccaaggagaaagatttggcggtcaaagaatttgaaggtaactcttctgactaactataaatgaaatttagccaatactgttgcatctaaattccttgattggtgttgtatgcagatcataaggggaagacaaaggcacaattcgacttcttgatcaacaaagtcgaagttgctaaaaaagctagaggcgaagttgccaacactgctaccccaattatctaggccatgtatttgagcaatagtggtacgagctccttggacacagtagaaatttttgataagttaaggactgctctagatgtgtacttcaaaaatatcaaggaggctggaaatatgggagcaagcatggcattggcaatgaccaagtctctgtaccccaaaatcaatgtcgatgctattgatggctttgcagctggcacaagtgaagaagacgcacatgatctgattaatgatgcccaaaaaactgctgaaagaattgctgttgatgtactagataggtttcagaacactagccttagtcctgctaactctgatgatggagaagatgactctgacgagtgatcatgtaatactgacaatggaggttcaattgtgtagtactgatatatttatgttgtgcttgaaaatttaaacttagtttctgatttcttaaaagtgtttgtcaaactttactgagcctagaacccgcaaaagtcgtcaaaaaactttcagtccttattgactaagctaaaaatcaaacagggcaatgataaatcaagtaggcaaattgaattgataaaaatcacactccattattattattatagcccccgactggtaactcaagaaatacttgatgttggcagtcaagagaaacataatgtacaaaaataatgcctaagcataaaaacgacaaagatgctcaatattccaagaattatcgacgaccgaaccatcttcacgcttgagtcgataagaacccggccgagtaacttcagagatgataaaaggcccttcccataaaggagataacttatgccgatcccgtatagtttgaatcttcctcaacaccatatccctgactaaaaatgcgtgtgatctgacattgcgattatggtaacgccgaagtccttgtaaataacaggccgactggattaatgctgcctcgctagcttcttctagttggttgagatcatccactcggtctttctcatagcgctcctctttaaaattgtgaaatctcatggattcaaactccacttcactcggcaacattgcttcagcaccataaaccaagaaaaacggcgactggcccgtagcccgactaggcgtagtgcgcagagaccaaagcaccgacgacaattgttcaacccatttgccagcatagggacgaagtcggtcaaaaaccagtgtcttaattccttgaagtaccataccattggcgcaatcaacttgaccattgctcataggatgcgctatggaagcataataaatctgaataccaaagtcttcacagaaatctttaaaaaccccaccagtgaattgggtactattatctgtaatgattcgattaggtactccaaaccgatgcacaatgttgataaagaaatcgtgagcttcgtcagctgtaatagtaacgactggtttcgcttcaatccacttggggaacttatcaacaaccacaaaaaggtgagtaaatcctccggtagccctcttgaaaggaccaaccatatcgagcccccaaatagcaaaaggccaggaaagagggatggtttgcaactcttgagctggcagatgaactagcctggtaaaaaattgacaaccttcacacgttcacacaaccttctcagcatcagacaccgttgtgggccagaaaaaaccctgccgatatgctttgccaactatggtttgtgctgccgcgtgactcccacaaattccataatggatatcatgcaacaattgcctgccttcctcaagagaaacacatcactgtagaattccagatgggctctttttgtataactcagcttcaaccatgacataaagcttactacatcaagaaatccattccgcttcattcttgtcttgaggtaactcttgctgagttaaaaatttgatgattggctctctccactcgacatcaatcatccctacttcattggtctcttcatcttcagttttatccttctttgataatgtcggctcatagagatgttcaacaaagacattagaaggagatgcttcccgtttagatccgaaattagctagcctgtcggctgcttcattgtggtgcctaagcacgtgagttaactccagaccatcaaacttgtcttacaatttacgaacttcttgtcgatatgcagccatattgtcatcaagacaggaccaatccttcatgacttgattgataaccaactgagaatcaccacggaccaccagacgctgaatccctagagatacaacaatcttcagcccatggagtagcgcttcatattctgccacattgtgagatgcttgaaagtgtatccatagcacgtagcttaacctctctctagtcggggaaaacataacaacccttgctccagtgcccgagagtctttttgacccgtcaaaatgcatagtccaatactccaatttctccccaagtgtatcttcctgacactcggtccactcggcaacaaaatctgccagggcttgatacttgattgacgttcgtggcttgaaggatagatccaaagacatcaactccaaagcccacttcgcaatacgtccagttgcctctcgattatggagtatgtcgccgagtggaaaagatgtgactactgtgaccgagtgactttgaaaataataggacaatttcctgacggtaattaaaacaccatataataacttttctacctagggatatcttgttttggagtcggccaagaccttgctaacgaagtaaattggtcgttgaactttttgaacatggccctcctattctcgctcgacaaccaaaaccatgcttaccacctgcgatgttgctgacacatataatagcaatggttcttgcggatgtgatgaagctaggactggtggagtcgtgaggagtctcttgaaatcatcaagggcttgctgggtttcgggaccccactagaaattatcagtcttcttgagtagcttgaaaataggcatcccccgctcgccacatcttgaaataaaccggctaagcgccgccatgcacccagtcagtttctgaatatctttctgggagctaggcggtttcatgttgaggatggcattgatcttctccgggttggcttgtatgcccctatgagacaccataaagccaagtagcttccctgacagtactccgaaggtgcacttttcagggttcaatttcatcctaaaagcactaatgctagcaaaaggtttcctccaaatcagcaatcaaatcagccttctgcttagtcttaactacaacatcatcaacataggcttctacattgcgaccgatctatgttgaaaagcatctctggatcatacgctgataagttgctccagcattcttcaacccgaagggcatagtaatatagcagtaagctccaaacggtgtaataaatgaggccttcaagcagtcggattcctttaggttgatatggtgatatcccgagtagcaatccaaaaagctgacccaaaaggatctttaggaaatgatttgttgagatccgtgtagtcaacacacatgcgtcattgtcctgttttcttccgaactaagactgggtttgctagccagttgggatgtaagacttctttgatgaagcatgctgctaaaagcttggtcagttcttcgttgattgcatccttcctgtcctaagaaaatcagcagagtcgttgcttgataggcatagtgtcatctttaacatttaaggagtgctcaatcacctctctagcgataccaggcatatcagatggtttccatgcaaaaatatctttattagcttgaagaaaggtgatgagcgtgctttcctatttacaatctaactctgcgtctattacagtagttttggagagatcggatggatcaagaggaatcttcttagttttgacatcgccttcttcggtctttggcatgttagttgcaggcactactccttcggtcgtagttgatgcagccagtcggattgattcatgggcaagtgtaatctcatgagtctgggccatctcgcagctttccttgtcgtaggtgacagctttcttgatgtcgcttcgcaaagatatgactccacgaggccctggcatattcatcatcaagtaggtgtagtgtgggacaaccataaatttggctaacgccgggcgtccaagtatagcatggtacgctgtctcaaagtcagcaacttcgaaacaaacgttctctgtacggaagttctcccgagtgccaaaagtaactggcaaggtgatctggccgagtggggttgaagacaaccccgggatgactccatggaagggcgcaccactcggtttcaactcggttcgtgggatttgcatctcgtccagagtcttggcaaaaagaatattgagtgcactgccaccatcgatgagggataaccgaagtttgatgttgcgaaccactaggtctagtaccagggggtaccaccctgggtggaccactcggtcagtgtcacgcccggaatttctatccaaaattccaaacgcttacatgtgtgtaaaccctcgtccagaaatcagccgaggcacacaataacaaattgataatagagtacaattattactctaattaataagcgaatataaagtcattacagaggtagatagttcctctcaaacaacaaagttctaagcagcggaaaataaaagaaacagcacaggcgactcctctccacaggcagcttgaccagggctacgcctaatcatccacaccatcagcatcactgtagaactcctcctctgatgaatgactgcaaggtgagtatatgacatactcagcaagccacgcaacaaatatgcaagtgcaatggataacgaaggatggcataatatgggctcatttgcataaacagcatttaataagcaattgagagaatagtaaaacagttgagtaattaaacaatattaaatcaacactatacaatacacccgtgttgcataggcccaaccattctgaacaaccaatcccggctgcacagttctatctccaaaccaggaatataccattccaaaccaggagctaaacaagttattaacatcatcatttaatatagtgagaagtgtgagactaatcacgaaagacattgttagacccgcccataaccgcgggcacggctattcgaatagtttaaactctgatcagaggtgtaccactgtacccacaagacacaacctcaacatcatgtcaaccatgcgtcgcgatacttgacaagtacccgaatagagattgtgacaatacctcctgcataacacaattcaaagcagtgcaccgttcctggatcataatcacccccttataaacaaggcatggactccccagcgacccccgtgggcttatctccgccacttcacagtctggtgctctacaatgaaccacactatacagaaagtaaagccgttgcccacgctggcttgtggttcgcacgattaatgtttcacaaccgaaaatcgtgaaccggtccttaattgtcatgagcacgaccatcaaaaccatgtgctcacaacccaccattatcaagttttagttggcaaattaattaattaaccaatcacgatcaaccatcgtgagctatcattaagccatcattaaataatagtgaatcataagttatcccatttatatgagctagtgtctctaagcatggctaagcatcctaatcactttagctaaaaccatataatgttctagctaatccaattattaactaggtgacaaagaataggtaatcaacataaaaaggctataacaaaggcaataggttatatccacccaatgacattcgaaaataaatgcaatagttgaatagaaacaatagctttaaacgggatcaacatgctcaaagggttgtttgggatctgtgtgacttgccttgctggccttggaactcttcaaagtcttctcctgcaaaatcggactctccgggaacgtcggaatctaaagagaaaagagcaaaatcaccaaaacagcacataaacaagcatgaacagtacatgtggatatttttaacatgtagatctcaattttagaaaaatttagagacttgaaccaactaaatccgagctaagatgaattagttatgaatttttaaagattaaatcagattaaaccatttatatagatatcaattgaattatgacgcaataatgaattatttttgaaaagaaaaaggggattattgcgtcagcggctagggttcacggtggaccgggtgcacggcggcggtctacggaaacgaacggccgagatcactctaaccaaatcggacggtcgagatcgatctagtctacggcggttcacgagacacggcgacaatgacgtcagcggtgacgtcatcaccggcgacggctcggacgacgcatgctcgccggtgaacgacggcgcggcggcgcgaacggacggcacctacgggttgcggacgacacggcgaactcaccagggaccaaagcagcgacggaagatcaacagacggcgacggcggcgaggaagaagtggcggcgaccttcggcttgacgacgacggcggtgctccggtgacctacggcgatgacggaggggtggacgaggtaggcgacggcttggcgatcacgacggcggccttcccgagcgacgacgacgaccggagcggcggcgacgcacggctgtacgaacggcggcgacggcggcgctaagctacacggcgctagggctctaccagcgacgagagacgaaggcgaaggtagcggtgggtagcggagggctcggcggtccttttatagcggctaaagggcggcgacgaaggaccacggcaacgggcgacggcgatggaaagttagggttcgggagagagagattgatccgaatcgaactcgaatccaccaatttccaaaagaaattagccgatgattccaaaagagaaaagatagaggagatcaaggcgatcatttcccctctattgatttcaccggagaaggaaagacgcgatcgaattggaagggcggcggcggctacgcgcggcgtggctagggcacggcggcgcgaggaggaagacgagtccgacaagtcggccccaccttacagcgggcgagggcgcacgcgcgtgggctgactgggctggggaaagagagagagagagagagagagagagcttttgggccgactttcggcccaaagccaaaaggagacttttaaaacctttttcaatttaaattattcatgaaatgcaattccatttattaaaaatgcttccttggctcaaataaatcccagaaaaatctaggaactatagaatcaagtgaagtatttaataaaattttatctggcccacttttatattggaatttattatttaaaattagatcttctcttctaggcttttaaaattatttctaataattccaattaaacaacaatttatacatttgggatttttagggtgtgacagtcagggtgattcgagtagtcaaacttaattgctatctccgaccacccgaaggtattgaggtgtgtccgactgaacggtattgatctccttatcagttagcttctgcttccgtttggactcataggcttgcggcccaaccaagatgtgattgagctccttacgagaatcttgaaaaccaggtgggccatcgtcatcgtcgtcctttttcttcgaggtgctttgctctccatcagtcagcttcttcgcttgtttggcatattgttcggcaaactgattatagatgaaacaatctttggcagcatggttggaatttgggtgatgcgaacattgagcattcataattttgtcgaaggtgttgactcgcgattgttgacgggaagaatgtgttgtagtcgccaccagatcctcgggcttccgcttgtgatctttgttatgagtgccgcttccactcgcccctacggttggtccatctttcttggatttctagtggctgcccgactggttggaagcaagaacggcttcgtcagcctttgcatactcattggccttctcaaacatttgcttgactatcctgggaggcttgcatccaaacttgccgactagaaggtcattacgaactccttttgtgaatgcggctatgatggcatcatctgtgatatcagagatcttgttgcgttgttcagaaaagcatcgaatatattcccgaagggtttcaccgggcttctggaccacgttatagagttcaaaacatgtgccgggacgctcgaaggtgccttgaaagttggcgatgaagtgatctcggagctccgcccaagatcctatggtgcctcgtggtaacccatgaagccaggatcgagcagagtcagctagggccactggtaaataatttggcattgccttgctatcttctcctactgcgcggattgtgagaccgtagacagtgagccatggttcaggatctattttttcgtcatacttctcgatgccagtcggcttaaaaccagccggccaatccactcgacgcaggtcgcttgtgaaagctgcgactccatcttcatcatattcgtagcagtccagggttcgatgccgccgatcacctctttctgcacagcagcggttaagtgtgtcacgtaggtcaatgggttgccagcgacatggcaagtgaggctgctcagcgcgtcactctctgtgcctatcggctggcgaatgaactaaatgttcatgatgatccctgcccccgtgagcagaccatgaccccccgtgattggatcttgaccccgcgatgctgagacttggttgatggtaatcttcagattggagggatggaacccgactgccagttggcacccgaatgctttccaggttgactggaactgatgcggcgatcattgtctttgtctgattgattatgttgagaacgtgattgggcacatcctctttaaggagtgtcagggttacgggttaggcataccccctacccttcgatatacgttacgtatcgacatggcatacccacgcgcacgcggatatttcctttatgatctaaggaaacctttcacgagatcaatagatgggaaaagtccttctcggacaagaactgggtcacctacgtatcgtgctaggtctggtatgttcgagtcccactcggagagcaccagacctgcgatataaaagggaccccccagggagggcatagatcatcgaatctcagtgccaacataacccacacagcctacgaagtcagagcctgcgaggagccaagtcgtcaagagctagtcgaatgagctcgactacaatctcgccggatctgacaagttccatcctttcctttgtaacctatgttttccaccgtataatcccacatcaattggattagggctattacctgtcaaggggcctaaaccagtataattcttgtcttttgattgctcgatgtcgtattacgtagatccttgtaccagcgtaccccaataccctctatatccggtctacgggtatcacccgtcgacagtggcgcgccaggtagggggacttggtactcaaggttctactactatgccatcaagcttcgtcgacaacaacatcaacaccagctccagccaagcactctcaacttcaacaatgctggtatggactcatgtcggcgaaatcgtcttcccggtttacaccatgacgccgatctcaaccggtcctccaatgactgaaaacgagaacgtagtggctacgaaccaagacggctccatgtcgaaaaatccacccgttgaaacggagaacggattaccgactacatccaaactcgagacggattctgatgcggccaaatcttgtccctccgacataaatcacgggccgacaaagatgacttctggtgtcctatccacaaaaccaagaaacatacccttcaagattgctgggtattcatcaacgtccgtgctgaaattcgcgcctacaaggaacgtggaattcagtgtatttctccaactcgggatgtctattgtcctatccacaagacaaagaatcacgatctctcgagctgcaaagtcctcctcggcgccatgaaaaccctgtctcctaagtcatacgtccccgctagggataacggcaaggaacagggagcgactccagcctcagatcgattcgttggggtaatcgatctcgatcctcacgaaccatcggtcttacatctcctcgaagactacgggtcatcaacaacaagtgcgccatgggaagtattagttatcgatgacgttggcacatcagcacaagccaacgcagaagcggcgaatcaatcgactactccggcccagcacatcagggctattcaagctatactgagggaaactccttacgatcctgttctgaacgacgacctcgagcgttggacagaacgattacgggagtcggtgaccaacctcagcaatgcgttcgaagaggccgctaccgcagcacaccaagatcagccaccaaccggcgacgccaatggtgaagatccggagcggagggaattgcctcgacaggctacccctccacctcgtggcactagcgatcttcgagatcaaattaacaaccgccgagaagcacggcgcacacgggacgacgcaaatcgctctcggcgtcatgtttcttcacggcgccatgatcgaggaaaccgcccaaacgaggacccagaatgcaacgatcgcgaacggcgggggccaaacaatactggtcatggccgtcgtcgcaacgacgacgacgaaggagatcggcgccgagataatagcgagagacaacgacaagattcccgggatccaggtcgtcatcctcgtaatcgtacgccggagccaagcgacccatcgtcatcgtcatcatccgcgtcctcttcatcgtcagacagacatccacgaaggtcatgcgaccgccgacaacccaccgcccctagtgctgggtgtagggctttcggtcgttcccaacgtgatgtccgatggcctgagagattccgacccggggccattgaaaagtatgatgggagcaccgacccagaagaattccttcaagtctactcgatagtgttttatgctgccagagcagatgacaacgcgttggcgaactatttaccaactgcgttgaagggttctgtacgtacatggctgatgcatcttcccccctactcaatctcttcgtgggcagacctgtggcaacagttcgtcgccaatttccaaggaacatacaagcgccacgcgatcgaagacgacttacacgcgttaacacagaactcgggggaatcattgagggaatacgttcggcgcttcaacgagtgcagaaacacaattcccgaaattaccgacgcttctgtaactcgcgccttcaagtcaagtccggtgtcagagatcgctacactacccaggagttggtgacaagacgcatcacaactacccgaagattattcgagatcgttgagcggtgcgcccatgtggatgacgcgctaagacgcaagaacgacaagccgaagactgggggagagaagaaaccagccgcagacgcatctgagtcgaataagaagaaaaatcgcaaaaacgggaaaaggaaagcttaagcggaagtcctcgcagcagaatacgcgaaccctcccaagcgcccagacccacaaggcagcgatacaaagaaatcatggtgccccatacacaaaacggacagacattctctggaggattgccttgttttcaaaaagtcgctcgagaagcacatggcgtttcaaaaaagcaagcgagtacgcgttgtcgagaagaacgaggagacacctcctcacgaatcggatcctgcgtacccaggctccgacctccacgtctcacacatcttcagcggctccacaacatactcctccaagcgggaatacaagaaagtggaacgtgaagtctgttcgacgtggtaggaggctgcacccaagatgaagtggtctgagcagagaatagagttctcggaagaagaccaccccaagacatctgttatcccaggacgatatccgattgtggtcgaacccactattcggaacgtcaaggtagcgcgagttctcatcgacggtggcagctcgatcaatctcctcttcgccagcactctggatgcaatgggaattccacaaagtgagttgacaccaaccgatcaacccttccatggaattactccccaatcatcgtccagacctctgggcaagattacgttgcccgtgactttcgaccaagccaacaacttccgaacagagcagatcactttcgatgtcgctgaattcgatacagcttacaacgccatcatcgggagaactgcacttgcgaagttcatggccgcatcccactatgcatatcaagtgctcaagatgccgggaccgaagggaacaatcactattcaggggaatgcaaagctggcggtgcagtgcgacaggcggagcctcgacatggtcgagcaaacgcccaccccacccgccacgtctgagccacccaagaaagtgagcaagccaaacaagacgccgaagccggacggcgccatcaagatcattccgctcaacaggctaaccccgacaagactatcaaaatcggggctacactagatgagaaataggaactcgcgctcatcaccttcctccgcgataatgtcgacgtgtttgcttggcgcccgtccgacatgccgggggtccccagggaggtgattgagcacaaactcatggtgcgacacgatgccaagccagtaaagtaaagactgcggagatttgcaccagactgaaaataagccatacgagaagaactcgacaaacttctcaaagctggcttcatcagagaagtacttcatccagagtggctagccaacccaatcatggtgcggaaggccaacggaaaatggagaatgtgtgtcgacttcacagacctcaacaaggcgtgccccaaggatcactttcctctccctcgaattgatcagttggtggattcaacagccggttgcgagctattaagcttcctcaatgcttactttggctaccaccaaatcagcatggcaaaaaaggacgaggagaagacagcgttcatcacaccgttcggggtattttgctacgttaagatgcctttcggactgataaccgccgggaatactttccagcgcacggtccagggcgcacttagcaaccagcttggcaacaatgtcgaggcttacgttgacgacatcattgtcaagaccaagacaagcgactcattaattgacgacctgcgggaaacgtttgacaacctccgacgatatcgcctcatgctcaatccagagaagtgcacattcggagtaccgtcgggcaagctactcggattccttgtttctggcagaggaatagaggcaaatcccgagaagatcaaagcaatcgagaacatgaagtcgcccacaagacttaaggaggtacaaaagctaaccggatgcatggcagcattaagcagattcgtcgctaggatcggagaacgaggacagcctttcttctctttgttgaagaaacaagacaaatttgtatggacacaggaagccgaagaggaatttattgcactcaagcgctacctatcaaacccacctgtactcgttgctccccaacctaatgaagaattattcctttatattgccgccacgccatattccgttagcactgtcattgtagtcgagagagagaaagtacagcgaccagtttattacgtcagcgaagctctccatgatgcaaagacaagatacccacagattcaaaaactgctctacgcagtcatcatgacatcaaggaagctacgccactactttcaagcccacagagtcacagttgtcccctccttcccccttggcgaagttgtgagaaacaaagacgttgtcggccgcatcgcgaaatgggtagtcgagctaagccaatttgatatccactttgtgccgcgaacagccatcaaatctcatgtactcaccgacttcatggccgattggaccatgccagataacaagtcagacaaccaaggcgacaatgagacatggataatggcgttcgatggcgcactcaacagccaaggagcgggggcaggatttatcttgacatcaccctccgaagatcaattcaagcacgcaatccacctcaacttcagggcaaccaataataaagcagaatacgaaggactactcgctgggatacgagctgcagccgcacttggggccaagcgactaatcgtcaaaggggactctgagctagtcgcaaaccaggtgcacaatgactacaaatgctccaaccccgagttatccaagtatcttgcagaggtcaggaagctagagaagaggttcgacgggatcgaggtccgacacgtctaccgcaaggacaacgtcgagccagacgacctagcatgatgcgcatccagacgagaaccgctcgacaccggcacctttctcgacgtcctgatgaagccatcggtgaaagaagttaacggtgaatctggcccgagcacccccgacattagctcgaaggacaccgaggcagaacgcgccgttgctgacatcgaaaccacagacgactggcgcaccccattaatcaaattcatcagcagcgaggaattgcccgaggacgatacagagaccgagaaaataacccgtaaagcaaagatctactgtatggtcggtaacgatttatacaaaaaagcgccaaacgggatacttctcaaatacgtctctaccgacgacggcagacaactcctcctcgacatacatgaaggcatatgcgggtcacatgccgccagtcggacattagtcggcaaggcctttcgacaagggtttttctggccaaccgcccttaaagatgcatgcgatatggtccagcgatgtgaagcctgtcaattccacagcaagcacacaaagctacctgcacaagcgctccagacaatccctctgacttggccgttcttgtgctgggggctagatatacttgggccattcccacgaggacagggtggctatagattcctatttgtggcaatcgacaaattcaccaaatggatcgaagcactacccactggggaaatcaaggccgacaacgccattaagttcgaagagggatattctgcagatacggactaccgcaccgcatcataactgacaacggctctcaattcatcagcgccgacttccaggattactgcatcggtttgggagtcaaaatatgtttcgcctcggtctctcaccctcaaagcaatggacaagtcgaaagggcaaacggcatagtactacaagggataaaaacccgcgtctacgacaaactcatgtcacatgacaaaaaatgggttgaagaactcccatcagtactatgggtcgtacgcaccacaccgacaacatccaacaaggaaacacccttcttcctcgtgtatggctctgaggccatgctccctagcgagttacgacatcaaagtacacgagtacagaagcatttcgacgagaaccaggaggaacagcgagacatcgatgtaaaccttctcgaggagcatcgtgagcgagttgccgtccgagcagctagttatcaacaagccctctgccgttatcacgagaagcgcatccgagcacgcatactttcgatcggcgactatgtcctccgacgagttcaaagccaagcaggacgaaacaaactctcaccaaaatgggaaggaccctacacaatcacacaagtcttgcggccaggtgcattcaaaatcgcagacggcgacggccgcgaattagcaaatttgtggaacattgaccaactacgtaaattctatgtatgagtcaataacgccgtacctgtaagcacccttacagtatcaataaagcctatttctaggcttcataccacgaccaaagtgttttcacccgatgatcccttactctgataatacctagcgttgaaacctatccttaggaccctttacgccgtctcgacaaggcctccaaggaacctaagggatcttcggctggggacgcccaaagccgataaggccttgtcagatccttcagagacgaaagaccatgtaagatctggtcatgtaagagttctcgccgtgcgtattaaccaagccgtgtaactggaaaccgagctttccaacttcacggctgggggctaggatcagagcttattcaaccaaggcagatcaagtgtccaagagccttatcatccgagaaaatttctccgacgacaaggctaggggctagggagagtgtacgactcaaacggccgaggtcgttaactgataacacactctaacacataacatccagagtaagatgcatttgtttaaggaatatttctttattcacataataattcttactgttttttacatagatctcccactacattacactttttcctaagacatctgtagcaggccacgagtactaccaagagggccaatgccagttcatagactggaataccttctcggctaacggcgacatcgacctcgcaaggtggtctatctccgccgaagtcctccgagaacgagcaaacccttcatggaggaattcgaaatccaggcgcgggcggtgatctcgcaggcaagctagcacatgtcctccggcatatcggctcgttcgacgacactcttgcttcaaggcttcgtcaatgcgattgccgatgccatcgagttgggcacaggccccgttgagccacgagatgtactcggccgccgactcttcaggatcgctgtggactactcgaagctccctgcatacccaggccattgaggtacagcaactctttaaatatgacacaaaccacacctcgcggcctcggagcgtttccacggcttgctctttcttcacggctagcatggttctctcgagttccgccacttaaaatttagtcttccaatattggatacgacgatcttgggttgcaagggcattcttgagacctgctaaacataacgaccactaagacaagctggaaaccactaacccaacggagttaaaaaggctactcacttgaggtggctgtcgccatctcgacctccacatcaagagtatggtcctcgacgtcgtgtgagacgtgtggttcaaattcgagtaccggaattatcgccagtgactcgggctgcccgcgctgctggacatcctcgtcatcagcatctctacaatcgacaagaaaaacttccaagatcaacattgaacaagggtggtaatcatatatgcacgaaggcaaccagagttcaagatttacaaattataaaaaatacaagaagtcctactcttcaaaaagggggaggacagactcccccaggtcactgacttcttccatcacctccttacgcgtgtcgcttgccgccccctgatccaagatctcacgcagatcgagttcagggcgcgacaaccttacacacgcgaggacgtgacacaccccggtgtagataccgttggacgtctcctccgcgatcctggacgtatgcttggaggggatttcccccattgctgtcgccagctccgcaagagaagaagtcaacgagaactcatcgaggttcaccgggatcgtggacttgacgccgcactccttggcgagctggtggaggccggtgtaggtgacccgcagcgaaccacggatctcggagagattgtctccaagttccgacatgcggtcctcgagccctttgctttggcgctcgttcccggccacaagctccctcatcttcgtgaggtcctcgcgggcctcagctagttcccgcaccaaccgctcggcaagcgcgtttgccgctgccgtctccgccctcgcctctgagatctcgcggccgatgccacgagcaccagctttgagaaggcggcccatttcgacttggagctcctcccaggtgaggacggcctctggcagactaggacccccagcgggatcgctgatagggccgcttggcgtcacctcctgactcccgaccacgggcacgacatctgtcgacaccgtggtaggggatgcgctggacgttcccccagatttggcccgagcagccttcgcccgcgcctccctacaaacgaccacgaatcaaaactccatttgaacagaagacacgagaatccaaaagtctgtgtactaacttctcgccgatcgtcacaatgctctgacgtcgcggaggtggaggagacgcgtcggaagcctgcaagacaaccaatgtagtatgagaataaaccttccttgctacataacctagcgacaaggtgaaattaccgagggagtcgctgctttgcggcgatgtctgagcacagacgagaacttcctcgccttggtcggagcttcgccaccactggtggtggcagcgtcagacgcctccttgacgactttctccttcagagatgccgccacctgatgatccgcgagcgttccgacgacatcagtcaaaggaagggcctatgctaaatcatgtcgtaagctgatttcgagcagagaaggcgggacgctatcgaatgaactcatattgatcgcttcgtcgcgctccgtcgctcccttttcacaaaggggcgtggggatgttgctcaccgtggtcgggccgctgatcatcacctgaccaacacgccgctccacggtttcgctgctcagacctgtcaaaaaggaatcaatttttgataagtcgaagaggaacgcgagtacaagcatgtctaaatgaatgcgagaaagatacaccgaggagaaacccgggtcgcgtcgtctggcctggaatagttataagctggatgggcctgactttggagcggctggattcgcctaccgacgaagtctgcaacgacttcatatcccgataagccccgttcttggagatcatcgatgatgtcgataaatgattggagagagggggtcaaggggggcttggcggtccagaccggaatcttgtccggttgttcctcgggaacaacgaggacaggatttgaatccttgatttcaaggtaaaaccacctgttccgccatttgctgcgagaagatggacactggaaggggacataacgcgacttcatgccatcacgaagtcggaacccgacgcaaccggataccctattgggttccatctagcgcaactcgtaataaaagcgaaacagattaaaaaagggctttaccccaatgtaggcctcgcaaagatgcacaaagacgctaaggaaagcaatggaattggggttcaagtgcagaagagaaagcccatagaaattcaaaaccagtagaaggaattcggagggtggagggagaaacccgcagacaatataatctttgatcgcaaccatgcgacctaagatgggctgaggattagtacctcctgctttcctctccgccttttcacggccaggaagggcgccatcctcctggagcttcttcaggtttgcgctggtggaagccgatttgccgagatccatcgttgctagaagatcgccggagatggacctagagctggcgaagctagagttctttacggcagcggagaaggcgaggagtgctaacaggcggtgtgtttgacggagttggcggatttcaaaatgcgcacccaaaatccctttaaataggcgcacccccgatggtgtgaattccaaggaactgagagaaattcccgccggaaatttatatgtccattacgcgcggcagtttttggacttcagttcaaaattcactcgtgaccgttgggtttcaaacggtatgctcgattacacatcatctccgcggttcttgcaccaggaatgataacgttctcgacacccgaagtcgcgaatggtcgcacgagttcattttttgagcagaagtcggggggctactgtcaaggttacgggtcaggcataccccctacccttcgatatacgttacgtattgacatggcatacccacgcgcacgcggatatttcctttatgatctaaggaaacctttcacgagatcaatagatgggaaaagtccttctcggacaagaactgggtcacctacgtatcgtgctaggtctggtatgttcgagtcccactcggagagcaccagacctgcgatataaaagggaccccccggggagggcatagatcatcgaatctcagtgccaacataacccacacagcctacgaagtcggagcctgcgaggagccaagtcgtcaagagctagtcgaatcagctcgactacaatctcgtcggatctgacaagttccatcctttcctttgtaacctgtgttttccaccatataatcccacatcaactggattagggctattacctgtcaaggggcctgaaccaatataattcttgtcttttgattgctcgatgtcgtactatgtggatccttgtaccagcgtacaccaataccctctatatccggtctacgggtatcacccgtcgacaaggagggtatccaaaattgtaatcgccgcaaccgcattctgctgtggggtgcgaaaaactgatgtgccttcgatgtcttgttgtctgattagctcacgctcgatgccctgattccaaagcacgctgtcgtcgctcctcagcttcccatgtcaatcgctcgggctcctgctgctcatgcagcagtcgggcttgctcttgggtttgccgctcttgttccaaccggcggcgcttggcttcctatcatgtgcacagctcatcggcctcgcgtgccagacgttgttcttctgtctcgttgtcggccataaagacgccaaaaagagaggagtgtagttgtcttcgtagtcttcatcaaggtcgtcgaagttgttgaagtcatagttgtagccgaagtcgtcatagtcgagaatctcggttggttgacgggagtcgacgccgggagagctgaggtagccatctagttcttccgtggagacagtcactacaacaagaacccccctctagcaatacatgcttggcaacgcattaagcatgcgttgccaaaatgcgaccctagcaacgcttagtagtgggtgagcccaatttgcaatagataatatgtgttgcagaacatgcgttgcagagattgagtatcttgcaacggccgaatccactttacaacagatatcatgcgttgcaatggtcttgatgccctgtaaaaacttttggaataagcgaacttattgtattttttaaaataatcgagtgagatatttatttttcatttcggacctctagcgaactgttttttaaaagaaattatcaagtgagttgcttttttttcctgttaaaacttttggactaagcatgctttttaaaaaataataataattgagcgagctgctgatacctgataggaataaattaggggggcaaagatgcaaacagaggattcgaacctgggtctcaaggatagaatgtgcgcaacccaaccaactgagctaatcacatttcttattaaatgatttctttaggtgtttatatcataacaactaaaatacgatctgtgaaattagcactttagcaggcaaccttagtctcccactttctctcctctcctctcgtgtctctcacctcacccaacacgcacgagagcgccgccccatcttgttcccacaccgcatctcattttcttctcacgcactcgcacatcactgccacggcgcacaccgacggccagcggcgcgttctcagcagcggcggcggtgagcccgcgaggggatcggccgcggcaggccggcgacgggccgaggctgacgacagcgggtcaacggcaagcacggtccttttcttagccacttctcataggttgattccccatttggccccaaatccaggtcagtgtcagatccaggtcaatgtcaactttttttttaattattcaggtttgttgcatcatgagtctatctgattgagtttaataacacctgcagatttttcttgttcatccgaacggatatttggaacataggttttaaacgcatgtgcttctagagtcatcatctgtagattaactagaggtaatttatagtaaggaatttaacttggagatgacagctttgacattagattgctggatgttttttctgtaaattgatttaactcttctctatttttgcagagtaaaagcttttgtttcagtgtataaaggaggtctattaggttgtgacaaaattagctgacactgattttatactggtatttttctaattgccctatttttgctacatcatgatcataagagacaattccttgtcattgttattatctacaagaacctgaaatatcaaatttttttatataggtcgaaatggatttagaaaccatcaagattcttttgcgctaccctagaggttctgttgagtacttagctggagtagatggatttcttgaatttgcatataaagataagttagaggatacaaagatttattgtccatgtgaaacatgcgtacatactatgctactttcaaaaaatgatgtctatgatcatttggtgtgcaatggaatgcttcagagttataaccaatgggattttcatggtgagtcttcagaggagcaaattaggaaccaacaaccacagcctcacaatgaagacatgcgtgctaacatgcacgaattaattaatgatgcacttaggactgtgtatgacgacatgcctatgagtgattctgcagattcgccatacacacacactgatggaccaaatttagaagctcaagcattttatgagttggtgaaagattcaaagaagcctttatgggatggatgtgaactatcacacttatctctactagtgcttttgttcaatatgaaatccatgaacaaatggagtgataaatcatttggagatctacttgatattcttcacatggcaattccaaatggaaaagaattgccaaaaaacttttatgaggctaagaaggtggtttcaaaatttggtctagattatcaacaaattcatgcatgtcccaataactgtcagctgttttggaaagagaaggttaatgatgatttttgttcaacttgtaaggcttctagatggaaagataaaaaaccagaaaccaagttaacgaagaaagaaagaaagaaagcaacaccaagcaaagtcttacgatattttccaataaaggagaggctgaaaagattgttcatgtgtagagaaacagcatcgctcccacgttggcatgatgaagagcgcttagtagaggatggtgtgcttcaacatccagctgattctccggcatggaagaactttgataaaagattcaagcaatttgcatctgattctcgtaatatacgatttgggttagctacagatgggtttaacccatatggtatgttgagctctacctatagttgctggccagttgttttagtaatatataatcttccaccatggctctgcatgaaggaacctaatcttctaatgccattaataattcctgggcccaaaagtcctggagataacattcatgttttcctccagccgcttctagaagatttaagagacatatttgccaatggcatttccacatatgatgcatttagaaatgaaacttttaatttgaggatagctgtactgtggactataaatgacttgccagctttaggaatgcttgcttcacatatggtgcatggagaatttgcatgcccgccttgtggtccaaatgtatggtccaaacgtttggcacatgggaagaaatcttgttttatgggtcattgtcgatttttgccacctaatcatgaatttcgttttgatagaaattcttttgatggaaccacagagattagtacagagcctatgacttactatgggcgtccggtattggatgaaataaattctatcggtgattttaagaagtcaaaaacttataaggcagtaagtagtttattcacactaccttactaggatgtcaatcttcttcagcataatcttgatgtgatgcaatatttatggtacacttctaaatttagaaggaaagtcaaaggataatctccaagctcgtcttgatctcaaggaaatgaacattagaggggagctccatccacaacaaagaacttcaagcaagttctacttaccacctgccagctttactatgtccaaaagtgagaagcaattgttctgtaaagttcttagggatataaaagttcctgatggctattcttcaaacatatctagatgtgtgaactctgctgaaggaaaaattcatgggctcaaaacacatgattgccatgttctaatgcaacaattgatgccaattgctttgaggggtattcttcccaatgaagtcacatctgtcttgtttgacttatctgcttactttcgaggaatatgttcaaaagttctccatgttgatgagcttgaccgtttggaagaagcaattaaaatcacattgtgtagaatggaaatgatatttcctcctagattcttcactgttatggttcacttagtcgtccatttagctactgaatgtaagattgttgggccagtttgctatcgatggatgtactttattgaaaggtactaaaaatatattagcatacaatttataatatttctcatatgtcatatgatacaatactaacttattagttttgtgccttgtatgtatattacaggtacctaggtaaattgaagtcgtatgttcgcaacaaagcgcgtccagaaggttcaattgcataatcatatttggcagatgagtgcatggcattttgttcgcgatacttggaaggtttccctaccaagcataacataccatcaaggaataatgacaaaccagatcaatttgagactcccatgagtaggcaagaatccactttgtttcctctagtaggaaaaccattgggaaaaccatcggcgtactccttaactgatagagagaaattgcaagcacatagatatgtgctatacaactgtgatgctgtagtgccatatctaaagtacgtattgtcctaacatagccttttttttatgtgttgtaagtgttttgcttcaaatttatgtttatttgttttgcagagaacatgctgctaatttgcaaaggaagaaacgcaaaaggctaactccaaaaaacattgagaacatgcaaaatgaacaattccctgattggttcagagatcatgtaagtctcaaaatttaggtttctctttttcaaatatgagtacaactaatacatcttttggtttggtgtagatcttgcagttggagaatcaaagaggtatcgatagtattgatgaggatattagatggctggcacgtggaccaattgaggtagcaaaacgacatagagcattcaatacccgtgggtataggttcatatcaaagcgttatgacagggtgactcaaaacagtggagttgttgtgactgcaaaaacatcgagctacacgtccgccagtgatactaaccctgtccttggtgatatcatgtattacggaaggatacttaatataattgagttagactactacggaaatttctcagttgtgttgtttaaatgtgaatgggtcgatgtaactaaaggaaaaggagtgaaaatagatatgtttggctgcacacttgtgaatttctcaaataaattcataccggtgaaaagattgagcatgagccctttgtatttgcaaatcaagtcgaccaagtgttttacattgaaaaccatttaaatccagggtggtctattgtaaggaagatgaaacctagagatgtatttgaactgggcgaagaatggaatgatgtggaatgcgaaccataccatgtcaataatcttggggagctatttgacagtgcacatgatggtcagacatggattcgaagagatatagaaggaacaactgtcaataacatggtaactaattaaaggtgaggttatgaaggtttttcactatctatctgtccattatcaatgatttccttatattgtttatatcttcacttggggagcactttatttttatggcagtaattttggatggagatttactgcgatgaaggcttcttcaccacaatagcttttctggatgaaaatgtcattcgtatatttccttggattgtctaagtgattgagccagatcgattcaactttttatttgcatacataagtcctgtaataatgttctacattagttatatacagaattggtggttagatcttatttttaaatatctaggatatcatattgtttatatgatgagaaaaaggaatgggcgtttataatctttgcatctattgtgttcagttattccatttccacctatataaatacctggagaaaactatttacgttgtgaatggaaactatttacgttgtcaatggcacctaacgtgaataagtaagtcgaacggacaactccaacatgaagtggacatagcctggtggtacatggcttcttcagccgtatcgaagactgtagttcaaatcctaacaaatgcgttttttttccatttcttctccagtggcgattcttaaaattttttccctctccttagctggctagataacgaggaaaacaaatatgccagcctagattttttttattttttttctaggggcgattcctaattttttttccctatccttcttagctggccagataatgagaatttttgaactttttatttttaattttaaaattaaactgatcgaaaacttattttttcaatataaatatttttggccacactaactattattttaggacaaaatatgttacgtctggatttgatcatgcgatcagtcagtatggaccaagacgacaacgaaaaaacatgtggtttttcggtcgtgctaacataaattaaataacaattatttaaagaaaaattattttacatcatgattttatacggcttgtccagaccaggtcgacaacgaaaaaacaagtggtttatcagttttgcaaacataatttaaataactattattttatgaccaaaaatattttacgtctcaatgaaaaatttcatgcggtctgtccacactgggtcgacaacgaaatagcatgtgccttttcggtcgtgctaacagaatttaaatttccatcttatataaatacctcgagaagtctatttacattctcaattgcagctaacgtgaaaaaataaataaagggggacatagcctagtggtacttagcttcttctactgtattgacaactctagttcgagaactagcaaatgcataatcgtttcatttcttctctagtgtcaattcctaaaaactttttcctctccttgaacgggaaaaaaattctgttgccccagaaattttttaattttttgaacttttttattttaaaattttaaaaataaaccattcaaaaacttattttaagaatatccggatttcatccaatctgtccggaccgggtcgacaacgaaaaaacacatgtttttgtcatgctatgataaattaactaactactattttaagacaaaaaaatattttacgtacagatttcatacggtctgtcggatcgtgtcgacaatgaaaaaacacgtggtttttgttgtcctaaaaaattaaaccactgttatttaattatatatatttttcatgtggtctatccggaacgggtcgacaatgaaataacacgtgatttttttggtcgtgctaacattttttaaataactatattttaagaccaaaaatatattgcatctcttttccatgcggtttgtccggaccgggtcgacaatgaaataacacatgaattttttgtcgtgctaacatttttaattaactatattttaagacctaaaatatattatgccactttttcatgcagtctatccggaccaggtcgacaacggaaaaacacgtgtcttttcggtcattctaatataaattaaataagtactattttaagacaaaaatatgttacttccgaatttcatcccgtatgttcggaccgggtcaacaattttttttggtcgttataaattaactaactactattttaacacaaattttacgtccagatttcatatggtctgtctggaccgggtcgacaacgaaaaaacacgtggtatttttgtcctaaaatattaaatcactgttatttaattatatatatatatatatattcatgcggtctgtccggaccgggtcgacaacgaaaaacacgtgttttttatcgtgctaacattttttaaataactatattttaggacaaaaatatattacatgtctttttcatgcggtctgtccggaccggattggcaatggaaaaacacgtgtcttttcagtcgtgcttagataaattaaataactaaccaaaatatgttacgtccgaatttcatccagtctgtccggaccgggccgacaatgaaaaaacacttgttttttggtcgtgctaaaaaaattaaatcactgttatttaattatatataatttttcatgcggtctgtccggacaagatcgacaatgaaataacatgtgattttttgattgtgctaatataatttaaataactagtttgacggacaaatcaaccccaaatcgatctgaatttagcaatttatgcctctccgaaaattattttcttctccctccactctttccctccttttttttttgctcccgcaatttttttctgttttcttttttttgccgccaacttttttttttgcccccaccttccccatcgagaaaagcaagccaactgcccctaaaaatctctttcctctatcctgactccctgagtaaatctctttcctctgttgtgggattcccctttcctacgaactctcctgtcgttctacggttctcctcctcgtcttcatcggtgttgatctgtaggtaagatgccgggcgctttactgacccaccgccccaagcaggcgctcctagatcttccaccgctccgctccgtcggctgctgtaccagccatcactgctgccgcaccttcctgccgattaacagccacgagcaggcgacccccatgccccatggatgatgtagggcatgcggcgggccggagacgcccccagccgatgtgccgggtgaccggggcactgcaattgatgcgggttatacctcccgacaccggctgtccacttcgctctgctccacgctgcgcggctggcggcaatgtttccaagccccggaatctctgcctccctctgcacatcttactacctctctgagtcgccaaattgcaatggaggctaattcccttccaggactacaatacttaccaatttgatatgttgtattttcaggtttggagtcagatgcactgaccgtccatagctgaaggagcctggtctacgtacagctaggcttcacacaactgtaagcaataaatatgtgatctagttttaccttgcagccaattaaattttgttatttctacccattacttgtttcaaattgttggcctataaaatggacaaatgaattagtgagtatgacaaacagatccatattatagcattacttttgggacaacagtactctgttgttcttcaaaaacaaatccaaaatggctcagggtataatcaattctgaaattattctttttgaaactatgtacagcacagtcctacttctgaaatgagaatgatatactttcgatgccataaatgacagataggttttttttgggtgcaagagatatggcaaggagtagaaaaaggcgtattgttcagagcaatgaggaatatttgtcagaggaacagactgaagaagaaaatacccttccacagcttgccacaccatctgaacaaaaaactgtatgtgatgattctggagaaggcaatgaagacactgatgacgattttaatatcaatgatggagaaggcaatgaagacactaatgacgatgttgatattgatgatgaaggcaatgaagatactgatgttgatattaatgttcgaggtaactgctaagtttaatagtcctaatggtaacaaataatgacattattactcgtatccctgattactaaggatcacttttgtcttcgcaatttaacaccgaacagttgaaaatggagcacctgaaacacgtggcaagacaaaactgaaagatgtttggaaccttccgaaagggcttagaattgtggtacaatgcaatgatctcaatcaggcggtaggggaagaagatggaattttgggtaaatttcttggaatgatatctaggaatggtagtctgtgtagcttaggctacacagactggagatatgtaataggaaagagagagaaaaatacaaatgaactaaaagttaaaaaggacatacttaagcaagtaaaggtaattccttttcagatcaacatttttgctaacttcttgtattatgttatgcatatccccatatggccatatgagtttctgtgttgctatatgtagatgagattcctttatgctcctcggatggaagagttcatattaaaaaaaattggagaaagatggcggcaatataaagcaaaactaaaagatttgtattttgatgtgaatgagactaaggaagctaattgcaacaatgtcccagaaggtgtgctttctgaccagtggattgctcttgtcaatcattggatgaacgagaaatcgaaggtacatataccatattcatttctgtaatggtcttacaaattagaactctgtactaaacaaaacaatgcaatattcttttttgattgctaactctacgagaccataacagagaataagtgagcagaataagaaaaactgccaaaagaagaaggcaattcacacagcagggacaaagagttttgctcgcacaagagaagagatggtaaaacatgtcttgaatagtattcatctatttccatttcaagcatgtatagctactattaggactttactgatttggtcatgtgttccataaagacacaaagaaccttgtaagat

SEQ ID NO: 34549 - DNA, 29504 bp, Oryza sativa
  unsure (1)..(29504): unsure at all n locations
gatgcgccnttggananctggattttgacatcagctcgacatcgcatgctgaactagagtaagagaattccgcaccccgtttgaaatggtgtaggatttgagcgggggacgaggaggaatttccctaggtcgagatggttctagaatcttctagaaggttaccgcgttcttacaaattagaactctgtactaaacaaaacaatgcaatattcttttttgattgctaactctacgagaccataacagagaataagtgagcagaataagaaaaactgccaaaagaagaaggcaattcacacagcagggacaaagagttttgctcgcacaagagaagagatggtaaaacatgtcttgaatagtattcatctatttccatttcaagcatgtatagctactattaggactttactgatttggtcatgtgttccatagagacaaaaagatcctgcaaagaagaacccacatagagctgttgtttatgtccacacacacaagcgcaaaagtgacaagaatataaatgggcatgtggtatactattaacactcaaccatagatatttttcagttattctcatatgttgttttattcgtattaatttttcatatgtttaggataatttgaagagacttatagctgaacaaccagctttagcggatgctagtaaaggaaagactgcttggaaaggagatgcattgaaccaaatactaggagatgacaagcctgggcgtgtgcatggtcttggactagttccaaagcctaaacaagtgcttgatgtgccaacttcccgacgtttgcagaatataaatcttactacagtggaggataactccagtgaagatgtaatggctattagactgcagatggaaaagttagaacgccatgttgagaataatgatgctgaacttttacaattaaaagagaaggcaaccaagttggaaaaggcacaaaagaatcaggtgaatttaagggagttgagtcttaaaaaaattatatgaacttgtgtgtgacccaatgaatgcatctaacttacctaattgaagttacagggaggtttagatggagcatctacaaataaaaaagctatttgtgatgacgtacctaattcaaaaaggagggtatgtatctttatggaagaaatatcataacattttctgcattatctcataaactgtggtatagatctctgttcattttctgttatggacagagagtgtatggtgacaacccctcgcaagaaatttgtatgtttgaggagggaaacattatggatcagcaggacaacagtttgatggtaatgtgatatagcaccatcttataactgggaatagctgtgtttttttacttgggaatagcatttattttctctcttttacaatagaatacacaaagccatgtgcacgatgagaatttgcaaccaccaaccaagcattctactgtttacaaggtccttgcctttgcatttaaaatattattatatatatattcactattatttacatagcattcattataatcatatgccttcttttactctagaatacacagtctttgggccagaatcacagtgggaagcaaaggaagattacttcctgtgcaaacataaacaaataattggaacattatagtttgtgccaattttatgacctattccattgcagcgcaaaggaaatttggaccataatgagcttatgcaaccagggaagagtatttctagtgcatacaaggggagttgattaagttctctctttatcctttcaaactcaatgccatagtcaataagtgtttgaaaagtagtttaatttcgatatataaatgtatatatagatttgtaaaatttatttgttaccttccactgtagaacaataaacctgacaaccaggacaactatatggtgaatgcacacaaagttacaagtacacacaaggttattttttcatcactttaagtcaccatgtctacagatataagctctttgaaactataacacacatgatttactagttataataattgtattgcagaacaaagagaaccttacccgcaagcttgttagaccaagcctaaacaagtatagtactgcttctaaggttagtctaattgtttcaagttcaaaatgctatttctgtttattgaacactacacaacaactaaaatagcacacacagcatgttggtttttactgtaaattctctctattttttcagaaacggcaatgcaacacaatagactttttaactgacaattcaacagtggtaaaccttgctaacattttagtctaaatagtttaataaaatctggtcttaatgtccttttattttccactgtgatagaaagtgtatggtgacggtcccttgcaagaaatttgtcatgttgaacaggaaaacattgtgatggtaatatacataaatttcattgttttatacatgggaatagttgcactattttgtaactgggaatatatgctctctttgacaacagaattcacaaagccatgctcaagatgaggataagacaccaccaaccaagcatgctactgcacacaaggtccttgtctttcaatttatatttttattctgaactcaccatggttgcatcctattatatggttatcatggatacatagcattatattatttggtattgtttgtaactaactatgaatgtttactatagttcatgacaatgtgatgtattcttttattctagaacaaacgaacctttggcctaaatgaccatgggaaacagatggagattatttgtgccaaggttagttttcacttcttattgagttcaaaaattatttgatagaaaagtttgaaagtaaaatttcttaatatatataattttagcactaatttgttgccctcccctatagaacaagaaacctgacaatcaggacagccatatggtacatgcacataaagttggtggtgcatacaaggttgtttttttattcaccatgtttacaaatatcagtccattcaaactataacatgcatgattcactagtattatgattgaattggagaacaataattggctctgtttggtctttctttctttctatcttgtggttaaattgcaaaccatgatccaatttttttttatagaaacaacagtgcagcaaaatggactttatcactgacaattcaatggaggtattttactgtgaaattatttatgatacttgaatttcttaaagtatattgataatattgatggatgtattatgcacttcaggttggaactaaagtattcttaaaaagttggaaaaatcggaatacaaacgtggctcttgccactattgtaagctgtgatccaacacgcagagttggaggtgttgagctaggaaatgaatttttaatggttcatgtcgatcttgcattggcaaaatccgaagatttgattaggccatacaaaggctacaaaattgttggtcatgttgtaggacttgaaattgcgtggcctgcaatttttatatgttcctatctcttacttcttacttcggagatgtgcttttcgtcttcataatggtatattaatgcttatatattttttctattataggttgacaagataaatgggtgaagatgtgggggaaattttgtgactgctagtacgcaactaggtcacctgtacatgtcacggaatgatgatggctgcaaggtggagaatgggggcaacaagatgtgttttttttatatactttagattctattttctgcattaatgttctgaacaaaggtttaatgccatgaattatactgatgattgtctatgtaatgcaaaatactatatttaatatataatcgattatcatgattgattggactattgtcacttgtgcatgctttgagttcatgggtctcttgcctgacaaaataattggtcaaaggccacctacagtggatagctcaaattacaatatttgtacatgttgcagcaacttgattatatccattgctaagattatataaaactgttcatctctcaagggaacaacatatataagtattgctgaaacctattaaaattgttgctaagtagcaacgcttatttccacttgttatcaacggttgtctatgtgttgtaattgatcctagcaacggcagcataggcaacgcatattaaatgcgttggtgcagaccctagcaatacttatagagacttttagcaatacatatatgtattgctaaagagggttcctcttgtagtgagttccgagtcgttgaagtatcacgccgacttccctagagccagattgaactgaggtcgaagccgagtttaatctggacctacggggagaagacgctcttgtagtaaaaacagcagccagatcgtcgggaagccacatcaagattgacggataagttgcctctccttgatttgattgcgaagaagttgacgagacctcatccgagtggtttgaatccaactcagatgagatggtcttagaatagatttcagccgagtttgggagacataatggagcaaagatggcatcccctcccgactggttcgaatctgagccgagaagagaaatattgtcgaagtcgtcggtgatgaagttgaggctgccaaatcggtatgcctgcccgggagggaaggcgaagtcgtcgatgcccgaaacaaatcccattgcactaatcggcgaagaacttgacgctacccctacttggtgcgccaactgtcgaaacaatattttggcaatactaaaaggggtggctatcaagctggaaaagtagatgggttaggagacactaggtttatacagattcaggccttctcgatgagaagtaccctactcctgtccggggattgatccgccgagtgtattattgatcgtatgatcagggagaaaaattatgcccctagaggcacccggacccctccttatataggaggaggagccggaattacaagatacaacccatgttcctaacggacaagataaattacaatcgtaaccgactagaactatcggatgtttccttgatacacaagttaacataacaaccgagtcctttactaaatttattctatctgtatatggtacccttatacctagtcggatatacatgccgtgtgggtatggggtaaactttagagcatgcacagaactagaaatggctataagcagtccacgtaggttcggaagatgacctggtgctaagcgcggatgagagagaggacgagcgtgcgactaaattgtcgcccgcctacacgcgcccttgaagaaaaagtggggtccgtttttctacgcgcgggaggaactgctcgacgacgccccatggcccatgggtatcggaacagaaatgcaaaggagagagaaaatgataaatgaaagaattaaatatcatttgctgaagtaaaatggcagatgcattacagcccatcgtgttggctatacatgacatggaaaaaattgcagccgatagtggactatactattcaccttcacaggataatcacggttaaagcatccggccaaatgatgaacaagcgcggagatggttgaattttgggtagcatcgtcaattatagtgtactattattaccaaggaacataattgaaatcatcattcagacagcttattaccattgtaggccagtatggttttttaatatcccagtccaattagaatttagcctgtgtggcttataagagttgtgtgctcatgtttagtaccaccttgagttatgtgctcatgtttagtaccaccttgagttatgtgctcatgtttagtaccaccttactagtttaacaaggttggaaccaacttataagacatcttccttccaatcatatcacttctaggttaacccttttacacgaagcgaggacgaaagtataagtaggttcgtaggcccgtccattggttgcgctcagagcctgtaagtggagtggtatccgtccattggttgggctcagagccgaccctcgcagtatgtttagtgggctcagagccgaccctcgcagtatgtttagtacacatttctcagatccaactttataggcagtggggtggcgtgggtaagtgggcccacccgtcagcctatatgtcgtgtggctacataggtgaattggaccgatagggacgacggggacgtttgggcctttgaagcaaggatagaagtgtaaatagccccacccgtcggttgggttgggctgttacatatttctaatttcattataaaaatattatatatccttttttatacaacggttggactgttacatatttctattctatcatttcattataaaaatagtatatatcctcttttatacaaatactttaattaattaatttgcagacaactaagttacgaatttttgcagtgaactaagttacaaattgaaaattaatcaatgaacgtacatctggacgatcgagcagtcaactaagttacaaattgaaaattaatcagtgaacgtacatctggacgatcgagcatgttgttatctaacatctgtcggtacccctcgagctcacactgatagacaataatcttcctcgttacatattgatacctctcagcactgactggccccacaaaaggtatggcgatagagctgtcagcgtatgattactcacccactacatttaatgaaatcctagtgcttacatatgtggatgtgatttcaatataaatttagttaggttaagggtatatttttcatattcgtgtgttttgaatttatttcctttcaaagctgtccttggctagttttggagtccccaaaacctcctctcttcaagtgagagccaattcgttctttttgccaaaccttaaaaccaaagtcaaatcccattcaaagattgtatatattggtccatttaaaaatttattgattcttaaaatgttatagtgctcttatgaaggtatttcgttggttaaaaacaagatatgaacataaaagacactcctcgagctagggttagaagggcctatacagattaacaaccctactttccttaaatgaaataaatgaaaacgtttggcttcctgttcctgtatgcatgatcaatgcatttaatctcttttttcatatgaagcaaaacttttcaaacacaaaacaagaacacatcccctacctgctaaagtacccaactagcccatcgttagtgagttagaaaacgtaacgaaagtttttttaaaaaagaactttttattaaagcattctttctaaagattttatttctttcatcgtaaagcatcacctagcattgcctcctctcactctcgtgtctaactcgatttgtatatgtctttcaacaccactcaacctatttaattaatttcccttttcaagcaaaagaatgcttttaaaagaaagccacgtacacgtattctctcactttaatttgtatatccagccaaatgatatattaccgacgaattaaactgaaaaacacaaccgaacatatacacttattagttgaggatggtgatcactctgttacctttctttcactaacttgtgttgggttgggttgaagatcaatttaaatgaagatttagttgagaaatcgataagtgagatattgtgatcgagatattgactcaaaagatgaagatttggcagagaatataaacttctagtcgttaccatatgttaattgtgcacatattgactgataagtgttcgattaatcaaatcgatggaagtgaggacacttgcgtaaaatgtgaaattctaacatcatttcaatcctcctcaatagataagtccaacttgaaatattttcattaatagaagtaaaaatattagtatttgatatatgaaaatgatattaatagacttccattatgaactcatatagttttatttttttataattttatagagaataaaaatataattgtaaattttgagaaatcaaggtatccatgtggtgcttttaaaatatagtgtctatactcccgagcccacatgggatcgcttgagcaatcttgtaattgtagaccctttgcaaacggattctaatgaagcagaagagaataacgtattcatatgatgttatgtacgtccgaccgcataaaaaaaaacagcctcccgtctaccacgtcagcacgtcaagtggagaggagacggcgcggtgtccatcggcaaatatccacgattatgggatgtcttcccccaaaagttcactttcgcggtgtcctgagctaaatacacacagttacaatgtcctgtagcaaaatttgcctaaaatatatggcaagttcagtgaggtcaaaaacctcacttcaagttagagccgattttttttagagtgaaatacatggccagtctttaaacttgaggggtggtatcacttaggtccatgaacttaaaaattacacgtttagatctgtgaacttggtttaatgtaccacccctggtccaatcgtcctttgaccatgtttgactgccaacgtgacgtgccacgtagacaacacttttgtgctcagccccctccacatatacttttcgcacataacttgctatgaccagtgtgcatttcaacccaaatccctcaaaatatccctaaatcggctagggtttcgacggtgaggttaggggaaggaggccgagaggtagcagctgtggtggcctcggcggtgcgattagtggcaggaggcagcgcagtgcagtggggttagcggtagcacaaggcggccgtattagcggcggaaggcagtgcaatacggcttgcgcgctaggcatcccatggattctccaagctcgtcctcgtcttgaagtcgctggaagaaagtgttgttaatcatgtgcccgttgcgcaaggataaggttattttggagtgcagagcaatggcaattgctaatcagaaccgcattttctatacatgcaaggagaagaatgagatggaagaacgatgtgagaatttttttgggattctggtgtcactatataactataagaagatatatgcgacgtgttgtgatgtggagggggctgagagcaaaagtgttgcctaggtggcatgccacgttagcgatcaaacgcagtcaaaggacgtttggaccgggtggtacattaaaccaaattcacagacctaaacgtgtaattttcaagttcacggacctaagtgataccactacacaactttagggaccagtcatgtatttcactcttttcttatgtacgaccaattcatttacttttttttcatatgatgcaacacacgatactaaacacacacgcctgctccgctaaagcacatcgtcgccaagttaaacagaaaacgtgacgaaaatgaaaacaaaaatttttatcaaggtattatttgtaaagttctttttcctttcacgatgaagcattacatagcattgcctcctccccctcgtgtgagacttgatttgtcggcgtctttcaacggcgctcaacctatttagtttatttttcaagtaaagcaatacctttaaaacatagtaccgtgtacgttttcttgctctccgtaaatcggtccaaacaatatattgtcgacgagttaaaccgaaagacacaaccgacatagacggaagcggtaaagcactttcataactaaacggcacattgtattacaaaatcagagaacaaccttgagttggaaagagggatgaagttgaaaatgtttaccaaaccaaaaccacataccaaagccaaaaaccatagaaaccagagaaaaagtcctaaaaaagctacacaaagggggtaaaaaggggaccaaaacagggcaaaaaattcccaaaataaaaagggcaagaacagcgagagacccaggaaggaacgaagcaaggcgcttaggcgcacgcacgcacgcacatctctcgagcccctcaccctccccttcttcctcctccttccgccgcattgctcgtcgccggcggcgaccaaccctacccctctctctccctctcgagcggcggcggaggcggtttccggtagtggcggcggcggcggggacaggaagaagccatgtgcgatttggtggcgagaacggggcggcaccagcagcgctacgagcatgggcgtcgactcgtggccgggtgggacatcctcaaagccccaatttttactcccccattcctctcctcctcctgcatcatcatcatcttcgtatcccccaccaccaagaaaaaatatcacttttatttttatcttgccgtaatttaggtttgttttgatatgctgcttgattggaatcaaattttcacctcttgctgctgctgctgctgtggaggggaagtaggaggactatttggtggctagattatgggaggaggggagggggtggtcttaatcaatgaacagtgagcagggctaccattaaaatttagctcctttaattcatccgtaggcacctgctgatggcgacctgcttatcgttttctgttctttactgattctcagtgtgctttgttctttaccggctccacatgattggggtgtgcctgtgtgtggggaaaaaaagggaggttggggtatctctgtttggtcccaggatgtgccatcaattaggtgaatcttggtaaagatttgtattgatattgattcggcatcggtggtgggccggcgtcgatagggaaattttcgcggataaggattctaggctcagtttggagggtctagagttttttttttttaggataatggatgtctcttgttgcaggtgtggattagtttgtgccttttatgagcactgtcagaaggtgctgtgcagacttggtatccctttggcttaaattgttcaagggagaggttccatttttatttgatttttccaagaaaagaaagtggtgataaaaacatagatatgtgtgagatgggcacagggagatggatttcaggatcatagagatgaccccagggtcctcttgttcccatgtgtgcagttagatatttgtattaacaaatacgaaaaatgatatttgtattaactggagactaaaaaccgaactaggagaatagctggttgtacctgttgtttatgctgctttgtcctgttgtcacaatgttccaaatactggtgttgttgcattaagtgcttattactgttagtgatataagctatatgagaattaatttatttgtttcaaaatttgaggtcaaattttatttggagtagcagttaaacattttaccaacattagtaaagttattactcatctgaatagtgcttgatagtcaagcttctacttaaactcacttcagaacaggattttatgaactcaattaaacagtactgtctacattagtatgtatctgtgagcgtgctgctcttatctttgctgtaagacaacatggttaaagaccctagagaagaatgttgtcatgctttaaattcatctgatacttgtttcttatatatgtaggtgcataccttttagatataaagataacaatgatgaaacttctgatgatggacacaagaaacttgtggaagttctcatgatcaactcccagagtggatctggtctcctatttcctaaggtattaacattttaaacatctatgcctaagagtcactcaattctcagaacatggtatatgaaaacatctgtgatgttattctgtttgtgctttagatttccagagtaattgatgggaaattatttaggctataatccaatatccgttatccatctaccattacataaagatatgttccttgatttgtaacctcaatgctctaacataacgggcatgagcaagataatcaatatccctccgaaatgtttgattaagtaggtactgaaatcaggtgccgtagagtcgacttttgagccagtcaggactcattagtagagttaatcttatgataaccttgtctgcgaggtgtactagttagttattgggataaatatatctgtttgtttattatatagtacatgattctgtggcatgcggtcttttgtttgatgtgccatactgctttagggaggatgggagaatgatgaaactgttgaagaggcagctgctcgtgaagctattgaagaagctggagttcgaggagatttagtggtgagaccctttggcacttttaccttgactttttgatcttctcttagaaaaaagccccattattatatcctatagccatatgtttgttgttcaaccttgtgtccaagacctcaggtcttttttgaggtatgcatgcgattttgtgttttatatagacaattagatataatcttctttcctatggagacctactaccttctgataactagctgtgtccttcacttaacctgaaaattgatccttaagcatagtctgagtctgggctatggaatttccggccttatctgttcattcagagtcagcatccattttgttaagtgttaatatgttcatactttagcatatgaatatgcaacgctgcttgttctttactaggcctttttttttgtgcattaaagaactagggtcatttgacaagtgttaggtgccacttgactaacaaacaagctggttggacctcatcattgtatactgttttataagattcattgtgtaaatagcacttgttggactttcagtaaacacaaactttgaagggcacttgtaagttaagggaggattcttgtgttgctaactcgcactttagattgtaatccagacctgaactgcttaatgctggctactctgctactgtgttgacactgattttgctcatttgcacatctggtcaagttgtttgtttgaaagtttaatgaaactattggtactagacagagcataagagcacacgacatagtgcagccaataaaccttgacctgaatcttgcattataaatggattattttataggaagtttatttaggaaagcaagctaagtcaaaggaatattgtgtcgctaggttgtacttgcatagtctacatttaatgtgtagccaagtttaaatagattctgtgattccttagtccttgtggcttgcgtgtggcttattattgaacatcacttattcccttccatgtgttctgccatcaaactctacttatttgcgattctttctgtgcataagcaattattgggcttctacgacttcaagagcaagacgcatcaagacaagttctgccccgaggggatgtgcagagctgcggtgttcgcgcttcgagttaaggaagagcttgcctcctggcccgagcagagcacccgcaagaggacctggctcactctcagtgaggcggtggagcggagccgttacccatgggtgcgagaggcccttacaacgggtttcaccacctggcatgagaactggagcaacggggacgaccatgtcgacccaagttcaagatgaccgcacctcaagcatcagggccaggggtcatgctctcttttaccatgctagtggtttcagaaacatgaccatttcggcgtatgtgtgctccctgatgcttcagtagttccgatcgccctatattactacctaggatgggaccaatcttagttctggaaatgtcgagatgggaccaatcttagttctggaaatgtcgagaatcgctggaattgtaagttttaattgattctcgctgctaccattatcagtcctcttggttctttatttctttttacaccatgcagtatcagctggtgtgttgccccttgtgtgtgcgcaaaaatacctgaaatcaaagaaggctttgtggatcaatgtgctgcaatgctccttctgagttggcttgttcgtgagcactggtctccaaaagaatattgcagaaagggggtaaagaaatcctgatgttctttgtcagcattgctgtctgttctggtctgtcagaatcaaagttgaattcagttgttaagaacgagtcaaggtgaacaattcacaacacagatcttgttgaggagtatctgttcttaaggaatgcaaccatttatttccagcgcttataaacgatgcgattttcggaaaagaaaacttaatatatatgaatttcttatgaaactgttcaaatccattttttcaactttataatagttaattcattttttataccctcgaatagttagacaaaattactcagctatatattcagacaaaaaagaggtaagaccaagaaaatgtgctgaatctgattgactctgcaaagttccattctcatattggatatgtgatggaaaaatgaaaaacgaaaagcgaaaactcatcttattcacttatttgtaacagcattttcctagcatttacatatataattgttcagttttgcatttctctatgcttccggtatgagaagaggaaccaaagaaacagagggagaagaaaataaatcacgagaagaagagatccccgagcactttgtatttgtatttgaccatgacgaggtgagatgagatgggtgttgttaggcggcggcgatgatcttgtcgtcgaggtcgaagctcatctccttctgccctctgccgctgctggcgtactccgcgaacctctccttgaggtcctccggcaggttcgtcgagctcctccatccaagcacctccttcgccgccctcggctccgcgtagaagtgctaacaattttcacacaaccattaacatatcaaaatcacatcctttttgggaaaaaaaacatcgatatcaagataaaattcacatccaaaatatcgggtgaaaacccgttaagaatcgggcctaaaagttcttttttctaaatttatataaaaagaaattactagagacagtacaagaatgaaccacgttttccaacctcgactttatttgaagtaagaaaaaggaactctactcgtctaaaatttgtttcttttcctgcgaaatgaatagattcaaaaaattttctaagtctatttttcacacgtacttcctgcgtctaaaaaaaattcaatcctaaagatatatctgaacatacacattgtccaaatacatcctcaggattgggttttttataagacagatgagtccttgcttatccgatagttttcatccgatattcccccgagataaaaaaaaatcacattttctttattcgagcaaaatagcaatgtgccgctgcatgaataaaaaacggttagtagtactaaccatgttgcggaaggggaaggccttcttggcgtcgacgccgacggcggcggggtcgtagtggaggatctccggctgggcgccggcggcggcggcgcacatcttgacgaggccgttgaaggtgacggcgcggtcggagacgcagttgaagatcctccccgccgccgcgccggggctctccacggcgagcgccaccatgctcgccaggtcgcgcacgtgcgatatgttcgtcacctgcatccccgaccccgggatcggcaccggcctccccctcacaatccctgcaaaaacaatttgaaaccaaaaaaataacttgacttcaattcgaatatttcttggaaatttacaccgacaatttgacaaatcggatttattcaaagtttacagcaaaaaaaaaattgatggttttgtcctcataatttggatttgtcagaacttacagttaaaaatttgaaagttttgttttcaaattcaaacaattcataatttacataaaaaattgccaattttttattcatatttcgaaatagttcaaaagttaaagaaaaaagaatcgacagttttgtcttaattcgatagttttaaaaaagactacagtaaaaaaattgacaattttgtcttcaaattgaagaatgttgtttggggcggtttgaaatttgggagaatttggttggggggatttgggtgattttactgtcgaagaaccactcctcgcagtccttgttgttgccggagccgatcatgtactgcggccggaacgacgcccagctgccgaactgctccgcgatgtacttctccacgcccacatgccccgcgctctccttcaccgcgtcctgcatttgcacgtcgccggcgagccgacatggccggagaaagtcagtcagtgaactcaactcatcgagccaatcctccggcgaatctggttgttatgtttctttaccccctcgacgtgcggcggctcgtcgctgggcgtgtagatgccggcgctgctgacgaagaggaattgcgccacgccggccgccttcgcccagtccaccaccggcctgcgggaacgcgtnnnncaccttngnnnnnncgcctgcttgctcggagcgaggggggagaataatcgagggaggcgacgtacttgacggcgtcgaggtccttgccgttgttgtcgaggacgacgtcgaacgaggcgccgccgccgaccgccgcgccgacgtccgccgggtcgccccacaccgtcgtcgccccggcactcgtcagctcctgcattattaattgcatccattcattcaccatcgccgccgtgagccctcgaacccccataatgttacctaccgagaagcgggagaagggcggcttcttcatcttgtcggagccctcgtcgccgacggtgagcacggtgacggcgtggcccgcggcgagcaggtccttggcgaggtagaacccgatcacggcgtgcccgccgccattcgtgttcacgatcagcacgctcttcttccccgcccccgccgccgcctgcgcgcgcacggtcaccgcgcccaccctcctcggcgccgcggccgcctcgccgcacctcctcgccgcgacggcgcgcgggaacgcgatgaggaaagaggaggacagcaggtggcacgcgccgccgcgtcggcggtgcccagagacgaaggcggtggaggcggcggcggcggtggaggagaaggccattggaggaggaggagaggatgagaggggggaggtgatgagtggtgggcactgggacgcaggatagggaggggagcggcgctgtgaggccgttatttaacggcttcgcgtgattttcccgcgcgcgccaatcggagattgaactcaaggaacgaacgtctagcgttgttgcactcaaacggaatactccctccctcccaccagttttataattctgcatgttttagataaagttaatgttaaacttttataactttaactatcaataattttaaaaatatttatcttaaagacacttgaatgacgtatatagatttgtctaaaaatattgtaataaatatacaaattgtatgtattataatagaaaaaatatagcatcgagaccatgttattatccaaaactgtaagaaattgtagaaccaggggagtaggtgattttgattttttttttctaatggaactgcatacctttattttttcgatggtggcagcgtggcaatggaggcgccaatggcggggcgatggtgcccattggcggttggcggtgctgaggatgctgatggtagtgttggacagtaacgagactagtccttcttctcttactcagacactggcgatgacggataacggtggaggctagccctgcacctgtgatggcgggtcagcagcatagcgcctgtggttgacggttggttcggccacggtagattgagacgatggcggtggatgttcttagcggcggtgtcctaggggcagcggtaacttggtgagcttcggtgccacgttctgaccatggtcaggcgagggcagtggacgatggtcgtcgatggctccgtgacgaggctgggttgatggtgtgcgatggccattgactttactgatgcagataaggacgatggcaacggaggctcttgacggaggcgtcctagaggtggcaactgtcacgtgagtgtcggcgtcaaggtctggttacaggtaggtgcgaatgacaacaatgcatctttcagcaagctcatggcagaaaagacaaggtgtatatcatgttggatggttccacgatgctttaggaactatggtgagttcaatagtctgcggaagacggtggtagggtggcaagcggcttcccggtgctctatggccgttcgaaatgcagcaaccgcataaggggattttcaatggcgacgacagaaaacagacttagcagttggcagcaattggtggttgagttctatagaggcggagatggtgcgacgacaattagcactgactagttccgtttctcctattcccccctctcatgctgggacgaatagaataactcatcaatgaaggttgagggttaggggggtgtttggatccagagactaaactttagtttttatcacattagatgtttggacactaatttgaagtaataaacatagacaaataataaaactaattgtataaatgagagctaatttgcgagatgatttttttaagcctaattaatacataattagcaaatgtttactgtaacatcacataggctaatcatggattaattaggctcaatagattcgtctcgcgaattagtccaggattttggaatgatttttgtaattaatctatatttaatactctaaattagcatctaaacattcgatgtgatagggactcccccctaagtcttctagcttttcttcttttgtgttttgcgtgtattgctctgtgtgaggtttggagtataagaactcgtgcatgtttttttttttggctgtgtatatcttttataaatatagagactgaattaatgaaaaatctattttctaagaagaaatcatcgaaatgctcaaagtcatgaaaactaaatcagcccctacgtgcaacagcttatattagtacgtatcggaaaaaaaatcatcacacaaaaaccagaaccacagaaaataaaaaaaataaccttgatcctctcgggcctcggtgcctccaccgttcactggggtaataatagtgattaacataaatataggcggataatgaaatcggccgcttgtgtaaataaaagtggacgagctcgggcgacctatccgtttgtagtaaaatcggcgtccgatttacgggtaacactactttaaactgatttttcttctaaattacttattcaaatcatgatccgattataccattaaatttattgtaattaaatcttcaaaacaagaccacacatggatatattctgacgaaaaaaaattagcttattattaaattatttttaaatgttgcacgatattccaccatgtatatcggaattatttaactaagtagatcgaaaatgtttcactcgtttaaatcaggtgttgttttaccttatataaaaacaatgtttcagcaaatagcgaaagaatgtttcagttcactgcaacattagatctatacatagtgaaacattgtgagtacactaggtgaaacatttttcggtggaacaaaaaataaaccaaattcccttaatagggggtttccaaaatatatgggttttttttgttgcaatggaatgtttcgttcactgcaacattagatctatacatagtgaaacattgtgagtaccttaggtaaaacatttctgatggaacaaaaaaataaaccaaattcccttaatagagagtttctaaaatatatgggtttttttgttgcaaaagaatatttaaattcactgcaacattagatgtataaatagtgaaacattgtaaatatactagatgaaacatcttttgtgaaaaaaggaaggagaagtaggtgggtccagtagatacgcatgtggggcaggggcgcgccggggagcgcccgatccggctcccccgcatcggtcacccagagtagagcattatccaataaaagttcgatcgttttaacatgtggtagatcatgtttgcaggtggttcttgaccgacgcccaggcgatttcccttctgatcgaaccgtctgtatggtttagggatacttacgaaaatctactactttatagcagtaattatttcagggagcaactcatttttttcttaagaaaactaatcatatataaaattattaatggttataaaattttaaaagttcgataaaatcatgttctacacgtcaaatgttttcgacatgttttccaaaaaaaatctacctaaataaaaatattcagacacccaaagttcgaaaaaaaaagaaggaaaaactaacaggtctatccgaaacaaccaatatccaaaagatggaacacgccaattttgccacaccccagagcacaccccataatccattcacactatcgacctaaactagaccgttcgtattgcatagccagatacagtttgtagtgctgttgggattggagacgtgttgcaattgtccatattgctttcttccgaagaaacgaattataggaaggacaagaaaaaaaaaaacaaattggaagagaggacatcaatccttttgttccaggtcagcagaaagcagcacctaacaaaagaatccagcaatgactagagtcgtcctggctctttatcgatttcttttaatttcctgtaggttctagctgtttgtactaattaagcagtaacttaacaagatttgtagtctgaatcctctagtaggagcagcacttggctcaaagctggggcataattcactttaactgaatcatcattagccatggtttagggggtacaactctttcagctttaagttgttccctaattgtcaagtctgtggcaaccaattggtaggagagactaggtgctatccatcgctttgcgccccttaacaaaagaatcgccatttcaaataggatattggtcctgtttagagagtatctggttgataaccggcttataaaaatctaaaaaaactggattctataagttgagaaaccagtcgattctactgatcagcacacaagcaaaccaaacacagagttgtagaacacataaagtatgagcgagtggaagctttatttcttctggatttgagtacgagctacaagaggagaagcaggagaccgaagatcggttgtcctcgccttggaccttctgggccctatttataggcggaggagggtggaggcttacatcgtaagccttggaccttctggcttgtgccgtaagctggcttcctctgtaagctggcttcctctgtaagctagcttctagcgtaagctttcttctgtggtaagcttcccactcataatttaattcgtccacaataagataggtttcataacactcccccttggacgaatttgaattatgcacatgcctcattaaaaactcctcccaaaaacccaatgggaaaaaatggtaggagaaaagagtacatggcactttgaatattgtgttgcacctgttgcctcgttaaaaatcttgcgtgagaaaaacccaatgggaaaaaaattcaccaagggaaaaagagtacaacagttgatcaagtcttcaggacttgtttgtgattcttcaggatcacaatcatgggctaattgtttgctccccctgatccttgcaattcactaagtcgtctcatgccgatgccacgaacacatctgtaaaagcttgatgctggcagagactttgtaaataaatctgcgagattttcgcatgacttagtttgcaggacatttatttccccgctcttctggagctcatggggataaaagaatttgggagtaatatgctttgtgaaattgcttttcacatagcccatatgtatttgtgcaacacaagcagcattatcctcatagataatggtgggggtgttatcaatgtttagaccacatgacttctggatgtgaccgatcatccgcctaagccacacacattctcgtgtggcctcatatagagcaattatttctgagtggttggttgacgttgcaactagggtctactttatagaccgccaggaaatggcagtattaccacaaagaaatacaaacccagtctgggatctggcattatgaggatcagacatatagccaacatccacatatcccaccatggatggatattggttcttcgggaaccacaacccaagatcttgagtacctcgaaggtacctgaggatagttttgacgccaacccaatgtcttctggttggggttgcactatatctagccaatagattaactgcaaaagcaatatcaggtcttgtgcaattggctagatacattagtgctccaatggcgcttaagtagggaacttcaggtcccaacatttcctcatcatctttcttgggtttaaatgggtctttatccgcttccagggatcggaccaccatgggggttttcaatggatgacatttatccatattgaacttaccaaggaccctcttggtataggtagactggtgcatgaacactccttcagggaggtgctcgagctgcaggcccaagaagaacttggttttcccgaagtccttcatctcaaactcggtcttaagataagccattgcttctttaatgtcctctgtggtgccaatgatattaagatcatcgacatagaccaagatgatacaaaatccattcagggattttataaacacacagggacaatcatcgttgtttaagtaacctctcttcaggagatagttacttaaccgattgaaccacatccttccggattgtttcaatccgtataatgatcgctgcaggcgaacactatacatgttgcgatttcctttcagattcagaatcttgagtccttcaaggaccctcatataaatttccgaatctagtgacccatacaagtatgcggtcactacatccatcaactgcatatccaagttcatattagttgccattgagatcaagtatcggaacgtgattccactcattacaagagagtaagtttcatcatagtcaatactgggtttctgcgtgaacccttgtgccactagcctcgctttatacctcaccacctagccattcctcttccggaggaagacccatttgcatcctacagggatgacccttggaggtgttgggactgcaggcccaaaaacctctcttttataaagcgagcgcaactctgcctctattgctgctctccatttgtcccaatctgagcgcttctggcactcagccatggactttggttctggatccaaatccattatgacagcaatctttgaggtaaagtgaatgtcgacaatagtggtctttctatgatgttactctcctgtatcagcatagttagtggaaatctcctcatttatttcctccagctcatcgtgatttcccataacgaccgagttggagtgttccgatcttccagtgccaaggtgcgcgcgtaaggcactgggttctccatcttcaggatggtgtccttctgggaccatctcaacttcaggttgagttgcctcttctggggctttctcaacttcaggttgagcttcttcaaccgattctttgagtggaacaagtggctcaggtccttgtctccgcggaaccttgtcccgagcacccggaggtctccccctcttcctaggatggggggtaagagcagagtcagtaaccttctgggttacctctactctttccggtgcatttactacaggtatatgcgaccttgtcactcccttgtaatcagtgatggcatctggcaacttatttgcaatattttgcaaatttatgattctctgaacttccagttcagcttcactagcgcgtggatctaaggactgcataccagttgcattccatattatatctcggcattcttctggatgcctttctcccccaaatgctgggaaaatagtcctcatcaaagatacaatcagcgtaccgagccgtatgaagatccatagtcatagactcaagatacttgattatggacaaagtctcataaccaacgtatatccccaacttccggttgggtcccatagaagtacgctgtggtggtgggattacgcagatgggaaatacttggttcttttccacgcactagctgaaggggggatgtactatgatatgcagttggcctgagttggattagtgttgctgcatgcaacacaacatggccccaacaactggttggcagcctacaatcctgcaacagtggccgtgcaatcaacttgatcctcttgatcaaggactcagctaggccattttgagtgtggacatgtggtcctgaatattctaccttaatgcccatggctaaacaataatcatcaaaagcctttgacctgaactcataagcattatccattcaaatggattgtacgcggctatcagggaagctagcttttagcctgatgatttgggcaattagctttgaaaaagcatggctccttgtggacaacaggtccacatggctccacctggtagaagcatcaatcagtaccatgaaatacctaaacgggcccgacaggggctggataggtccacatatgtcaccttgtatccttgccaggaaaacaggtgactcatccctaatcttcaggagggatggcctagtgatcaacttcccttttgcacaagcagggcaactaaaatcttcagggttagggaagtctttagtttcaacattgtggccagcataattgttgatgatcctcctcatcatacccaacccaggatgacccagtctgtcatgctgaactctaaatgactctgggtttctaaatatggtcttcatcgcgacatattcctcagtgggttttatgtacgtgtagtacaaacccaatggcgatgaagggagcctttccaccacttgcttttgatatccatctatttttgttatgagcagatattcagcatcttgctcaatctcggtttctatatggaaaccgtttgcacggatatctttaaagcttaagagggtacgctttgaatcaggatacaatagagcatcctttacaaagatatgggtacccatagggagaactagagtagcacttccggtgcctactatatgagcattgcttctggcaatggtcataatatttccagttttcttatttaaggtgtggaaatatctagtttcccttaagattgtgttagtggtggcactgtctactagacatatatcctcttctgccatgggattcccacccaagtctgtttatggaacataaacataaatgaaattaaacatggagtaagttgattctattaagggaaacattacaaggactttaggcccagttaaagactaagcgtgctcttcaggagcattattcatgaccaaagttctacatgtgctagtcatgcggaacactgcatatgactgacatataggagattacttcacgtctccgaatatgtcatcatcttttttcaagaaggttgtcccaatcatcgtccatacgaacgtccccaccatccttaacattgataagcatgtcatcatgctttcaatttgagcttcaggctcaatggtgaagtgggactcatgttggctctttttctcattcatgctttgttggtagagctcaaccaggtgcttggggacacggcaattacgggaccaatgccctctgcctccacatctatagcagttatcctgctttaccccagatgattcacctgtaaccttcttgagttcgcctttacctctgggtttacccttgctcttgcccatgaatatgatacttcacttacctttccctttcttctcaccatggcctcttttacggccacgcgagtttccaacaacattggcatgtgcttcaggcactgccatagacccagtgggtctagcagaatgattctttagaagaacctcattctgcctttctgcaactaacaggactcagataagatcatagtacttcgggtactttgagttcctatattgctgttgcagcactatgttgttgggatgaaaggtagataaggttttctcgatcatctcagtgtaagtgatcttcaggccacataaacacaactgagaaatgatcctatggagggcagagttatacgccgccacagacttgtagtcttggaagcgtagggtgatccagtcatgttgtgcctgtgggagcacaattgacccttgctggtcaaagcgatccttcagggattgccataataccagtggatctttctcggtcatatactcagatttcaggtttgggtggagatggtggtgcaagaaatgcaatgccttttctttctcggccttcgtagactccacagtgccaacttcgggcaacacaatagtatgatcgagacccatagagttgagtttaatctcaacgtccaatgcccaagtgaggtagttactaccatccaaggcaagctcggtgaattccttctttactatgtccgacatgttctgcaacatcatttagtatttacgacaggtaaatacgatgtgcagggtcgacataaattggtcatgcgtaatcttcaggattactagtgtgtgtaatctttaggattatcacacagtttcccatagaatctttcctagcaaattaacttaagtaatcttcaggattacagattgcttgattaactattattaatcatgctcggaaatcaatttcataacaataaaataaatgttatgaaagtcatgcaaacagcaaagtaagcatgtaaaacaaaatgaagagcatacatgggcacttcatgcatattgtgcagactgtaaaaagtaagataaaccatatagtacttccccactatgagcccacgcttcatggcgacagagccgaccttagcggcatcaagggcccatatggatgatgtccataaatcaagggacatccataacgacacttcagggtcgtgtagaaggttcgtttgcctccgatatttggcggcaacggcggcagagccgtccattaagttgccatgccggtgcttcaggcacctatatcacctctagcatttggacgataacggcggcagagccgccattgtgttatcaaatagtgctaaggggatgtaccatctcaagcctttggacggtaacgacggcagagccgccatcatgttaccgggcgttgctaagaggatgtatcaactctagcaattgaatgataacggcggcagagccgccatcatgttatcgtgtattgctgagaggatatcgggggatggtacttcaggtaccatgttcttctgcttatttcaactataacagaagaatgatttgcacataaagagcaagatgatcagtagaaactgatttctcacatgtttacctttttagcttggtagagtctcgtgctgataacgtgttgagaaaccagtcgattctactgatcagcacacaagcaaaccaaacacagagttgtggaacacaaaaagtatgagcgagtggaagctttatttcttctggatttgagtacaagctacaagaggagaagcaggagaccgaagatcggttgtcctcgccttggaccttatgggccctatttataggcggagggtggaggcttacatcgtaagccttggaccttctggcttgtgccgtaagccggcttacgctgtaaactggcttcctctgtaagctggcttctggcgtaagttttcttctgtagtaaacttcccacttataatttaattcgtcgataataagataggtttcataacactatagacctattgctacgaatttcacaactttaatgaaaatctgtattactcggaggttctgaaaccaggtgcaattgttataaactccccaaacacccccaaacaggaccattatcacgctggttctttcaccccttagcaagaaaaagaatgactaactttcgagcatgacacaaagtgttggttttgaaatatggatgattataaaatcatgataaagtaagatccataaattggatttgaaaggcttgaacaagcgactggatccatactagaaaagctttagagaggagctaatgaaaatgttaaattacgatcaagtccctttgaaagacataatcaaaggtgcaattcattggttggagccaggaaatgggttcgctatatcctcgaagtttttatatcaccgaaaccacatccaattttttatgttactttacttttaaattaatttaaggttttctccatcagattcgtttattaagcattggctttacaacagcttaagaataaaagtacagaaatcttatctattattttaagcattcggccatgtgtctgaaagagcttaaacaaataaacaagcgtagtccatccaccctagtatgttttagatgaattttttttgttgacttggttgagtcccatattaaactattttttagatgaatattttttttgactaggttgactaggctgaattgctaaacgatttgtttttttaaaaaaataatataggaaacctattttaaaaatcatattaatctatttttcaagtttttaacttaattaatcatgtgctaatgatctactttttttttttgccaggaaagaagggttaaagcaaatttaatagtatagccaatttccagctctaaattatctatagtcaatttaatagctaattcatacaatagttagctataaacatatactacactattaatacctggtcccacatgtcatacacatattacgttttagagtccgtgctacagctagctacaaatctgtaatccaatgctattctctatcatctcttatctcctaaaaatatgtttatagatggcttatagtctattattatacctgttcttaccaaccacccctaaggttccttggtaggggacgggaactaatccctccagtacgtaaaatggagcaactcattagcacgtgattaattaattattaatattttttaaaatggattaatatgatttttaaaactattttcgtatagaaaatttttgcaaaaaaacacaccgtttagtagtttgaaaaaaacgtatgcgtggaaaacaagaaagatgagtcctacctctgtctcaaaataagtttatttttgagtttctctgtctaacgtttaaccgtctgtcttatttaaaaaaatttgtcacacataaaatactactattcatattttatcatctaataataaaaaatttaattatgaaaggttttaaataagacgaagagttaaatgttgtattaaaaactgaaaaatgaactttttatgggatggatatactacttaaaaaaaactgaggttaactgaactgaacttaaattttcttcatatgaaatttgtgtgtctgacacggtaaacgtgtgggacaagtggacatatacatgacacatccggggtcctcttcaccgtcgcaacgacgtggccctccactgatcccatcccattcccacctttattccaaagcacaaaaccacccgccccccaccaccatttccccttcccccaaaaggatcattcgccagcctttcgatccatcggacgaacacctccatcgaatcactcgcccaccaccaccaccgaccagagacccccactccagccgccggcgagggcgaccccatggggtgcgcgcagtccaatgaggacggcgagggccccgtggcgcggtgccgcgagcggaagcacctcctgcgcgacgccgtcgccgcccgccacgcgctggcgggcgcgcacgcgggccacgccgccgcgctcaagaacgtcggcgccgcgctctccgactacgcctccggcgagggcgaggcccacgccggcggggctctgcggtcggggtcggctgactcttcggccgcggcggcggcgctcgtcacggcgtcctccgatggcaagcccgtgctggctatcctgcgncgncgncgnncgagcttcccccgcctccccgcccccgcgttgcttcgcatggcgacgtn

SEQ ID NO: 34550 - DNA, 8661 bp, Oryza sativa
  unsure (1)..(8661): unsure at all n locations
tttcgattccatgccgccgcccactgtggacaccgccgccgccgagccatcgtcttcggcgtcggccgagcggagagaaccaccaccccccgcgccggacgaacaccagccatcggcggcggcgagaaaggtggcggagggcaagaggccggccgcggcaaaggcggcgacgacgcggcgggcgatgacgcagaaggcggcgaggaaggggaaggcgaaggcggtgatgctggtggcgccgccgcagccgcagccggccaagctgggcgtcggcgacatcctccgcgccctggacgaacacttcctcaaggcgtcgcagagcgcgcacgaggtgtccaagctgctcgaggccgccaggatgcactaccactccaacttcgctgagacgcgaggtaatttcaattttcaaaccaacacgatgaattcacttcacgattcagattactttcaaaccaacagcaaaattaaaatatcttctttacaatctttttcaatttttcactgtgatactagatagatagaacacttgctgcttatctaccatttcagattactcattggaatgagtaaaataatcagtacacttgtttcggggaatatgctttagcaagattggatagagaagttcagatacgttttattaatggtgacttggtgattatggaagaagttaacccgttccacacgattgtattaagactttgaatagattactaatctgcactgtcaagaacaacagaatgattgcattgttttaattattggaatgggccaatggaatggttatggtagtggagccgcatttagcgggtaaagcgaagaaccggacagagcatctaatcacatatgggtcacagggtacaggggaatgagttgtttggggttcacatttaaattgttgatgacctgtattctcatgattcactttcaagttcagttgagcagtctctgtcttgcttgttttttagtgctcgctgtgattattttcttcatactcagcattcttttttttcttcttttgagaactctcaggttaatttggtttccttccattgttaacgtaaatgccatttgcatcctatcttagtaggatttgagaaccattcctcgaaaaaaataggaattacatatttgagttccttctgttgttaaatggcatccctcttcggtcttgctaggatttgtggaccattctgccagagtgatgcaagtaatcacttggaatcgctcgtttaaagggatacctcaaccggaaaatgtgaggaatgaaatggacgatgacgaatgggagacacatgctaccactcttgataagctgcttgcatgggagaaaaaactataccatgaagtcaaggtacatggtgtttcttttttgtttaccactagttcaaaatataaatctttgcaaccacccactcatttattggtacaatcttatagattgctaaattcaatagcactttcttacgacaataattttgcaatatgatttgttcagcacataaagacgacctctgctactagtttgctggagtattttctttcttcctgttaagttattttcctgttcttgtggaattttttgttcatgcaatcatctgatctgtaaacctttctagccattttaatccaatttcattacctatccatgttgttttttcctttgaaaggacagttgcttccatgttttagactcctaggatgtgaaaatgattgaagcaacaccatattgtcacttgtttcttgatctaaactgttatgtttgtacatctgagccaggattttgaggttatcaggagggaatatcaacaaaagctagctgttctcaacaaaaagaagcagcgtggtgtcacttcttcctcacttgagaagaccaagtcggttgttagtcacttgcacacaaaatatgtagttgatctgcaaacaatggagtcaacagttgcagagatcaaccgtctcagagatcaacaattatacccaaaacttcttgaacttgtgaaggggtaagcctttttcaatgatttctccttctactatgaataacaacattgctaacgaaacaaaaaagaacaatagatatagactcaagagaacttaattgttttgttttcttacattggcagaatgtggcacatgtgggatgcaatgtaccttcatcacaaaacacagctcaagatcatcttggagctcaagtcgttggacatctcggtcgccccgcgggaaacaagcgagcaacaccatgaccggaccgtgcagctgtggaatgttgtacatgagtggcacactcagttcgacaagttcatgacataccagaagcagtatgtgggatccctctacacctggatcaagctgaatgtgatccccatcgacaccaacttgaagccaaattcatcacagccacatgagaccacacctcccatcaagagggtgctgcatgcttggcatgaaatcctcggaaagctccccgatgaggctgccaagaaggcgataaacacgtttgcagagatcgtaaagacaatcctggttcatcaggaagacgaactgaagctccggatgaagatcgaggataccaggagggattatgggaagaagaggaggcaattcgatgactgggcacaaaagtacatccaccaaactgcgggtatccttcctgaggacaggaaccctgacggtgcacgccccgatccgatggcggaacggaaggctgccatggaaaagttggagctttctatgaaggagctggaggagatgtatgtcaagcagtgcagggtggtcagggagaagtccctcagccttctcaggacgaatttgccggagctgttcagagttgtgtcggatttctcacttcagtcagctgggatgttcaagggcgtgtggtcgattgcacacaccaatgaccaactggatgaataatataagttcttttgttgttgtaatctttctttctttttgtttatgttcataggttgattagttgttgtatattgatttttggcttgtggtgccgagattaaaaaaaaaagaatgatcctttttgagctactgttgttaaaattcgtagtatagatataggagttttacttttacattacatggtatttgaaagagggaactgtattttttgtttcatatttgataaatattgtaggctttatcatgatgagttgcaacaatagaaggaaggtgattgctttaatcttatatgtgtttggtgtgaatgatgagttttgtgaaacagatggtgtgtgagttgatgttttgatgatgtgacaaatcagcacaagcacaagaacctgtcgatggaaagttgaatttgttattgccacttcaatcactgaagtttgatctgaatattctagtgtttcctgtctctttatttatcaagtttgatctgaatattctataaaagaaaacgattttttttaacaaatcaacatctacggtgaggtattgtcaacttaatttgaagaaagtctacctgtatgtattattctgcctgaaaaataatatcaacagggcattaaaatagatcatgaatccattactactacatcatacttacccaagatgattgatgcacatcctttttaaatcttctatcgtactgtacttttgttctatgtgcatgcctggggaatataaaatcagattgtacaaagtagcaagggagacttgattgcatccatgtcaatgtagaacacccttgttatgttatcaatactaggtaggttatatcattgatgtttgacattatatgggaatagatcaataccaatttcaatgtaaccttaataaaaatatttccatctcttcctccttatgtctatatagtagatagaattttaagtttcaagtttacgcgctcataagcacgttgtgattaactacactacatcaagattacataggccctgtttagatcccctggcaaaaatttttaccttgtcacatcgaatgtttggacacatgcatgaagtattgaatataaacgaaaaaataactaattacacatattgcgtgtaaattgcgagacgaatctttaagcctaatcgctacatgatctgacaatgtggtgctacagtaaacatttgctaatgacagattaattaggcttaataaatttgtctcacagtttacaggcggattatgtaatttgttttgttattagtctacgtttaatacttcaaatgtgtgtcagcatatccgatgtgacacgccaaaactttacacccctggatctaaacgcagccatagtgacaatatactgatgtaatttctgttttcaaaaagaaatactgatgtaatttctatttggactatgtattagtcaatattatatattccaaaattgtacttttgggctaaccatatactccctccatttcaaaatgcaggatgtcattgactttttacacgatgtttgaccattcgtcttattttaaaaaaatatataaatttaatttattttgttaccacttgttttatcatcaaataaaatataatattaacctatagttttacatattcatactgaatttttaatgagacaaatgatcaaactttgtgcgaaaagtcaacggcgtcatatattctaaaatggaggtagtattagtcattttatagattttatattatttaaaaaggtacttttggttttagtacgatggtaaaaaacctgtattacatgttggataatgacggtagaagtatcgaggataatactcatcgagcgaggatggaagtgccaaatatggccaactagcaaaatatcccctcaacatgtggggaaaatatgtggtggaaaccatatatgtagtggaaatctggaaactaccgttaaatcgaaaaatagatgtttgagatttgttcacgtcatcacgaataaaaattttactcacggatttagtcataagtaaaaattttatcgcaagtaaaacttttactcatgatgacatggatgaatcacggatgtctatttttcgatccaacggtagtttccaagtttccaatatatatatatatatatatatatatatatatatatatatatatatatatatatattccaccacatattttccccaatatgtgtggcaataattttttcaataaatgggagactgccacctaaccatatgccattaaaactccatcatttttcacatacatgcccctcgaactgctaaacggtacaattttcttaaaaaattatataatagttactttaaaaagtcatattaatatactttttccttttttactaataattaattaatcataaaacaggctcataagttttgtttcaaagaggagggtttgagaaagaaaaaaccgctcaaaagtcaaaacaccaacaaacaaacaaacaaacaaagagaggatgacagcaaggccaccaaccgccgagattaaatcatgcggctacgcgtcaccctgaaaattctcgcaacccacatcccgtcaacccaaaaaaaaaaaaaaagaaaaaaaatcacccgacgaaatttcccgcaccagcagcagctcatccctctctccgagtcgccgctctctccctcccgatcgatccatcgcggggtgatgccctcgcgctcgcggcggtgacctcgccgccggcggccgcgccatgacatcctccccctcctggttctccggcatcgcccgcgcctcctccgccatgccccccggcggcgtcgcctccgcggccgctcccctctccgatggcgcgggtgggaggggcggtggaggtggaggtgaaggtgaaggtgaaggagtggtcgccgccgtggttgctgcggggcctggcgctggtgctggcgttggcgcgggcgggaagaggaggcaggtgcagggggcgctgttcaagtacggccccaagtccgcccaggtactctctctctctctctggggcgcgcgcgcgtgcggcttccggcgggagatctgtgggggatcgttttgggattgctcgggatgatggattcgagggtttattactttgcattgtagaaatcctgcgattgcgtcgtggggggtttgaaatggtgtaggatttgagcgggggacgagaaggaatttccctaggtcgagatggttctagaatcttctagaaggttaccgcgttcgtgccgcccagccttcgagatgcgatgcggggatctcctcgttggattcgtccttctgcccttttccgctgggtgcgtgcggttgttaagagagagagagatagaggcttatggaataaggaagcttctgtagcatagccgtgtttctactcatgatccagggcttgtaatggaaataagcgcaggcgattctttctttagaggggttgcacttttgggagcccaacttgtgtgctaataattttcttctcttagttttcttttgctgatgttaacacggctagctaggccttttgcgtcttgtctccttgcttctgtatcatttctcgcgtggaagaaagcctactgaatgaatatacaatgtttgaccctatctaggcttatggtcccttttgcatagtagttccttttgctgcgtgtagaggatttgttttctactttgaaattgcgacgaaataagtgtacaaatctctgccagctatgtttgttatgatcctttgttgctacaagcaaggttgtttatatacaccttttgttgtagtacaaaagtgagggtctcaactctgaatgggataatctgtcacaatgtacctgcattctttcctttgtttggaccacgtagtgccacattgccatttgtgaccttattaagatgatcagttggtagtaagcctatagaacatcagcattatatcatgccaggatgtggttgcaatattgtggtttctagataacttattctgccggtaagatgtacccttttacacattatagaatctggttggaattttgaaatctcttggaagttttatcattttaattctaaggtaaagtccatttttggcactcaaaacttgttggattccattttttaccgttaacttaaaacccagtcatttctcacactcaactttcaaaaccagaaaaataacacccaaaagctgattccatggtagttttgattgacatgacaactgacatagccttcaggtactaaactttgttggtgtggaactgtggacctaagtggcatccacattagcaagacatgtatagtaggagtctgcactagtgaaaaccatcaccatgtcaataaaaacactgtgaatatggtctagagtgttattgatttgcttttgagagtcgagggcgaaaaaatgaaaaaaaaaactggttattgagtttagcatgaaaaaggacttctagaatagttcaagcaccaaacatggtctttaacctagttgttttaactacctcagaggcccagatgtctatgcactatgctttgttatgttgtgtacattctgtaacacccttcattttctgatgatttgcatatacaaaggaaaccctcacagcctcaccatccatatattaacttctaattagatatggcttgtcattactgttttgtttcttctataaatttcttcttgcaggtcgcatttaaaactggtgattttaaccaccaggtgatcttcatcggtggtttgacggatgggtttttagcaaccgagtaagttggcaatatgcagttccattaaatatttttccatatcatttgttgaattagaagacactattgatagtgaaagttctcatgagtttccaattagggtactgtccaagcgcttcagtaacaacgttatttggtatctttactgttagttagtcaagttattgttttgattagtctataaaatagttgttctgaagcatggagtgaaatgcctttctccctgaaagttctttcatcctagtctgtggtctcctccctatcctaaagtgccttcccttcagccatgtcactcctcagtatggaagctgccctgatgtactgagttgcatagcatgatgcatacatggaaacatggaaatatatactatataatcaccatttagtacttcatgatgcattcatgcaatcacttccctctcaccaaatcagtatgagataatctagttgttgttattatttactcggcatatgtataaaatttcaagttataattcattatatgttgagagtaacaaacatgagaaaaatctgaaaaatgatgaattggagaaggataggaaaaataacacaataagttctgtaagtatataatcataatacatatgttatcatttttttttctcttggttaagactggaactaattttattattctaatccatgttggaacattacagctacttggagcctttgtcacttgcactagaggtcgagaaatggtcactggtacagccgttactttcttcatcatacactgggtatggaatttccagcttagagcaggtatgatctgtaacatggaccttttcatccttagagtttaagaaccgcatttgcatacattgaggtgttcatggtcttagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34551 - DNA, 694 bp, Oryza sativa
  unsure (1)..(694): unsure at all n locations
nagccgttcgcgatgctacggatgatccgnctnnnnnnnnnnnnnnnnnnnnnnnnnnnnnnnnnnnnnnnnnnctttactttgccagccgaattcgggattgaccaagccgatgttgacgaacttactattcaccttcacaggataatcacggttaaagcatccggccaaatgatgaacaagcgcggagatggttgaattttgggtagcatcgtcaattatagtgtactattattaccaaggaacataattgaaatcatcattcagacagcttattaccattgtaggccagtatggttttttaatatcccagtccaattagaatttagcctgtgtggcttataagagttgtgtgctcatgtttagtaccaccttgagttatgtgctcatgtttagtaccaccttgagttatgtgctcatgtttagtaccaccttactagtttaacaaggttggaaccaacttataagacatcttccttccaatcatatcacttctaggttaacccttttacacgaagcgaggacgaaagtataagtaggttcgtaggcccgtccattggttgcgctcagagcctgtaagtggagtggtatccgtccattggttgggctcagagccgaccctcgcagtatgtttagtgggctcagagccgacccttgcagtatgtttagtacacatttctcaaatccaactttt

SEQ ID NO: 34552 - DNA, 606 bp, Oryza sativa
  unsure (1)..(606): unsure at all n locations
cgcgggggnnnnnnntttgtttatagacatactcaagctatgcactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaatccatggctcctttgccgacgctgagtagattttaggtgacgggtggtgacaatgagtccgtgtcgagcgctgattttttcggcctttagagcgagatttatacaatagaatttggcatgagattggattgctttt

SEQ ID NO: 34553 - DNA, 735 bp, Oryza sativa
  unsure (1)..(735): unsure at all n locations
nccgcgcntttgaaaccccccatttgaatgctctcacaacnnnnnnnnnnnnnnnnnnnnnnnnnnnnnnnnnnataaaataatagttatttaaattatgtttgcaaaactgataaaccacttgttttttcgttgtcgaccgtaatcttgcccagaggtctggacgatgattggggagtaattccatggaagggttgatcggttggtgtcaactcactttgtggaattcccattgcatccagagtgctggcgaagaggagattgatcgagctgccaccgtcgatgagaactcgcgctaccttgacgttccgaatagtgggttcgaccacaatcggatatcgtcctgggataacagatgtcttggggtggtcttcttccgagaactctattctctgctcagaccacttcatcttgggtgcagccttctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34554 - DNA, 1016 bp, Oryza sativa
  unsure (1)..(1016): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatggtgggatatgtggatgttggctatatgtctgatcctcataatgccagatcccagactgggtttgtatttctttgtggtaatactgccatttcctggcggtctataaagtagaccctagttgcaacgtcaaccaaccactcagaaataattgctctatatgaggccacacgagaatgtgtgtggcttaggcggatgatcggtcacatccagaagtcatgtggtctaaacattgataacacccccaccattatctatgaggataatgctgcttgtgttgcacaaatacatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34555 - DNA, 713 bp, Oryza sativa
  unsure (1)..(713): unsure at all n locations
ccgtgggctgagcccnccctnnnnnnnnnnnnnnnnnnnnnnnnnnnnnnnnnnnnnnnnnatcgagatcatctaccgtgtccttggcgtagacgcttgaaccctccacgacgccctcaaaataatagcttgggttcttcatcttcaatcggctgtatatcagaatcggacacttttagaaaatctccaacccaaatcttcctggataaacaatcaaggccatccatctcccaaagagctagatcggcactagcaacattaactgacctgtcggctgtatatcagaatcggacacttttagaaaatctccaacccaaatcttcctggataaacaatcaaggccatccatctcccaaagagctagatcggcactagcaacattaactgacctgtcggctggtacaatctcaaccttgtcgccttgccattgaatcaagcattggtgcatggtcgaaggaatacaacaattggcatgaatccaatcccttccaagcaacaagctgtaagaacctttcccatcgatgacaaaaatgtggtagggatagttttacttcttcctccttcctctctttttcgactcgctcacccctcaacgagcttgaggccgncatggctcactcttttgactcctccctcaccgagcttgagtcgggcatagagatctcgccatgctcgagagaaagagggaggtggcnngtgccatgacnagttga

SEQ ID NO: 34556 - DNA, 958 bp, Oryza sativa
  unsure (1)..(958): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacatgggaatagttgcactattttgtaactgggaatatatgctctctttgacaacagaattcacaaagccatgctcaagatgaggataagacaccaccaaccaagcatgctactgcacacaaggtccttgtctttcaatttatatttttattctgaactcaccatggttgcatcctattatatggttatcatggatacatagcattatattatttggtattgtttgtaactaactatgaatgtttactatagttcatgacaatgtgatgtattcttttattctacaacaaacgaacctttggcctaaatgaccatgggaaacagatggagattatttgtgccaaggttagttttcacttcttattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34557 - DNA, 834 bp, Oryza sativa
  unsure (1)..(834): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggtttgaaaattgaaattacctcgcgtctcagcgaagttggagtggtagtggattgccttgttttcaaaaagtcgctcgagaagcacatggcgtttcaaaaaagcaagcgagtacgcgttgtcgagaagaacgaggagacacctcctcacgaatcggatcctgcgtacccaggctccgacctccacgtctcacacatcttcagcggctccacaacatactcctccaagcgggaatacaagaaagtggaacgtgaagtctgttcgacgtggtaagaggctgcacccaaaatgaagtggtctgagcagagaatagagttctcggaagaagaccaccccaagacatctgttattccaggacgatatccgattgtggtcgaacccactattcggaacgtcaaggtagcgcgagttctcatcgacggtggcagctcgatcaatctcctcttcgccagcactctggatgcaatgggaattccacaaagtgagttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttgcgtatt

SEQ ID NO: 34558 - DNA, 909 bp, Oryza sativa
  unsure (1)..(909): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatatgccaaacaagcgaagaagctgactgatggagagcaaagcacctcgaagaaaaaggacgacgatgacgatggcccacctggttttcaagattctcgtaaggagctcaatcacatcttggttgggccgcaagcctatgagtccaaacggaagcagaagctaactgataaggagatcaataccgttcagtcggacacacctcaataccttcgggtggtcggagatagcaattaagtttgactactcgaatcaccctgactgtcacaccctaaaaatcccaaatgtataaattgttgtttaattggaattattagaaataattttaaaagcctagaagagaagatctaattttaaataataaattccaatataaaagtgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacg

SEQ ID NO: 34559 - DNA, 895 bp, Oryza sativa
  unsure (1)..(895): unsure at all n locations
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagattaactgcaaaagcaatatcaggtcttgtgcaattggctagatacattagtgctccaatggcgcttaagtagggaacttcaggtcccaacatttcctcatcatctttcttgggtttaaatgggtctttatccgcttccagggatcggaccaccatgggggttttcaatggatgacatttatccatattgaacttaccaaggaccctcttggtataggtagactggtgcatgaacactccttcagggaggtgctcgagctgcaggcccaagaagaacttggttttcccgaagtccttcatctcaaactcggtcttaagataagccattgcttctttaatgtcctctgtggtgccaatgatattaagatcatcgacatagaccaagatgatacaaaatccattcagggattttataaacacacagggacaatcatcgttgtttaagtaacctctcttcaggagatagttacttaaccgattgaaccacatccttccggattgtttcaatccgtataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnag

SEQ ID NO: 34560 - DNA, 642 bp, Oryza sativa
  unsure (1)..(642): unsure at all n locations
nccccccccgcgcggtcnnnnntttganatgatatcgactcgacgccnnnnnnnnnnnnnnnnnnnnnnnnnnnnnnnnnnattctcgctcgacaaccaaaaccatgcttaccacctgcgatgttgctgacacatataatagcaatggttcttgcggatgtgatgaagctaggaccccaccaccaagaaaaaatatcacttttatttttatcttgccgtaatttaggtttgttttgatatgctgcttgattggaatcaaattttcacctcttgctgctgctgctgctgcggaggggaagtaggaggactatttggtggctagattatgggaggaggggagggggtggtccaaccacttgatttgatgagccgactgatgtgtaccacatattccttcatgaacttccccgagtgcaacttttggctgagcggcgctcgaacatttaagaatcactatatcaatcatccgataatagaggacatcatccaataaagtgtatttcaaggccttataacgcaatttctgcgaagccgattgagatggattctgtaaatactgaaacacattatatcttcattcatcggctggaattgtagcaatctctatttcgatattttttggcattggcttatatcccgacg

SEQ ID NO: 34561 - DNA, 1461 bp, Oryza sativa
  unsure (1)..(1461): unsure at all n locations
aataccggtaataccggccttgaattaagctaaaccgtctcccgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtaattgtgttgatctggagtcccatgttaagagtatgtattactaatagttttgtgatgcgttgaactgtaattaattatgtaatcattctggggcttgcctgtttggtatatagaaaaagaaaatgaggtatggtcagatgtaccctatttttttcttaagggcccatatgactatatatgccataagtcttttgcattttgttctggtatatactatatatgaacagtattgtttgtatgatgcaagagatattattaaatggcatggcagctaatctacgcaattcataagtcttttgcattttgttctggtatattacccgagcattttagttacagtgattcttctctaatgtcttcaatccattccacatgtgtaggcggctatcttcacaaccgcgacaatcatcaccctcaccacaatgctgataatctgtgtatacaaatgacatctgaagcttgcgaaaacagggctggaggatcctcgattgagagacttgagacattcaggatggacatgtgattttagtgattgcagccaattttaacccatcatataccacaacgttgtacttgatcgaaacacggtagtagcttcgtctgctgctaccttttggttatactgtattaatgttcattattattattgttactgctgtcactaactctgagctcgcccggcttcatttttacacaagctgtcaaaatttctatggaacaattatacacccctgcagcatcctgccccaattttgcgtgtcacgaccagatattcagatatcaaatggcatgtaaaattaatgtctagagtttattctttctcccatccaaatgcatgatctgaatcttgtgacatgatgataaaatccactgtaaaattatactgacttgaatcacgtggaccttttttttcttttttgttgagtataatccacttgtactctgctctacacccttcctgatcttannnnnnnnnnnnnnnnnnnnnnnnnnnnnnnnnnnnnnnnnnnnnnnnnnnnnnnnnnnnnnnnnnnnnnnnnncgatcatcaaacgcgc

SEQ ID NO: 34562 - DNA, 1890 bp, Oryza sativa
  unsure (1)..(1890): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgttcactatgatgctattttcaaccatattattctttggtaaagttgtcaaaattttggctacgtttagtttgttgctaaattttagtaagcacatatgaaatcttgccaaaatttgacaacctcgttaacattttgtcaactttactaaaatttagcaatgctaaaacttggtaagattgaaaatggtagtaaagtggacacgccctatatcatgtatggtcaggccatttcccacgcgcgccacaatttttggattcgccaataatctgtgttaccgtgtcacgtatacacatgcatatatgcgtgcgtgatgcacgcggctctcttgcaaatatgcaaacctgcaacgccgaatgtgacgttcgatgcgcgtaaatttcgctgatcgatacatggaaagcaacgtgtgttttgggcatcgatcgatcggtaaatcgcacccgcgcgaacgttctagctagctgctacgaactccattccaaatagttgtcggcatcgttttaattaattttgatgtttttttattggttagactgtaatgaacgaaaagttagtgcttaagtttaggatgtaagggtatgttcagattgtagccaaaataaatcttaccaaattttgataatttaacaatattgctaagttttgacaggatttcttatgtatttactatttactagagtttggtaaaaaaaactaaatggaggtaattttcgacaactttaaaaaatggtatgatttgaaatgacattaatttgaacaacccctgagacgtttatgaacaccaaagtatttatagttctaaagaaaaagacaagtgcttaaaatttaaatatgaacattatgtagtgaccaaagttttgagaaaggagggagtagttagcaacatcttgaagattatatatatatatatatatatatatatatatatatatatatatatatatatatatatatatatatatatatatatatatatagagaggaacgaaactttagggttttcgactctgcgctcgctacggtcgcagtggttctggagtccatccgttcggagggccagctgtggtctatagtcggcgttgctttttttgggggatttcttggtagtgtagcgtggctctgccccctcccgctgtttggagttgcgtttttaaccgtcgtagtagttcctagcttcaagtccccccttttaggcataagccagtctggctgattgctttgtataacaaaaactcatttcctgctaatatattgacgtgcaaattttttgtgcgttcgagaaaataaatattcatgtttcaaatatcggagagaccgagagatagatcatgtgaactggcattgcctgcaatatccatatgttgttgagttgttctaacgacaatattttaactaaatgtcagggtgttgatgactattttgtcactagtaagcttcaccgaccctttgtttatctaaaccatgctgacacggtctaatagtaggaacaaatatgattagtagaatatggttgaagtacacgtgtatggctccagtctaattaattagttttgtgatgcacggattaataatctgccatttgagctgatctaatcaagannnnnnnnnnnnnnnnnnnnnnnnnnnnnnnnnnnnnnnnnnnnnnnnnnnnnnnnnnnnnnnnnagggcgtctatcaacgcgg

SEQ ID NO: 34563 - DNA, 1210 bp, Oryza sativa
  unsure (1)..(1210): unsure at all n locations
ccagcaaggggcattttcatatgttagttagggtttttaaccattatttactatcattcatatgcaaattataattgactggagaatttttaaaagtattaaatttaatatatttttaaaactatcattcatatattagagtttttcacaatttaatttactatctttcatatgctacttatatatgacgcatcgaatttttaaaaggtttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatatattggaatttttattaattataagtcatatatttgcttattacgatttatccacttaatttattatagacaaaaatactttttcgaagtaattgtcattaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggctggtgctaactcccgcgcctacagctaatgcacattttctattcattaaaagaaaagcgccttgtagatgaagcattaggtaatttgatccagtgatccatacatggcccacaaccattgttcacaactctcccattttctcctcatcttcccccaagctttgctctttcttaccctacgacatggacacccatgtcgtcttcccgttctatcacgcatcataatggcgcactgccttattatatacaacgtttcccttccattcccctgtcctctttttacgccatccctaccgcgggacggccctaccctaattgctgctttcatttcttgttcgtctctttctttcttctacatttttcctctgtttcagctttaaatattaatgctgactgngcttctctttccctttccacttcttttgtttttatgatgacaacttttatccacctaagattcctccaatcactgttcctctggctcatggccactttctcggagctgtatgctcatctgacaggtccatctttcacacgttctcacg

SEQ ID NO: 34564 - DNA, 748 bp, Oryza sativa
  unsure (1)..(748): unsure at all n locations
gcggccattgatgaccgcccnnnnnnnnnnnnnnnnnnnnnnnnnnnnnnnnnnnnnnnnnnnnnnnnnnnnnnnnnnnnnnnnnnnnnncctacacggcagtgggtttcatctttgctgggaaagatctcattgctgtcacactgacttggttcttctacatgatgtgcaagcacccacatgtcgaggcgcggatcctccaagagctcaagggccttcaaagctccacctggcccggggacctccatgtcttcgagtgggacacgctccggtctgccatctacctccaagccgcactccttgagacactaaggtgacacatctttgatctccccattctcccccaatctcactaacaattaatctccctctcttcatcttctgacattctgaccaactattacattgcttgaattgtgttccaggctctttccccgcaaccccgttcgaggaaaaggaggcgctcgttgacgatgttctctcctaacggtaccaaggtgagccggaacacgaggatcatcttctcgctgtacgccatgggaggatagaagggatctggggcaaggactgcattggagttaaaccngaagcgggggtgtcaaaagcgggcgcctttgcacgagccagctacaagttctgtccttaacaacggcccaagagctgcctcgggaagaactcancttagcacatgagatcatcgttgcctcatattcacactttaagttgacttgttcagggcatgagtgan

SEQ ID NO: 34565 - DNA, 847 bp, Oryza sativa
  unsure (1)..(847): unsure at all n locations
ccgcgnccttgattgatnnnnnnnnnnnnnnnnnnnnnnnnnnnnnnnnnnnnnnnnnnnnnnnnnnnnnnnnnnnnnnnnnnnnnnnntaattttggctgaaccttctgtatgcaaagatggtgatacctacaagtggaatgattccatggatgatgcttccctcttagcatcattagaaaaggatggtcgatgggaggaagcacgaacttgggcaagacaactggagtcgagtgatgtagcttgggagtctacttttgatcatgtgacagaatcacaggtatttggtttgtaccttcatctgttacattaccaagtgtgcccttatgacttttatgctgatatgaattttttctgtgtgtgtaggcagaagctatggttgctgaatggaaggagttcctctgggatatcccacaagaacgtgcagctttgtggagccactgtcaatcgcttttcatgaaatattctttacctcctttacaggtactatcttctgaaatagcctaatatattcttcatgtgggcttttatctgtataaaatttatcggttgtttatatccattcaattgtgtttgcaggctggatctttttttctcaagcacgctgaaacggtaggagaagagataccggcacgggagcttcatgaaatacttctgctatctttgcaatggctaaccggaactatgacttactcctctccgtaagcttctttgtaatatgtattgctgctgtacttggnctcattatcttcttacagatatatatacattgtttgcagggtatatccacttcatcttctccgngacattgagactagggtttgctcctggccgttgagtcagagat

SEQ ID NO: 34566 - DNA, 8133 bp, Oryza sativa
  unsure (1)..(8133): unsure at all n locations
ntcatcatagctccaaaagacctgatataacttatcatagcatgttgccgacaagcatacagagactcntaaaaggttacaaannaatgaccaaaagatttaattttctattcaaacnaatagaggctagacaaatctagctttgcaatattgtagctaaactactttagtcatgatgatgtaatctggcagctaacagtacttaatgaaaaaaaaattcagaacagagtctggataatgtagccgtttagtgacaagcctattagcatatatttcgagaaaactgataaaaaggaaattgaatacatcaaatacagaataggtagcaagtaggtgcaggaaacactgcatacctgccttttctattcaaaacaatagaggctagacaaatctagctttgcaatattgtagctaaactactttagtcatgatgatgtaatctggcagctaacagtacttaatgaaaaaaaaattcagaacagagtctggataatgtagccgtttagtgacaagcctattagcatatatttcgagaaaactgataaaaaggaaattgaatacatcaaatacagaataggtagcaagtaggtgcaggaaacactgcatacctgccttttgtacgatgatacatagccacctagtggctcatgatggagttcaactccttcggcatgtctcagtggaggaaaaagtaatgtcggttgggagagtattcggaaaagtaaagcagcagacgtatcagcagcgataccagctctcattgacattgcagttccaatagcacgcaggaaatgaagatgcatccagttctttggaagctaaaacataaaacaaagctatgacaatcaataaaatattcaaaacacataatgtgctgttatgataatattgcatgatgtgtcatcttgattgatagcactgaaacaacagccagagagatgtatgatatacccgcatgccagaatcgtaatcttccgctgctctaaggagttcaacaagctgtactgctgcatcaagtgcatctggggcccatgatggtggtgcctcgagaagaccaaaaagcaacctttgggtagcacttggagtagcaattgcatagtatctgacgaaaaatagcatgttagcaatcatttggaaagtacacatggtacaacagtggacaggatcataagagcttacctatgaaacaagcgagcatatggttcaagaggagggagccccgcaaccaaatgttcgtccaatggtgtggtcggtggaggtaatagaagtgcaggaacagctgccgcagtcaaatttgctgtctcataacgagctacttcctcatcacagacacttagtataactccagctccattggcaacagcccatctgggcgtggatggcataagttgtgggtgcttcccagatcctcggctgtaagctgaatgacccaagcacatgttagtaacttgtgtttataataagcattagcatccgagttgcaagaaaaagataaaggtcccactccaatgcagaaaaacatgcatagtatgagctcataaagcccatatgcactatgttttttaagaagcaaaaaaactgaatgcaagtttcaaagtaatttacaaacttccattaaaaagtaatttgcaaacatatcacaccttttttaataatatgtactctagaatctagaaaaaatgtgctcccagtaaaataaacaatcaggctaactttaatttgtaggttatgtcttgtcgccacaggacatgttctacttgtttactttgatttacaatatacatcatttgctttgtcaccaaatgctagtagtaaacaaatataaaatgctcactttcacagcatattgccattcactcctattataatccatactcactcctgtcaaaaataaacttttggtctgatcaatctctctatggacattaagatcaaccatgcaaaaatgatgagtatatttgtccctgaatgtacattcttcacattataatttttccatgctttattaatatattacaaaagaaactgctattcaaagttttgttttgaagaatgtgtttatgcctaaagtatcactttttttttatttgagggagtaagttattgatactccagtttccctttggggatcttaagaagggaactgatctaccaaagaatgcaaaatatgcaattgtagacattgtcacatggtatctcaacagaataaaaagacatgggagtaattaatgttacaataattataaaaaattcacgatagaaaattccattgctgattttaccaaccagttgttggaggcttcaattctccaccagctgcgtattttcccatgactccaccacacctgatgcatttgaagacaaaacagggaatggtaagcgtccattagcaatagaagagtactcaagcaaatttttcatcatcagcagcaaatatatagtatgttccaacatgcttgacaaaagcaagtttacacaatgcatgcagttccattagcatacttttaaaagttgtctatttttcttgccatacttgcattggggaattatgaacatgcatgaagtttgaacttgttatgagttccaccccttgctcctgcgttctgctcacatacttctattattttccgtgttttaactttaaattatatgcgctcttccttcttgtcaatatcaccataaaattgaggttgtatttctcaagaaaggaggatttcagattttcagtccacagaacaataatatgttatcatttattatgactcaccatctaaaatagtcacttctaatacccagaggtgcagcaagcaatatgtctgtgatccaaggagatagtggcctcaatggcttccggtcaggttcatttcttggagaaccgttagcccttttctccatagactcacatgatgaggcctgatcagatgtgctgctacattccgcttcactatgttggtgatcaactttgaagattggcctgttgtagtgagttagaactctaagaatttctccacaggccaaggcccactgctccgagtactctttctgcataaaagttgcatctttatgagcaagagtagtttgataagctataagcagcacagtttagatataatattgaaatgcacagcagaggcaaaatcttatcaaacacagagaaatgaaccaataaattggaactaaccattagagtaggggccttacctcagaagtatggctaaataaagagatgaaggacatgaacgggaaaccatttctatcataactgagtgtcccatctatgatgcgtgacagaatcggatgcacaactgcatggccatgctcaggatgatgaagaacaaaagttgctggaaatatgagaaaaatatgtcaaactctttcttcaattgtttgtggaacatgtattgatcactggatcaaattacctaatacttcatctacaaggcgcttttcttttgatggatagcaactttgaattagctgcaagcatgcaagaaaaagaatgcaaaagttaacacactggagaaagattttatcacagaagatactaaacatgcttagagatacagtacctgagctatatcttcagggaattgctcactgtcagctgtaaactggccaaagtactcaacataggccagaatttgtgccttcagagaggagacgcaaccaagtttcccattgaggcaagtatgttcaacatatagaatttctaacaagaatcaaataggaataatgttacctgtttttgttgtgaatcctgtggtgggggccagaacagtgatgagaactggagcccatcaatccacttctcatttgaagctgacatacttggtagctcaagagcctgcccaagaaactgagagaattctcaaagagaaagaaagaaactacacaaactgctccagttagcaataaaagcacctgtaatcaacaccacgttgaagccgccagttagttcatccatttatgccaccaaagtccaaatcttcttataagctacttgccttggtatcaagaaacttcgagcaagaaagttataagagtgctatccacttcattcaatcaacccccataacgggggtctgcatctcacaacgtgacacgttatcatatcaaccaatgccaaccatatgagcttcagagtctctacactgtaatatatcgcacaacaaaaaccaaaaaaggaggaaaatacatgaattttaattaatgcaaaaaaaaatttactccctccgtttcatattataagccgtttgacttttttcttactgaaatttcttccaagtttgactaagtttatagaaaaatatagaagtattttcaacacaaaaaaaacatattatcaaaatatattcaatgttagatttgatgaaaccaatttaatattttagatattgctaaattttactataaactttgtcaaacttaacaaagtctgactaggaaaaaagtcaaacgacttaaaatatgaaacggagggagtagaaaaaaactgacaaatgaaaagagagggaggtaatgcaacgaaaattgcataatcttacaagcgcattattttattgtcaagtacaactaaattcataatcaaacgaaaaaatatatctaggaaaaaggtggaagctttctcgtttttaattatcgaaatgaaaaggtacatgttgcaatcatttataaggtaaagtttaccataacatttagttatggtgcaagctcacatgtcgataaatatgttaaggaaggcatcatagaaataggcaaatttatggtaatgctaatggatgtggtgtacagaaccattcacttggttcctcgtaggctcctatggcttatcacacaaaatcaatagatgtgtttttcgtgacatttatacttcatttgttattccacgtcactcatcggtctgtttttgttggtcgattataaatgtattgtctaagacagaatttaatgatgttgttctatcttgttattctttctttttttggcaagcaaagattctatttcgggtactatgacaccgaaccagaaagtatattacctaaagcatagaaatggaaaatatataggaacaaaacaggttcttcttttggtgtttaattacaggtgtctctgctcatcggttggtgtctgtattcacttccactgttaacgaaatgaggaagggatcccttgttactgtttcaggggaaaaaatattaaagcagagctagcttactgcgaattaattttcagtaattatccccgcacaaattacatccacagccgtatgcaccacatctaaacgcctccacgaagcagcaaaatccagctagaatcaacgctactcgcctaaaaaaaccacaaaaacctcctgaaattcgcagtaataagcatccatctcgcgttgatctatccgatgccacgaattattacaatactaatcagctcaacctcgccgtcaaatttcaaaactaatttccctttcacgtcttcaaaatcccaaccgcatctaccaccaaaactctctccccccaaacaaaaatcccctcaacataacaccacaaatccacccgaaccacctcgccccccatacacgacaaccttagaaaggccatcatcaaaaccagcctaaaaatagttttaaagaaaaaaccaccaagcacagcacagaaaaactaaaaccgcacgggaaaaataaaaaagcattacctcgatcagcctttcaaccaatccggacctcacgcggcgtaaacggcggcggcggcgaggggatagacgcgcgcggcggcgacacgggcggtggaggaggcgcaggggaaggaggaggagagagagagggagagaaacggctcggaggaaggagaggcgagaaaaagattttttccggggatggtggtggtggtggtggtagtggccgcgctatttcccacccgcgcgcgcgcgtggggtgggggcccacgcggcggttccgggtcgccgacacgtgggggcgggtgatgtggggcccacgtgtcggtgataggcgggtggggtagctgcggggtgagatacttattcgtgagtgcggcgggggggtgggaaggctttgcttggcttggcggatcgcctcctggcgattgctgacatggccttgatattttcgggggtgcatggcatgtatgtatgtatgtatgtatgcttggtgatcgtcatgcatgaccccccatggccatggccaatgacatggattttgtggttctagtccttgtgttgtgagattattgcgaaatggtccctatgatttttgaggtactatcatggtaagcggttaaagtggaggtatatatccattttcttttgcaagtgaatgattactttttttagagagttgactaaggctcccatcggttgtcattttacccaaaatgacttatttggcttattagaaaattaaaattaatttataagtaaaacttttgtagatttgttcgtagcgacttaaaagccaacattaacaaaaattacgttaaaagcatttcaaaatcaacttcaaaatcaagttcaaaaattcaaattttggcttattctttggctgtttaggccaaacgatggggctataaaatttagcctctgtattcaaactggatctacacggttaaagtgataagagcaaatttaatagtaaagtcaacaagttgctataagctcctattccatgcgtcccaaaatacaaggttagttctattttcctctcatctctctttctctctctacaaatttaggctgagttctttctccgaatttttcaactcactttcctcgtttttcacgcgtacgttttttaaactgctaaaaacagtatgtttttttgcaaaaattttatatacaaaattgcttaaaaaatcatattaatctatttttttaaaaaaaatagtaaatggtttattaatcataagaaaatgtgtcactccattttacgtgcgtaggaggtgagtttccaatctcacctcccgaaacacaacctcaatgtttctatgttggagtatacgtagagatggctcttgttcgagaggcaacaatacacgttttcttttatttctttcctccgtatatgtttatagttggtttatatctaaatagtgtacttgctcttaaatgatagtgagattgcatgttccttgagcttctaaacaatgtgatttgtatgaaaaaatttgcatatgaactttataaaaataccattttaaaacccattttcagcattgtaaaatttaatttattcattggtgccctcgaacagttatcccaaaaatatccatccatttagcttgcaagaatagggatagtggtgataggacaatagccatttggaaaaaaaataggattattataggacattttaggactatttgaaaaaaatggctgttaggaatcttgtctcgaaaataaattgcgaccgttgttaggaattgagagaatgatacaagtaaaatgcatattctcaatggtcctttaaaatgcaacactgctatactatacttgatatatttcttctttgatttttccctgcatttagatcttcatgttggagtactagttaagaactaaaatcttaacaccacaccaacatgaagccttgattcaacttcttggctgagcgggcatgtttctcaaactagtaaataacatgtttaatttaaagaatttacataaaatgcttattcaaaatattaaataaatcatttttatattgtaataggtaattaatcactcgctaatctaagtattggacgaaacacattttagtactaaaattttggacgaatattgtccaaatttatagtagtagaatttatctcatccgttattattatgttgctatattataggatgtacgaggcttgatccttaaaaaattaccagcaataataaagcgtagccgacaaagtctagtgcttagtacaagtgcacaatactaggttctaccactatatatgtaattttactaacaccgagtcaaccaagccatcagaaagaagggcctaattataattatcgctaatgacgcgtcagacccccgaatatttgaccgatnnnnnnnnnnnnnnnnnnnnnnnnnnnnnnnnnnnnnnnnnnnnnnnnnnnnnnnnnnnnnnnnnngggtgtcactgcggg

SEQ ID NO: 34567 - DNA, 806 bp, Oryza sativa
  unsure (1)..(806): unsure at all n locations
gcgggcattgttgatggctcgccnnnnnnnnnnnnnnnnnnnnnnnnnnnnnnnnnnnnnnnnnnnnnnnnnnnnnnnnnnnnnnnnnnntagtttaccttgggtgctgggtgttcttgacgaccttctggccgtacttgcgccacttgtagccgtcgtcgagcacgtccacgtcgctcatcgtcttgaagcagaatctcggctcccgcaccttccgccgcgccttccctcctcctcctcctcctcccccaaccttcttcatcctcaccgcgccaacccccagatgatgctgcgccgccgccgccgccgacgtgttgttgccggcgtcgttgatccccatggcgcccatcgccgccgccgcctcgcccttattccccatctgcggcctccctcgatgatcgccttcctcgcaagacctagcacggcaataacgtcgtcgacatgggagaaaaggggggagagagagagagagagagagatcgattgggtgttacgggtacttaaatactcgcaattaccatggatgcggcggcgaccatctctgaagatgcgcggcggcgtggaagcccccaccattgtggcggcggacggtgggaggagagggctcatgccaggaagcctgcgccgctggtccgtggtgaaagacggggaccaagtggctgtatcctatgaatccattgtggtggtgatgatacaacgcgtggccgtgggaatctggaatgggaatgccactgtggttgtggcctggcaccgcctcgcatggagcaggtccacattatttaggccgaccacccatggtggcggcg

SEQ ID NO: 34568 - DNA, 1043 bp, Oryza sativa
  unsure (1)..(1043): unsure at all n locations
tctgtcccttggatgaatcattcgccagtctnnnnnnnnnnnnnnnnnnnnnnnnnnnnnnnnnnnnnnnnnnnnnnnnnnnnnnnnnnnnnntgagaatccacactcgtaacattctgtttttttatttttccaaagtaattgcaatacctacatgttcataggtggttgcatttaggtcaatgttgatggtgaatccaatataatacttcctccattttttttatatttaacatcgttgatttttttacttacgtttggccattgttctcattcaaaattttatacaaatatgtaaaatcataaatcatgcttaaagtactcgtaataacaaaacaaatatcaacaaataaatgatgattagataagttcatcgaataagataaatagtcaaacttagatccaaaagttaacggtgttaaacattttaagaaaagggaggaagtttttttttttttgaaaagggtagggactagggaggaagtaattgatgtggaagaaaagataactcatttgttttcttgattgaaatgaggtggcattgcctacttgccgtgcaccatatgactcctccctcctcatcactccctttcacctaatgacctaaacccaaaccctccacaatttttatcatctatataaccacacgaaactccatccatggcggcgagcgagctcacaagtccacagagacacacctcaccagcttgatcaagagctagccaagccaaatggagctcctgccatggcttctcggcttcgtggtcaagtacccggagatcatggcgtccgccgcttgcttcttgctgctcttctgcaggtttaggaggaggagcaagcggattccgacgaactggccggtggtcggcgcgctcccggcgatcgtggcgaacgccgggcgcgtccacgactgggtgacggagttccttcgcgcggcggcgatgtcgcacgtcgtcgagggaccgtggggctcgccgggggacgtgctcatcaccgccgacccggcgaacgtggcgcacatgttcacggcgaaacttcgcaan

SEQ ID NO: 34569 - DNA, 1416 bp, Oryza sativa
  unsure (1)..(1416): unsure at all n locations
ggccccattgattgcttgacgatcgatcgnnaagggcgaanncgagctcggtacccaatgtgtttggtatcaccttaaatttgttggtgtgatgctttttgtaatgttctatttttttaactagggcctgaattaattgtgggttagtcatggacttatggttcttatatgctctatagataatactggaccagccttgtcacgcacatgcgtatgctcatttctcatgggaatctcagtttgaatattttgttgctcataatgatgtgctggaagtctgcaaactcctggacagtattcctgacagtgtacttctagaagggattcttagagtgaatgtggacaattcacaagctacttacaacactctgtctgacgtagcaacccacggttataaaatgtacttatttgactcagaagagatagaacctgtttgtatggaaataccacatgtcaaagtgttcagatctttgtgtaatcatgaatcaacttcttggatgagaatgatcatgctacaggaattggcaaagaagcatatctttatgaaagagtactggcaaagcactactgaaattatacctatacttgcccgcgcgggcatgcttgttaatacttcagagctttgttcagatgttctacatggtgcataccaccaggattgtgacggagcattacacaaattagtcctacgcttctgtgtgcagtataacacaccaaacctactggacctctatctggactactgtaacttggctcttgaaaaggattctattcctttgctcaaggaagctactgtaagtttttgttcaattttagtttatgatactatttgatgttcaatagtattctctggaacctttgataatcacctacctaatttctcaattatatgaccaatacaattgtagactttatgaccagatgatatttgtcaataaactagattatttagtttaggatatatacttggtgacttagcctttacatgttttttttttttttaaattctgggcttacaatattctttagaaaaataccaaaaaggtcaaacttgccaaatctttcagttttactgtgagatttggcctaccctcctaagcatactccgtacaaagtgactttagttctcacttactttgcaagctcattctcttgaatagtaaaccaattattatcagaaactgctagcaccgttcgaatgagaacattgttgcattcacgaagcctgccttaatataatgcccaggattttattagcctgcagctacagcggattattccatctatctgactaaagatttgccttacttgccgatannnnnnnnnnnnnnnnnnnnnnnnnnnnnnnnnnnnnnnnnnnnnnnnnnnnnnnnnnnnnnnnnnnnnnnnnntgcaagtcgaaattcaatgggcagg

SEQ ID NO: 34570 - DNA, 870 bp, Oryza sativa
  unsure (1)..(870): unsure at all n locations
ctttgatttgcgcaacacgattcactatancgcgaattcgagctcggtacccttaaaggagctagtatcaattgtacatctgcttgaacactagactgcactgagatcacttggcttgcattggctgattttaactgtgaagctcttttaccaagaagatgcctgaaagcagctagtgctcgaccacggtgcaaatgatgttccaccctcaagtctttctcctgaagagggtaataacgaagttgctagtttggggggaaagaactagaaaactataatagagcatgccaaaccaactcagagaaaagaaccccaacttcatggaatgaatgcactgttgtttttttaaaaaaaatgctagtgaagaaggttcaagctgtttgtctgctatatgtggccttatgctatttaaataagccaccttgaggccaacccacttggactaagcttgtggggtcttttggcttaagttcaagcacctttacactggctcctgctatgatgaaatagcatcccttgcattcttgattggtatcgcatataatagcacagatgcatgacaacatagcatgaagtggtcaaattcagactatagaacaataacatgggttaacagcacaaagacgaggcaagattccaaatgaccgaaacaacattttccaagaaggtatttttatatatgacgttagatgagcataccctaagggaagagtataggtctttctcaacacttttttgatggatgctttaaagacaaagcattagtttcttatacctcgcggaatgatatataatctgtgacactgtgagtaaatacttcttcggtgatgtgcatttgatagcagtgcgattccaaagggcctgatcatg

SEQ ID NO: 34571 - DNA, 745 bp, Oryza sativa
  unsure (1)..(745): unsure at all n locations
ntttgatgacgaactcgatgacccnagcgcgaattcgagctcggtacccttgaggcacgaggagtaagatggtggtgcagaataatcagcggaagccaggatagttttgtgaatgcttggttcagttcagaacaggttgttcttggtgattcatctggcagcttaattaacagggataattttggctaatttggtgaattggttgtgtgtttttgtaggcttcttggcccaaggttgtgctgaagaaatggctcaacctcaagagcaaggattcggagttcaacgccgacgaggaagacgacgacgacgggagcgacgttgatgagcaaggtacatactgtttctgaaaaacaaaaaacctcttctcagatcaaattatccatctgaatttaagtgttcttgaggagaatttagttaccagtcaggagtcacattttttcctccttctgattggttcggtttcaagcagagaactgcggctgcgacgacggcgaggagcggcggcgggccgacggcgatctcgccggtgagtcttatgtctatgtgacggtttgatgacattcccatgtttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngn

SEQ ID NO: 34572 - DNA, 870 bp, Oryza sativa
  unsure (1)..(870): unsure at all n locations
ggctgcttacaatcgactagacgtagatcatctcacttcaccatacctgcttctcgccgaagatatattggtaatacaaacgtttcaccaatagngtcccnnncctctcccatgcggcncccnnntttgatgactaatcgattcatacagggcgaattcgagctcggtacccgtacaggagtaccttatctgtgggcagttttaacttgttgcactagaagagaacttttggttggagaaaccagaagtttgcctaatggtggcaaaatgatcagcacaaatggtagcactactgacaatagtggattgtatgatcctcttttccaaccctgtctgaccagaaactaatggccagctaatcttgatgtgatcagtattcagtggtaacccttttatgtctactagaacgaacttgctatacattacatcaatttggttcaagcaaagaaaataaatcacatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngn

SEQ ID NO: 34573 - DNA, 1180 bp, Oryza sativa
  unsure (1)..(1180): unsure at all n locations
ctcacaccccacgacgctacaaaaagattgacacaacatcgaacatcgacctcttgttcgggcgcgatatattctccctataccaagcacgctctgatctaaacatatatatgatatgcattcttttctccccgccaccccccaggcccncccccnntttgagtggcagtcactttcacaaagcgcgaattcgagctcggtaccccgacaagcggcgtctcgagcaccatctcctccggctccgccatctcctacttaggatcctgcaccgtctcctcctcatgctccgccagcaccgtctacacctcaggctccagcatcgactcctcaggatcctgcaccgactcctcctcgtgctcctacacctactcccccgcaagctcctcttccggcaccttcaaagtcaagggccccccccagctccaccgcttgcccacacaagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagtctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctatgaactataccagctggacgccctcgacgtctctattatgagttgctggattttgtaannnnnnnnnnnnnnnnnnnnnnnnnnnnnnnnnnnnnnnnnnnnnnnnnnnnnnnnnttganaagcggggagtccatcgtcatcgg

SEQ ID NO: 34574 - DNA, 813 bp, Oryza sativa
  unsure (1)..(813): unsure at all n locations
ctttatgagcaaaagtagtttgataagctataagcagcacagtttagatataatattgaaatgcacagcagaggcaaaatcttatcaaacacagagaaatgaaccaataaattggaactaaccattagagtaggggccttacctcagaagtatggctaaataaagagatgaaggacatgaacgggaaaccatttctatcataactgagtgtcccatctatgatgcgtgacagaatcggatgcacaactgcatggccatgctcaggatgatgaagaacaaaagttgctggaaatatgagaaaaatatgtcaaactctttcttcaattgtttgtggaacatgtattgatcactggatcaaattacctaatacttcatctacaaggcgcttttcttttgatggatagcaactttgaattagctgcaagcatgcaagaaaaagaatgcaaaagttaacacactggagaaagattttatcacagaagatactaaacatgcttagagatacagtacctgagctatatcttcagggaattgctcactgtcagctgtaaactggccaaagtactcaacataggccagaatttgtgccttcagagaggagacgcaaccaagtttcccattgaggcaagtatgttcaacatatagaatttctaacaagaatcaaataggaataatgttacctgtttttgttgtgaatcctgtggtgggggccagaacagtgatgagaannnnnnnnnnnnnnnnnnnnnnnnnnnnnnnnnnnnnnnnnnnnnnnnnnnnnnnnnnnnnnnnnnngggcgactatcaaccgtg

SEQ ID NO: 34575 - DNA, 800 bp, Oryza sativa
  unsure (1)..(800): unsure at all n locations
atcatgccctcacattttgttaaatagcaagccagggttaattctggcccttttggttcattcgcctctcagttggtcaccatctttgtaaagactcaagaccagattatgaacatgttgacctagttatgagcattggaaaaatattgcaagattgagtatataaggaaattacttttctgggggacagcataaagttgctcattatgtaagatgccacatcgcgcacagtttccctcacctgtgcaatttaaaaacagtcatgttgattactatagccaggaaaaagaacttgaaagaataggggacatggtaggaatttgaccaggataaagatggttctgttctttcataaccagaaacctctactacaacagaaagtgccataaacgcatggatagaaataccagtaggaagacgtaaaaaatatgactcatataaggaaaaaaaatgcatgctgggaaaagtcttgagttctgaaaaaatgacctgaaactccttgacgagttccaaattcaacatatccatcatagcgacatgaccttttcgtccacctactaccatataccggccatttcccgtgtatcctagagtataagggccaagtactgcatcataagagaagagctagtcaatccctcataacttgttggttgtcatccgaaaagttaatagcagcaagtagatgaaaagtgctatctagcaattattccaaaaannnnnnnnnnnnnnnnnnnnnnnnnnnnnnnnnnnnnnnnnnnnnnnnnnnnnnnnnnnnnnnnnnggtcgtcactaaggcg

SEQ ID NO: 34576 - DNA, 808 bp, Oryza sativa
  unsure (1)..(808): unsure at all n locations
cggaatgacnactgtaccccnnnnnnnnnnnnnnnnnnnnnnnnnnnnnnnnnnnnnnnnnnnnnnnnnnnnnnnnnnnnnnnnnnaagccgggcgagctcagagttagtgacagcagtaacaataataataatgaacattaatacagtataaccaaaaggtagcagcagacgaagctactaccgtgtttcgatcaagtccaacgtggtggtatatgatgggttaaaattggctgcaatcactaaaatcacatgtccatcctgaatgtctcaagtctttcaatcgaggatcctccagccctgttttcgcaagcttcagatgtcatttgtatacacagattatcagcattgtggtgagggtgatgattgtcgcggttgtgaagatagccgcctacacatgtggaatggattgaagacattagagaagaatcactgtaactaaaatgctcgggtaatataccagaacaaaatgcaaaagacttatgaattgcgtagattagctgccatgccatttaataatatctcttgcatcatacaaacaatactgttcatatatagtatataccagaacaaaatgcaaaagacttatggcatatatagtcatatgggcccttaagaaaaaaatagggtacatctgaccataccttattttctttttctatataccaaacaggcaagcccccagaatgatacataattaattacaggtcaacgcatcacaaaacttatagtaatacatactcttaacatgggactccagatcaacacaattacattaaccaccaaggagtttgatgttctatacagga

SEQ ID NO: 34577 - DNA, 11059 bp, Oryza sativa
  unsure (1)..(11059): unsure at all n locations
atggtcctttaaaatgcaccactgctatactaaacttgattatttcttctttgatttttcctgcaatttagatcttcatgttgaagtactagttaagaactaaatctttaccaccacaccaacatgaagccttgattcaacttcttggctgagcgggcatgtttctcaaactagtaaataacatgtttaatttaaagaatttacataaaatgcttattcaaaatattaaataaatcatttttatattgtaataggtaattaatcactcgctaatctaagtattggacgaaacacattttagtactaaaattttggacgaatattgtccaaatttatagtagtagaatttatctcatccgttattattatgttgctatattatagaatgtacgaggcttgatccttaaaaaattaccagcaataataaagcgtagccgacaaagtctagtgcttagtacaagtgcacaatactaggttctaccactatatatgtaattttactaacaccgagtcaaccaagccatcagaaagaagggcctaattataattatcgctaatgacgcgtcagacccccgaatatttgaccgattagcatgtcaaccgttggatggaaggacgtggccatcggacggcctcaacgaggaggcatccgcttcgctttaccttctcgggaacggcaatcggggtgacgtcaccgctacgaagctggacggctgtagatcacggatgggaggtcactggacggtggtgcgacgttgccattttttatattttaattgctcgctcgtcctcgtccattattgtcgtggtgggccccacccattggctaattgcgctttagatctgtgtgaattgtgattaggtcgaaatttggatgcttaatggagtaattaacaaagcagagtagtagtagtattaggtttgatgcatgcatgtgtctcactatctctctttctttctttctcgtgatgcccccaccttgtgattaggttgttttgtggaaatgcaatgggctatagctatggctgatagatccatcagatcactcgaattgatatttcctcgtgacctgcaatcatggaggcagaaatgttatcattaattcatttttcacatgtaaaccgggagcagtaatcgtatggatatatacaaagtatgctgatcaaactgtaaattacatgagtgtagtataaaaaccactgactttaggcccgactcttttttgcttaacggatgaatggacgaaaaatgcgcacactttcaagcatgcacttgttgaatgaatatatgagtttgtaattactaacatacatggctgaatggttgtagtatctaactatcttctaatcaagttaatctaattagaccactgaagaaaagccatagaaatcttataagatcccagctgtaacattgttcgatgcatcttgctcctctccacacgtttgcaaaagccaaagttgcagcaccagtggcacattaaaatattttcaaggaacaataattaaacaaacaaagcaaagacatcacaccaaaacttacgtacgctaagaatctctagtcaaatatccaagcaccttctgctttagaactctctagaaccatctagcttttagcttactcctcgtcttcgcagaaaaatatactactcctaatcaatcttagcttaattaccacggcgcaagttactaaccgggtttcgcgggcagtggacctgagagggaatatccgatccgcatcggacggcccacaggcgtccacgctcgccacgagttgacctcgcggcggtaagtgggatgcgtgggtggatggcgacggcctggggatgtgggcccgcgggggcggtgccacgtgtgaagagaaggatggcccaggtggccactgttggaacgtgggtcccaccatacctttgatttgcaaaataattatgccatatctcgtgctaatatatttgtttgttttgggataaaaaatttttatctatgtgagagagctagcctaaatcattacaggtgagttggtgagatgagaatttagaccggtccaccaaacgagatgatggtacatttagacactactctctctgtgaaatactttatctttcttttttgccttcactacataaacagaaatgcatttcggctgaactcattctggctagagcgcagccaattcaaacggccgtatttagtactccatccgtttcataatttaagacattttagcattattcatatttatatagatgttaataaatctagacacacactatgtgtctagattcattaacatctatataaatgtatagtgtgtctagattcattaacatctatataaatgtgaataatgctagaataacttacattatgaaacgaaggaagtatgtgttacagtgcaactaaactggtctatattttataacaagtgaggattatactatcttactactctgagttgtgagtaggacaagtgtctggttatgtttgcaacgatgaggcgaagttgtctacctagtgtttttgctgtgacttgtgaggccacacatgtgcaaaggctgtgtgcttataactatctcgaggattgattcggagcggcaagtaaccgacggtgtttggtgcaaggaattcaatccaagcaaaaaaaaaaaagaaaaagagaaaatctatctcagccacgcaaataattactcagcccaaatcaaagagctccatcaattagcctaataaaataaagtaaaagtcaaaatttaaatttcgaacttgattttgaagttgattttatgacattgacatttaaactgctacgaacaaatatataaaaaattatctataagttattttttattctctaataatctgtgttttggtctattggtgaatacgcacaagagatgaggctgaaaagccattgggcatagacggacaacacggggcgacgtgtccgggaggcgaaggcgcacggagcacaaatccgccttcgcttctcctcctcccgcggagaaaggggatgatggccaatgggaggggagcaaaggatattttctctctgatgacaagcccgcgtccgcgtgtcgacccggggcgcgcacgaataatttaagcaagcggggagacccaaccgagaggggaggggacggccccacctgtcagcgcatgcatggatggatggatggatatgcctagccccggatgggtagcatgggcgtggtggggcccaccagctctctcaacttgtcatgttggtccctgtgagattactgtatctccttcaccctactacttctaccctgcgatattggcatcacaccggttttttcgtgctaagactaacctgaataaaaaactgtctagattcgtattattatagtatatcagcatcagatactgggttggttttattaggaagaaggaagtttaaatgttattttcttcgtcccagaaaaaaaaaaactcaatctatgagacggaggggtactacttgcatcccctgtgatcctatgattcttcgctttgtttagttactgaaataaataaaaaaacgcattatcattacataaattggttcctaaaatctgcaatcacttaaaattgtaagatcacatactgcaagagagtatctagccaggatatgcagtttcgtggaaaacccattgagatttgtgaactggttttttgatttcgagccagctcaaaattggtcaacatcaaggaggagttcaaatggtttttgagaaattcaaatctgaaatagtagatttgattgaattcaatcaaaatttggttcgacatctggctggcagcagcagcagcagcagaagaactattacctccaaaatatactccttgaagtgaactgtccactgtcgatggaacaaaaaatgtttgtctccaacgaggtcaacttcaataacagtccaaacaaagagagaaaaacatgggcgccggcataacacaccagcaagcagattggtagtttgggagtacaatacaagcagaaagactgcaaaggtggactactggtgggccctgaacacattaaactgaatacttaagcatatgaaacgtgcagtacagtatgtagtacttgccactaaattgtgcagaaacagcatgctcaactcaggtgactggatgccaccagtggcgaagccagaataaaaattactaggcgttcttgatatgcttatatactaatttttaagtaatataatgcttaatataactaaaacacctagaaataaataagctatccggtgtccggggacaccgggtagatacatgtaggaacgcccctggatgctaccaaccgtgtgttactgctactagtaatactagtacgacataaattgtactgaatgcgatttgaacaatgatcctgtcaagtgtcaagaaattaattgaggtggtagaggacaggtttaatataatccattattaaaaaagaaattaactgaggtgctctccgtatcataaaaaacatgcatatccatattaatttcataatattaagatatgaaacatttcatattagattttttttagacgagaaaagtatttagtactctaaatcacaatactccaccataataacctgactaactatagtattactccgaggcaaacatgggtaaacctgtcaaagactcaaaggtcctgattgagagggcttccagttcctgcagcttttcccattagctccagcttcccagacaatttagattatcagaatatgtagttagaattcaaaaaataaactagaagccaaaagatagaaaaaaaacttctccaaattcttagggtccccttgaatcacaagaataaaaaaaaatagagaaatagaaaaaaatagaattatgacagtattgcaaatataaaacaaaatattacaaaacaacacagaaaacaacacaagaatgaccgtttgattggaacacaaaaaaaaaggaatttgagaagagataaagactcggggcccctttgttcgcaggataggaaaaacacatgaattgaaatagtatgtttctcaattcccatatgaatgaaaaaccataggaaatacaatgggagtaatttgatagtgccatgagaaaaataaaggaaagttcacaaagagatcacatctatcattatttttcctctgaaatgtgaagcacatgaatacaattctatgagaatttttctttctttcctatgaattaaagggacatgtaggaaaaaaaaatcatacaaatttgaatcagagtttttctccaaaacttacatgaaatgaggcattccataggaatttaatagggctccatagggtacattccttcgattcaaaggactatataggaaaaatcctataagaattaaatcctctaaaatttgtatgattttttttcaaattaaagggattttaaaaaattggttaccaaccagctgcttattataattttagtctccccaaacagggccaaagttttgctgacacctgggagatagtggtggtactgtaatgtacaatggccaatgggggatagctgcttcagattagccaacgcaaacagataggttcgctgtccgctcaaccaaaagatgataaacatgaatcacaaactgttgctggacatcatgctatccatatgtcgcgatcgacctttgcattccccaacttgattagttagtctcgcccgggtttacctttcgtcctttcccatgaactggtaacgcggatttccttaatttttactcgaattttctttttggaatacaaatttctcaaaaaaattcgattttttttatcgaaatctactttttgcccccatgtcgaaacctcaaaaatttaatcagaagataatgcttaatatatgctatccaaaggcatcgatcgcatatcggtcggtctgctgtatggcccagttggatctcaatctactcaagttgccatttctcagcccaaaagagattcagcgtggatatcaattgggcccagcccaaagctctacagatagatccccctcttttccccttcttttcttttcgtgtacaattttccctttccctgatttaagaatatggaatatatccttgaacacccccacccccccccccaaaataaagtgaatatatacaggcttaacataagataagtacactaatgcatgcatgaataacgtataatgattgtcatacagaagacagtatacttacgtgctcatgatcaactgataaaaggtccgatcagctaactgataaaatgcacgcaagaaaggaataaagggtttggacgatggaaaagagagctcaacgtacagacagatcgatcgacatagatcgagagggaaagagacatgagagaagcccgcaagttatgctgtccatccatgcgggcgtccagctttttttcatcactatttcaccggatccctaaactgctgcttgtattcatccatcacctacaaacaggacagaggtctaacttctaaatctattatataattaaaggaataggaaaaggagcctccacgttcgctcttatagcctagaaattctcacattaatcagagaaaaagaaaaaaacagagtccatatagaaatacaatttagaaatagctcaaattcggaattaaaaaataaaaaatattagaagaggagactagagtccatatagaaatacactttagaaatagttgaaattcggaattaaaaaataaggaatattagaagaggagactagagtagttattacacattagtagttttgaaaagttattgcaaaatttaaaattatgttgtcagtgtaatatattttaataatataatgagaaaacatatatgctattatatgagagaaaatataatgatgctagctgcacaatttgcacgggccaccatgctagttaaactttaattaagagtcggatttagaataaagttgtaaagtactagtgtcttgaactccgctccatcgcactagtctatttcatgagaccgctcaacctctctagtccatttcattttcatgagagaactctaacccgtttcgctctcttttttaggtttgagttgaaaccgtttgaatattgagatctacttcaagagctacaaacatttgcttaataacccaccggctacagaaaactgtactccataatattactcggctacgtacaacaagcgctatatataagtaattatcaccagcctaactaactaacataactatgataacggtgacaaattaaacaacagtaacagcaaatagtaataataataatacacacacaagcatgtgatatcgaaatgcagtcgtcgatggatatatgaccagctagctgatcatcagcttgtggatcggagtcggagaaggcgaaggacgacgacgacgacgacgacgggagagctaggtagaggaagcaagctaccagatgaaggtcatctcggcggaggcgcgggcggcgtcgtcgtcgtcgcgggagggggagtggacgtggcggccctcgtaggtggtgatcaccatgcgggggtcctccgccagccgctccacccgcttcttcacccggcagttgtcctgcgtgcaccggtaatagctcctgcatatatatatatatatatatgcaaatatatatccacaatcacacacacagttaaccacatatatacttcagtacgtgtgtgtgtatatgcgtaggagtgtgtaaatttgctttaaggttatcacttatcaacaagaaaatcgattttgattaatcttgccttttcttgcaacacaacgcacagatcaaaatatagtatagtaatacggagtagtattgaattagggactaactaatacgcgtcgctagtagcctagctagtaaatacatgttcggatgacatccaaacaactttttagtacggagtataacatactccaagtagttctgtttagcgttatggcaacggatgcttttgctagctagtagatctacgcacgtcctaaagcttagatatacctttctacccggtactgctcgtgctactctattctacctacactctacaaatatggagtatagtttttatgtagtcggatttccaggtgaaagagagattacaagtattctaggaattggtatgttaaagtacaaggagagacagatattggaaaattctcaatcatggcctgaccctgctgacacaccaactagctaggccatggagataatattccaggctacccagctggtagcatcattcctcatctcaaacctaaggggcatagatattgagaaagatgtggtaataattacagggtacaaaaatcttgggccctttgcaaagctcaaatccaccttttcatcatctcatggccctttacccaacagtaaagattctccatcagctcccacagccaacaaaaagcagatatatcacacatccaatatatattcactttaaggcaatatcataattgttttttcctagaattttcaagcaaaacatgaaaaaaaatcagcattcgaaataagaacatacccctccatctaaaaaaaagtctaatactaactatgaacctggacacatatatgtccaaattcgtagctaagggttgagttttatggaacggagtagcatatatcaccacgcttatactttcatcctctcgcagctctacataagaacttgcatgcttaattatatgttggcctcaaccgtctaaagtctctctactgcatatcaacacccacatataatacctacaattgttcgcatgaacctactaatatacttctatatgtccagattcgttgtagtaaaaagtggcacattcaatgtttgattgggttttttttgaacggaagaagtaacagcttacacatatacgtacaggttgcgatcaaattaagttgtctcataaccagatgtatttgtgagacttaatttgctcgatcgtcgttacgttgacacaatctcgacgctaattaatactgtatgatacgatacaccagattatccattactaatactaccctgcagtattagttttgacaatcaagaaagtagaagaaaaatgaggatgattgccaatcgattggaaaagtcatgggtgtgttgtagtagtggtgtgtgagccagaggaccggatgggaggagagggtttctgagtggcatcattgcaaggggctaatcagattggactggatgctgggctcatgtctgctgcggtgtgggtcaatgctttggcactacctgtcatgatcaccatcacgcatagacagatgttcacacaagcacagaggctcctaggtggtctgccaggagatgatatagatcttgtcatgtcatttccatcaattttatagtagcatgaatagtagggctgtgtcgagttccacgttaaatttagaagctcgaaaaaattagaacaatatcacgaaaaagttagaagtttgtatgcgcagaaaagtttgatgtgatggaaaagctgaaagttttaagaaaaaagttggaatataaacaaaaacctaggtgcaaactttatactccctcgttgatgtcactagctacttctgattatcctaaaataaatttaattttaagtaatcattatatcatatcagagtttataaaaatacatagagaataataaatatattaaaaataaataaaagggaaataattacattaagattcgataaagtgggagtattctagtctttatattttgtattggtatatatggaatgagtaaaaaatgaactttggtacatagagtaatttttttaattattacttcttccgtgttaaaatacttgttattgtaggcaattcagccttattaaatgatgtcaatatgattaggagtagtacttcagagtgacaaatattttagaacaaattttggaaaaaaaaaaagctactactttctccgtccgtccaaaaataagtgcagccgtaagaatctgtgtccaacatttaacgtctgtcttattttaaaatattataattttttttaaaaaaatcacacataaaatactattaatgttttatcatctaataacaataaaaatactaatcataaaaaaaaaatcaaataagataaatggaaatgaacagttcaaaacaaaataaaatgtagaataaaatgcatcctccgagtgtccatatttatagaacaaaatagaggtggtattaataaatgtagaataaaatgcactcccgagtgtccaaatttatagccatgggtaattcttttttaacgaaggaaaagtatattcatagaggtagattaggaggtttcataaattaaactgcacaaaaaaatgctttgctaattcagtatcataaaattatccgatagtaccaattaagattacaaattactaagatagtttgcttttcttctgttgcgacagttgttgtctacacatgggatgagtggacgttagtgggactgttagatggtgcaatgagcattcaacctactaagttaggatgcacgtcattctctacatgggagctcagttggtcctacgtgaaatggactagtcgatcgatcaatttcattcttgaacagaatgaaacaaatgtagcgcaatctgacccaatctagctattctggagtgatctaatcatctacctgaagcaaaatatcatttgttggtggttagttggaatattagtaatcactaaaaaccggggaaatagttgcatattatgtataaaatcaagcaatcaatgccaaagttattccacgaaacaaaggaatatagatatatatgagcgagaaagatacactggtggagaaaccatctttggtcggtccggcaaaatccacaatagtcccggatccaaaaagaaccgggactaaagattgtttttagtcccggttataaaaattttgatctttagtcccggttggtaacaccaaccaggacaaaagatgatctttagtcccggttcatccgctgtcagatgtatgtcagggggccgaggatctttagtcctggttgatnnnnnnnnnnnnnnnnnnnnnnnnnnnnnnnnnnnnnnnnnnnnnnnnnnnnnnnnnnnnnnnnnnnggagtgcatgtatcn

SEQ ID NO: 34578 - DNA, 2012 bp, Oryza sativa
  unsure (1)..(2012): unsure at all n locations
cgccgcattgatgaacgctcttcatnnnnnnnnnnnnnnnnnnnnnnnnnnnnnnnnnnnnnnnnnnnnnnnnnnnnnnnnntattctaatagtttagcataaaagatgtatcattagattttatatcaaaattactatactaatatcttatatttaaatttatctgctttcctatcggttaaaaattaatagttaaagttctccggtcaaccaataaacatgcatgtatgaacgtgcagggagtaaatgtatttcacctagcttttagagcaggtttaatagtatcgccggctacaagctataaatgtgtaccatgtcatcttatagttagagagtacaataataaactgttgatacgttaaacaagtaatatctttattaattttttaatcacctcaatctctttcttctttacccttccctctctcactccgctgcaacactgacaaaaagcaatgcacagacgtctaggagctcgtgtgcgctggcgactaatttaccgtccgctcgcaccctctttcctcccttctctcgcccatatcatcatcaaatctgacgtgtagctcatatcactggctcaatctaccttattaaacctgctcttatgtggggaatatttcggatatacatcacttgtacttagttgcgaaaagcctaattcccgaacacgcgtgggcacctcacgaatgcgcccagacaatggattggtgatagtggcaggggcaaagtgagacgaaagagagggggaggagatcaactgccggggccacagtgcatgcttggtgcctttcgatgctcgcgaggctggcggttgcagtggaggaggtgagaacaccaaaggggagagaagggagttcgccagagaaaggccatctttgacacatcccgctcctatcgctgaacttgtacgctcgttcacggtcaagtttggagaatactaagatggagagagagagagagagagctggagattagggtaatgggatgctgggctgtcagtatgcgtttgtaacccataaatgctcgcctattagccccacccacttagttgtatggagttttgttcaaactctaaaaaacttcagtcttctacgataattaattactccggtgcacgtaggtcaattaggcgtacagtcaccggtgtgtatgctcttttgggaaaaaaaaacattttcctaacttgtggctaattgcacgtgcagtttatcatcaagttttacttaagtccatacggcttgctagcatgtcatttggcgttaattatacctaccacacatgcagcatgccacattgcctctgtcagaagaaaatgtagtagtagcttcgagacaacaaagacgacagttttttctccacaacaatctcgaggtcaaatcttgattaattatgctaattaacgcgatccggatatacaatctgcagatatattacttaattacactaatgatgaaacgctaattgcctttttttttctccaccaagttgatgaaatgatcgatcacctgtcttaccattaccttaccgaaagtccctttatgagatagagacgctaattaaatatagttttccatgagaaaaatgctgtcactgatcaattatgcttagagaaacagtaaccataataataaataaattcattccctgctgtagcaaggaggcacgtgacgcaagcatcaacgtcagaccgctggcccattatccgatctaagcccaccggcccaggctcgaaatatccggcccatatacttacatgggccgggatctgaaacaaacatcaggcctaactacgtaatgggcccagatttaggcctnctaacgaggccttgatgggctaagcgccatcatgggcctncgctttttttcgagcccacggcgaattcccttcccagcgccgncgtagcccgctctgcgtcggggtttgcgcggaanaaaccgangatattcccgncggttcgcgccggccgcggtcatcaatcttttgcctctccgaacctagatccaaatcgac

SEQ ID NO: 34579 - DNA, 5672 bp, Oryza sativa
  unsure (1)..(5672): unsure at all n locations
cataaggaaattgtcaaagggaagcggaggaggcgaatccaatgtccattaggccnaataggcgttgaagccgaaaggaaccggtaggagaagccacactctgtccccgaagaggcccccgacccgatgaacaaatttaaggggagggggagaatggcgacgccgccgcgcaacggccggcgctgccgctggggagggtgaagcggatcatccgggtggaccgtgacatcaagaaggtgaccaacgagggggcgctgctcatcgccgcggccacggagctcttcgtcggctccctcgccgcgggcgcccacagggccgcctcccggcgcggccggcgcgcggtgcgtgccgtgcacgtgcgggccgccgcgcgcgagcaccgccccaccgccgacttcctcctcgactgcctccccgccgccgaggaggcggcgcctgctcgcgcggctgccgccggtcccagccgcggcggcggaagaggagaggcaaagccgttgccacgtgggacccgccgcatcgacgcgttcttccagaagaccacctagtggtgttccctctctgtatgtgtctaatgcatccgctgctctaaatgtttggagaaaaatttcactcgcagatgaaactatgaatttttatcatttcgttagtcaagctcgtttccaatgtcttgcaatgatttggtatgacctgctcaaatcttgattccggttgccgtgaattttgcgatgcagtttcggtaggaattggtctttgtaagatgatctagctaatatatttctaggtcctggttcaaacacatgattctcaaaagaatatataatgctaatactaagattgcgacttaccttagtttcagtgatcctctgtgattcacctctctgatagattacacttattctgcaaacagtttattgttttggtcttcatgcagtgattcggtaattatatgctgacgctgtgacgcatactgtgataagaaacacaaaacaaggttgtccttagctactttgtcgctggttaggatgccgagccgtgttggtttcatctgaggaagtagcttgattccctcttgccatggaacatgttagcatcacaaaatttgcatgagtggaaccccacacttttgaaagaatcccacactttttgggtgtttacctgggaaacaagtaaggccttagtttttacaccagttttagaaacattctgctctctttcttgttcttatttgttctcaaaaaatcatgttcattttacctgtctaaacaggataaggatcagaatcagcatattaggatggttatttatgtgtaaccactaattccatatgaattgatgaataataaaattgttcttttattgcataaattcagaaatgtcaacacactgcttgcctgatgagtgacaataatctcatatcaacagataatacaaattcgttagagattttctgctggacagaactactcctggtaaaagactaataatatgattttcagatttttggcatctataacatatgaatgttgtgagtccctaaactttagggcactgacttctgatgccacaaggcatcaatgcacataggcagcttctttatatctgcacaacgaagctatgcaggaaatccaaaggtgaagcttaggctcatttgctgcatgcacctcttccctcagcagctcataacgctgcacaaccatgggccccctttggaccttcattctgctatatcctgagatcttcctagctatcatctgcttcttctggttttcactcttccgtcccatcaggcagcgccagaagagcaacctcccagtgaactggcctgtttttggtatgcttccattcctcgtgcagaatctgcactatatccatgacaaagtcgcagatgtgctccgcgaggcggggtgcaccttcatggtcagtggcccgtggttcctcaacatgaacttcttgattacctgtgacccagccacggtcaaccattgcttcaatgccaacttcaaaaactacccgaaaggcagtgagtttgctgaaatgtttgacattctaggtgatggactccttgtagcagactctgaatcatgggagtatcagcgacgcatggcaatgtacatatttgctgcccgtacctttcggtcctttgcgatgtccaccatcacgaggaagactggcagtgtcttgttaccctaccttgatcacatggctaagtttggctcagaggttgagctggagggtgtcttcatgaggttctcactagatgtgacatactctactgtgtttgcagctgaccttgactgcttgtcagtgtcttccccaatccctgtgtttggccaagctacgaaggaagctgaggaggcagtgctgttcaggcacgttataccaccaagcgtgtggaagctcttgaggctgctcaatgtcgggaccgagaagaagctgaccaatgcaaaggtggtgatcgatcaattcatctatgaggagattgccaaacggaaggcgcaggcaagcgatgggctccagggagacatcctgtccatgtacatgaaatggtccattcatgaaagtgcgcacaagcagaaggatgagcggttcctccgtgacacggcagtgggtttcatctttgctgggaaagatctcattgctgtcacactgacttggttcttctacatgatgtgcaagcacccacatgtcgaggcgcggatcctccaagagctcaagggccttcaaagctccacctggcccggggacctccatgtcttcgagtgggacacgctccggtctgccatctacctccaagccgcactccttgagacactaaggtgacacatctttgatctccccattctcccccaatctcactaacaattaatctccctctcttcatcttctgacattctgaccaactattacattgcttgaattgtgttccaggctcttccccgcaaccccgttcgaggagaaggaggcgctcgttgacgatgttctccctaacggtaccaaggtgagccggaacacgaggatcatcttctcgctgtacgccatggggaggatagaagggatctggggcaaggactgcatggagtttaagccggagcggtgggtgtcgaagagcgggcgccttcgccacgagccaagctacaagttcctgtccttcaacaccgggcccaggagctgcctcgggaaggaactcagcctcagcaacatgaagatcatcgttgcctccatcatccacaacttcaaggttgagctggtcgagggccatgaggtgatgccgcagagctctgtcatacttcacacgcagaacggcatgatggtcaggctcaagagaagggatgcagcttgataaccatgctgtcagcttagctatcctgctttcttgtgttatgtatatctgcatgagactagatgtctatatgcagagttgatgagatggaattattattagaaagtgtaaaatgtctggttggattagtgtcagaattgtaaccatgtgaaaggaacaaaaatgttgtggtgattggtatatgattgtgtgatggtctttgggttgatttattcaagtatttgtgaagaacagtgtacttaacatatcagttaagacttgagagtaagtatcgggtgattattattatctggtgaccacgtctgtatgtgatgggctttacaaacctgcatacgagaataggataattcttgtttcgttttcatgaccagttcacaagtaaaccattagactgcagaggctccatcatttcttcacttttaaaagaaacatttggctgggcccacttatatttttcgtgtaaactcagaatcgtcaagcgaattgtattggttcagctcatcgaaaagtttgatggtctcattgtcgccgagtagttggtgaaagatgccttcagcttgtggtgaaatgtgacctctggatgttttttggtgtttttgcaaatatttatccaaactataattttatttttgaaatggtctagaacaaaggaacaaaaaaaaaaacagaagtagcacatcgctgttcagtttcaaaaattgtactacaaagtaagttcaccaaaagacttcaatagcacgtttaccagagactgcaaaactggtctgctttcttaatggaaatgacgacttcagacataggtaaaccttagtgacatatatataagtgaagtaaataatatttctttgaggccattaggcaaactttcttaatcacaagaaaactcttttggtataccagcaaggcctaatgaatcatatatagagtacaggagtaccttatctgtgggcagttttaacttgttgcactagaagagaacttttggttggagaaaccagaagtttgcctaatggtggcaaaatgatcagcacaaatggtagcactactgacaatagtggattgtatgatcctcttttccaaccctgtctgaccagaaactaatggccagctaatcttgatgtgatcagtattcagtggtaacccttttatgtctactagaacgaacttgctatacattacatcaatttggttcaagcaaagaaaataaatcacatacttcctccagacacaaaaagagtgccatatttaaattcatgcagttaacataagttaactttaatcataatgattattcagaaatatgaaaatgacacgtgcaagtttattataacaaaatatctcataatatcacacttatatcgtaacacttttctatgtatttatagaaaggagaattaaatggtcaaagtcataatttgtgactagagggagtaacattcgggaaactattctaatccctcgagggaatgttccctcgtttgctcaaaaaccatctaaacggttatgaaaaattctggaaaaatttgaaaacattcatacaacacatatatacaactccacaaaatcttaagtccaaactcaactcacacgtcgagatataaaaaagacaaattcagcgtatgaatagtagcgtactgtttatatctaaatttgtcttttttgtttctcgatgtgtagatcgaatttaaacatgaattttggtggactagtaggtatcattatactctacattatcaattttttttagaatttttcacaactattttcatcgaatttggaagaaaaaggtatacgaggggatatcccctcgagggattagaatccacactcgtaacattctgtttttttatttttccaaagtaattgcaatacctacatgttcataggtggttgcatttaggtcaatgttgatggtgaatccaatataatacttcctccattttttttatatttaacatcgttgatttttttacttacgtttggccattgttctcattcaaaattttatacaaatatgtaaaatcataaatcatgcttaaagtactcgtaataacaaaacaaatatcaacaaataaatgatgattagataagttcatcgaataagataaatagtcaaacttagatccaaaagttaacggtgttaaacattttaagaaaagggaggaagtttttttttttttgaaaagggtagggactagggaggaagtaattgatgtggaagaaaagataactcatttgttttctnnnnnnnnnnnnnnnnnnnnnnnnnnnnnnnnnnnnnnnnnnnnnnnnnnnnnnnnnnnnnnnnnagggcgtacaatcaatcatgccg

SEQ ID NO: 34580 - DNA, 1343 bp, Oryza sativa
  unsure (1)..(1343): unsure at all n locations
atattgggttgctctccaaccacccgggggtaaggcaagaatcctcgcgaagctcggggcgcaccgcggtcacccacgggcgcgaagttaagcgtttggtctacttgcacgcgcncctgtcgaagtcgcttccgccttgtacccgcgggtgccgttcgagcacaagcggccgggagagccggaacacgctgccgaccgggcnccnccgtgggcccaacgcgcggggtgatcgtgtcgctctactccatgggaagaatgaagccggtgtggggaaaggctccaagaagttcagcccgagcggtgcctaaccccgccgggaaggttccggcacgagcgctcgtgcaagttcgccgcgttcaacgtcggcccgcgcacgtgcctcggccgcgacctcgcgttcgcgcagatgaaggcggtcgtcgccgccgtcgtgccgcggttccgtgtcgccgccgccgcggcgccgccgcggcccaagctgtccatcatcctccacatgagggatggactgaaggtgaaggtgcacaggagacaagaggattgaaccaacttcctttggacactttggaacgaaccatacagttcgaggtttcgtattgatatagcagaaaaacattgtttggtttcatattgatatagcagaaaaaatattgtttagatatgggtgctctgcaatctacaagagctattagggcatacatgcactgatgatactgtgctccattgattaattaattcgtgtatgctaattaatacaggtggtgatcgatggtacattacgttatatataggggaataagagacattagtcacagtgattataaatttacatggttagttgagcgagtggtctgtgatctgatgtgatgtacataaattctattttaaatttaaaggaattttacacatgaaatttctgtgaaattcatgcgttcaaagaggccctaaagctggtgcagtgatggatgcatgtgtagtatgcaaaaccatttttcctccttacgtaaatctatgactactgtctatatgctagataaataaacaactggtaaagatagaatatgtgctcatgtgcacgaagacatgcctatgtaacttacaagaagaagaaaaaaaagaaacaagaacacatacatatgtgcaatgtgtcactcccccgtttcgtgcatcatgtatgatctgttgcaattgtggtgtgtgaatattaactttgatgtgaagatgcatttcattcccccaagaacatatgcatttcatgannnnnnnnnnnnnnnnnnnnnnnnnnnnnnnnnnnnnnnnnnnnnnnnnnnnnnnnnnnnnnnnnngggcgatcatcaatgctc

SEQ ID NO: 34581 - DNA, 834 bp, Oryza sativa
  unsure (1)..(834): unsure at all n locations
cccgcattgatgcacgctcnnnnnnnnnnnnnnnnnnnnnnnnnnnnnnnnnnnnnnnnnnnnnnnnnnnnnnnnnnnnncggaaagtcgaaagatacactggaagcacgtaatgatctgaagcatatggaacaacgcgggaaccttcacccggaaccaaatgagaaaggaagccattacttgagtccagccagctacactcttagcaagggcagagaacgaaaagtatgtttggaatgcttggagagcataaaggtaccgtctggatactccacgaatatcaagcgaataataagcacgaaggagaagaagttcacaaacctaaagtctcatgaatgtcacgtgttgatgacacaactgctaccagttgcaataaggggtatcctttcagacaatgtgcgtgcaacaataacaaagctatgtgcattcatgaacgcaatttcgcagaagtcatcgatccggatagattagaagccctcagattgaagtggtgcatgtctcgccagttttgagtggaaatttcaaccttcattnttcattatattgaccaatttgcttggcaacctgggaaagaaaatcgcgatcttcggccctatgactacacacacaatgttcctttcagagagtacatggccgtcttaaaaatgatgttcttaacgcgcttattccaaagaaaagttgccaaggtatatgacagaagaaggattcaaatttcgtaaaattattgagacccttcccaaatgggggcctgaataacccatgaaggagactccgggaaagggaatctcccgaaggaagcataatgacgctgacacaaattattccgaaaggccn

SEQ ID NO: 34582 - DNA, 834 bp, Oryza sativa
  unsure (1)..(834): unsure at all n locations
cacgctggttgaccatctccacgcnnnnnnnnnnnnnnnnnnnnnnnnnnnnnnnnnnnnnnnnnnnnnnnnnnnnnnntttgtgaaatgtgtaaaactatatgtatacataaaagatatttaacaataaatcaaatgataggaaaaaaattaataattacttaaattttttgaataagatgaatggtcaaatattttttaaaaagtcaacggtgtcaaacattttgggatggagggagtatatgctaagaatcataagctccttaattatggtatgctttgccaggagagttctaacgtgtatagcatatatatatatatatacatatatatatatatatatatatatatatatatatatatatatatatatacgacagtcactctatgtgtgaatctcccgcatatatatagcatctcatttatcttcagattgctcgtaatgaacttatgaactccaaactgcgtatgctaatttatatatgacaaaataaatattaactccgaattccgcggcttcgaagttgatccctactcttgtggttgcaatggcaactcacccccggccccaaaatttctcccctcgcgcacacattaaacgcaaaacacagtctcctccccctcaaacaactcaaacactccctccctatattcgcacctgtcgccaacaaataaacaaccccctctccccactcccctgcgtttttggcggcacgatctatagccctaggcccgttatctctctccccccccgaaactttccgcaaatctccccgatccttccttctttcctgtcaggccctccttttccacccccccccccttccggggccc

SEQ ID NO: 34583 - DNA, 907 bp, Oryza sativa
  unsure (1)..(907): unsure at all n locations
cacggatgtttgacgccctnnnnnnnnnnnnnnnnnnnnnnnnnnnnnnnnnnnnnnnnnnnnnnnnnnnnnnnnnnnnnnnnnnatatgcagtttcgtggaaaacccattgagatttgtgaactggttttttgatttcgagccagctcaaaattggtcaacatcaaggaggagttcaaatggtttttgagaaattcaaatctgaaatagtagatttgattgaattcaatcaaaatttggttcgacatctggctggcagcagcagcagcagcagaagaactattacctccaaaatatactccttgaagtgaactgtccactgtcgatggaacaaaaaatgtttgtctccaacgaggtcaacttcaataacagtccaaacaaagagagaaaaacatgggcgccggcataacacaccagcaagcagattggtagtttgggagtacaatacaagcagaaagactgcaaaggtggactactggtgggccctgaacacattaaactgaatacttaagcatatgaaacgtgcagtacagtatgtagtacttgccactaaattgtgcagaaacagcatgctcaactcaggtgactggatgccaccagtggcgaagccagaataaaaattactaggcgttcttgatatgcttatatactaatttttaagtaatataatgcttaatataactaaaacacctagaaataaataagctatcccgtgtcccgggacaccgggtagatacatgtaggaacgcccctggatgctaccaaccgtgtgttactgctactagtaatactagtacgacataaattgtacttgatgcgatttgacaatgatctgtcaagtgtcaagaaaataatngaggtggtagaagacaggttaaatatatccatattaaaaaagaaattactg

SEQ ID NO: 34584 - DNA, 853 bp, Oryza sativa
  unsure (1)..(853): unsure at all n locations
acacctcccaagcatgtgtactcatggccagtcataccaaacgcatcaaagcatggcaaattctggttctgatgaacatagctttgccaattcaagaagtcaataaacttcccaacaaggggggcagggccttcttcctttgggaatccagataccctccacgatgtgcagctaaaagcccctgccaaatattaaaagcacattagncaatatatagaatgcctttgctgttcctccaaaatgaagtgtgttaaaagnatggtgtagttggtgtacctttagaaaggaatcagcaagaattcttgcaatgctagatgcaggcatggtgtgtgtctccaccagaaatttagcttcatcaaaagaatcctgagctttcagagaaagcaactgaagaagttcaattggctgtttctcaaatgcttcagaaaatgggagtcccagtacttttgcagtttgaacaactgctgctattctcctgacaagagctcgtccacgaccctcgccacatttcatggctagtttctccataacctgacataaaagaaagaacaacttgttgtaatttgtggaccgtgcaccactcaaacatttattaccaaaactttcaagagacaatgatagcctgtaattctgaccatggaaaaggcagtaccatgtgatcattaataccggagcactattgtactcataaaatgaatgaatctgagataataccaacagtagcattcaataccaatttctgtgctaactcttttgttgtgttttgcannnnnnnnnnnnnnnnnnnnnnnnnnnnnnnnnnnnnnnnnnnnnnnnnnnnnnnnnnnnnnnnnngggngtacaatccatatcg

SEQ ID NO: 34585 - DNA, 14150 bp, Oryza sativa
  unsure (1)..(14150): unsure at all n locations
ccgtgattgatcttcnnnnnnnnnnnnnnnnnnnnnnnnnnnnnnnnnnnnnnnnnnnnnnnnnnnnnnnnnnnnnnnnnnnaggggttttcatttatcaagatctaatgtagcaggggaaaaaattagggcttgatttaacaagccgcctatgatatcacagcttcaaagaacaaaaaaaacagatttagacacttacaaggtaagatcatatcaaatggctttcttgaactcaaaagatccacgtcctcccggagcgaagtttgctgatatctgtacgtcttctccagaccatcatcatcaggctctaaatagccgccctcggtaggcaagagccactgcaaaattggaagcaaaaataaagatcaacaaacgacagattctcaattctcccattgtgttgcatatgctcccagaaacattcattacaagaatcaacaaccgcaccttctcggtctgaacggcggctttggcggagtgtccatagagcttctctcttgcggcgagctgccctttcaatttcttgtcgcgaagagtctgataaacccaacataaaccacacatacacatgtgaatcaaacagggacgcagatttttgaagaagaagtagtttagcagcagtctcaccccaaggtaagcagccttcccccgcgagtacttgtgcaccttcttctccatttcatccagagcctcctgctcgcccccttccatagccttctgttcagcggcgggcttggcactggccatggttaccttcaacagcggcaacagcaacagcaaacaacaaaaaacagtcaagaatctgagtgaacttcggtgcgccattgttcacataatatacagatagcaacctaaaaaaaaggcagagcaaaacgaaccgcgagggcaaagaccgactcacgagaacagaaggaatcgaccaatccaagctcggatccacacaagccgcgtcagtacagctgagtgggggtggagtactagtacgtcgtcgccgacggccgccgccggcgagagaggagagtcccttgtcctcgaggaggggggaggtgtgtctgacgggcagaggcggcggcggcgcggcgagagggggggcaagaggaggagtcggcggcgcgcggatgtattggcctagggtggggaggagatgaggagagagtttatgggccgaattattcggcccatatagagtaaggagctaagtccatggatggaggcgaagttttctgtgtgggctttgaagaatgaatagttgggccgttactattctaccactagaccactagaccactggtgcccttgttgccattcaactgaatctttcttacagataaagacatcaattctgcagaatctaggaccagcgatttcgtttcggcaccttgcattttgttcgtttcaattcagatccatagaaagattcagaagctccgtgctatcggcgatgagagtgggagtggccggcgagcctgacgacggcagcagcagttgcagtgcgtggagactctgcaaaggcgcgctgccgccgccgctgcacacatggcaccggagaaaatctcctccgagaaaaatcacccagcctactgccctactccaatcgcatgatacggaaacgaaggacatgtttgcaaggagccgaaagatttttacagtaaaaacttggcagctacgctgctgctgctacagacacacacaattgagaattcacaagactagacaaagctatataaaagaaaaggatcacaagacatgaaagaagaatgctctgtgtgtctgtgtgatcaactagttggatttggatcccagcgtttgatcttttgtcttccagtactgatcgaaccgctgccttgcatactcctggtactcgaagtcgatgttcttgttcacatgcccctggagacaagaaacagataccaaccagctttgtaagatcactaaatagattatctatacacatttgccattggcgtggccgctgtgttaagagagcttactgagattattccccaaagaccccagaagatatggcttgcaagactgtattttgcaatcaggccaagtaaatgttcaacttccgcatctgatgggttctcacctgataaacagaaggaacaatcaagattaaaatcactcatggcacattacagaaaatgcagcatcagtattcattcagtcccaaagtgcattattttcccttttctttcatcgggccaacggtgccaaggtgcatcctgcttacctgaagagctgaggtacgtttgaacaaatctgcgttgttcgtcaatgcctgaaatatgcagaggtgtcaaacaagccgatttttttctcagtgaaatgcacacagccatgcgcgcaggtagaacttaacagatatggctatcatcagtactgaccagggtattttgtgaagtccagcacatgaggtgtggctgaatgataatcagcagacatctcacagaagtgattagcaatgtcaaatgccacaggattaaaactcgcatactcgtagtcctgaaggataaaagagatcccaagacagcagttatttacagcaaaatattaacagaatatgacctaagcaattgctcccattccaagaattaccaacatcatatgcttcatactagttcaattatgcaacccagatgcaaatttatgtttaaatcaagcatcagagctgttcgcctgatttcggagcatttgtaaaaggagatactgagtcgcttacaattaaggtcacttgtctggtttcttcatatatcataatgttgccatattgcagatcattgtggcaaaatcctactctctgatcaacccctgacaatgcaatgtccagcattgcgatctcatcacctagcttctccaaactgaactgcctagcctcctcgggcgagcacctgccacgagcttcctcaagccacctcctgattcatgaagcacagtgaaattagcctctggaaggggggattgctcgtggttctcgccattaatggagataaagaaatagtgaaggggatgcgtacctcagcctctgccacagtgacacgttcttgggtccaggcatgtcgagatcgtggaattcacgaagcttcttggcgatcagcgaggatatctccgcgtcgcgcagatccgccgcggagagcgtctgagcagaacacgaggagaatgagccattgccattgggagcagaggagtgatgggggagagagagagagagagagagagagagagagagagagagagagagagagagagagagagagagtgcgtaccctcgcgttgatgaactcctcgatgcggccgttggggaagcggccgaggaggcgggggccctggccgtggcgggacatgcactcgaaggtgcggacctcgtcggcgcggtcgaagaagacctcgacgccctggccgtagatgcggacgagcaccttgcggtggtcgccctcgccctcgccctcgccgccgccgccgccgggccaggtgatccggaacacctcgttggtcatggcgcccttgagctgggacacggcgagcgcggcggggtcgacgtcgccgccccagagctccccggcgaggcggtgcaggatgcggcgcgcctcctccgggacgcggtcgaagctcgcgctccgcttcatggcgggcggggcggccgcggcctcccgcggcggcgggtcgacggcgaccattgtcggcggcggcgcggcgcggaggcgatctgcggaggcggagaggttgagacgtttttgcttcgttttcgtttcggggggagggaatgggaatgggaatgggaatgggattgacagtgcgccgcggaatcggatcggaatcgggattcgtgggaaaaggaggggcagggcaggaagcttccaggggaaaatatatataattacgggagtgccacgtcagctgccagcagtgcacgtcagggtgacacgtgggaagtagagaaatgaagctttcattactcacttttgggcttcgaccaaatggttgaagcaaagcatcccctagaattatggaagcattgttgcgctcactcgtatacttatccgaattgtttattaaaaagtacatgtacttagtaaatgatgtaaagtaaagtacaattagaaaaaaaatcaaactcaaaactaagttctatttaaattttggcttataaatataagcagagcaaatgcatgtttgcataattgaacttcgatttgggaaaactacacaaatggtagagaatggggtgatcaattgttactgtgatgaataacattgtcctaatttgatttatagtaccgccggttgttaataatagtcgcaataatacttacgatcatctcactttaaccacaaattacttttaaataattatattgtgatgaatgaaaaccgtattgtaatatttttcgacatcagatattttaataattatgacataattttaagtattttttaaaaagagacaagcaagatggaaaaatggaaagtattttttataactttatagagttttaagttttattactgttactgccaattattccagaacggggaaaagtaattatagaagacaaatggaaaagaaaaatctaaacaaagattagctggaaaactgaaaaatattaagctgttcctaaccactcgtacgcactctccatcaccacgtataacagtgaagtactagtagagttgtagaggaggcgagaggtgagttacagtacgtcggtagccgaagcagacggcggcgattccggcgggcggcgggggcggccaccggaggcgacgaggcggcgccggcagcactgaccagcgcggccgggtcaccggggccatcgccgccgcgagctccttgctgccggcgaccatactaaacgtatcgcccttgagctatcatatcaaagctgagcagctgagggagacggcgagagatggacgcaactcgctgatcttgggtttttctacggctgcttcgcctcgccggcgacgctcgtgaggagtttggtttggttggtggtggcagacgaaattggggccgtcctaggcttgaatatttccttatggcctactggaatgctatatttctttttcttagcaagaagtccaagtctcgtgtggcatggattgttggaatccacgtgagaagaattatccatccggcgttggacgatcgccgccagggttgttgggaatgaacagtacaatctcaatcaaatagcacaatcttatcaagaatatcaaaggcacaatctgatcaagtgcatatcttctcaagcaggactagggggctcaaaactgccagaactctgaactcacaattggtcctgaaggattcagatttcatggcagttcgatggattcagatccagacaaccagcatatcaatgagtatcttgtgaagcataagtgacgtgaagaaaattgtacaaaatttcatggttgggtcaatggaatttacaacaaactacagacatcaggcaccacgagtacggcgctacaacccacacgaaaacttccaccgactgaagccgcaaaaactcactctcaatcggctatgttcatcttatccactcagaatgcttgtatatatacaaaccgaatatctcccatggcttcatccatatgtatcaaaaaactagaatgctgaacgcaggcccaaagaaaggacgggaaaaattctcacctcactatatactgaactcctgtaagattcagtctgccgaaagttgaacaagatggatcaaaatggaaggatttacatgagagggaggtatgtaccaccatggcccttcctcaggattagagggccagcgttctccggaaccttgtccaaaacactattgcatgcgtcaagaacgtcactaaatcccgttgcaagagttgccaactgcagcctcagcctcatatccctcgttcgacggagaaggctcctgaacgatctgccaagatgtttcacccactctgcaggcaagcctccgggcgaaagccagaccgagaagtgtgactggtcccccctggctgcaacctccgcccggtaaaatcttgcaagctcgagtagcattggtggctgcaggggcagcaccaacacaaactcagccacaaattgctcaattagatctggtttcagcatttggttccaaaaaactggagcccattccatcggctgatttatgttgtatgcttcagcaacaatgagggcctcttggaacctagattgttctacgaaaatccgccgagcattggtttccgaaagaccaatccacagaaggtcaggtatacggatctgaagtgataggagagaagctcgcgcacacgcccggtgtgtcctttggccagcatcaattgttgaaagaacctcagccatctcaacaaggtgatgcatagcctcaaggagctcatcattcctcctttctttgtcatatcgagataaccagctgttcatgtattgttctgcacgtgactcaaggagagaagcagcctcatgcttcatgtcaaagtgcttatatacctgcatagtatacagaggttgtaagaatgtaaagaaacagccaggaggtatgtcttgtcattgtaaaagtgaagctgtcaggatcgactaactatgaaggaaactaaagtctcaggttttcttttattcttcatgtagatgctaaataagctaaaattgctcaatgaattttctgtacatactaatgcatagatggcattgaatgtgctcaatcaacagatagaacttatgaactggctaggataagggcatgaagatagttagacagaggatagggcactcgtcgtcaaattgcgctgacagggcttccctgtcgagctaagagatgttctgaggtttatttgactaactttagattcattgcttgattgataatatgataaatggggtcgctttatatataggatggactgacttgacatccaagaaactaatgttgaatataacggaaactaatctgatctctatctctagtttactaacaaacctcatatatttcccaactagataatctctagcagattaaaacaagctgttgttagcacattttctgtatgcacaaaagcgaagatggcatggtatgtgctcaatcagcagttttaagctttgacaaagcattaggtcatcagatatatccacagtgatgctcctttgtgataaatgaactcctttcaggccatgcactacttggctttggacctagattggatcacacattatgtcggttgtttgattgtatgcagactaattggatggtaaaagaacgtgtctcagacatcaatacatttcagaaaccaaaatttccagagagagagggagagagagagagagatatataccagagaaagagcgtcgtcatcacttgggataaaatgtttcagtgaggtgataacagccatcctaaaccctctaactgatgcaggtgccccagtggctgagtcagttgcagagtacttttgaagtaacaactccaattgtccattttctataaggatggaaagaatgaagctcaaggaatgaaaattgctcactccagtgatcaagcgagctaaacaagaaaaatccccctctgacacatacgactccactctattagctgcaaatgtgactagaacatccactccatcgagacaagaagaagacatgtagaagtggtaggacagtattaggagttcaacctgcaaaacatttgaaatggaaagttcagagacggcaagggaacagcatacaacagtaaaattcaaaccaaaccatagtcaatctgatggtagctaagtagcctggatacattaagtttacataagataacacaaacatatcaataccaacgaaggctcatgcatatcagtattctgcaaatttgattactttcaagcaacccacaggccacagtcaaatgtcagtaacttatagttaacaacactaggaatactgaactaaatacaacgcaagactgacaaagatggataacttctagttttcaaatgaggaaattggttcttcacttcactctatataagcaatggcttaaaaagtggctcagtataaacctactaatatatgatgcaaagaatgtggaaactagcaaattctttcacaatcaacagggcactagccagcactggccagtttaaagcaaatacaggtgagtcagtgagtttcagatcttatacaattataacttgtttcttccaatactgcagtgaaataaataaggttatgcgcaagagtaatagatacttgttacccataggccacaagaagcacgaaccaaaaaaggactgaaatcccaatactccaaatcaactggtttttattaagctgatttgttccataattccataagccaccactttaaacaccgacacctcatcaagttgagtgcatgttacttgagttccataagttagtcactttatgagtggaataaaactgatgtgcatgttttttttttgaaattaacaaatttatggcataatcatactgacactaattaaatattataccttgataatatatcaagggtcaaacatgaactttgcataacactgtttggataagttatatttcttagaagatggcatttgcatgtatacaaatcagtattgtcttggtaacttagaagatcatacaacctcgcaagcatgtggtacttcatggccagtcataaccaaacgcatcaaagcatggccaatttctggttctgatggacatagctttgcccacttcaagaagtcactagacctccacaacaggggtgcagggccttcttccttttgggaatccagataacctccacgatgtgcagctaaaagcccctgccaaatattaaaagcacattagacaatatatagaatgcctttgctgttcctccaaaatgaagtgtgtttaaaggatggtgtagttggtgtacctttagaaaggaatcagcaagaattcttgcaatgctagatgcaggcatggtgtgtgtctccaccagaaatttagcttcatcaaaagaatcctgagctttcagagaaagcaactgaagaagttcaattggctgtttctcaaatgcttcagaaaatgggagtcccagtacttttgcagtttgaacaactgctgctattctcctgacaagagctcgtccacgaccctcgccacatttcatggctagtttctccataacctgacataaaagaaagaacaacttgttgtaatttgtggaccgtgcaccactcaaacatttattaccaaaactttcaagagacaatgatagcctgtaattctgaccatggaaaaggcagtaaccatgtgatcattaataccggagcactattgtactcataaaatgaatgaatctgagataataccaacagtagcattcaataccaatttctgtgctaactcttttgttgtgttttgcactgcgagcaaaatatttattactgtaatttcatcattacagttcaattagtcatgcaaacaatcaatcctgttatttaatgttcgtaatagtctaatagaaagttctgaaagaaataagtacaatggaaaaaaacagacctctgatggatcagtcgtattgcttcctagtgactgaagtattgaaagagcttctgggtcaaagcatgataaactgatctctccattactgctgttattggcaactcttaaagcaatatcaacaaggacaagttcctcaggaacatacgatggagacagcttttgttgaagttgcgtggcagcagttatttgtccaaattccagtaaggagagaacagccttctccatatcaacaggcctaacattttgctcccaaccggataaagacacttccatctttgcaaactcctcttctgacagtaaacttcttgcttgtccagcaatctttgagctattaaaggagttagaattatcaccagaatcatttatgctactttcaacactatccttggcaacccgtctaagtagcgtatttgtctttgatcttcgccttgctcttgtgttatgtacgccttcgccattagactcaaagagttgcaaatgttgatggaatgatggggtggtgttgtcccttataccattcctttctgttattctcatccgtggtgaactcatactattgtctatttttgtgataacatcagctgtttgttctataatattggtattgtttccagtagctagattttgagtaacactggaaggtgcatattctccgtcagctttacactgactctctgactccacggccaggagccaaaccctagtctcaatgtcacggagaagatgaagtggatataccctgcaaaaaatgtatatatatctgtaaggagataatgagaccaagtacagcagcaatacatattacaaagaagcttacggagaggagttagtcatagttccgcttagccattgcaaagatagcagaagtatttcatgaagctcccgtgccggtatctcttctcctaccgcttcagcgtgcttgaggaaaaaagatccagcctgcaaacacaattgaatggatataaacaaccgataaattttatacagataaaagaccacatgaagaatatattaggctatttcagaagatagtacctgtaaaggaggtaaagaatatttcatgaaaagcgattgacagtggctccacaaagctgcacgttcttgtgggatatcccagaggaactccttccattcagcaaccatagcttctgcctacacacacagaaaaaattcatatcagcataaaagtcataagggcacacttggtaatgtaacagatgaaggtacaaaccaaatacctgtgattctgtcacatgatcaaaagtagactcccaagctacatcactcgactccagttgtcttgcccaagttcgtgcttcctcccatcgaccatccttttctaatgatgctaagagggaagcatcatccatggaatcattccacttgtaggtatcaccatctttgcatacagaaggttcagccaaaattattttccaataacctcggcgaaagtaagctgctgaggagccaccatcagaaaaatcaaccactgcaaggagctgtagcaaacatctcttctcataaattgatggacatgtcgagagtactgcatctgcggcttttacaacagtaacagctacccatcctgccatagctgactcttctttggaagagtttaattgagcatgggatgtttcgtctttcagtcttgcagaaaatgatgccaaatgtgcagaagcctcggacagacgcatttgacaaaatgccttaaaaagataggacaaatgatcatgttaaattaaaaagatggcacaaatgataatgttaaattaaaaagatagtgcaaatgattatgttaaattgaataaaccagtactttcaaaaaatgaatatataccaacctgaagagatcgaatgaaggggagaagggagcacgaaggcagaaacatttcaaaagctctaagcaatggtaggaacaactgctgttcacaaagcactgctaccatacttgacaaagatgcaaatctttcatcaatatcaactggaattttagtctcttcagatatgggcttcagtattttctgctgaacatcaaaatttggaaaattaggagttgcagtagggcttggtccacatgatgagaaacctgatgtgaagctttcttgagaagcctctaggaatcgccttcgttttggattcttcctgttgtaacgatattcaacattcctactcatgcttggtaatttatttgtggcctcaacagcggatcccacattttttgctattttcgaggaaatatcatccaccttgattaatgacatctccctgatgacagacataaatgccaatgcaataatattacacaccagtgatagtaatgaagcttgcaaaattagataacagaatttctacagatgacatgctcaatgtgctaccttgaagctgtaatgtcaagccaaacacttaagcatgagagaggagtcacatctgaaaaacaagaagcaatcatagccaataaagaccactgcatttgttttgctttattcaggagggcctccccaggattcttttgtttttcacagacagcaagaacagagaaaagttccatagagttgtcaccatcaacagcaaagaaagaggaatcacttcctgaagatacattactagaggatttccttctagctgacatcatgttcttcagaattgttagtatatgagttctcaatcttgaatcccttatctctttggctgcctgaacacaaaaccagagagaacaaatgaatatagtttttttccccatgaactataatcaaaatgtctactttccaaaataagaaacaataccacttcaatgacaacttcaattggaaaacctgacacctgagcttctgttaaaaaaccaacctgccaaaaaaatattgcatcaaattaatgtgtggacatatataaacaacaatatccaacatgagaagaaaataattagtgaatacccagtcattgtcattggccagtaaagcaagatactttgtacttaatggcagatggtgtgcctgacagaattctgtaaccaaattccaatgttggctggcttcattttgctgtgttcggtaaagagatgcatcaccaataccattcaagagccaaaatccacaggttctaccttcttctaacactggcaaacttgctttttcaaggtgatgcagaatagctttaagaggttgtgatgaatgttccctcttgggagccttagagggctgcttctgctccaaaacatgaagatgatcagactggatataatcttctgctaatgttcgggcaagagtaggagcaaggtcagctccatgggagagtacatgtagcccaggactcctcggtgaagatagatcacattgtttattttgctgaaatgacttatagtaggaggagatacgttgaagtgcagcaatatctagacgaagcatgttagcacagagaccacagagttccaacaggaatgtgcacgaagcaacaagagttgagtcctcaaagtttgtgatagcaagtggagctacctgatattgaaaaggcataggaaagtgaaaagacatccaacaacctaaagcattaaaaaatagaaatatgacaacctattcctaaataaacaaattaatataagaagttttgcaagcttatgctgattaaatgttcaatggttcagtataatagaatcagaagtcagaactagaagtagaattttagcatatcacactcccataaaatatttggaatattgtcacctcacaagtgccaaataaatactactaaatagaacagtcaatacctccatatgtccgttcacatttacactatagaagtccaaagtatttgttcatatttgcaggcctctgattattcagatgaataaaatttgaacaatggtggcaactcagttattttggagtttggacagtgatatgatggtaaactatttatattgcaaatttgcaacaaaaaggactgatgaataccagcagaataagtattttaaagttaaaaaaaaaaagcaagaaacatggacataccgatagaagaataggtcgttcagtttgacttaaaggagctagtatcaattgtacatctgcttgaacactagactgcactgagatcacttggcttgcattggctgattttaactgtgaagctcttttaccaagaagatgcctgaaagcagctagtgctcgaccacggtgcaaatgatgttccaccctcaagtctttctcctgaagagggtaataacgaagttgctagtttggggggaaagaactagaaaactataatagagcatgccaaaccaactcagagaaaagaaccccaacttcatggaatgaatgcactgttgtttttttaaaaaaaatgctagtgaagaaggttcaagctgtttgtctgctatatgtggccttatgctatttaaataagccaccttgaggccaacccacttggactaagcttgtggggtcttttggcttaagttcaagcacctttacactggctcctgctatgatgaaatagcatcccttgcattcttgattggtatcgcatataatagcannnnnnnnnnnnnnnnnnnnnnnnnnnnnnnnnnnnnnnnnnnnnnnnnnnnnnnnnnnnnnnnnnnnggaattaatgtcaccgg

SEQ ID NO: 34586 - DNA, 2297 bp, Oryza sativa
  unsure (1)..(2297): unsure at all n locations
ccggattgacttacactttcgannnnnnnnnnnnnnnnnnnnnnnnnnnnnnnnnnnnnnnnnnnnnnnnnnnnnnnnnnnnnnnnnaagaaccccaacttcatggaatgaatgcactgttgtttttttaaaaaaaatgctagtgaagaaggttcaagctgtttgtctgctatatgtggccttatgctatttaaataagccaccttgaggccaacccacttggactaagcttgtggggtcttttggcttaagttcaagcacctttacactggctcctgctatgatgaaatagcatcccttgcattcttgattggtatcgcatataatagcacagatgcatgacaacatagcatgaagtgttcaaattcagactatagaacaataacatggctcaacagcacaaagacgaggcaagatacaaaatgacagaaacaacattttccaggaaggtatttttatatatgacgtaagatgagcatacctcaagggaagagtatagttcttcctcaacacttttttggatggatgcttctaaggacaaagcattagcttcgctataccctgcggtattgtatatataatctgtgacactgtgagtaaataactcttcggatgatggtgcatttgatagcagttgcattccaaaagggccctgatcatagattatggttaataaaaccacaaaagtatctctcaaactgtgaacaaaatcaaaacttatgtaaaccacatgtaatgaattaaattaccattgcatatcagtaattttgtactggtctcgattcatgattagccatctccttttaaagtagtaaagataacaaatccagcaatatttccatgtttatggaataaaaacctaaaacccaactaatgtcatggggtagggttacaaaacatacaggaaccagcacaaacaatatattggtggtaatgtggcatgtgaggcatttttgtttgttcactattatgtgttgtctgaagttaaaatgccacaaagcgggaaattttgggagaaaactccttttttttttcatgccaagatatgaacagtaacatgtctagggttatatgcatttttctaggcgggtcaaaccctgtgcagtaatacagtaaaggctatattacacaggacaaaataaaaaccaaggattaaattcgaaagtgttacatgctgttatccaaactaaagacaaacctgttcaaatagctgaactaatcttctaatagactttgggaaccaacatgggagcatttgcaacaatgaagtgtctcctccagctgaggaaaaaatgttatagcgccagcgcaaatactctgaaattggtgatttcccaaactctgaaaaggaaatataattcaatttctgtgtagcacatagaaaacaagaacattctaatataaagaagggaaaaaatctgtattttgtttaccattagttggagaacagtttaaacaaccatacccatcttgcccaaaacaagaagaaagaagggtcttccatagtgttggaaattgctgaaggtgagggcttagattctctaatgtgcactgagaagataccccacgatttctgttcacacttccagtacatatggacttctgaattggtgttgaagcatacatcagggttgctagagcagacatttccccgattcgttcagccatatcatcaacagtgtacagtatttcatctatctcaatagcagcaagattgttatgcctaaccatttcctgtgacagattccaaagtgcattacaaaaggatgcctcgtattcataacctttgaccctggagaagagtaaccactgcgcccacttgcaatcaccctgaaaatttcatgacagagcagctaggtgaggcttactcctactataagttataatgaagaaacaacagacaagcatgttaagaagcttaatcttacatctatgatgaaaggaagcatgccaagtacttcccgtaccacaactagagtattgacactattgaccataaattagccataacagtatgcatgtgtctctagtatcaaagtagctataacagcaagtctctactatcaaagtagctataacagctgttcctagtatcggcaagtaaggcaaatctttagtcagatagatggaataatccgctgtagctgcaggctaataaaatcctgggcattatattaaggcaggcttcgtgaatgcaacaatgttctcattcgaacggtgctagcagtttctgataataattggtttactgggtaccgagctcgaattcgcctatataagtagtcgatccatcccgc

SEQ ID NO: 34587 - DNA, 6006 bp, Oryza sativa
  unsure (1)..(6006): unsure at all n locations
cggttgatggtcgcccnnnnnnnnnnnnnnnnnnnnnnnnnnnnnnnnnnnnnnnnnnnnnnnnnnnnnnnnnnnnnnnnnntaatttcagtagtgctttgccagtactctttcataaagatatgcttctttgccaattcctgtagcatgatcattctcatccaagaagttgattcatgattacacaaagatctgaacactttgacatgtggtatttccatacaaacaggttctatctcttctgagtcaaataagtacattttataaccgtgggttgctacgtcagacagagtgttgtaagtagcttgtgaattgtccacattcactctaagaatcccttctagaagtacactgtcaggaatactgtccaggagtttgcagacttccagcacatcattatgagcaacaaaatattcaaactgagattcccatgagaaatgagcatacgcatgtgcgtgacaaggctggtccagtattatctatagagcatataagaaccataagtccatgactataccaaaattaattcaggccctagttcagaatttagctcattacaaaaagcatcacaccaacaaatttaaggtgataccaaacacatttccacgaaagggaaaatgaataacacagaccaacattatcattatttctgtggcaacatatatggtcaaattgatcttgcgatgagttggaaatacataattatcccatatatagcataacaaattccacttgatttcacagtgattggacagatctaacaagactagcaaaattcttttacattttcagataagctacagcacattgccacaatcagaaataaggtgcaatctcaatactaacaagcaaaaatgttaagtcgtgacttacacggtccacagttctttgatcccaagcatcagaccatatggcagcacaggcccaataaccatcagataaaatgctttcagagaactccttcaaattagtgtaatcattcacattcgcccaagaaccgatcacagctccatcaacatcaccacattcaataggacagtggttatgaatatcgagaactagtactggtttatcttctcctggtagagtaacaatttttgcagcatcgtgaatgacattctccctgccaagatacgtgtcccagaaactgctgcttgggtaaaattgcttttccacagagaaaaaaaaaagttgatcactatgaaagcaaatatcaagccagcattttgatcttttataaattggaaccaaatgaacaaaaacaaaatatattgaaatatcataattttcccaattagctaaagcagggggtagaagcaaacctcaatcaatgatattatctccagcatcttccactcatttgaactcatgtacccacgcttcttcatctcctcggcaatttgccgcctaagtagcctcctgactgtaccttgcataagttgtctgaggtctgactctatgtcatctcctagtctttccagggttgcgacagccaatccagtttcaccctgcagataaaagcattagatgacaggaaatgtagagagtatacacgtgttaagcaaatggtatggagtactacattaccttcattaacaggtcatatatgatggaccttcctatttcatgaacttcagagaaaacatcttctggatcgttggaaaatgattccctctggcgcaatagttgcagttgaaggacagccaaaggtagtctaccagactgcagtgcttcttttactacagttctcaagtccagattattcgtttcccaccggttcatcatatctttgatatttccttgagtacttggtattacaacttgatcagtatcaatggcatgatgcatagtagcactaatagaggattcaactggagttaaagctaattgtccattgctaccagaaactaactcaaacatcgcaggtgttgactcttgcctatcacgagattctataccacctgattgtcctgctgaaacaccatccactacaacaattggcagtgaagtgttcagtgatacttctgcacctattttcgatgagtttttgtcatcaccctgctacaaaataaccacaggattaccaaataagaaggatcatccaaagtacaagtacgactacatgtgtacaaaaaggaattattatcattttaccatccgaatagaattctggttctttgcagagattcggctctggatacttctaattacccccaaaaggaaagccatttcatgaagttttactgaattatctggtgcatctgagaaatagagggtaagtctcacataacacaaataaaataaatggtgcaaaataaaagatcttacccttattttgcttaagtagcccatagcatttgatcattctcgtcgcaaagcgcacagctaaaaccatcagcctgttttcacactgtaagcttacatattacgaagctaaaagttgaaagcatatgacatattgcaggcttcatcaattcaaaacaaggaaaagaacagaaaggaacatcggattgtagcaaatcctaaataaattctactacagttttaaagacggctcaatgctacattgtttggatgtatctgcatcagcaggtgtcaggtctttgtccaagtgcttgaccaacaaatgattttccattttaagtattgcagaatggtagtatgtatcgatgtgtcataacatgtctatgttaaatcagtattactgtatcaaagtatgaacgtatatcagttccatttaactccattttccatacaaattttattcttgaccgtccaatcactatattcaaattatttcctgtcttaccattatattttcacctactgaaaatttctttgacaagcatgtttatcacaaaataaaatgttaattatactttgcaaccttagaacatgataaacagaagtatttttaattcaacatgaataatctgtcccatttggaaaaatgaatgtgtcaatggatagtgcaaccttgttgcacggagtgtaacagtactaccatagaattgctctatcttaatatttccgctatataatacacagtcggtgtgcatcctcgttatgtagagaccgggagagtcctcggaacagttgtatcaccttgatgtaattgactgagatcaataaaagcttccattatctaaaaaatatataatacacagcccacaattgtacccagtgtgcaaattatgctattcgtggaaacaacatttgaactagagaattgtttattaaaaaggtactcgatccgagaaggagcaaagcttaaaagcttgattgtgtctatgttgggggaccaatgtcattagttgggtagtaatcaaggcacgtgattttttctgttcttagttaaccaattcagaggtatgtacctaaaaaatgtttttctgcatcacagttctgtagacagagcaacatatttccaagaataaagtagaacttgttccttattttagagaaagtacaaactgtttgtatcaagggaccacagtttagtaatacggctaattaagttgactcataataaaaaaggttatcagggaataaaatatacttggatgacgccgcaacttcactatcactttccgccctacttaatagccggtagacagatgctaatagcagttgcaagacaccttcttctgcgagattgacctccacgagcatatttaatgatctagcaattcagttttgttagatattcttgcatatataaaaagatcatgtcaatgcaaattcaaataattcattcaaaaagtaaaaaagaaaaagaaaaaggtaggcatggaactagctaaaaattaaagcataataacacgaaacaatgtatatatagaaacaatgtgcataaaggatgaagtgagaaccaagtatatgcatatgagtacatgactgaaaggagattcatgatagcatgaaattaattgtttcctctttgtgagttgtgactggtataaatgtaagtcttattcagtatattcttccagctataaattcaactttcctcctagaaaaccatatcttttaacaatttccaaacacataagcaatacattcatgtcctagttcatttaactagtttgctctgtatgtataacaaatattttaatgctctccaaacagttgtaactgttcattgaaatcataagacatgtaccacaaacataatactggtattaatgtataagaaactagggcataggtaaaagagatgaaataaaagaaaaacaacaaagctgatattaatgtcaagacaaaagaaaagtacaagatcttactgctcaagatcactgatctttgtgtagtgcaaggccaattgcagccaacgtaacctagagaatttaaggtcccatcctgccaatgcaataagcacatagcagggtcagagcatatggcgtgtacttttataacacccagcatgtgttgaacagaacattgcattgaggcaatgctatcatctatcagaattggatatttcattatatacataaatgagaaataagtactaacagaaaaagggaatgagatcattgcttgttggatacttgacacaaaatgatagtaataataatgtaaaatgaattataatgttttaatagtgcgcattaatattcaggtattagtcaacccatcgaactaactactgtgaataataattggaacagtgtttattccagaaaacgacaattgaccaatcaccaaaaatagaataaaaatccaccatattcaaaatacttgggtacaacatttatctcgcaaatattttagtataaatcgaaatagtttagctcatttctgattaaaatagtgtagctcaaatttctgtttgcaatacactgcaaataaatctgtaagcataaccttaaggaaaaataaatccatgagccaaatattaagaaaacggcaggactgcaagatgggacaggcaaccgaacatctagaaagagactcgggactaaaagcagttagaatagcaggacaacagacaatatgaaaaaactaaagatattgccaagtgtattaaaacacaccattctcccagcagagcctgtctgcaaatgcaggtccttcatacaataatgccctgtccaaaacttctatttgccaaggcttccatcttgtttcaggtctgtttactgaggacaaattcagagcatcgcatgcactaccaccagcagaagtcggttgccaaaatttgatgccattgttgtgagatgaaaaggatgaaacagaaattgatggaagaaccacagaaaggctatcctgggtaatcagatacacatatccctgaaaggagcaaaggacacactctccggtaaaagtagagtccttctgaaatgaggaccttttaaggaaactagcatcaatatccctctcatcaaggtgtaatgaagccataagaaagtttgtgtgaacaattctaaaatgcttgtttccatccgcattgtgacttttaaagattctcgttaacccaaatggtgagaggctaattatattctcctgtaatctgcatggtggaaggatcactcttcttaatggattggaaactgccattgtatcagggtaagctaacccatctttcatcggtgttgtagtactgaaaccacttggccagctatccacctgattttcattactgctacaatgttttcttcttttcctaggcctgacaacaccaggattgtctctttctgagaagtcatagaccaattgctgtacagaccgatgacaacaaaatgttacactcccaatatcatgaccagcagcttcccaggcagcaaaactatcaccacgataaaacatggaaggcggatgaaagtttccatgcatactggttttgaaatctaagatgtccttggcatagaacaaatagattaccccaacctcatctacgacagcaagaacaagagaatatgatgccaannnnnnnnnnnnnnnnnnnnnnnnnnnnnnnnnnnnnnnnnnnnnnnnnnnnnnnnnnnnngaggggtgtcagtacat

SEQ ID NO: 34588 - DNA, 879 bp, Oryza sativa
  unsure (1)..(879): unsure at all n locations
cgattttcattaacgcccnnnnnnnnnnnnnnnnnnnnnnnnnnnnnnnnnnnnnnnnnnnnnnnnnnnnnnnnnnnnnnnnnntatagatgataaaaattgtggagggtttgggtttaggtcattaggtgaaagggagtgatgaggagggaggagtcatatggtgcacggcaagtaggcaatgccacctcatttcaatcaagaaaacaaatgagttatcttttcttccacatcaattacttcctccctagtccctacccttttcaaaaaaaaaaaaacttcctcccttttcttaaaatgtttaacaccgttaacttttggatctaagtttgactatttatcttattcgatgaacttatctaatcatcatttatttgttgatatttgctttgttattacgagtactttaagcatgatttatgattttacatatttgtataaaattttgaatgagaacaatggccaaacgtaagtaaaaaaatcaacgatgttaaatataaaaaaaatggaggaagtattatattggattcaccatcaacattgacctaaatgcaaccacctatgaacatgtaggtattgcaattactttggaaaaataaaaaaacagaatgttacgagtgtggattctaatccctcgaggggatatcccctcgtatacctttttcttccaaattcgatgaaaataagtgtgaaaaattctaaaaaaaaatgataatgtagagtataatgatacctactagtccaccaaattcatgtttaaaatcgatctacacatcgggaaaccaaaaagacaaatttagattaaacaagtcgctactattcatacgctgaaatttgctttttatatctcgacggtgagttgagtttgacttaagattt

SEQ ID NO: 34589 - DNA, 887 bp, Oryza sativa
  unsure (1)..(887): unsure at all n locations
agctttgctgggaaagtaaaagccacctgtaggtaatatcattcctctagagggtcacnaatgattcgagattaacaatgaagaacaagatgtagaagagcaagggacgagtggtacattcgactcatacgtctagcagcngtttgtgcctatcttgtgagctcaacctgttcccttttatttccaagaatgggaaccattcaaatctgaagtactccataaagatagtcatacctgtaaaaacacctggtatcagtaacgagctacacaatagcattagctcagcgattcttcatactcgtagaatacttggcatcttgaaagctctgttctccttgaagccatcatctgttggtacttcatgaagttatagttcaaatgagattgttgcagcagctatggttgctgctcatgtttctgagttatttcgtcgatccagcccatgcttaaatgcactgtctgcgctgaagcaatgcaagtgggatgctgagatttctaccagggcatcatccctttaccatttgattgacttgcatggtaaaacagtgacctccattgtgaacaaagctgagcctctagaagctcacctgacccttacaccagtaaaaaaggatgaacctcccattgaggaaaagaacattaactcatcagatggtggtgcattggaaaaaaaggatgcttcaagatcacacaggaaaaatggttttgcaagaccactcttgaaatgtgcagaagatgttatactaaatggtgatgtcgcgagcacagctagaataccccttacaattagtcaggtgacagctcgcaggccgtcgttttcactcatagtgattggnnnnnnnnnnnnnnnnnnnnnnnnnnnnnnnnnnnatcncactgggaacagc

SEQ ID NO: 34590 - DNA, 950 bp, Oryza sativa
  unsure (1)..(950): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctgttctccttgaagccatcatctgttggtacttcatggagttatagttcaaatgagattgttgcagcagctatggttgctgctcatgtttctgagttatttcgtcgatccaggccatgcttaaatgcactgtctgcgctgaagcaatgcaagtgggatgctgagatttctaccagggcatcatccctttaccatttgattgacttgcatggtaaaacagtgacctccattgtgaacaaagctgagcctctagaagctcacctgacccttacaccagtaaaaaaggatgaacctcccattgaggaaaagaacattaactcatcagatggtggtgcattggaaaaaaaggatgcttcaagatcacacaggaaaaatggttttgcaagaccactcttgaaatgtgcagaagatgttatactaaatggtgatgtcgcaagtacttctgggaaagccattgcaagtttacaggtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34591 - DNA, 1095 bp, Oryza sativa
  unsure (1)..(1095): unsure at all n locations
tcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggttggtcgcttaaccgaaacaataaaatactgtatgcgaacataaacagtcattagaacgaataattacaaaacctattaaattgttcgcgagatgcgaacgttcaaggattagacccgtccgcctcgaagtgctttgtaggctagagtcacggatccaaaatttatatttctcacagtgcagtggctataggaatgactttgattttatattttagccgtgaaattatttttgttcagttctcatatttctagaatttgtgttgaacccctagaatcaaaaaaataataaaaaaaatccccttcacccgttctctctctctcgccatctacccatctccgtcagtctccctaccggcggcagatcccctctccttccgggcggcgctccccttgttttctcccccgaccgacggccctactctcctggccggtgcaccgacaagcttgacggcttggccgcgggnanacggcgagatngnngnnnacccctcccccctcctcctcctccaaccggcggtcttcctcctttggctggacaccgataagctcctctccctctccgtcaagctgttgcgtggttttgagcggggacgacgacgagctcggcggcagctgaatggtgacaaaaacgaggttaggcgccacctcctcttcctcatccgctgccatagccgtcgccttatcgagctcgccagatccgctttgggggcagcgacatatctcgtggtggtggcctcgccggtgaccgccaccgccttgcacggggtcacgcctctctcaacacgtcgctcgnnnnnnnnnnnnnnnnnnnnnnnnnnnnnnnnnnnattcactcccat

SEQ ID NO: 34592 - DNA, 1233 bp, Oryza sativa
  unsure (1)..(1233): unsure at all n locations
cgattgacagtcgacgctccnnnnnnnnnnnnnnnnnnnnnnnnnnnnnnnnnnnnnnnnnnnnnnnnnnnnnnnnnnnnnnnnnnnnnnnnatagaatgtacgtgagaattcctgcaaagatatatttttctgtataaattttgctcatatttcatatagtactcgtcacgtccagaaaaatgtgtttctactactcaggatatggtttagggtttgagtgaaaaaagtatatttatatgtgactacaatcttgatcttagaggtgtttggctctatacttcagctcaaaggccgaaactcatttaaaaggttacaatttggttttaaaagaatttttgtcctcactttttattactaactctttttcatgactaataaaaggaaacagaaaaggaatatctaataatactactcccttcgtcccataatataagggattttgagtttttgcttgctctatttaaccactcgtcttattcaaaaaatttgtgcaaatataaaaaaacgaaaagttgtgcttaaagtactttggataataaagtaagtcaaaaaaaataaataataattctaaaattttttgaataaaatgagtggtcaaacagtgcaagtaaaaactcaaaatctcttatattatggaacgagggagtaccattcttagaaaccgatcgaattttaaaaattcgaaattagcatgtgaatcagatccttaattatttaatcactatatatagaatcacatgcctagctatttaccctcaaaaacaaaaacaatcatgcacgtgcgctgaactttgcaccgtgtttacgcaaaagcgattgaattgacgagccgttacattttggctcgtccagtgtcgtgttctaacggtagcaacgtggttgcctgaagtgagggtccgctgctcactgacatatgggctccagtactacagaggatctatattggttgcttgcattgcctactacgcctttgagaaacgagccgtcaggtgacgtgtctcccaaggatcagtgaggccagcgcgcccggatgtgcgtggacgagtcaacctgtgcgtggcagtgacatctacttcctagcgtaaaaaaaaagacaaactatgggnttccatgtccaatatttgaccgttcattttattttaaaaattttaaaaaaaattnaaaggacaagtcccgcataaagattatcatgtntatcatctacaacatgaanatacctatataaaaaaaa

SEQ ID NO: 34593 - DNA, 944 bp, Oryza sativa
  unsure (1)..(944): unsure at all n locations
ccgcgagttgcacccnnnnnnnnnnnnnnnnnnnnnnnnnnnnnnnnnnnnnnnnnnnnnnnnnnnnnnnnnnnnnnnnnntgtcactaaacggctacattatccagactctgttctgaatttttttttcattaagtactgttagctgccagattacatcatcatgactaaagtagtttagctacaatattgcaaagctagatttgtctagcctctattgttttgaatagaaaaggcaggtatgcagtgtttcctgcacctacttgctacctattctgtatttgatgtattcaatttcctttttatcagttttctcgaaatatatgctaataggcttgtcactaaacggctacattatccagactctgttctgaatttttttttcattaagtactgttagctgccagattacatcatcatgactaaagtagtttagctacaatattgcaaagctagatttgtctagcctctattgttttgaatagaaaattaaatcttttggtcatttttttgtaaccttttaggagtctctgtatgcttgtcgtcaacatgctatgataagtttatatcagttcttttggagctatgatgtattcttgtatattttatgactgctaggatattatgttaaaactgttttaaaggtatcatcaaacaagttaatatagatattgctacctaccaaagttggaatttgattatgtcgtaaaatatatgcaccctacatgttttagcttcatattgacttatattttcatatgtgctccttcaactgcacaaagctggaagttcctgcatctgaagccactattgatgccactgcgcaaggcattgcttccatgctatgtgctcatgnnnnnnnnnnnnnnnnnnnnnnnnnnnnnnnnnnnnnnnnnnnnnnnnnnnnnnnnnagtgacacctgaaagcgaacgttaattcgggg

SEQ ID NO: 34594 - DNA, 834 bp, Oryza sativa
  unsure (1)..(834): unsure at all n locations
ctgcgggtgaacaccccnnnnnnnnnnnnnnnnnnnnnnnnnnnnnnnnnnnnnnnnnnnnnnnnnnnnnnnnnnnnnnccagaaagtatattacctaaagcatagaaatggaaaatatataggaacaaaacaggttcttcttttggtgtttaattacaggtgtctctgctcatcggttggtgtctgtattcacttccactgttaacgaaatgaggaagggatcccttgttactgtttcaggggaaaaaatattaaagcagagctagcttactgcgaattaattttcagtaattatccccgcacaaattacatccacagccgtatgcaccacatctaaacgcctccacgaagcagcaaaatccagctagaatcaacgctactcgcctaaaaaaaccacaaaaaccttctgaaattcgcagtaataagcatccatctcgcgttgatctatccgatgccacgaattattacaatactaatcagctcaacctcgccgtcaaatttcaaaactaatttccctttcacgtcttcaaaatcccaaccgcatctaccaccaaaactctcttcccccaaacaaaaatccccttaacataacaccacaaattcacccgaaccacctcggccccatacacgacaaccttagaaaggccatcatcaaaaacagcctaaaaatagttttaaagaaaaaaacaccaagcacagcacagaaaaacttaaaccgcacgggaaaaataaaaaagcattacctngatcagcctttcaaccaatccggaccttaacgcgcgtaaacggcggcggcggcgaggtgatagacgctcgcggtggtgacactgtcg

SEQ ID NO: 34595 - DNA, 842 bp, Oryza sativa
  unsure (1)..(842): unsure at all n locations
cctggngatagnacgcccgtnnnnnnnnnnnnnnnnnnnnnnnnnnnnnnnnnnnnnnnnnnnnnnnnnnnnnnnnnnnnnnnnncaacatatcacaaaagattcagaacaaaatttgggtgcttacttctgtgcaccattgcctcatgtgcaaaagcctatggttcacaaggaagcagatatgacatttgccagctacacgatacaatgcacactagtgataaatatgaggttgcagcaaacaaaaagaaaaagaaaattctgtgctccattgtcactgcctactctttgcgaaccgctgcaaggcctttggcagctcaatctcctcgctgacccgctgtttcttgtcaggcctcccatcgttttccttgtgttgctccaggaacggccttttggctttcaaaacttcttcctccctcttcttggcccgcttgctggctttgctcctacccttggtcttcttcttgaactcgatgctcttggcagcctctacggcgtctttcatctcctcctcaatctccttcttgggcttcttctctttcttccttgaaggtcttacggtagctatcatgttcggattaagcattatcgtctctggctggagcttgttaagcagggattgcaccttcttctcccttctctgcttggaagtctcaacggggtttgtcaacaaaggtatcaaagtttggctcaccagatccaggaacaagaatggcagaaaggcccatggagtgaccaatccccaaaacattctcgtaaggacggaacaaaaccttncaantctggtatccctttaccattctatgnttcatataaaatttataaatcttgtcccccgtatn

SEQ ID NO: 34596 - DNA, 2012 bp, Oryza sativa
  unsure (1)..(2012): unsure at all n locations
gcgcattgttgcacnnnnnnnnnnnnnnnnnnnnnnnnnnnnnnnnnnnnnnnnnnnnnnnnnnnnnnnnnnnnnnnnnnaaatgaggtggcattgcctacttgccgtgcaccatatgactcctccctcctcatcactccctttcacctaatgacctaaacccaaaccctccacaatttttatcatctatataaccacacgaaactccatccatggcggcgagcgagctcacaagtccacagagacacacctcaccagcttgatcaagagctagccaagccaaatggagctcctgccatggcttctcggcttcgtggtcaagtacccggagatcatggcgtccgccgcttgcttcttgctgctcttctgcaggtttaggaggaggagcaagcggattccgacgaactggccggtggtcggcgcgctcccggcgatcgtggcgaacgccgggcgcgtccacgactgggtgacggagttccttcgcgcggcggcgatgtcgcacgtcgtcgagggaccgtggggctcgccgggggacgtgctcatcaccgccgacccggcgaacgtggcgcacatgttcacggcgaacttcggcaactaccccaagggggaggagttcgccgccatgttcgacgtgctcggcggcggcatcttcaacgccgacggcgagtcgtggtcgttccagcggcggaaggcgcacgcgctgctgtcggacgcgcggttccgcgccgccgtggcggcgagcacgtcgcggaagctcggcggcgggctcgtgccgctgctcgacggggtcgccgcgtcgggcgccgccgtggacctgcaggacgtgttcatgcgcctcacgttcgacctcacggcaatgttcgtgttaggagtcgacaccggatgcctcgccgcggacttccccaccgtcccattcgccgcggccatggacgacgccgaggaggtgctcttctaccgccacgttgcgcccgtgccatggctaaaggctccagagctacctcaagatcgggcactacaagaagatggccaaggctcgggaggtgctcgacgcgtccatcgccgagctcatcgctctccggcgagagcgcaaggcggccgacgccaacgccaccggcgacgccgacctgctcacggcgtacctggcatgccaggacgagatcggcatggacggcgccgcgtttgacgcgttcctgcgcgacacgacgctgaacctcatggtcgccggccgcgacacgacgagctcggccctgacatggttcttctggctgctctccaaccaccccggcgtcgaggccaggatcctcgccgagctcggcgcgcacccgccgtcacccaccggcgccgagctgaagcggctggtctacctgcacgcggcgctgtcggagtcgctccggctgtacccgccggtgccgttcgagcacaaggcggcggcgaggccggacacgctgccgagcggcgccgccgtggggccgacgcggcgggtgatcgtgtcgctctactccatggggaggatggaggcggtgtgggggaagggctgcgaggagttcaggccggagcggtggctgacgccggcggggaggttccggcacgagcgctcgtgcaagttcgccgcgttcaacgtcggcccgcgcacgtgcctcggccgcgacctcgcgttcgcgcagatgaaggccgtcgtcgccgccgtcgtgccgcggttccgtgtcgccgccgccgcggcgccgccgcggcccaagctgtccatcatcctccacatgagggatggactgaaggtgaaggtgcacaggagacaagaggattgaaccaacttcctttggacactttggaacgaaccatacagttcgaggtttcgtattgatatagcagaaaaacattgtttggtttcatattgatatagcagaaaaaatattgtttagatatgggtgctctgannnnnnnnnnnnnnnnnnnnnnnnnnnnnnnnnnnnnnnnnnnnnnnnnnnnnnnnnnnnnnnnnngggcgtcaataacgg

SEQ ID NO: 34597 - DNA, 5419 bp, Oryza sativa
  unsure (1)..(5419): unsure at all n locations
ctggtacattacgttatatatagggaataagagacattagtcncagtgattataattttacatggttagttgagcgagtggtctgtgatctgatgtgatgtacataatttctattttaaatgtaaaggaattttacacatgaaagttctgtgaaattcatgcgttcaaagaggccctaaagctggtgcagtgatggatgcatgtgtagtatgcaaaaccatttttcctccttacgtaaatctatgactactgtctatatgctagataaataaacaactggtaaagatagaatatgtgctcatgtgcacgaagacatgcctatgtaacttacaagaagaagaaaaaaaagaaacaagaacacatacatatgtgcaatgtgtcactcccccgtttcgtgcatcatgtatgatctgttgcaattgtggtgtgtgaatattaactttgatgtgaagatgcatttcattcccccaagaacatatgcatttcatgagaggttgatttagtcagtaaatgaaggtttagtactggtcaatctgttttgtctcaattcaagatcaggaagggtgtagagcagagtacaagtggattatactcaacaaaaaagaaaaaaaaggtccacgtgattcaagtcagtataattttacagtggattttatcatcatgtcacaagattcagatcatgcatttggatgggagaaagaataaactctagacattaattttacatgccatttgatatctgaatatctggtcgtgacacgcaaaattggggcaggatgctgcaggggtgtataattgttccatagaaattttgacagcttgtgtaaaaatgaagccgggcgagctcagagttagtgacagcagtaacaataataataatgaacattaatacagtataaccaaaaggtagcagcagacgaagctactaccgtgtttcgatcaagtacaacgttgtggtatatgatgggttaaaattggctgcaatcactaaaatcacatgtccatcctgaatgtctcaagtctctcaatcgaggatcctccagccctgttttcgcaagcttcagatgtcatttgtatacacagattatcagcattgtggtgagggtgatgattgtcgcggttgtgaagatagccgcctacacatgtggaatggattgaagacattagagaagaatcactgtaactaaaatgctcgggtaatataccagaacaaaatgcaaaagacttatgaattgcgtagattagctgccatgccatttaataatatctcttgcatcatacaaacaatactgttcatatatagtatataccagaacaaaatgcaaaagacttatggcatatatagtcatatgggcccttaagaaaaaaatagggtacatctgaccatacctcattttctttttctatataccaaacaggcaagccccagaatgattacataattaattacagttcaacgcatcacaaaactattagtaatacatactcttaacatgggactccagatcaacacaattacatcaaccaccaaggagtttgatgtcctatacagaagaatcatggacttctttcaggaaaccgttttgatccctggattcttgctataagtaattgtagtgaactagtattataataatatgttcagggttatcgtgaaaggaatactaaccgcaaccgccgatgcagcaagaccagggcgctctcggggatctttgttgtagtacttacagcagtaaagagttgctgcatagtaccagatcaacggacacaagaaacctaaaaggaaactgcaacaagaagatatctgatactgccacatgaagaattttagtttggaaatttgaaccaaagttgatttgggcagcagagaatactcacgaggaccatcctataccacaaccaaagcaaggaagtcgtctttcaaacattgccagccgtgggttttcttcatctctgagcaatgtatacttgccaagacagccctgacaatggcaaaattgatccgagcctgctgcaagatggaaaaataggattaagctaacagaagaaatattctcaacaaaacaaagataacgccactgcatttatgatttatgttaaagctctaaatgtttgagtcaaagtataacttggaagttggaactacagtagtttatgtcatcaatgtttatatactgcaagtaagccagtatcatgacataatctcctactaaaaaaacatgtttctcaaaatgtcagattcaaggattttgtgtatagtacaaaagtgaaatgcttcccacatgtcttaagagatctagcaaggaaaagctaagcttaacttcagaaaagaatgagagagagagagagagagagagagagagagagagagagttggaaacagttaccttcccccatttaatttagagcagttcagcaaagaagcacccagtaatcttaatgcaatatctccgttgcagattcctctgtgccgtagcaagaatcagtcataacaacatgaagataaggacatcaatgatgcaggttgtctagaatggtcatgttgctgtactggagagaaaacaatatgtatcagaattctgctcaagcacacataagtagttgataaaatactttgtgcaattgcaatttgaaaaaagaaataccaaaaaaagaggaaatagcaactactgacaacaagtgccatgtctaaatttctgaacatgcacacaacacacaaatgatgaatatggtgaaaccgcaattagcattagaaagttttaactctagaaatcaatttccaagttgtaatccccatactcccaacccagaagggaaaaaaaacaactccaaaacccccaacttttaaaaatgtgggaacaatcaaaccatatgcttgagatatacccacaaagccatcggcggccgcttacagcagagtacaccctcatcttgcacgcctccgaagaagcaggagccgtgatcaacacgagcatcttgtcctgctccaccccacacagtgacgagtctagggcacgacgaaggcgcgctcctaaaccgtgggctcggggctccggccagaccggaggttcagaatgtgctgtcctaagatacgtagaagcaaatacaatccagaggcatcaaatcctgatatagctctctacctcctcagataactccggtcagtaatttcgtcgaacacttcgcgttcatcgtccgtactccctcatcgcattggcagcaaaaccaacaagaactgaccgtcctcacacagtcccaccaaaaaatcaacaacccagattcgagtattccacccacccagatcatccttccaatcgaagttgcaggaaatcaagaacggacaacacaaccatccaccaaccaagatccaagaaaccgcaagagcaagctagaaaaattcctgcagaagaatgaactcaccggagcaagacgaagcatgcgccgccgccgatcggaacagaggtggaagcaagatttgtgcgttcttggatgggcaacagagagcagcagagccctagcggtgggattccccttggttgagtggaagaaactggagaaagcgcgaggccgttttgtcctcttgctttccccttcttccccctctcaatcgatcgagagcaacagacaaatcactcccaattttttttaaaagaattgaaaaaaaattcaagagcgcacgacagttcacgtctcgcctcctcgatttctttctttacttcgtcgctcgcttcccttccaaggggagatttctctggttcccctctctggtttgttgacgtgtgatagactagtactgtgccgtttggacttgcttgtattgatcttgtccgtccatggcgttcagcatcgaccatctacgtctgagattccacgccacgcacgtgtccgcgctcccaacctaaagaccgcagagccaaataaaagatacggattcttcgtcagaaattgcacaggcatcaattagggcgggagctgaggcacggggcgagcgacgtgttgagagaggcgtgaccccgtgcaaggcggtggcggtcaccggcgaggccaccaccacgagatatgtcgctgcccccaaagcggatctggcgagctcgataaggcgacggctatggcagcggatgaggaagaggaggtggcgcctaacctcgtttttgtcaccattcagctgccgccgagctcgtcgtcgtccccgctcaaaaccacgcaacagcttgacggagagggagaggagcttatcggtgtccagccaaaggaggaagaccgccggttgaagaagaagaagggggaaggggtcgccgccgatctcgccgtctcccgcggtccaagccgtcaagcttgtcggtgcaccggccaggagagtagggccgtcggtcgggggagaaaacaaggggagcgccgcccggaaggagaggggatctgccgccggtagggagactgacggagatgggtagatggcgagagagagagaacgggtgaaggggattttttttattatttttttgattctaggggttcaacacaaattctagaaatatgagaactgaacaaaaataatttcacggctaaaatataaaatcaaagtcattcctatagccactgcactgtgagaaatataaattttggatccgtgactctagcctacaaagcacttcgaggcggacgggtctaatccttgaacgttcgcatctcgcgaacaatttaataggttttgtaattattcgttctaatgactgtttatgttcgcatacagtattttattgtttcggttaagcgaccaaccaatcacttttccctattatcagattagattttatttcttgaaaaaaatccggtgatgcttagatttttttatttgtacatgcaaatataattcataatataaagtttataaataaaaaagtctaaaatataaagtgtatatacataaagtaagattatatacataaagtctatatatagaaagtttatacacataaaatctatatataaaaagtttatatatataaagcatacttgtagagaggtccatgaaaatactacatataaaaagtttccattagaatagctttaaaaatgactataaagaaaaaaagtaatttgaagaaaaaaagaatggaaaaacagaaaattgatacatacctctacaggagaattaacgtaaaaataaggacaacgggaattgaaaagaatcacataaaaaggaaaaactggaaattaggaacaaaaacggtatcgtagcgatacaccgcaccggcctgcggaaaatctaatgggtgaccgcgatcgggtagcgatcactacccctccaccctctctccctccacgtttccttttnnnnnnnnnnnnnnnnnnnnnnnnnnnnnnnnnnnnnnnnnnnnnnnnnnnnnnnnnnnnnnnnnngggcgtcaatccaaaacgg

SEQ ID NO: 34598 - DNA, 9327 bp, Oryza sativa
  unsure (1)..(9327): unsure at all n locations
cgtgccccttgatgactgaccgccnnnnnnnnnnnnnnnnnnnnnnnnnnnnnnnnnnnnnnnnnnnnnnnnnnnnnnnnnnnnnnnnnnnatgactgtttatgttcgcatacagtattttattgtttcggttaagcgaccaaccaatcacttttccctattatcagattagattttatttcttgaaaaaaatccggtgatgcttagatttttttatttgtacatgcaaatataattcataatataaagtttataaataaaaaagtctaaaatataaagtgtatatacataaagtaagattatatacataaagtctatatatagaaagtttatacacataaaatctatatataaaaagtttatatatataaagcatacttgtagagaggtccatgaaaatactacatataaaaagtttccattagaatagctttaaaaatgactataaagaaaaaaagtaatttgaagaaaaaaagaatggaaaaacagaaaattgatacatacctctacaggagaattaacgtaaaaataaggacaacgggaattgaaaagaatcacataaaaaggaaaaactggaaattaggaacaaaaacggtatcgtagcgatacaccgcaccggcctgcggaaaatctaatgggtgaccgcgatcgggtagcgatcactacccctccaccctctctccctccacgtttcctttttttttttttttgcaccgtattacttttctattttagtaaatttatgcatctaaagtgtatacacctaaagtttatatagacccaaagtttataaatcaaaattttatatatccgattcaaatttaaatttgaattcaaatatttttatatatagtatttctatacatctaaagtttatacacctaaagtttatagacccaaagtttataaatcaaaagtttatatacccgattcaaatttgaatttgaaatatattcgattcaaatttgaatttaaattcaaatatttttttatatatagtatttagatacatctaaagtttatacacctaaagtttatagacccaaagtttataagtcaaaattttacatacccaattcaaatttgaatttgaatttgtatccgattcaaatttgaatttgaattatatccgattcaaatttgaatttgaattcaaatatttttatatatagtatttctatacatctaaagtttatacacctaaagtttatagacccaaagtttataagtcaaaagtatacatacccgattcaaatttgaatttgaattcaaatattagtttatagacccaaagtttataagtcaaaaatttacgtaaccgtttcaattataaatttaaatttaaatatttatggtgtagtaggaagagaaaaagggaaggaggaagcgacggtatagggaaggggcgggtgatcgctcgcgtcccccaccggtctgtcgctcattaccacgtgtctttgatcctccccagcctgatccgcttcttgtcttccgagtctcgcgcatgtttgcgtagtagacttcccgcttcgaggcttctcataagggtaatgtgtgctttttcatgaagaaatatgtctaattctcaatttctgatgaataaaaattccaaatgtaattgattaacttgccttagtacaaccaagatctgatcatgcctagccattccaaaatccaaggccgagtttagttccaaattttttctttaaacttccaactatttcatcacattaaaacttttctacacacacaaacttccaactttttcgttacatcgttccaatttcaaccaaactttcaattttggcgtgaactaaacacaccccaaattgctcaatcagtagtacgtcctagtgtatgtttagttcatgtcaaaattggaagtttgattgaaatcggaacgatgtgatggaaaagttgaaagtttgtgtgtgtaggaaagttttgatgtgatagaaaagttggaagtttgaagaaaaagttaggaactaaaccaggcccttgtacaaaagaacaagtgcgaagcatcttcccgactgctacttcccattcgggtgtgtgataaatctttgaatggctaattcctcgttcttcatgagcacgcttcataaactgttaaaggatatgttttgtgcaaaagttttatgtatataatgtttataaaaaataaataaatccattttcaaatttatataataattaatgtttgattaatcatgtgctaatgacttatctgtttcacttgctgaaaaaaacgctaccaaaccgctgatccaaacatgtcaaatacttatttgagaagctagagatgagaatataaaagctaaaattagcttctagccttctacttacttagggggtgttggtccctctcccccaaacacccccttattcattttctaaattttgttactataggtggtgtttgggggggcactttatttttattctctctcactaaaattccataggaacttatattttatatcttagtgagagggtttagtccctcccacccaaacaccaccttaaaatccaattgaatctaattgtttcaggaagcttacaaattccgtgagaaaatgcaactgacaaaaactcgtcaaaacagggcgttccaccagggattggattgagcataacctgtattgatgcaaagaagccatcaaagaataacggcctcaaaataatcaattatatatccctgccacgatagactgagccaaaataaaaatgacaccggttcagatttggatgacattatatgggaacatggtgcaagtgctgggaagaacatgttgttatcttattgccatctaagttacccattgagattattaaaacagtcagattatatcaaaataactctaggaagagaatttaagaggttgtcagcattctctattcaattcaagccgaagaacgtttgtcagctgaaagtaaaagagaagtccgagagaagctaagaaagaaaggagggtactcaccaaccatatacacgaggaaaaaaattactcacatctataatatgatgtactcttatttattaataatgtaataatattattaaaattgtatatatttcaacaaaaatttgtctttaacacagtacaaggtaaaactaaaaatttgtttttgaattattctgctattcaatctttttcttgttatctcattcttctctagtttcaataataacattactagctccagccaccaaattttgcagctgaacactgctacctagttaagtgcacacgttatgtaatatatattattgataatttttatgtgagttagtaataattactgttaatgtccgattttcagattcagagagaaattcggccgaccgcaatagttcgaaggaggaagggggtaattcgtactttttccttgaaattttaagaggctgtcaggcactgttgtttataggattacaatgtccttgacagcacaagcatattaagaaaactgaaactgccaatttaaaggtgccagtttagattttactacctagtataatcgttctggtgcagtcattagatcaacggagaaagatgatcatttgtccacatggcatcacatgaacatggcttgattctcttgtgaatagttgtcaccaaatgaagacatcagaaaacaatgtttaaaattcagacatccaatatcgtgctttaatcatcagaatggcaaacaacttcgacatttccacatcatttcaaggttggcatcacaattcaatagattgtttgatctaagcaagctgaagctcttctgcagaaatagataccaattcttattccaactaaaaagtaactagtcccaatttcatgcacaaaacaagacaatactaaaattcttctgctggtacaattcagcctttcacaaggcaaaaaaaaaaaaagaagaaaagaaaagaaaagaaagaaagaaacaaatcctaatgaaactgattgtctggttcttccattccatgtcatttctgccctcttgacacaatcttgtacttgcctgtcaattgttgctgcaacaataaacacaaacaaaaatctcaaatcgcttaattagtttctgcaaatttcaaccaaaccactcctgaaacgcagcagcaatgaaaatttcaaaaatgaaaaattgtgtaccttttcccagagcttggtgtgctccaagcagaagccggcgacgacgccgccgccgccgccgccggccttggcctcctggtactcgatgcagaggccggcgtcgaggccgcaggagacgtggaaccctaggccgcacctgggctgcgagcactcgagcgcgcagccgccgccgctctcgcagacgtagcacgccgtggcgaagcggtgcgcggggacgcgggagcagtcgacgccgtcgcggccgtcggggtcgcggaagaacacctccggcaccagcagcgcgcacgcgatgtgcgcccaccgcgcgtccgtcgtgcgcttcatcgcgccgcccctcgccgggcagaggcagcagcgtggcggcggcggcggcggcttgttgcccttgctcttcttggcggcggcggcggtgcagacggagcagaaccagtcgccgtcggggatgaacgaggcgagcgggttgccgtagcaggaggcgtgcaccatgaggtcgcacccgtcgcagaacacgatggggtccgacgggtcggcgtcggtgctcccgcacaccgcgcagtgcacgccgttgttctactgttccacctcctcctccgccgccgccgccatggcctcttgcgttggctctcgcgccactctctctccatcccaggagtcttcttcccgtgctgcttcgttgagatcaatcgctttgcaagctttctcgagtgcttcgacttcagattgcttcgcactaatagcactgcaggattgattgcattcctgatctttcgattctctgcaagtgtttgatctttgtttcttcgacacttgctccttgatttcttcatgattgataggcttctccggaatcttgggcttctcttgaatcttggatgcttcagctcttgcataatcatcttccacaccatttgccacgctcgaattggtggtggcgccacgtttattggatccttgaggcttggcttctttaacagcggcgacgcgagctccatccgactccttggatggaggcggcgatggcgggagaaacggcggcatcacgcgcttattgctcggtaggcaaaccgagaccggagcggcggtgtccttcggggacggcggcgcgcgggcgctcttcttggccgggatgctcggagaaacggcggcgtctctcggcggcggcagggtgttgacgagatccttgaacgggacgcggggagaagcgtcagtagccgccgccgccgccgtcgcgctgacgcgcttcttagcagggaccgggatgctcggagaaaccgccgccttctccggcgccggcgccggcggcggttgcggcgcgtgaacacgcttcctgaccgggaccgggatgctcggagaaatagcagccttatccgccgccgccggtggcagagtgtcgacgcgcttcgtagtcgggactgagggagaagcaccactatccggcgccggcggcgccggcgcgtgaatgcgcttcttggccgaaagacacgcgggcgcgacggcatcatccaccggtggcgcataggcgcgcttcttagccgggaggcacagagcgaaaccgcccccctccaccgccgccgccgccgcataagcccgcttcttcgccggaaggcaaacggggacggccgccgccgccgccgccgccgcctccagcatcggcgggcacaaccgcttcctcgccggcaggcacggcgccatcccgagactggagccgccgacgtacttgaaccgcttggaaggcggcagatcacgcacgctcccgctgccgacggcgaactccatggacggaatcgagaccggagattttgctacacggggaagaagaagaggaggttcgcggcgggtgatttgggatcgaaacgaaccgggggtttaaatgactgaaaatttcgcggtcgaatcagcgagatggcgcgcgcgcagccgcgcagcgaagaatctgacgaaattttggctcggtgggaagcgaaatgtttgtaatttttgtttgaaatttcgaatttggggcgtgcgggctgcgggaaaattttgcgtttcgtttggatttcgcggcggcggcggtggcgccagcatttcgctcgattcgggccgtgggcttgggcctaattaggttgggccatgaaaccctaggtgggctcactttttttttcgccgatttataattataaaattattatcttctttttcgtctattgaaaaagacgagggcctagtagccatcgtcgatccccaagtctccgcggcggaggcgctcgcgtcgcgaccccgtcgccgccgccggcgatccgctccagccgaaccccgccgcaccgccgcggtagctgccgtcggcgaggtgcgtctcggcaccggactccaggaatcgtgctgctgctggaacgccgcgcccgctcagccggcggccgggcgtcccgcgtggctcgctggcatcgatcggggatccctcctacgggctcgccgtcgcggaggtttcaggggaccggcgcttggttggtaacttggtttcttttgattgtttaatttctctggttgtgatgtgtgctctagggtttaagccgagttactgggtcaggatgggtcaggatgatatatgttctgcttgttaggttcgatgtattgggtggatctagctacagaagataatcttcgatcttctgaaggggtggtatagagcacgaatcaaccccaactcatcatcatcaatggttctatagtagtgtttggtggttatcctattagtagtcctttataatgattggttggattgattcatgtgctcataattcgtgtatggatcataattttggctcttttcttttctgtaagaatcatgtgaaaatattgttaggcatctctaatataaggtgtttacgcatgggcgcttaaaataattaatcatcggacaattgaaggctcatcgaacatcaggattagtaccaattctctcacaggtggtaagaaaattgattttcttttgctacggacccatccaagcaccttaattggagatagaaagatagaggagaaggtgtctatttgatatttaccgacgagtccattcttcatgtggttcagtctgatatacttctcaggtgccttttaaaaaattgatgctctgcatgtgcattcacatttaccctgtaaacccaaacatgtaagcttggcgattgagattgttactgttctattaactgtttcatgtcatgctgtttcatttatatgttgtttcatttttgtttatgtcactaaggaatgtccacttctcacatttgtcactaattcggttcaacttctcatatatgccatcattccgttatagcacttctcatatttgccactttaaattgctcaaaggtcgaccatcattagcatatgtaagaatttccagcaaaccccaaatatccttcttgctactcacagttgcgcttccacagtgctgtcacccatgcatgcctgctgcttacaagatcagcaaaataccaagcctctttacagtaggaaggatagaggagtgtgttggagatgtcatatccttgagcactttcagattgtgcttcaggtgacagaaacagagtggccagaaagagcagagctggggtggctcagatgatggcatcgctaactgtggatgtccatgatctagcttcctccttacttcactctttccagcttcccacagctaacactgcatggatcctgcttgcaccatcccaatgctatggctatgttgcatgacaaccagtagtcggttggtggagaacaagcaggatttcaatcttttaaaacatcatgaatagggaaattgacagaatggcaagaatgaaatttggtttaacggaatgatggcacaaatgagaagccgaaagaggcataaataaatgtgcagtggggcagcctatatttcttcctttctatcctttgactaatggattgctcaaaaaaaatttgttatcccctttcccctatttaatcatttcgaccttttggcgcatttactgactctacaaatcaacaggacacgctctttcctcatcaatctgctgacgttttgaaatattggaatgcttctgtcgtcgaatttggttatctacagcatctgaattggttataacttataacttataagtggcatgtctgcgaaggttccaaggtactattatcacttagcagagttactgcagtgcatgcataatcacttggtgaaatacttaaactgtgttttaatttatagccagccagcatggttatagggcattcatgttttcattcatggtttagcactgcttttgtttaatctctacttgtgaagtaagaaagataaaattgttgggtgatataacattgtgatgggttgataaagttgccttcgtcaaacaatacttctttacgtctggcctgtagggcatcatctaacttgcttcacaaatttgaccataaggattaggcttttcataactgaaattggttgtctttcttacttctgttctcttgaccacatcccagaattaaatgaacatggcatctcatacgtttccactaggcatcatatacttatttttagatttacctatcagaaacacatgttatgcaaaatacaggttatgcaacttcataatcctgtttaagcattttcgagtacttgctgcagaaagtttatgtttttactgttttgatgcatgatgtgatcatgccgataatctgacatacagatttgctttaggcgcctagaagctaattccgttgggatggcagattgggctggtcttcagactgatatccttggtgtaattgtaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagttaccaagcg

SEQ ID NO: 34599 - DNA, 816 bp, Oryza sativa
  unsure (1)..(816): unsure at all n locations
cgcgcgatagtttgcccnnnnnnnnnnnnnnnnnnnnnnnnnnnnnnnnnnnnnnnnnnnnnnnnnnnnnnnnnnnnnnnnnnnctgttgaaggtaaccatggccagtgccaagcccgccgctgaacagaaggctatggaagggggcgagcaggaggctctggatgaaatggagaagaaggtgcacaagtactcgcgggggaaggctgcttaccttggggtgagactgctgctaaactacttcttcttcaaaaatctgcgtccctgtttgattcacatgtgtatgtgtggtttatgttgggtttatcagactcttcgcgacaagaaattgaaagggcagctcgccgcaagagagaagctctatggacactccgccaaagccgccgttcagaccgagaaggtgcggttgttgattcttgtaatgaatgtttctgggagcatatgcaacacaatgggagaattgagaatctgtcgtttgttgatctttatttttgcttccaattttgcagtggctcttgcctaccgagggcggctatttagagcctgatgatgatggtctggagaagacgtacagatatcagcaaacttcgctccgggaggacgtggatcttttgagttcaagaaagccatttgatatgaacttaccttgtaagtggctaaatctgttttttttgctctttgaagctgtgatatcataggcggcttggtaaatcaagccctaattttttcccctgctacattagatcttgataaatgaaaacccctatctcaagaaaccatcatcttgcttaagttaatcattactaatgttgggtta

SEQ ID NO: 34600 - DNA, 1283 bp, Oryza sativa
  unsure (1)..(1283): unsure at all n locations
ncaagtaataaggtacccgtacaaagcaatcgatctctctctctctctctctctccccccttttctcccatgtcgacgacgttattgccgtgctaggtcttgcgaggaaggcgatcatcgagggaggccgcagatggggaataagggcgaggcggcggcggcgatgggcgccatggggatcaacgacgccggcaacaacacggcggcggcggcggcggcgcagcatcatctgggggttggcgcggtgaggatgaagaaggttgggggaggaggaggaggaggagggaaggcgctgcggaaggtgcgggagccgagattctgcttcaagacgatgagcgacgtggacgtgctcgacgacggctacaagtggcgcaagtacggccagaaggtcgtcaagaacacccagcacccaaggtaaactaactaactaacatctctacacatattgatcgttttgcattatgaatcaaaatcaatcacaacatgcatgcttaattacatctgaatcagacatttatacgtgtgaagattttttttcaacgactctggtctagacggtatgaggttctattgatagagcactaaaaaattataagattacaaccctgtaatatcgtaatcaggaaaaataaaaaatatataccaccacccacacaccggcaacaccaacacataaaaccaggagaaggctagcatcggaccggccgccactaagcgtgacagaccgccactaagccaacaatggcacacagccgagatcgtcttaaactcgacccttacaaccaacacaaagtccaactctagtcaagtcttcaggatttaggaagagagggtgaagatctcatgtgcgaattgattgattaactccaatttatcgcaaataaaaatgcatatggatgttgcatgatcgtttgcctgacgtgttttgtgaggaattaaggcttcagctagagcttctgtaaatacttctacctccaaagtttttcccccatcataatgttctaaacttttggattgagaaataataaatagcttaattggttttatatatctcactggctagggcttttgaactgccattcttcccatgcatggtgtgtgacacttttgctagatagctagccaataatcaatggttcctcgtagaaaaatactacctccttccctaaatgtttgacaccgttgacttttttaaacatgtnnnnnnnnnnnnnnnnnnnnnnnnnnnnnnnnnnnnnnnnnnnnnnnnnnnnnnnnnnnnnnnnnnggggtacataagccgt

SEQ ID NO: 34601 - DNA, 800 bp, Oryza sativa
  unsure (1)..(800): unsure at all n locations
ccgtgatgatagacgcccannnnnnnnnnnnnnnnnnnnnnnnnnnnnnnnnnnnnnnnnnnnnnnnnnnnnnnnnctatacaggatccccggattcttttgatgaagctaaatttctggtggagacacacaccatgcctgcatctagcattgcaagaattcttgctgattcctttctaaaggtacaccaactacaccatcctttaaacacacttcattttggaggaacagcaaaggcattctatatattgtctaatgtgcttttaatatttggcaggggcttttagctgcacatcgtggaggttatctggattcccaaaaggaagaaggccctgcacccctgttgtggaggtctagtgacttcttgaagtgggcaaagctatgtccatcagaaccagaaattggccatgctttgatgcgtttggttatgactggccatgaagtaccacatgcttgcgaggttgtatgatcttctaaattaccaagacaatactgatttgtatacatgcaaatgccatcttctaagaaatataacttatccaaacagggttatgcaaagttcatgtttgacccttgatatattatcaaggtataatatttaattagtgtcagtatgattatgccataaatttgttaatttcaaaaaaaaaacatgcacatcagttttatttcactcataaagtgactaacttatgggactcaaagtacatgcacctcacttgatgaggtgtcggtgtctaaagggtggcttatggattatggcacaacatcacttataaaaaccacgtgatttggagtat

SEQ ID NO: 34602 - DNA, 935 bp, Oryza sativa
  unsure (1)..(935): unsure at all n locations
taaaagagaaagaaaaaaatggtatttctagttggggaataaatttccccccaacgaccccttaaatcgagatgattatttgattttaagaaaggttttttggttttcaagacaaagaatgaacatggcaaatcacggcgcttccggtgttggtgttcttcttggggngctttaaattaaaaaccctggttttgggggttaacccatttctccagcacacctttgggccaagaaacatactaatacatcacaacgatgttcacgaaataagccaaaataatccntgttaattaagctgccagatgaatcaccaagaccaacgtgttctgaattgaaccaagcatccccctcctgtgcgtgggtgcgcgtgattcttctccacccccatatatatatatatatatatatatatatatatatatatatatatatatatatatatatatatatatatatatatatatatatatatatatatatatatatatatatatatatatatatatatatatatcactggtggagaaaccctttgtagtcccggttcctaacccccctttagtcccggtttccaaaccgggagtaccaaccgggactaaagatcgctatctttagtctcgggtgaaaggctgagcaatctttagtcccggttggtgttaccaaccgggactaaagatcgtgacctttttttttttgcatgcccctgttgctgcatggtttatatatatatatatatatataaaccatgcatatatatgtttcaatacatatatatgcatacatatatatatgtatttatacatatatatgttatgcaaatgcatatgtatatagatatatatatgaacaaaatatatttacattatagaaaatgtgtacacatgcatatagggaaccgagctcgaattcgccctatagaagtagtatacctatcg

SEQ ID NO: 34603 - DNA, 861 bp, Oryza sativa
  unsure (1)..(861): unsure at all n locations
ngcggtggttacacttctattggcgaattcgagctcggttcccctatgcatttatgcaaccgtgctccagaatgatgattaagcaatagcattccccagagtggtcaccagaggaactgaatctcagcacgtaatactgctgtaaatgtagtgctactctatacttcagcactgacattaacaaggcaccaacagccgacggctacaccgttggggtcacatgcacatttgaccaacatatcacaaaagattcagaacaaaatttgggtgcttacttctgtgcaccattgcctcatgtgcaaaagcctatggttcacaaggaagcagatatgacatttgccagctacacgatacaatgcacactagtgataaatatgaggttgcagcaaacaaaaagaaaaagaaaattctgtgctccattgtcactgcctactctttgcgaaccgctgcaaggcctttggcagctcaatctcctcgctgacccgctgtttcttgtcaggcctcccatcgttttccttgtgttgctccaggaacggccttttggctttcaaaacttcttcctccctcttcttggcccgcttgctgggcttgctcctacccttggtcttcttcttgaactcgatgctcttggcagcctctacggcgtcttccatctcctnctcaatctccttcttgggcttcttctctttcttccttgaaggtcttacggtagctatcatgttcgggataaagcattatcgtctctggctggagcttngtaagcagggaattgcacctcttctccttctctgctggaagtctcaacggggtgtcaacaaagtattcaagntnggctcaccagatccagaaacagaatgcaga

SEQ ID NO: 34604 - DNA, 819 bp, Oryza sativa
  unsure (1)..(819): unsure at all n locations
ccgcatatacgctcnnnnnnnnnnnnnnnnnnnnnnnnnnnnnnnnnnnnnnnnnnnnnnnnnnnnnnnnnnnnnnnnnnatagcctataaattttcacatttatgcgtggcatatagcagctcatgctccatattgaaagacgatggagctaatgcctatattcatgctgaaaaaatcatgtgtattttatgaggagactagtgtccatttagagctacactttagaagtggttgaaattcggtgtgaccaaataatgtatatgaaaagaggagactctagtatgtattacacatgagtagttacgtaaagtgattggctagtttaaaattatggtgcgcgtgtcatatctttcaatgatattatgcgagaacatctatgctattatatcatagaaaatgtgatgatgcttgctgcccaatcagcacgggccaccgtgctagataaacgtgcattaacagtcggatgtaaagataagactgtacgtactagtgcactgaactcctatccatactactatgatatttcatgagaccgctcacgctctctagtccatttaatcatgattaaagaactctaacccgtctcgctctcttggataggtatgagctgaaaccgatcgaatattgagatctacttctagagctactaacttttgcttaataccccaccggttactgaaaactcgtctacgttatattactaggatacgtacaacatgcgctatatgtaagttattatcaccagccttactaactaacttcactatgaatacggtgctaacctaaccactgtactgcaatagtagtataatattcc

SEQ ID NO: 34605 - DNA, 795 bp, Oryza sativa
  unsure (1)..(795): unsure at all n locations
agatcaacaatgggattttttggtaattaaggttagcttttattttcctactccttggaaagaggtatctccttcaattttataaattcaatccgggggttgcacatcagttctgtttacagctcaagcaatgtatgcgtccacccatagagcgctaggggcacggccccctgaagggttaatctggcgtcagcggctccccccctaaaaacgcgtcgtccgcttaatgacagaggcgccggcaagttcgtcgagctcgagactccggcataattcggcggcatcggctcgagattcagccctagccagtggcggcgaacatatgtggccaagaatgacagatcggccaataacgtttaagtgttggttatgaagccgagtgcgcgccgggaataaagatacccctggatctttactcccggatgttgagaagaaccgggactaaagatatcaagatatctttagtcccggttattctcaacaaccgggagtaaagatccaggggtatatatattcccggtgcgccctcgtcttcttcaccaacacttaaacgttttcggccgatcgatctctctcggcctctctccttcgccgccactgcctagggcaaatccccgcgccgacgccgccgtatctcgccgtcgtctcgagctcgtcgtcctcgccgccgcctccgcctcctccgctgccgccgcatctctggggtgagagccgccgccgccagatctcccttcatgnnnnnnnnnnnnnnnnnnnnnnnnnnnnnnnnnnnnnnnnntttactattcaaccagg

SEQ ID NO: 34606 - DNA, 819 bp, Oryza sativa
  unsure (1)..(819): unsure at all n locations
nccatgaacgatcatattnnnnnnnnnnnnnnnnnnnnnnnnnnnnnnnnnnnnnnnnnnnnnnnnnnnnnnnnnnnnnnnnnnnnnnatcttggcagatcgttcaggagccttctccgtcgaacgagggatatgaggctgaggctgcagttggcaactcttgcaacgggatttagtgacgttcttgacgcatgcaatagtgttttggacaaggttccggagaacgctggccctctaatcctgaggaagggccatggtggtacatacctccctctcatgtaaatccttccattttgatccatcttgttcaactttcggcagactgaatcttacaggagttcagtatatagtgaggtgagaatttttcccgtcctttctttgggcctgcgttcagcattctagttttttgatacatatggatgaagccatgggagatattcggtttgtatatatacaagcattctgagtggataagatgaacatagccgattgagagtgagtttttgcggcttcagtcggtggaagttttcgtgtgggttgtagcgccgtactcgtggtgcctgatgtctgtagtttggtgtaaattccattgacccaaccatgaaattttgtacaattttcttcacgtcacttatgctttacaagatactcattgatatgccgggtggctggatctgaattcatcgaactgcctgaaatctgattccttcaagaccaattgtgagttacaagtttggcgaattttgacccccttatcctggcttggaaaaaattgccctttacaaaattggccctttgaatttttggaaaaaatggcct

SEQ ID NO: 34607 - DNA, 1173 bp, Oryza sativa
  unsure (1)..(1173): unsure at all n locations
cagcgcccattannnnnnnnnnnnnnnnnnnnnnnnnnnnnnnnnnnnnnnnnnnnnnnnnnnnnnnnnnnnnnnnnnnnnnnnnntcaaatggcagattattaatccgtgcatcacaaaactaattaattagactggagccatacacgtgtacttcaaccatattctactaatcatatttgttcctactattagaccgtgtcagcatggtttagataaacaaagggtcggtgaagcttactagtgacaaaatagtcatcaacaccctgacatttagttaaaatattgtcgttagaacaactcaacaacatatggatattgcaggcaatgccagttcacatgatctatctctcggtctctccgatatttgaaacatgaatatttattttctcgaacgcacaaaaaatttgcacgtcaatatattagcaggaaatgagtttttgttatacaaagcaatcagccagactggcttatgcctaaaaggggggacttgaagctaggaactactacgacggttaaaaacgcaactccaaacagcgggagggggcagagccacgctacactaccaagaaatcccccaaaaaaagcaacgccgactaaagaccacagctggccctccgaacggatggactccagaaccactgcgaccgaagcgagcgcagagtcgaaaaccctgaagtttcgttcctttctatatatatatatatatatatatatatatatatatatatatatatatatatatatatatatatatatatatatatatatatatatatatagatatatatatatacatatatatatatatatatatatatatatacatatagatcaatatataaatgtaagcacttgtctttttatttagaaatataaatactttggtgtacataaacggcacaggggttgttcaaattaatgtcatttcaaaacattccattttttaaagatggcgaaaaatacctccatttagttttttttaccacactctagtaaataggaaatacatgagaagatctgtgaaacttaacgattttgctcatatatcaaaatttggttagatttgttttggctacaaactgaacataccctttcattctaaacttaagcgctaacttttcctttattacagtcttacccataaaaaaaacttaaaatttatccggcggg

SEQ ID NO: 34608 - DNA, 2362 bp, Oryza sativa
  unsure (1)..(2362): unsure at all n locations
ngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacctgtaaacttgcaatggctttcccagaagtacttgcgacatcaccatttagtataacatcttctgcacatttcaagagtggtcttgcaaaaccatttttcctgtgtgatcttgaagcatcctttttttccaatgcaccaccatctgatgagttaatgttcttttcctcaatgggaggttcatccttttttactggtgtaagggtcaggtgagcttctagaggctcagctttgttcacaatggaggtcactgttttaccatgcaagtcaatcaaatggtaaagggatgatgccctggtagaaatctcagcatcccacttgcattgcttcagcgcagacagtgcatttaagcatggcctggatcgacgaaataactcagaaacatgagcagcaaccatagctgctgcaacaatctcatttgaactataactccatgaagtaccaacagatgatggcttcaaggagaacagagcttccaagatgccaagtattctacgagtatgaagaatcgctgagctaatgctattgtgtagctcgttactgataccagtggtttttccaggtatgactatctttatggagtccttcagatttgaatggttcccattcttggaaataaaagggaacagctggagctcacaagataaggcacaaacggctgctagaacgtatgagtcgaatgtagcaactggtccttgtctcttcttacatctgtgttcttccattggttaatctcgaatcatttgtgacctcctcagaggaatgattatcactaccagttggccttttacttcccccaggcaaagcttgatgactgacgcaaacagttaatactacaaatagtaatctggacgcaaggtccattgaagcacaggactccacaaagagtgaatgtatcattgttcggagttcaacaacagcaaggttcttagattgacttcttggtttcctggattgttcaaaggtttctgatggaaaagttcttctcagtatagcttcaactgttgccacaaaaattctcataaggcatgcttcagatggactcccacgaggtaaatactcaaatactttcaacaatggcaagtataggctccatgacaaagtaggtggctgaagtggagcagctacaacaatttcaggcaaatcaactgctgatgaactcagaggtagcaaaccatacgcagcctcccagatggtacatattctccactcaacatcgggaccatgagcacatagcatggaagcaatgccttgcgcagtggcatcaatagtggcttcagatgcaggaacttccagctttgtgcagttgaaggagcacatatgaaaatataagtcaatatgaagctaaaacatgtagggtgcatatattttacgacataatcaaattccaactttggtaggtagcaatatctatattaacttgtttgatgatacctttaaaacagttttaacataatatcctagcagtcataaaatatacaagaatacatcatagctccaaaagaactgatataaacttatcatagcatgttgacgacaagcatacagagactcctaaaaggttacaaaaaaatgaccaaaagatttaattttctattcaaaacaatagaggctagacaaatctagctttgcaatattgtagctaaactactttagtcatgatgatgtaatctggcagctaacagtacttaatgaaaaaaaaattcagaacagagtctggataatgtagccgtttagtgacaagcctattagcatatatttcgagaaaactgataaaaaggaaattgaatacatcaaatacagaataggtagcaagtaggtgcaggaaacactgcatacctgccttttctattcaaaacaatagaggctagacaaatctagctttgcaatattgtagctaaactactttagtcatgatgatgtaatctggcagctaacagtacttaatgaaaaaaaaattcagaacagagtctggataatgtagccgtttagtgacaagcctattagcatatatttcgagaaaactgataaaaaggaaattgaatacatcaaatacagaataggtagcaagtgggtgcaggnnnnnnnnnnnnnnnnnnnnnnnnnnnnnnnnnnnnnnnnnnnnnnnnnnnnnnnnnnnnnnnnnggggtgcaatacaaggcg

SEQ ID NO: 34609 - DNA, 9055 bp, Oryza sativa
  unsure (1)..(9055): unsure at all n locations
gggggccattgcgcacatattttttctcgcgtcacccccgaactgtggggaaaacagtgtaccgccttttgaatgagctatacccgccccccacacccgcacgcccaaccacacagtgttagagagagagagagagaaagagagcacgaaaccccccccccctccccccgcgcgtgggcagattcatatatacagatagcgagacagttttctcgtctgaaaaagggacagtgagcgccacacaaaaaatgtgagtgtgctctctctctagcccccccacccttcactctttatgtttcngggtagattgttgtgtgtgtgtgtgtgtgtatatctctctcacacacaaaatatctatgtctatgtctatatctatatatatagctgtctctatagagcactcacgcgcgcgcgcgcgcgggtacgctctagagagtcaccgatatatatatatatatatatatatatatatatatatatatatatagaaaggaacgaaacttcagggttttcgactctgcgctcgcttcggtcgcagtggttctggagtccatccgttcggagggccagctgtggtctttagtcggcgttgctttttttgggggatttcttggtagtgtagcgtggctctgccccctcccgctgtttggagttgcgtttttaaccgtcgtagtagttcctagcttcaagtccccccttttaggcataagccagtctggctgattgctttgtataacaaaaactcatttcctgctaatatattgacgtgcaaattttttgtgcgttcgagaaaataaatattcatgtttcaaatatcggagagaccgagagatagatcatgtgaactggcattgcctgcaatatccatatgttgttgagttgttctaacgacaatattttaactaaatgtcagggtgttgatgactattttgtcactagtaagcttcaccgaccctttgtttatctaaaccatgctgacacggtctaatagtaggaacaaatatgattagtagaatatggttgaagtacacgtgtatggctccagtctaattaattagttttgtgatgcacggattaataatctgccatttgagctgatctaatcttgcaagaatttggaatcaacaatccccactgtctttttcgtcctgtttattgtcacatcgaggccgtaactatcagagaaattgtgctgcaatgcaaaacgactccaagcctgacgaacctgatgcgtgatggagactccttggaattagctgagaaggttttgcttcactgctactgtagctatagcattacgtgtttctgaaaaaaaccaaaatcataaagacaaaaaagataagaaaatgaccaaggggagagagaccacacgatcgagccacaggtgggtgtgaacaatgtgtaaggagaattcatggaaatattgcatgttcacaaaaagggcagtagggaaattaaccaacatttcgttacacgtacgtatgaaactctcacgtaggaaggtgacggtgtgcaatgtgacgatggttttgaagacacggttttatttatggatcgaatacgagagttatgtgtctccaaaattatggatagttctggagacactgtttcgagtacatagaatgtacgtgagaattcctgcaaagatatatttttctgtataaattttgctcatatttcatatagtactcgtcacgtccagaaaaatgtgtttctactactcaggatatggtttagggtttgagtgaaaaaagtatatttatatgtgactacaatcttgatcttagaggtgtttggctctatacttcagctcaaaggccgaaactcatttaaaaggttacaatttggttttaaaagaatttttgtcctcactttttattactaactctttttcatgactaataaaaggaaacagaaaaggaatatctaataatactactcccttcgtcccataatataagggattttgagtttttgcttgctctatttaaccactcgtcttattcaaaaaatttgtgcaaatataaaaaaacgaaaagttgtgcttaaagtactttggataataaagtaagtcaaaaaaaataaataataattctaaaattttttgaataaaatgagtggtcaaacagtgcaagtaaaaactcaaaatctcttatattatggaacgagggagtaccattcttagaaaccgatcgaattttaaaaattcgaaattagcatgtgaatcagatccttaattatttaatcactatatatagaatcacatgcctagctatttaccctcaaaaacaaaaacaatcatgcacgtgcgctgaactttgcaccgtgtttacgcaaaagcgattgaattgacgagccgttacattttggctcgtccagtgtcgtgttctaacggtagcaacgtggttgcctgaagtgagggtccgctgctcactgacatatgggctccagtactacagaggatctatattggttgcttgcattgcctactacgcctttgagaaacgagccgtcaggtgacgtgtctcccagggatcagtgagtccagcgcgcgcggatgtgcgttgccgagtcaactgttgcgtggcagtgacatctactccctccgtaaaaaaaaaagacaaactatgggtttccatgtccaatatttgaccgttcatcttatttaaaaatatataaaaaaaaattaaaaagacaagtcacgcataaagtattaatcatgttttatcatctaacaacaatgaaaatactaattataaaaaaaaatttcatataagacaaataattaaacgttggacacggaaatccaaggtttatctttttttgggacgaaaggagtaggctgccaggtggcactgagctagaagcagctactgcactgagtataaaaatggaatatcatgtacatcacaaaatataaaaacttataattggtaccgaatgtgacacacgtagtactatgaatctaaataattcctaataataagacatattttagtactattataaatctgaatagatcatgtcttatatattttgggacaataattgtttagcgtttgattacttgcttttctcaaacagtggcaattttgatcatgcatgtaagccaagatgagaatcactagttgagtgtaattattgagtactttgagcgagacaaaaataattaagaactgaagaaagtttttttcgtgaacgcaattaagaagaaagtgacgtggagatagaaagtagagagaggatcggagggaaaaaaaaggtaattactacagattaagctcgtgttaaaatcatgcagaatgatagtgatatctaccctcccatcatttcttggagattctgctgcctgtaaatatttcaaaaagggttccatccaactacattacatgcatgtttcactcatggtctcagggatattataattaagagaatatgataccaaaagctgtttttacaagtaagttataggttaatttcagcataaagaacgttgcaataattcttttagacagttaaacttctaagtttctgatctgaagacgtattcgcaacattttctctgaagaaactttagagagttactagtagtatgaactatgcatcatgagatgctgcagttagcaaccgcaacaaaaacacaaataacaaactaatatatacttaggagttcatttagaccttaaacataacaaaaagacacaattagtgacctgattgattctgtccatgatgaggcatagatgatgatagatcatagattgaggttggcagcaatcaactcaactggtacgaagaacatggctggagttctagcttgtctccagtgtccagcagagcaagtcaaacacgcatagcaaacataagattaaacaaaaaatccccaggacaataggtgtcaatacgatgttctaaaatatgtcatctctttgtcattattaatccccatcagtgttgtcacctaactgatcgagccattaacagtggattctgcacgtaatacggcgagctcaaaatcacactgacagatcatagaatgattaattaaccacgatttgtgacaaaattgttgttactcatttcattattggagctaactaatggacttgcaaccaactgattgtgatgccaaactttataacaaaccgttcgaaatgtcagagccacactgaatagcaaaataccatttctactgttgatgtcagagttctttggatttagctccaactaatataattctacgaatcgatatgttatcataaagcaattcaggataatcagttccacagaccaacaaatgtcaacactgccgaccaaacagcgcagaacacgcggaatcaaaaaagaaaaagacaagttctttgaagcaattactaattcatatccagaaacatcagctgtagtattatggaaatgattaggtaggcatcagtgattcagtggtaattgcgcggtgaaagttgcatcaaatactggtatggtcaaaactcaaaagaagtaatgcacacgcgtggcttgggttaggcatagctggctggaaaattttaaaaaatagagcgatttattagcacataactaattaactatcagcaaaaataatttgaaaaataaattactacaatttttaaagttacttttgatagaattttttttaaataatacatcgtttactgtaacgtgcgcgtgaaaacaaagtggtcagtttgataattttctcggatgaagggcctgttcactttgatgaaaaaaaaccttactaatgccaaaattttggtatagttgccgccagaatttttataggatttcttatatagataccaaaatttgacagaaaaataaatgtaaccactttttgacaactttaccaaaatttggtaaggttgaaaatggcatcaaagtgaacaggcgaaatgaggcagccgggaggcaacctgctttgtcggatgcccacatttttcccattgataatattatattctattattctattctattcttgtggtttgcttggcgccatcagatggcaatgcgtttgtttcagagcttaaaaaccaccatgtgctccgttctcttgtcctgcctatctatctaacaaacatatcactgctcaactcacgggtgctcgtgcaagaggcccctccattttcaggcacctagctagctcaggccattgaagaacgcatccaagaaaggtgcgagaaagaacaggagcagagactgatcaagattcagtgattcagaattggagagggaaggagagaagattcagagagaaacagaagcagtgtagatttggatttctagtccgttttgtctgaatttttggtgtgtttgaggcacgaggagtaagatggtggtgcagaagaatcagcggaagccaggagaggtaggtgaatgcttggttcagttcagaacaggttgttcttggtgattcatctggcagcttaattaacagggataattttggctaatttggtgaattggttgtgtgtttttgtaggcttcttggcccaaggttgtgctgaagaaatggctcaacctcaagagcaaggattcggagttcaacgccgacgaggaagacgacgacgacgggagcgacgttgatgagcaaggtacatactgtttctgaaaaacaaaaaacctcttctcagatcaaattatccatctgaatttaagtgttcttgaggagaatttagttaccagtcaggagtcacattttttcctccttctgattggttcggtttcaagcagagaactgcggctgcgacggcggcgaggagcggcggcgggccgacggcgatctcgccggtgagtcttatgtctatgtgacggtttgatgacattcccatgtttgcgtgttgctcttatcctaaaaaagatggggaggagaaaagtgcagctttggactgttcagagtcttcagagtgatagtgctgttgtttagtgctttgcaccaagcttccatcaaatcttgtctccaatcacaacaatggcttacctacaattgctcaaagtggcaccttttctttttggattttgggatccattcaactgacagtaccaaagttgggttttgtcccaaaatcttcttggcagtaaaaaaaaggttcaatttctagaagggaaaagaagctactagtacaaactctgtgttgtctggccaatgaaaatgtggaatccaaacaaatcaacattttgtactccaaaaaataacattaggaaactgaattaaaaaattatttttgagaaaatgttacattccaccattgctcttttttttaaagaaaaacttccattgcagaattggcgtttttttcaagctcaaggctcttttgaaacgcatggattttacagaatagaatataaatccttcaaaatgttgtgaggtctttatcttgtttggtttttattagtttgtatctgattttggttttgttactttggttacatactcactgtgcgagtttatttttgtgtgaaccttataataattggttgtaactcattgagtaaagacccgaatgttttattccatgattaaaaaattaatccttcaaaaatccctcaatttcaaaggaggtctcaaacaaaaataaggagaaaaaaaaagttgtacagagttgctcatcacaccctaaccatttgtaaaaatgcccagatgagaatgtggagggcggcgcgccgtacaggctgcggcggcgaaactcggagacgctgcgcgcgcagtacatcaacaccaaggagctcaagctctgcgtcggcacctggaacgccgccggcaaggtcccccccggcgacctcgacatcgccgactggctcggcgccggcgccggcgagcccgccgacgtctacgtgctcgggttccaagaagtggtgccgctgaacgccggcaacgtgttcggcgcggaggacgcccggccggcgcaggcgtgggaggagctcatccgcagcgcgctgcggcgggcgcggccgccggcgagtagtcggccccggtacaagtgctacagccaccctccctcgccgtcgcgcggggacgcgacggccgccgccgccgccaccgatgacgacgagctcttccctggcaccgatacggacacggacaccaacaccgatgacgactcgctcttcagctcgccggcggagtccgagcagcagaacgtcgccgccaccccgaggaggctgaccaggctgaaccatttcactgccgccgccgacgccgccgccgccatggacgactccggcgacgagcatcagcagcggacgcttctcaagacactgagcaggtcggacagggtcggcctggcatggccggagcagccgctggacctgctcgccaagcacgccacggcgacggcgagtaccaccatgccatcgtcaagatccttccgaacctacaactcattcaggccgtctcgcgccgccgccgccgccgaccagtcgaacgacgacctcgccatgatcgccgacctcgtcatggacctcgccgcggcgcgcaagaggcgttcgccgtacgtgaggatcgtgagcaagcagatggtgggcgtcttcctgacggtgtgggtgaggcgcgggctgagaaggtgcgtccacaacgtgggggtgtccaccgtcggcgtcggcgccatgggctacatcggcaacaagggcgccgtgtcggtgagcatgtcggtgtaccagaccatgttctgcttcgtgtgcacccacctcgccgccggcgagaagcccgccgacctccacaagcggaacgccgacgtgcaggagatccaccgccggacgcacttcgccggcgtcggcatgccgagaaacatctatgaccatgagtaagaagctactaatccgcatttttttaaaaaaagattcaaagtgcatccaaatcatatctgatctgaatttgaatgtcaattgtgattttctgcaggagaattttttggttgggtgatctgaattatcgcatcgacgtcgcgtacgagagagcacacgagctgatttcgacgatggattggactcagctggcagagaaagatcaggtacacatctgaagaacaagaataattagcatgagagcctcatcgtttgccctatatagaatcgtctgttacaacaaaaagttcaattctaaaacttaattttaaagttgattataaaatattttaaatagtttcttctagcattgggttttaagtgactaattctacatgtataaaagttttatctataaattttgttttcgtcgctaataaaccattttagcttataattagctcatagtcaatcgatcgggccctaaagtttctgtgtggcacatctgaatcttgctgtttgatctgaatctctctgattattatgtctgaataataaatcagctgaagcgagagctaaggaagggtcgggcgttcgacgggtggacggaaggggtgctggagttcgcgccgacgtacaagtacgagctcaactcggccaagtacatcggcgacgaccagcgcggcggcaggagaacgccggcgtggtacgttcgtgcagctgctcactgcaaaatgcacgtcactctatttcatattataagtcgttttaacattttcttaagttaatttttttaagggagaatagctaatatggtccttaaagtttcgctcctggatcattttagtccttaatattttatattgtccaaacaagtcctttaaatttatcatgtggactgatatagtccttggtcccaccaaaatcgccacatggacatgccatgtcatcattcatgcaaaatctatatgatttgtccaatttacccttacgcataggaaaataaaaaacaaaaggaaaaagttaaaaaaaaatacatggtatatgtaagagcaaaaatatacctcaaaagggtgaaaaaaaagagtatttttttcctatggctatgtctaattcacccttatatttatttttctattatatacgtaagggtaaattggacaattcgtcatagattttgcatgaatgatgacatggcatattcatatgataatttggtggaccaaggggtattctatgcttattgataaattta

SEQ ID NO: 34610 - DNA, 5801 bp, Oryza sativa
  unsure (1)..(5801): unsure at all n locations
ccgcgatagacattctacgttcnnnnnnnnnnnnnnnnnnnnnnnnnnnnnnnnnnnnnnnnnnnnnnnnnnnnnnnnnnnnnnnnnnnatgccatgtcatcattcatgcaaaatctatatgatttgtccaatttacccttacgcataggaaaataaaaaacaaaaggaaaaagttaaaaaaaaatacatggtatatgtaagagcaaaaatatacctcaaaagggtgaaaaaaaagagtatttttttcctatggctatgtctaattcacccttatatttatttttctattatatacgtaagggtaaattggacaattcgtcatagattttgcatgaatgatgacatggcatatccatatgatgattttggtggacccaaggagtattctatgccttatgataaaatttaaggatttctttggaccatttaaaaggttagggactaaactgattctacagagaaactttagggactaaagtagctattctccctttttttaagtttgattaaaatgataaaaaaacatagcagcattttacaattttcttttgctcaaattcgcacattttgcgtgtgtaatgctgcgatgagagtgcgattttctgtttgtttgtttgtttatgaattttggatgatgtgtatgatcgatcaggtgtgataggatactgtcgttcgggaagggggtgaagctgatgagctacgggagggcggagctgacgatgtcggaccaccggccggtggtggcgacgtacgcggcggaggtggaggtgttcagcagcaggaagctgcagagggcgctgacgctcacggacgccgaggtggaggccggcaccgtcgtcgccgtgccggaccacctcgccggtttttgagggcgagagaggatcggtttctgcaaggataacttgtagttgtagcgctccatgtgtaaacactgtaatcggctaatcgcccatggccgtgaaggattctcttctttctcaagctcacaatccactggtgcatttgccattttgcttcatactgagtaaacccggagaaacgttcgtgtaagctcatgtatttttttttcctcgcaaaaacaaatctcatcaatttaacatcagtgtagggaaaggtaaaaattatataacgacagtatatgaaaagtgtaagctcatgtattttttttctcgcaaaaacaaaatctcatcaatttaacatcagtgtagggaaaggtaaaatttatttaacaacagcatatgaaaggcaaacaatagggaaaggtaaaatttatttaacaacagcatatgaaaggcaaaaaatactgaaaaaatgcaccagcaaggaatcgaaccagggtctgtaccgtggcagggtactattctaccactagaccactggcgcccttgatgaaataaaactgactggtaatttcatatagtttgataacttgcatttgctccttattgcaggatacagatttgttgtgttgctttcaaatatctaaaggtttcggtaactatcaggtagtgatgcctattgctgtagtgataaacagagaaacaccatcagccaacatgctcccttgtacaaaacgcaagctgcaaatacaactgaacgagtagctatgcatttatgcaaccgtgctccagaatgatgattaagcaatagcattccccagagtggtcaccagaggaactgaatctcagcacgtaatactgctgtaaatgtagtgctactctatacttcagcactgacattaacaaggcaccaacagccgacggctacaccgttggggtcacatgcacatttgaccaacatatcacaaaagattcagaacaaaatttgggtgcttacttctgtgcaccattgcctcatgtgcaaaagcctatggttcacaaggaagcagatatgacatttgccagctacacgatacaatgcacactagtgataaatatgaggttgcagcaaacaaaaagaaaaagaaaattctgtgctccattgtcactgcctactctttgcgaaccgctgcaaggcctttggcagctcaatctcctcgctgacccgctgtttcttgtcaggcctcccatcgttttccttgtgttgctccaggaacggccttttggctttcaaaacttcttcctccctcttcttggcccgcttgctggctttgctcctacccttggtcttcttcttgaactcgatgctcttggcagcctctacggcgtcttccatctcctcctcaatctccttcttggtcttcttctctttcttccttgaaggtcttacggtagctatcatgttcggattaagcattatcgtctctggctggagcttgttaagcagggattgcacctccttctcccttctctgcttggaagtctcaacggggttgtcaacaaaggtatcaaagtttggctcaccagatccaggaacaagaatggcagaaaggcccatggagtgaccaatccccagaacatcctcgtaaggacggaacaaaaccttcccaatctggtatccctttaccattctatgtttcatataaattttataatcctgtcccccggtatccctgaatatctctacttgagatccattgctgcaggccaacaaacctttctggctgaaatccagggattgtgcacgtgcagcataagaatttataacctcatacttcctgagatcccaaatcttgaccttcctgtcaacacctgctgttgccataagatgaccacccctgtcaaatgcaatggctgtcacagggccactatggcacagcattgtgacaaggggtttcacactggttggcttccacatggtaactttgccaccagcatgcccaaggccaataacagcattgtaaggatttagccgcataacatcagtacgtcccagacctgtcctgtaatttgcaaccatctcaccagtgcttatatcttggtaatggagctgcccaaagctgtttattgatgacaagagaaagtgcttttccagaaattggagcttcaacgatttaccatgttcctgtggacacaaaacattcagaatcctaaacaagataagatatacattcaaatctttactgaactttgagagataccagtataccacatcaaagcatagacatacataaagtaaaaattaaatagctataaagttttaactttcctgcatgttaactgaaaacatgtgaaacaacaacaaaactaacaatttctcaaaatcatcaatagctaggcacattcattcagaaagccaatgtgtttacatcataattacctttaagcagtgaatttctgtgccatgtcgattatatatgtaggggtacctgttaaaagaatatcacatgaggaagtctaaaaattacatggaaaggtaacataaaatgtttgacaatatttggagttatgcccacaaatttcatcaaaaatagacgtggaaaactgtggagataagctatgtattacacgctagtgaaaaaaaaagtaaaatatagaaaatattttaaaaaccaaattttggtgtggctccacctctgggctggccaaaaaaaaaaacaaaggttccctgccatgtacaggaatgatcatcatttccagggacagatcaatgacttatactccagtagggcaatcagaactcagaaggcaattctaccccagcctaccgcacattgctcaatttgctcatcctcaatctatgtactagcagttcaaaaaactgccagaaattaggcttcttgttcacggaagtagcatagaattataccactccagcaaatttttataacgaatcatacaggaaatcttgcattattctatagcctaattgatccacaaaccaaaccataatgtgctagaagtacttatgtgtgtttaaactttaaagctctgagcctctgagcaatcagcctagtttgattcttgcactgtttgcttcattgacctctcagtttgtttatatagtcagactaggttgattcttgcattttttgcttcattgacctctcagtttgtttatatagtcagcctaggttgattcttgcactttttgcttcattgacctctcagtttgtctacatctttgtcaagactcaagaccagaatatggaacatgttgacctatgttatgagcattggaaaaatattgcaaagattgagtatattaaggaaattactttttctgggcgacagcatagagttgctcattatgtaagaatgccacatcgcgcacagtttccctcacctgtgcaaattaaaaacagtcatgttgattactatagccagggaaaagaacttgaaagaataggggacatggtaggaatttgaccaggataaagatggttctgttctttcataaccagaaacctctactacaacagaaagtgccataaacgcatggatagaaataccagtaggaagacgtaaaaaatatgactcatataaggaaaaaaaatgcatgctgggaaaagtcttgagttctgaaaaaatgacctgaaactccttgacgagttccaaattcaacatatccatcatagcgacatgaccttttcgtccacctactaccatataccggccatttcccgtgtatcctagagtataagggccaagtactgcatcataagagaagagctagtcaatccctcataacttgttggttgtcatccgaaaagttaatagcagcaagtagatgaaaagtgctatctagcaattattccaaaaaagatacattgttacatgatgatacagaaatgaagataaataaatgctatggttatatatatttaaacaaaaaaaaatcagcattcatccagataaatagaacagtgtacccctgccacaattagaagaagtgaagaagggggaatttacagaagaggaacagggaaagttttatagtggctacaaaataagtgtattggaaataaaataattcaattgaaaacactaatggtgttccttctacacttctttttagttttttttaaaccaaaattagtaatggataaattaagcaagatgatggtttcttgagataggggttttcatttatcaagatctaatgtagcaggggaaaaaattagggcttgatttaacaagccgcctatgatatcacagcttcaaagaacaaaaaaaacagatttagacacttacaaggtaagatcatatcaaatggctttcttgaactcaaaagatccacgtcctcccggagcgaagtttgctgatatctgtacgtcttctccagaccatcatcatcaggctctaaatagccgccctcggtaggcaagagccactgcaaaattggaagcaaaaataaagatcaacaaacgacagattctcaattctcccattgtgttgcatatgctcccagaaacattcattacaagaatcaacaaccgcaccttctcggtctgaacggcggctttggcggagtgtccatagagcttctctcttgcggcgagctgccctttcaatttcttgtcgcgaagagtctgataaacccaacataaaccacacatacacatgtgaatcaaacagggacgcagatttttgaagaagaagtagtttagcagcagtctcaccccaaggtaagcagccttcccccgcgagtacttgtgcaccttcttctccatttcatccagagcctcctgctcgcccccttccatagccttctgttcagcggcgggcttggcactggccatggttaccttcaacagcggcaacagcaacagcaaacaannnnnnnnnnnnnnnnnnnnnnnnnnnnnnnnnnnnnnnnnnnnnnnnnnnnnnnnnnnnnnnnnngggcgaacaatcgcgcg

SEQ ID NO: 34611 - DNA, 10025 bp, Oryza sativa
  unsure (1)..(10025): unsure at all n locations
agagtgannnnnnnnnnnnnnnnnnnnnnnnnnnnnnnnnnnnnnnnnnnnnnnnnnnnnnnnnnnnnnnnnnnnnnnnnnatagtacataacccttataattaatcatcaatatcctaattaagcaaactagttacatatgtctatcttgggtacgtagatatagacaggattacattacattagtgttccatttaagaggtgtagacggcaaagggaccagacataacaaaagccatctcaggaccagctttgcaaacactttacccttttgagatccaatgactagcactttagaaaaaggtaactgtgtaggagtagaaaggttgggatagacttggctctggttgcctagttgcgaccaaagcgcactgagccagaaatgtttcataaacttagtgggggtaaatatgtgatgcaaaccccaaacctagatgaaaactcatgtaaagatcgataaaaaaaattgtataaacatattaaaaaccacacatgtagataatacgatgctacacaaccatatataaaatcttgtctaaacttgtcttcgtttgtgagatataaaaataataaagtttgaacaagaaaaatgtcttgatgatttgtccaaaaaaaatgttatttttatatatgataaacaaagtgtgtaacatcacctcatctacatgtgtgattttttttttgaatatagacaactttttagtcagagtttacatgagttttcacctaatttgtggtttaattacaccgcatatttgcccaatttagtgagtatagtgagtttctgtagagaagctcatcttagaattattcatgtattccactactaaattactgagtgcaaagtaaaacctatacagttaaattacggtcgacctatatacggataaatattggatggcaaggggaatatatttatttaactagaacaaatgtccgtgcgttacaacaggtgaagtctattttaatcttattactgttatgttatatggtttagttaagatgaaatttactgtgggagttcgtttggatatatatttttaaaaaaaatcatgagctgcagttaagtccgattatcttaagttagcatgtgagtttttttaaatagacttcttgtatgatttcttatgtattaccaaaagtgaacgatattaaaaaccgattcaaatacggatatatatttccaaaaacaaacgaacttaaaaaccgactcatacatgtatgacgtaccaaaataacggcaaaaacatcttaaatttttataatagtagagttaggatcggagtgtatatttttggacagtgaaatcttcccaaacaatcgatatagcacaataatacacaacaaaccagacgactgttttgacattaattaactactcctaattaatgtaattttatgcaagttaatcatgaataatttcattgtttgatctgatctgcgctcgttaattgttttgcagcaaatcaatttatgttattaatccttgtctttccattgcagcaaaaaaacattctccttacatattttggttccatcttttttttatcactttcctggtcttgctttaatattttattgagggattcataaacaacacatgtattttacagcatggatatagctactagctccttcctcaaaacatatgcgcattagctgcaatatgcaatgcatatatataaattattatggacttggttaggttgctagactaaaaaaagcaatatatacgtgaataaatgttatcatcattcggaatcatgttaatttgtacatacgtgcaagtttgaatttggtgataagacataaagatacgatacatagggcctgttttaaatccactggcaaaatttttcatactgtcccatcaaatgtttgaacacatgcatagagtattaaatatgaacgaaaaaataagtaagtacatagtttgcgtgtaaattgtgagacgaatcttttaagcctaattgcttcatgatttgacaatgtggtgctgagtaaacatctgctaatgatggattaattaggcttaataaatttgtctcgcggtttacaagcggaatctgtaacttgttttattatcgtctacgtttaatacttcaaatgtgtatccgtatatccgatgtgacacggcaaaacttttcacccatggatctaaacacggccatattatatatgggttctgagctctgaaacagttcatgcatgttagtaattcaccctcaagtacagctagaagtagagaatgacgaccttaattcacttgtctaatacctcgaacaatgatggaaggagaattcttggctttaattagttccactccattatttttcccttaaagtatcacacatgataaaaaaaatgaattcaaatttaatttcacagggaactatcagaaacaaaatcaactacaaaaccgcggaattcggaattaatatttattttgtcatatataaattaacatactcagtttggagttcataagttcattacgaacaatctgaagataaatgagatactatatatatacgggagattcacacatagagtgactgtcgtatatatatatatatatatatatatatatatatatatatatatatatatatatatatatatatatatgctatacacgttagaactctcctggcaaagcataccataattaaggagcttatgattcttagcatatactccctccatcccagaatgtttgacgccgttgactttttaaaatatgtttgaccgtttgtcttattcaaaaaatttaagtaattattaattcctttcctattatttgatttattgttaaatatacttttatgtatacatatagttttatatatttcataaaagtttttaaataagacgaacggtcaaacatgtttaaaaaagtcaacggtgtcaaacatttagggaaggaggtagtatttttctacgaggaaccattgattattggctagctatctagcaaaagtgtcacacaccatgcatgggaagaatggcagttcaaaagccctagccagtgagatatataaaaccaattaagctatttattatttctcaatccaaaagtttagaacattatgatgggggaaaaactttggaggtagaagtatttacagaagctctagctgaagccttaattcctcacaaaacacgtcaggcaaacgatcatgcaacatccatatgcatttttatttgcgataaattggagttaatcaatcaattcgcacatgagatcttcaccctctcttcctaaatcctgaagacttgactagagttggactttgtgttggttgtaagggtcgagtttaagacgatctcggctgtgtgccattgttggcttagtggcggtctgtcacgcttagtggcggccggtccgatgctagccttctcctggttttatgtgttggtgttgccggtgtgtgggtggtggtatatattttttatttttcctgattacgatattacagggttgtaatcttataattttttagtgctctatcaatagaacctcataccgtctagaccagagtcgttgaaaaaaaatcttcacacgtataaatgtctgattcagatgtaattaagcatgcatgttgtgattgattttgattcataatgcaaaacgatcaatatgtgtagagatgttagttagttagtttaccttgggtgctgggtgttcttgacgaccttctggccgtacttgcgccacttgtagccgtcgtcgagcacgtccacgtcgctcatcgtcttgaagcagaatctcggctcccgcaccttccgccgcgccttccctcctcctcctcctcctcccccaaccttcttcatcctcaccgcgccaacccccagatgatgctgcgccgccgccgccgccgccgtgttgttgccggcgtcgttgatccccatggcgcccatcgccgccgccgcctcgcccttattccccatctgcggcctccctcgatgatcgccttcctcgcaagacctagcacggcaataacgtcgtcgacatgggagaaaaggggggagagagagagagagagagagatcgattggttgttacggttacttaattactcgtaattaccatggatgcggcggcgacgatctcggaggaggcgcggcggcgtggaggccgccgccgtggtggtggtggagggtgggaggagagggcgcgtgcgagaaggcggcggcggtggttgggtggtggtggtcgaggacgagggggctgtaacctaggacgccatggtggtggtggtggtgagacggcgtgggcgtgggatgctggaaggagaaggcgacggtggtggtgcccgtggccggggcggcggcggcggaggtcgtcgacgaggaggccgccgccgccatggtggtcggcggttggcgggcggcgccgtggtggcctagcgccatcaccgccctccctggtgatgggaacatctctccctcttctctctctccagtttctctctctgattattttcgctgtcttgtttgcttttttgtgaggtgtgagtgtgaatgtgtgtgatatccggatgtttatagggtgtgggagagacaagggattgcattattatatatcatcgaggaaattaagacaaaacaaaaacaaagtcttctcgaacttttacatcacacgcattctgaacaaaattatcaacaccttatagttactccatcatgattataatcggtcatgaaaattgatacatacatacatacatatacatatacatatacatatacatacatacatacactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatcatctttagtcccggttccacacaaaccgggactaaagatcatctttagtcccggttcgaatgctgtcaggacctgtcaggcccccccgggatctttagtcccggttggtaacaccaaccgggactaaagatcttaactttagtcccggttggtaatcccggtgatctttagccccggttggtgctaccaaccgggactaaagatcttaactttagtcccggttggtaataccaaccgggactaatgatcccggtgatctttagccccggttggtgctattaaccgggactaaagtcccacccctatatatatgtcttcttcctcctccagctgcccgagcaagcttcaaaatttcttcaaaaaagaggggaggtcatgccaaaatttctattaaatttattttggtgattacatacaaatcggaggtgcctaaaaggtttgcaacttcatcctccaatgttttttttgtcatactacatttgcacctatgttttgcacactttttttgtctccaaaatttagttgtaagttgatgagagagaaaatgtgtgtggggaagaaagaatatatagaaatttagttaatttgctaaacaaggttttataaaatagttgagaaggaaaactctagtgaaagttaatcttaaataatagaaaacaaactaaaatgaaaattaaaagaagtaaaacaaattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgctagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcattaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcttgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacgatttggtttgagtacggatggcatgaatccttttggagagatgagcagcggccatagcacttggcccgttacgatgtgtatctacaacctcccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgcaataaggggtatccttccagacaatgtccgtgcaacaataacaaagctatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcatccagaggcaagcgtcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcacgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtattgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaagagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgcaaattataattgactggagaatttttaaaagtattaaatttaatatatttttaaaactatcattcatatattagagtttttcacaatttaatttactatctttcatatgctacttatatatgacgcatcgaatttttaaaaggtttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatatattggaatttttattaattataagtcatatatttgcttattacgatttatccacttaatttattatagacaaaaatactttttcgaagtaattgtcattaatctttgtactttaaataatgttaatgcattaacttctattttataaacacatannnnnnnnnnnnnnnnnnnnnnnnnnnnnnnnnnnnnnnnnnnnnnnnnnnnnnnnnnnnnnnnnngggcgtataatgtcaatgcgcg

SEQ ID NO: 34612 - DNA, 10702 bp, Oryza sativa
  unsure (1)..(10702): unsure at all n locations
gtgccacgcgtaaatgggtgaagatagcgaacgcggagcgcacctcntgtagagcgcagatcgaaagtttggaggtatgagcgcgttttttcataagaaccctcctcccccccccggcgccnatggatgtacngncagnctagnaacnnnnnnnnnnnnnnnnnnnnnnnnnnnnnnnnnnnnnnnnnnnnnncgaacgttaacgtgaaatgcaatatatatatatatatatatatatatatatatatatatgttacttcgcatttatcctaatacattttttttatcttgcagaaaagacgtgttgtcggagtcgtccgtcaagcctgagtggaagagctagccctagaaggaattggagcagacaagtgacgtaataatataaatgattgttatatttgtaatgcaattaattaagattattagacctgtaattagacttatcacgtaaggttgcgtagggttctaatgtacaacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggaaggcgatgatggaaagaaacaaagaaaatgccgccaagaagaagtaccatcaccacttggggtcaggaggctatagcgtcgcgatgccgaagtgggagcagatggaggctagcttgattgacaggggtatcgaaccggcaacagccaattggccggaacgatcgaagttctggtactatgctcacggtggaacgctcaacccagctgatggctcactggtcttcggctatcagatacaagaggctgcgcgacgactaacagatgcagtggaagcctcctctcagggcacgttccgaccagacagagatagggacgagctgacactcgccctgcagactccagagcatccaggacgaactcgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgtatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattactttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggacgattccagcaggatactccaaggtcgaagttgagttggtcgaaggcgcgtacgaggacctcgagctggattaccctggaggagacggtgagacgcatctacgagacacatgccatgccattattctatggcgcaggcggtacatcatccttcctgggcgacaagcggcgtctcgtgcaccatctcctccggctccgccatctcctcctcaggatcctgcaccgtctcctcctcatgctccgccagcaccgtctccacctcaggctccagcatcgactcctcaggatcctgcaccgactcctcctcgtgctcctacacctactcccccgcaagctcctcttccggcaccttcaaagtcaagggccccccccagctccaccgcttgcccacacaagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagtctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctatgaactataccagctggacgccctcgacgtctctattatgagttgctggattttgtaagtatatcgttcagttagatttcttactatacgtctcctttaattaattaggtccttgtatataagtagaccatagaaaataatatacccccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaaatcttgttaagttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacatgtgcgagtattgccactgccttgcagaccaaatcatcaccacaagagagctcgatgtacgtacaaataaattcaaattttcattacgtagcgatttcttgtttaattactaattaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatatatgtatgcatatatatgtattgaaacatatatatgcatggtttatatatatatatatatatataaaccatgcagcaacaggggcatgcaaaaaaaaaaaggtcacgatctttagtcccggttggtaacaccaaccgggactaaagattgctcagcctttcacccgagactaaagatagcgatctttagtcccggttggtactcccggtttggaaaccgggactaaaggggggttaggaaccgggactacaaagggtttcttcaccagngatatatatatatatatatatatatatatatatatatatatatatatatatatatatatatatatatatatatatatatatatatatatatatatatatatatatatatatatatatatatatatatatatatatatatatatatatacgtacacatatatatatatatatacgtatatatatatacgtatatacatatatatatatatacatatatatatatatatatacatatatatatgtatggttgttttgtactcccgggagtacatacaccctcccctgacagtggatcatgcaataggagccaatttaccggattgaccaaaaaaatgattaataaataaatgatgtaattaacaatcggggatgcatgcatgcaactaataatttgaaaattagtctgcctgttgcatgcaaagtagttacgtttgcattacacctttttttacttcataatattcggtatatatgtaccacgaccaacgttgaaaatgccttttcttttttagtatccggtatatactgtgtgtttatgtgtatgatttagtatgtacaccgtattacattttttgttgttggactgtatgcatttttttaatatccagtatgtatatacttgatcttttttagtatggcatatacttttttatgttagtaacagtatatacctttttaaattaggagagcagtatatactttttttaatccggtatatactggactagatcatgtactggttggttgtaggactacgtaccgctttaatttctttgtaggattcactatatattagaccaaatactgtttttttaggtacgatagctcttccttttttcagggagagtagtagtctttaagtagcagtgcatgctattttattttagtaagtcagtaggagtacatactgtttttaaacttagttgaagtatatacttgttttaacttagtataagtatataacttcttttaattagtaccagtatatgctacatacttttcaattactagtatatactttttatgagtatatactgttcttaaacttaattagtagccgtacatatgtttttatagtaagttaattagtaggagtgcacactgtttttaaacttagtagcagtatataccttttttaacttagtaacagtacatacctatttttcaacttagtaccagtatatagtttttgatgaatatattttttgaacaaacataaagatgtttgataaggaaaaaaatcaaaacaacttataatatgaaatgaagggagtagtataggtattttttttccacgtaatagtacgtaccatttttgtcttatagaatagaacaatacgtaaatttagtatgtgtagggttgctaattttgaataaactgtatcagtcaatgattgataaagaagtgtcgtcaatcattggcaaagtatcgggttgctgcattctgaataaagctaaatgaatgaaatacgctagaagtgcactgaattctgaatagacaattctacatgcaggctaacaaatcggttagcatcgatgggatcacgccaaacacgcgccggagagggaaacgagtattaatgtgccagcttgctggatcaacggaatcacggactcagcgccgtcgccagacgaccatacatgctggagtgttctgttgtcagcaccatctatgcccacgatagatgtgtctcgcatctgcatgcaccaaacaaatgcattcatcataggcttaatcattctatatatcaacgtcatacttcatgtctgcatcctcgtctgcaaacaataacagagatatacccaatagaaaaaggaagattatgtattatcattctacaggaaaaaattaatcaaacaaaactggaagaagaaagaaagggcttgccttgatcgttgcacgggcgctaaggtcaccggcgctagtttcgatcggtcagccaaggtgaagccaccgccccctccgcgtagacagcgtcaccgcacgggcagacggctagataggaagagccgatggatcgatgccgtgataccgtcgccacaagggtcggcaccgcctgggaacgccatgttgctgcagatgaatattgtcgccacatcccagcaaatcaccgatggatgttgccgccggcgtggttgctcgatccccaatggatcgtgctgtacctccgcttcgagtcgccagtagctagcgctcgatccgaatacagcggagagagcgagctgttaccatcgcggatgggatgggaaccaagggatttatacgacctgttcagaaccgattagtgcgggataattaaacattaggagaatattctttaaaaaaatggaaacgggtccggtgagtgcatccgctaacatggttgatcgtgggtggctactgatcaacggtggatgggagcaggtgtacgtactcctgggaatatagaaccattttcatatatatatatatatacacacacgtacgagttgaacatagctcaactggttaattagattcattgtggtggaacctcatcacttggacaaccggcttcaagctctaaaaaattgggcggatgcttgcattcatctaattgtcttcgttggtgcttataaagatattatgtgtatatgtttacagtggtgagtgtgcgtattttatgtgtataccgtatttgggggaaaacaccacgtatatttctatatggccataagtaaaaatttatttattgaatgtaacttcttatttaatttagctcatacagtttgcgcagataatttaatttggtttggtgaaagctgacgtctgtgacacttttgtctatgcatatatggttggcactcagctgtgctgttaagagttaaaaagtggcaggctggacctaggaacagtacattatctaacatgttttaggataattctcaccacatgtacagtgccatcgatggcaaaggctgacctgatgtaaaagacacccttttgcaaagccagacatgattccttgtcttttggacacatctgatcggttgatccccttaacttgaatcatcagtaccataatgttcacatttgttggcaaactactcgcactagaatatgcatgaatggctgcaaacttgcaaactttgtgatgatctgcaaactagaatatgcaaatcatcacgaagtatggctggatcgatcgatctgttgatcaaaattgctccaaatcttcgcaggcagcagtgtaaatggtaaatgtgcgggatgcacagatatatattagtggtgaattttcgaatcagagttttgaaataatatttaaattctaacaaggagtttggctgtacaccactactcttattttgttgtatgcacaacacatctgatattctgatgaatgaaatatctgtcaatggctcaatgggcgacaaggaaattaatttgacacatttcaagccgaaaaataggcgcacattgagtttctctattttttttcttgttttaagaaacagggacatacacatggtgacatggatgtacacaggacgcatgagtgcatgacacggttataagagcaagtttaataatatagccaaccgctggctacaaatcatctatagtcaacttaatagccaattcatacaataattacatataagcatatatactacaaaatcaatatctggtgtcatacacatgtgcgtcttggagtccgtgctgcaactggctacaaatatgtagcccgttgctcttatctctcctcttttatccacttaaaatatgtttatagctagcttatagtctgctattgtacctgctctaaagaggtaactgagacatgaagtgcttgctagcccaaagataaaacactaagggggtatcctagggacttattttttttttgagagaaggattaaagtttagtccctctctcccaaatacccccaagatgagtactcaattatggagaagacatatatacacatgggatggagaaaaagagggagagcatgtagctagagctatgtatatatacaaatacaaagtttatagctaggatttgagaatttttttaaagggagggagtacactatagcggggacatggcgtgcacgaatgcatatgcacatgcagctagctccatcccccatccgtgcagaggataacgaaacaaccatcagttagcctagcacgcatgtgcatgtgcatccatcgatcgatggatgatggatcaatcgagctactcgctagctagctagcacccactttcgtcaagcgctccgcgtccatctcgcactccttctcgcgcgcgcacgcacgcacggtcggcctagctattcaccaccaccttttccacagtagtagtgcactttgctcgatcgcgagatggagctggctagcgccatcataccattgccatgcatgatgcacatctctctctgccttttttttttcttggtgtgttggttgcatgcatggccaccgtaccaccctgcctaggctgctcgatcgatcgatcgtcatcatgaattcatgatcgatttactagctagtttgttccgttagagcaggtacaatagcaggctataagccagctataaacatattttaaagagataaaaaaattgagagaagagcagcgggctacagatctgtagcaagctgcagtacggactccaaaatgtaatgtatgtatgataggtgagaccagatattaatagtatagcaagcaactattgtatgaattggctattacattggctatagatgatttggagttagtagtgggctatactattaaacttgctcttacttccatatgtttatatgttagctcaaccagtggcagagccagcagtttcgtaaatcgtgagcgattaaaagtatttttcggtggttgatcaattttttcttagggtgtgtttagttcacgccaaaattaaaaatttaattaaaattggaacgattgatgtgacggaaaagttagaagtttatgtgtgtagacaagttttaatgtgatggaaaagttagaagtttgaagaaaaagttaggaactaaaccaagccttcaacaatctacaataaaaacactagcagcgcgcgaacttcggacggttgcctgccctacccgggggctagtttttccgctaggcttaatcacccaattcaattattttcagaaacttatatgattattagtgtggattatttattttcatttaaaaatatgttttcttgacgaactttcatttattatattgcttagacattttgttttaaactactaattaagtttattataaaatattttgttaccctcaattaaatatataatatcatgcagtcattcgacaaataactaatctgttgcaaatttagaatttttttttctcccgcacttagtttcaagcatagtgcaaatacacattgcagtttgacacattgcgcgatattcattctgtgtccgaagatatataatgttaggcacacattagatgttatgtcaagatatatgtagtgacggctccatgcctagggtagctaggcctcgagtcttatgtgtaggacaataagtttccatataaatttcatattttttcttgaattttagagaactaggataaaataatacaagctggctccacccctgtcaacatgcatatgcaacggataatactgttcttaataataagctcagattacaaaacaggtgcactttagctagctaatattccttgccccagcaattattatgagtttatcaccatgcatctcggttgccattatatgcaagcagctagtagccagctatcacagcacgtgagctgatgatgcagcccggatttcactaatcatgccacccatgcacgtaaatttcgatcacaatcaccccacggccatccctgcatcttgtaactaatgataaacattgccagtatattttacatttgacaacaaaattctattttttttnnnnnnnnnnnnnnnnnnnnnnnnnnnnnnnnnnnnnnnnnnnnnnnnnnnnnnnnnnnnnnnnnnngggcgtcaacaaccgc

SEQ ID NO: 34613 - DNA, 3284 bp, Oryza sativa
  unsure (1)..(3284): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcaaccatgcccttagtcttcgtgtttccggcatgtcgaaatggtgatgggcctaatccacacgctgaaagtcccaaaggttaagacttaggcccatcagacccaataccggtgtgcttctctcgaaaagcccaaatcgcccagttccgttcccccgatcacgtgacgccacgtgccgcgtcgcgttggcatccgatggccgcgatgccacatctcctcttctcttctcctctctcttcggtttctcttctctctgatttctccacggctttcttctacctctctcgccgtccttactcctctccctgctctgatccagccgcggcggcctcgccgcgcctcgcctcgcctcggcgcgctgccgccggcgagaagggcgcccgcaggcaccccctcctcgtcccccgagcggcggggcatcctcgtcgtcgcgtgcgcggtcggcgaggaggtgggaggcgacgcggcgggccttcgtgttctgcttgcgttatccgtctcgggttcggatcgaatcggaggtatgttcctcgttgttctctcgtactcgtagccctagctgactcggtccctcccgcgcgcgtggattccaggacttgatgagtggataatttggttgatttccatccctccaattaacctatccactttcttctgggtttcgttgatgcgtagtgtagtgctagtagcagcttgtgtttccataaatgtttgggggttctgcttatgccccatatgtgacgctcctgccaagctggattgcgttctgttttattactgtaattgtcaatggccgaatcatttttagggctgtgtgtttagttggcgagtatatgcaatagtggctagtagctattccattttatctgcaataagtaaggtcggaatatgcagtagcaagctatacaatttcctgtgcattgtagcggctagtgagctataccattttatctgcaataagtaatgtcggaatatgcagtagcaagctatacaatttcctgtgcattgtagcggctagttagctataccattttatctgcaataagtaatgtcggaatatgcagtagcacgcgatacaatttcctgtgcattgtgcagtctttctgtattatgtcaactaaagttttttttgtatgtttttattcaagcaatgttgcttggtaccattagcaggtgaacgggtgcctaccaacaatgtctacatctcgtgaagtagatgatgggcccgctgtgctacagttatatagatggaaaagctcccaaccgcatcttgaactatcgaaatttcgagaagcttttatatctcctacacggcgcctatttgggctgctctcggaccatggtgaggttttactgcttcactgttctctgccactgccatccctgttggagcccttcattgctctgctaacttactatattgttgtttccgtactgattctggttttataatccaggggatcttatcttgtcaatgaccaatgttgatcaatcacaagttgaatcaccttccctctcagatagctgtagtccagtcgtctttgattgcttctcttctattcctagagtgaagtctttagcatgggggcaatgttataatgcctctagccaacttgaggattcaatttttaatgaagttcttgttgtatctgatgatgattctatcacacttcatgggttttgtcattcttacaaaagcacactaacagacaattctaaattggacactggagatttgcatggggagtggaaagagtggcgtcctactcagtgttcagttccggaggatgatgaggcaggtacaaagaacagttttcgttcttttctgactacaatcagtggatctgtttctgatggaaaataccaagccaaatttcctctaaaatcttcacttccgcattcagcagaggtggtatcgtttagcatatacgacattactctatcttttattaagttctggtctagcaattatccttcaaagacctggatgcaaaacgatactaaatcccaacaaggttttcttggtcatgttcctacaactgaaacatcctgcaactgccagtgggaatgtttgaaggttttgcctagttcttcaggttatttgattggcttggtcttaattcgtaatgaaccagtgagctgtgaggtccatcaacgcaacatgaaggatattttggttgttgttattgagctaaatcagtggggtatacagtggaactttgtggcagaccttcagaatgtatatgatggtgctgttcctaatcaacaatgggttgatttccaattgtcagatgattttcttgcatgccttaactcgggagggtttgttgtcatttggaatgtgagaacttgtaacattgccgcctcctttagtgttcttgaacggtgcagaacagatatagatattcctatggggagcatcacccccaccgtaaaaacttctgatggagaaaatatctatattgggaatcatgcaagaagaatgtttaagaggttagttttggcatcatattctcttgttcttgctgtcgtagatgaggttggggtaatctatttgttctatgccaaggacatcttagatttcaaaaccagtatgcatggaaactttcatccgccttccatgttttatcgtggtgatagttttgctgcctgggaagctgctggtcatgatattgggagtgtaacattttgttgtcatcggtctgtacagcaattggtctatgacttctcagaaagagacaatcctggtgttgtcaggcctaggaaaagaagaaaacattgtagcagtaatgaaaatcaggtggatagctggccaagtggtttcagtactacaacaccgatgaaagatgggttagcttaccctgatacaatggcagtttccaatccattaagaagagtgatccttccaccatgcagattacaggagaatataattagcctctcaccatttgggttaacgagaatctttaaaagtcacaatgcggatggaaacaagcattttagaattgttcacacaaactttcttatggcttcattacaccttgatgagagggatattgatgctagttnnnnnnnnnnnnnnnnnnnnnnnnnnnnnnnnnnnnnnnnnnnnnnnnnnnnnnnnnnnnnnnnnnnnnnnnnntaatggcaaatcaaacgcg

SEQ ID NO: 34614 - DNA, 825 bp, Oryza sativa
  unsure (1)..(825): unsure at all n locations
acggcttgttattgtacgcccnnnnnnnnnnnnnnnnnnnnnnnnnnnnnnnnnnnnnnnnnnnnnnnnnnnnnnnnnnnnnnnnnntaaaaggaaactgcaacaagaagatatctgatactgccacatgaagaattttagtttggaaatttgaaccaaagttgatttgggcagcagagaatactcacgaggaccatcctataccacaaccaaagcaaggaagtcgtctttcaaacattgccagccgtgggttttcttcatctctgagcaatgtatacttgccaagacagccctgacaatggcaaaattgatccgagcctgctgcaagatggaaaaataggattaagctaacagaagaaatattctcaacaaaacaaagataacgccactgcatttatgatttatgttaaagctctaaatgtttgagtcaaagtataacttggaagttggaactacagtagtttatgtcatcaatgtttatatactgcaagtaagccagtatcatgacataatctcctactaaaaaaacatgtttctcaaaatgtcagattcaaggattttgtgtatagtacaaaagtgaaatgcttcccacatgtcttaagagatctagcaaggaaaagctaagcttaacttcagaaaagaatgagagagagagagagagagagagagagagagagagagagttggaaacagttaccttcccccatttaatttagagcagttcagcaaagaagcacccagtaatcttaatgcaatatctcccgtgcagaattccttgtgccggtagcaggattagtcctaacaacatgaagatagggacatcat

SEQ ID NO: 34615 - DNA, 813 bp, Oryza sativa
  unsure (1)..(813): unsure at all n locations
acacgttannacttccgatttannnnnnnnnnnnnnnnnnnnnnnnnnnnnnnnnnnnnnnnnnnnnnnnnnnnnnnnnnnnnnnnnnnnnnnnnntcaagtcagtataattttacagtggattttatcatcatgtcacaagattcagatcatgcatttggatgggagaaagaataaactctagacattaattttacatgccatttgatatctgaatatctggtcgtgacacgcaaaattggggcaggatgctgcaggggtgtataattgttccatagaaattttgacagcttgtgtaaaaatgaagccgggcgagctcagagttagtgacagcagtaacaataataataatgaacattaatacagtataaccaaaaggtagcagcagacgaagctactaccgtgtttcgatcaagtacaacgttgtggtatatgatgggttaaaattggctgcaatcactaaaatcacatgtccatcctgaatgtctcaagtctctcaatcgaggatcctccagccctgttttcgcaagctttagatgtcatttgtatacacagattatcagcattggggtgagggtgatgattgtcccggttgtgaagatagcccgctacacatgtggaatggattgaagacattagagaagaatcactgtaacttaaatgctcgggtatataccaaaacaaaatgcanaagacttatgaattgcgtagaataactgccatgccatttaataatattttttgcatcatacaaacaatacttgtcatatatagtttatacacgacccaaatgcaaaagacttattgcatatn

SEQ ID NO: 34616 - DNA, 794 bp, Oryza sativa
  unsure (1)..(794): unsure at all n locations
naattgagataaaagccttcaatttgttgaagttgggtgctaagcttttatggtgtgattaggacatgtgacttttctttttcctggttaattacgataattacgacccttcagggttgtaatcttataatttttttctgctctatcaatagaacttcgcaccttctcgtacgagtcgttccaaaaaaaaaaggacgtgtgacttgacaacgacggtagcataggggttgacgaagacagctctgatggatctgccggtggtggaaggagggatcagttggccatcttagccgacatggacgatgcaatcgcgaaggactggggtggactcgatcaacatggcgtgatgctacggcacggcgagaatgcggcgctgaagaatgagcgtggcgaaggtgcggcgttagggcagcggtcctcgaaataggacgtcacggataggatgggcgtggcacgatggagtttgcatgacaaggaagagagtgaaaactctatttggtgcagacatgcgtgggtaggctacctcacacgacacggttttctaccgagccatcgcataaagcccaagatggcataggatgaagccgatgatcatgatggcacagggatgaaacccatgatggcttggatcaaccatatatagtaagtgtttagtgattttatgcttttgaataattttttaatttattttcaaagtatgnnnnnnnnnnnnnnnnnnnnnnnnnnnnnnnnnnnnnnnnnnnnnnnnnnnnnnnnnnnnnnagnggtgtatgggnagaggaanacaatgcgcg

SEQ ID NO: 34617 - DNA, 21562 bp, Oryza sativa
  unsure (1)..(21562): unsure at all n locations
cgacgtgtttgaacccncattgagaatgacatacgacttacacnaggcgaattcnacccttgtactcccctatgcctattaccaggagggtgatgaggacgatggcgctcagtaggtcttagttacggtcgttgcctgtggcaatggcgtgccgctgccttaactccgctgccttacctacttctgtttttggaatgtattccggaccgctcggtccgatgatttaagactgtgcctgtgggcttatgatgtaataattcgtactagactctcgtgtatgtgcacttgatatttcagctatgagttcgtgtataccagactacttgatccagggaaatggtacggtttacacgattgattcctgttataaaaacgggggtctacagagctggtatcagagccatacgactgtaggaaaagaccaaaaggcaccccacccctttttaagttggccaagggagaaattcccatttagtaatactttcaaaaataaaaatgctatgtttacaaaactcggtacgattttcatcttactcttaactattttctttacaaaaacaagttttactctcaactgactttgggtttttcttaaaattagatggcaagatccggattcacccgccacctgggagatgggcgtaccccgctcagagggatacgtcattgagctacaccggctgataaggcgtctgcgataccccagattttccgatctaccgagtgagacatggtggatctgtttgggaggctcgggtcgaggtccacaccagagttccttcagagttagactacagcttcccgacacgccaccgtcgcgacttgccggagatcgcgatgcaggatgctgcccgggaggccttcctccgacttagctctatccaccgagctgagttggcgagtactgagtttgctcaccacccgtttcgagaggagggcaacttcgtctgcacagttcaagacacaccttgctgctacaggccgataatgacccgactgtcacgatgggctgaggctgtggacgacttctacgaggaggccctgttggagattgacgatcagcagagacgtgtgggtatggctctagtagctcttctcttctctttcgtaagctttgtacttttattagaatactcttctttatacatttatggtattgaaatactttctaagtatataaatgccaactttacattatgttcgtgttatactgattatactgctagcttatttgggagatgcattggtacggatatagtgtttgcttatgcaattactctatgtcatgacaatgatattagagtagtatctagtagtttaggcgtagtgtctagattacgggcaaatagcgaaagaatgtttcagttcactgcaacatttgatccatacatagtgaaacattgcgggtatactaaacgaaacatttttcgatggaacaaaaaataaaactaattctgagggtttccaaaatatgtgggttttttgttgcaatagagtatctcaaatcactgcaacattagatatataaatagtgaaacattgtgagtacattaggtgaaactttttggtggaacaaaaaaataaaacaaattcccttaataggggtttccaaaatacgtgggttttttttgtaacagcgtgttctataatatcaaaattcactgcaacatttgatccgtacatagtgaaacattatgagtacactagctgaaacattgtaaaactactggttgaaacatcaaaagagaccatatgcaacatttaaaaaaatcaataaaaaattaaaatatttttttattaaaatataatcatgtgtggtcttgttgtaaagatttaattgtaacaatttagtgatgcaatcagatcgtacattagataaatagtttatgagaaaaaatcttttgaagaaatgagagatggaagcatgtagggaaagattctttgcatacaaatggcagaccatgcagcgtctgatttttctcccctctcatcggaggcctgacaactagcattctccgttgaaaattacaagtgtacaggttaaaatttaagagtgtacgtacagtggttgcatgctgcaattgtacagtcactttaatgcacgtggctgccgaatatgatgggaactattatggagaggacatcttctctttatttacatgtatttaaatgattatgaaaaaaaaatcaaattactatgtgataggtcattccaccaatacgtatggtcaaatttaacttctaaaatgttacaacgaaaaaaacaaatttaattgtaaatatacgtcgactagctatagtttagttttatttttttttaacttattcttgacggtcgttagcgatcagtttcgaccgtcaatattaccaaaatagagaactaattatgcttgcaatgcatatccatgttagaataataatatttcactagtatttggttcactaactttttgcagagaataatcataaagtggaggagcatcgacatcaaatcagacgatagatcaatcggacgatgtcgagaatcaaaattatacatgaatgggccaagaactcataattgacatgatgaactgggccaaaattcataagtctacgtataagagcaaaggaggaggccacatgccaagtttaggccaggttgggccggcccctggtttggccgaacccccgtggcgccaatggatgcagggtcttgatggacggctgggattgatccccaatgacgattggaggatattactgacatttccaaccatcataaccgtcattacctgcatataaaaggagctctcatcctcacttcactcacacacctcaagcaagagctctctcatattctctcaagttagtttagtagtcttaagctagtggagtaggaatagagtagaaatcggagtccggaagccttcggaagagttcgggtatggctctagtagctcttctcttctctttcgtaagctttgtacttttattagaatactcttctttatacatttatggtattgaaatactttctaaatatataaatgccaactttacattatgttcgtgttatactgattatactgctagcttatctgggagatgcattggtacgggtatagtgtttgcttatgcaattactctatgtcatgacaatgatattagagtagtatctggtagtttaggcgtagtgtctagattacggtgtatcattatttggggttatatgctgcggatgagaggtcggccgctgatggtgacagctcagtacgggtattcctccgtgagtgtatatagttctaagttaatttcctagggaggctactcctccgtatttagccccggttgtatggtcatgacgggctgtcgtaaggaactcggcagtcagggatggcttcttgaagtaccaggagagcatcggatagagggtattagctagtatgtcagataactagaatgtatgtatactatatatactagaagtataggaatagattatctttctattttctttcaacttagcttaggtaatttagtatgagaatgagtagttccatgcttgtgtgtcattctacccttgaattatgttaactcctgcttaaactatgattattacaagtaacatctaaattactagtcaggttctctctactatgatcttcccacgggattaaataaatacgatacccttggaatactctcgggtgaaatgctaaaatggtatatccgtgcgctcgcggatgaactctgtagccataatataccatgagtatttctgcgccattgctgtgaattatatttctagtaatgtcgttaagaaataccaacacttatagaagttgaatttcaacttgtatggttgtgggaatgatatatcacatattaataatcttctcaattttttttcataactatttagatgacatgcaaataacgaggggatgtgatccggtgaccctaacctccagacgaccagatccagtggcctgcccactagagaggggctaccactgcaacccctaatctccaggtgattgtgaagcggtggggaggagcattggcaccatcgaggagagagggagaggagacagggagagcgacggagggagactgagaggggagagagtgatggacgggcggaaatgttgttcggcgatcgatcgccctggggatggggcagcgatcgatccccttccccctccctccctccacccctccacccggtttccttttttggcaccgcattactttcctattttagtaaatttataaacctaaagtttatacacctcaagtttacacatctaaagtttagagaccaaaagtttataagtcaaaagtttatatatccgattcaaatttgaatttgaattcaaataattttttatatatagtatttctatacatctaaagtttatacacctaaagtttatagacctaaagtttatatacccgtttcaaatttgaatttgaattatatctgaatcaaatttgaatttgaattcaaatattttctatatatagtatttctatacatctaaagtttatacacctaaagtttatacacctaaagtttatagatccaaagtttataagacaaaagtttacgtacccgattcaaatttgaatttgaattcaaatattttctatatatagtacttctatacatctaaagtttatacacctaaaaactatagacccaaagtttataagtcaaaagtttacatacccgattcaaatttgaatttaaattcaaattttttatatatagtatctctcccttatccaagaaacaaaaggggacctctctctctcccttatccacactcacagaaacaaaaggggaccgggcggccctcgggagaggcggcggcggaggacccgacggccctcgggagaggcggcagtggtggttcggcggtaccccatcctcctcccccttctttcttccctcctcccccttctcttattttctcgatctggtgcgtggctcagtgcgcggtgcatggcggcggtgaggagggcttgacggcgtgcagatgcggtcgcctcctagaggtcggggttgaccggatccggcggcggcctccaactccacgcgcgagcaccggccgtcgtcctcaccgtttcaagcaccgaccgccaccgccaccactgaggtcgggggacgctggatccagcctcctagaggtcgggggacgccagatccggcactggacagccttctcctcttccgtccccaagcgccctcctccgagagctagtcacctcctcctgcatcctcgcgcggccaccgccatagcttcctccaccattcccaagtactgattaatgtgtttatgtgcttacgatttggtttcagatcttgcaagtcatcgattccaagtttttgattcgggtgtggtcttgttgaagccccatgatgtgttgccgctggagattaattgatgttagaagaagacctgtgaacttttgtcttgtttttcttgaagatactagagattttttcgttgtgatgtagctagaaaattagaatcttaacaatttccctgaaatgcagtttcccagtagtttttagttttgtagtttgtttttcggttcctattgtaaaacttgtaagttctccggcttcttgccatcttttgaaaggaattagtttgaaatgtttggggttaattattagttcttcggcttctattaccaattttctatggttgcaactgggcaccatttttttaagatgactttccattccagtgatgggttctgtcgaggagcaaccctctctagcgggtggtcgtgagacccccccccccctttgtgagttcgaccgggggatacagcgcgatgatcaagggcctacttcggcttggcgtttaactactaaatcgctctcggggctgtgtggaagacaaaggattatacaggttcgggccgctatcgagcgtaataccctactcctgtgcatgggattatgatcaacttttacaggatgtcttgagctctggaggggaccctagccgttcttcctctcgaactcaaaactatctgagagtcgtcacttttttcggtgggcgaggtcctccttttatagttcaaggggataccacatgcaccgtccatacctactcctccaggggagaggaacccaccctgcctcgattagaccgccattcgtgccttcaaccggaagcaaggtggctgtgcgtccttgggtggggcccagcgccgtcccccgcctgacacgggggacatccctgtcattccccctttaaatgcatggagactttggtggctcaccacgtccggagggcacccctggcagcatactgacgggacggggcgtacctgcccccattccgcctgacacagggcgggacgtgggggcgctgccgcccgcccaatcacctgtgaccggtcacagaccagtcactcccgattgacatgggtcaatcgggcggcgccgtacatccacccacaccgcgttaaaatgcggtgagggacggttggggcgccacgcattaaagatcctaagaggcgtccttcgcaccgcccgctctcctcgccacgtggtggccgtgcgagggcctcggggtagcacgccccgaaagcccgaggggtatgacgtggcaccccgaggcccccatggccaccttagcgctatccaaggggcaggaggacgcgaggccgcgtggccgcgcgactagacgggaaggacacttccctctactgtgcgtacccccaggcccatttcaccgacaggttcatatcttgaactcgttggaggtgagtctcaggtgtctacctttgatgggttgcaactacacattggcttgtggagatcctcacctttgacaggccggaaaatacggacccgtcagaggtgagtgtgcctctgacgggccggtcacccatcaaaggtgattggacttgccagtgaccactgatcactgaccaagcccaaacccgtcaaaggtgagggtttgggcccgtcacaggtgacattatccagtgtagtggatgaaagagttaaagggagtaaaattgacttttcttttttaaatataagtgtaatctttaattaacgggtatgattgatatctgctttttaaaatataatgataaattgtacctgtggcgagttagagtacagcccatgaagatttggttgttacaatacacacatctagtcatatttgtgcataaccaacctaactcacattaaaaaaatgattcaactcctacagtttggtggattaggatatatacaacagcaattagtgggacactataagtaagttaatacttttttttgacgtcgatgagagtggagagcgagagagaaaaatgagttatcgtttctttagacagcttgggataacttagttacgagaaaaaggagagatagatgatattggatatcatataattatctttcatatgtatacatgtcatattgttttctaaattatctctatttaatgtagatactaattaacacagacaattaatagcagtaccaaagttgtagtgtattacaaaagcaaaatagcaataatagttttatcacaaagtacgtattcataacgtagacactcatgtaagtacacacccatataaactcgcccctcctgatatattggatcaatatctactctttctatatagttacaaagcatattaagcatttaaaactcaacatgcatgcaaacatagttatcgatagtacatcctaaagcataacattcaagcatgacatatcaacccaccaagtatctataaaactcaatatgtaagcatagccattacatatacaatttattatattctaaagctaaacatataagcatgtgttgtaatatattccttacatcattttttttacaatatttcagcccaaattggtcaattatttctacaacatttaacttatattcactcttgtattccaccgcgaagcgcggtgcatcatctactatctttagattaacatagtcaccaaagtccacaagtccctagttggtacgccacataccactaaaaaaataattagcgttaaatacgaacaccaataccaagagtaggaccggaatccaagcaggtaggatctaccacaagaaactaaatcaattgaggtatgctcagtttgcatgaaataaataattatttttttgagaaaatatgaataacccctacaaattagtgatctttctaatctcccacctgcaagttagtttcatgcaaaacattgctcacaagtccattttctcttccaacttctcacctatatctatcttttattgatttctcatcgcgcttagcgattcctcgcatactgtggatctctagcatggtgtgcatggaattaatttgtagggaggacattgaaaaaactagtgacttgtagggggtatttggatttttttttcctctttaatttttatgtgatacttaaaccaagttgtggagggtttagacccttttttgtccaacttatgtactagctagtagattgctgaaacaaattatttgctccacacttcaaaaaatatacttttctaaaacaaattcttctattgcattacttagatcattgttttaacatattcgttaagtttatttctgaaaatatttaatttatgcatgtgatcacctagattgtccaatgcaataatccgctgaatagtctaaaatcaaacaggatattaatgttgctacagaacatttttacaaggcttcaaaatgcattaccccggttattactcgatctgcatttagaaaacactagccactccattgtttcgcttatgcgtatatttataagccaaaatttaaatttcaacacttaatttagatttgattttatggtttttcttatcatagtttatttcacaccatttgcttttgaatctctaaggacacgtatatggaagttttacccaaaaattattttggagaaaatttactatgtaccactaaatttgtcctagttcaataatttactattgacattaattgtcccttctataataaaccagcgagtttactaattattctataatatgccactatgcttgtttcttttttaaaaatacctagaacacccttataaacatacaagttaacaattgatttattctatcaaaaactttcagaaaaatatgaaatttttagcctctttacacaatatataagtttcagtatttttgcttttctatttttttcataatacaatttatctgctatatgctgtatgtgttgttgttttcaatgcaaatctttaaaaacctagacaacacattttttctattatataccaaacaaaaaataactttcttaaaaaaataaaataccaaaaattatcttgaaagttatatacaaactactttccatgttgtataaggaggctatataaaaatcatatttttttttgaaatttttattgtaataaatagattgttaaccttatatgtctttgagatattttgggtaattttgaaagaaaaagttagaacaatcgataaactcgctggtatattatattaagagacaatattaatgtcaaattgttaaaatgagatgacattggatagattatctcattttggttgtttataagtcgaacgataagtataagtgaaacgatggggctgcagataaactagctgagtttcaaaattttggtaagcacaagatgaactgaattcaaatttttggtaaattttatatgaatttcactggttttattaatgactgctcggttatttgtcgacaaaaccgttggcagcggttggtggacaaatggtccaggaaattaaagtcattctctgctatcatatcttcagatcgtcggtctctttgctattaattgcgttgtggaaaactcagctttgcttcctcgactggtcacttgatccccctcatttttactgacagtactgtttcaataagttttctagtatttacatgttaaaatataagggattttattcatataattatatagataaaatcctgatatttttggaacgaatgaggtagtacgtacctgtactatctgcatagtttccttctcttttagtggcaggttataacatactagggcgtgaagcttgtgagtattgtaggtaggatttattcggatactctaggagtctaggtgactaggtgcatgtttcttttttccctactagatatatgcctatatattaatgagaatatatgtacctttcaaatatattagagcatggatgatataaaatatgctgatgttaccatcacgacggagatctgccatgttgaaattaattaaatgacaaggacatcaggaggaggaaaatagtggagaaggatgatgccgtttgttaatgttaattagcaaatatataccactatggattctcaattgaaatttaagccaccttttgtttcaaaagttttattttagatcaccttaattaactaatattttcactcgagaccagttaaatttacatttttttactttaaccaccataattctcttctattgccatatttaaccacatccctccaacaaaagatatggcttgcgcacaagagaggggtcatggtgtgttggagataatgtactcaaggtcgttcatgtggttaagaaatggtttgggatggtccaaattactatataatgataaaattaactagtccaaagtaaaaaaggatggaacaaagggtgggctaaagttaaacttggtaataaagtgatccaaactgcaatttaacaatagttaattatataaatccactaagtgaaaaaaaaacttatggtacgagttatgtctatattattcaaatgtctctatactattttaaaagtgacagaacttactcccctaagtttaagtcccaaaattgacacgtgctcatttttacggctaattattttgttggtgctaggcaacgtacctatcgatatcgatatcgagatgtgcatggatacttcatcaatatttgccaatcttaaaatatgacacatcctaattctactctttcaaagatactcatagagatatgtgtgtgtatttacgtttatagagataattgtgtgcgtgttgtgtacatttatatttatactgtgtttctaaaaatattaaatatttagtcatgtggctgttactgtataaccgccgctgtagcttgatcgaggtctggttccatcttccagctctttcatctttcatctttgcacccaacccaaccaaacaagtcgctgctaacatgacagaaaagcccacctaaccgcgaacgtgcaggcaggtcgagggctgagctggccgctaacacacactcattagagcaggtacaatagcatactattagccagctataaacatattttaatgagataaacgataagagaaaaacagcgggctacagatctgtagccagcttcaacacgaactataagacgcaatgtgtatgataggtgggaccatatattaatagtatagtaagcggctattaaattggctataaataaattaaagccggtagtaggctatactattaaacttgctcagcagtaggtaatacgtctctttttcagtacagtccacatctttaagggacaagtcatgtgtgcctcgaacaataactggttggtccggagcacaagtcgcacaatctttttcagtgctgaataatatgcactgttcattccagtgggcctcaatttactgactcgttcgttatcactttcttgctgcccctccatattcggtaacctttgatattgtctattttctcgcacctccgtctcaccgatttcttgcagtaggcagctggcttgttcctaggctgagtcgtcttggcgtgcgggggcggtgatggcaatgtaggccctgtttggatctaagggatattttttagccctccctcaaatagcctaaataactcaaaaagatctaaaagggtgagctatttggaaatagcccacccaaaaaactatcccacccaaggggtgctaattggggctattttaggtggggcccactgaaaaagtggcttttctctctatctctctccatgagaaggtacattaaaagccagatagctctcaaaatagcccttcgatccaaacaacttagagctattttattggagagttattttcttgtgctaaaaaatagctctcaaaataactcttggctagttctccaaacagggccgtagttgaggagaggccaaacttgccgcacattaattgagataaaagccttccatttgttgaagtttgggtgcttaagctttatggtgtgattaggacatgtgacttttctttttcctggttaattacgataattacgacccttcagggttgtaatcttataatttttttctgctctatcaatagaacttcgcaccttctcgtacgagtcgttccaaaaaaaaaaggacgtgtgacttgacaacgacggtagcataggggttgacgaagacagctctgatggatctgccggtggtggaaggagggatcagttggccatcttagccgacatggacgatgcaatcgcgaaggactggggtggactcgatcaacatggcgtgatgctacggcacggcgagaatgcggcgctggaggatgagcgtggcggaggtgcggcgttagggcagcggtcctcgaaataggacgtcacggataggatgggcgtggcacgatggagtttgcatgacaaggaagagagtgaaaactctatttggtgcagacatgcgtgggtaggctacctcacacgacacggttttctaccgagccatcgcataaagcccaagatggcataggatgaagccgatgatcatgatggcacagggatgaaacccatgatggcttggatcaaccatatatagtaagtgtttagtgattttatgcttttgaattattttttaatttattttcaaagtatgtcaaaattgtgtaaacttttgatagagatttaaaacttttaacctgaactttaaactttctgcccaaaatttaaaaccttcatctagattttgaaactattaacttaaattttaaatattctactgaattttttaaaaaaaaataaattttaactcaaaatttaaaactttcaaatcaaattttaaaactttcatatcaaatttcaaaactttaaactcaatgttcaaaactttaaaccccaatttcaaaaactttcgactagatttttaaaatctttctaccacaaatttaaaaacttcaaactattccttaaaaacttttaactaaattatttatgtagtggttttttaaaaataataatactaactattgtcattagtgttaatatgctcatcggcgtaaggcgcgcgtggctgtgcaacttgcgtagctaggatatgcgcgcaaactagccaagcctgaaagagagggtgcatgaccagtatggcgctgctagggcatggaaagacatgagaaatgcagactccgatatcatgtgctccctccgttaaaagaaaaccacttctggatttaaatctagatagagaattacgagatgtcacgtactcaatgtgagagagggggaactgatatatatatagccaatatacaccagttataacatatgcccaaatagaggagatatatatggcaagaagagaaaaggtggctatataaatgtgcaaatatctataatttctttatagtagcggccatcaatccacctcccgctcgatccttgttggttcttcaccgtggtgagggctccattcctcttccttgtctgtatttcaaattttttccatgagatttgtctaccatggaagcaggataaagatgttaggatcggttagggttttcactataccttgcaccgccaccatccatcttcctcgaaaccgtctagtaggccactgtcgcctccctcggccatagacgctgaagcgtcccgaggaaatgtgttagaactcaaggtcgaagttgtcctgctagcttaggtccccaactccccatcgttaaaggcccaaggtggaaagggagaaagggcatggcatgggctttaggggcggtctgtcttcttgggcttgccaactggaggtaggaaggtcaggccagcctggtttggttggcctggtgggagagaaaatgaaaggaattgagaagaataagaagccaaattagactttaaataggtctcgaaggatttcaattctacaggaaaattttcctatgaaagtgtttgaaacaaaagattgaatcatatgctattctttgaaatttctattaaatggacaatcctatcgagattttaaaggaaatttaacaagtgctctaacctcttggaaatttttctttgagtctatctctctcatataattcttttgtttttcctgcggtctaatcaaaagattatttctgtgttttttttgtgtgttttgcaatcctctattttgaacttgcattcctatcaaaattctgcatttttcctattcctttttttttttcaatcctgctattcaaaatagcccttatgaattttagggtttggattaggtgagttgggttaggctaatagacttttaattctaagtttgaaaattagtttcttaaatattttagttcatgttaaggttttagaaaataaataatatttatttcctttttttaatataatttattgatttaaattaattcgtaatcatgtttttaataaatgttgtatgaatttcatattttaatttagaatttaaatatgttttttaattatcctctggatttatttattttatttttttgcactggcacagaaagggaaaatccaataaataccagcgtgatgcaatttgaaaaaggttttattattctaaatgtttgtctccaaattttcagatttaactattcaaacttgacaaataacgatccccccacttaatctgaagtggttttggttctacgtggcattcgcgtcacaatctggtcattatttttttattaaaaaaatcaatgagccacacctattagattctctcccttttcttatatattttcccttcttcagtgattaaattgaattaaactccaacatgctcgaccagtttcagactttcagtaccagttcactttaaaaaccaaaagtgataccaatattatttttagtgatggttttaaataactaggaatgctgtggtggtcgggattgatggttgtgtggtaatgtaaatttcataataatataatactccctccgtcccaaaatataacaacttttagcccttaggatttatcccaaaatataacaacttcttcaccaatattctcttcccaaccaatcacaattctccactattcacttctacctactttcttaataaccgtgttcaactctaaaacttcttatattatggaacggactccactattcacttctacttattttcttaataaccgtgttcaactttaaaacttcttatattatggaacggactccactattcacttctacttattttcttaataaccgtgttcaactctaaaacttcttatattgtggaacggagggagtagtttgctttgtttctacttcccgagttaacttatatctgttttatgcttatttagaatataggtttttttagtctttttggaaggacccacaccaaagtaatatatatatatatatatatatatatatatatatatatatatatatatatatatatatatatatattccaagctagaacattaatctttgtttcatctggatgtgtgtgttgttggatgtcgacactatttggtttcagccggaaaaaaaacggcattacaaatccgagaatttccacactggtgcttgccgtgcataaacttacgatatagatgcaatctatctattatattactagcaaaatgcccatgcgttgtactgggggaagaaaaaaatagtaattagtgtgtgggagcataaacaccaggttcattgaggtctttatagtcgaatcgaatctttctagtgcaaataagacgctaacatgatataattatttgttgctctaaatccactgacatggatactaaactttgaaaccacaaaaaaatatttacttttttgtcatgtattattatgagtcaattgcagtactttgttattttttttactcgatattgataagcactttttttcatattgtaaagagtaaccataatataagatatattttttgctagctatcagattaacctcactgcactccaattgcataaccactcacttaaataatcagaaggaaagaaaaaaatgtggtatatcgcagaataactttcactctaaataatagaagaaattatacgatgaatgaaaaaaagtgatgtgattaggtgtcctgtggcgaatgagcaattgatgagggaaaaaaaatccaaatgtaaacacgattcaatttgttggtgattactttttttttaaaaaaaagaaagacacatgtgattatttttatttttaaaaaagaatttattttgtcggtaaataattcattttattggtgactacatgttttaagtaataagatctcttctttactttattcgtgttcggttgctacagtgttgcgcagtactgtgctgggctggtgggctgcttctcctccgctctgtgggctcgctggtgggctgcggctgctatctgggccggtctgcagctgctttggatgggctgcctcgtcactaatccaatccgggctgctttggatggactgctccacaaacaaggttttctctttttatttttcttctctcctttatttgcaggcgtaagagatcgtggccacgctttcggatcgtggattagcgacgaattatcgtgtgggcccactcttaatgacggacgaaaagattaaccggaagccttacttattttttaattagttatatagatatagatagatatagattaaaggaatagaaaaaggagcctccacgttcgctcttatagcctagaaattctcacattaatcggagaaaaataaaaaaagtagagtccatataaaaatacaatttagaaatagctgaaattcggaattaaaaaataaaaaatattagaagaggagactagagtccatatagaaatacaatttagaaatagttgaaattcggaattaaaaaataaagaatattagaagaggagactagagtctatataaaaatacaattaggaaataactgaaattcggaattaaaaataaggaatattaaaagtagagtatagagtccatatagaaatacaattaggaaataatagaaattcagaattaaaaataaggaatattagaagtagagcatagagttcatgcagaaatacaattaagaaaaaaaatagaaattcggaattaaaaaataaggaatattagaagtagagtatagagtccatataggaatttaaaactaactaaagttcggaataaaaagagcctccacgttcgctcttatgaccgagaaattctcacattaatcggagaaaaagaaaaaaagcagagtccatacagaaatacaatttagaaatagctgaaattcagaattaaaaaataaggaatattagaagtagagtatagggtccatataagaatttaaaactaactaaaattcggaataaaaaggagcctccacgttcgctctcatgacctaaaattctcacattaattggagaaaagaaaaagatttataaatagctgaaattcggaattaaaaaataaagaatattagaagagcagactagagtccatatagaaatacaattaggaaataactgaaattcggaattaaaaataaggaatattagaagtagaatatagagttcatatagaaatacaattaggaaataatggaaattcgatattaaaaataaggaatattagaagtagagtatagagtccatatagaaatacaattaagaaaaaaaatagaaattcggaattaaaaaataagaaatattagaagtagagtatagagtccatataggaatttaaaactaactaaaattcagaataaacataataaaatgaaaagtagtgtttagagtccgtataaaaatataatttacaaataactaaaattcgaaattaaaaaaaacatgggaagaagagtttaaagttaagataggaatacaatttagaagtaactgaaattaaaattaaaaattaaagaatattgaaagatgagtttagagtccacgtagaaatacaattagaaataataaaaattcaaaattaaaaaaaaatattaaaagacaagtctaaagtccataaaggaatatatatgatttacaaataactaaaatttgatattaaaaataattaataactaacacgtatataaaatacaatataaatattacacatcagtagtttcgtaaagttattgcaaaatttaaaattatgttgtcattgtaatatattttaataatataatgacaaaacgtatatgctattatatgagagaaaatataatgatactatccgcgcaatttacgcgggacaccttgctagtttacaatatataaacatataagatgtttaaaccgttacaataatagttcacagcccacactggtgcaattgggctaatcagagcgattcggcatcaacatgtcttatatatacgtcggacgtccgaaaatttgcgaaatatcagacgatgctccgcatgcccctctacccctgctgttgccgtttttttgacaaattggtccttatagaaaacttatttcgaaactagtccataccaaaaactatatctagaggttgttcatatcagcgccaatgggactggcgctgacatcgcgccagcgtggcgggcgagacgcgacgtggcagggcctcagcgccaatgtatttggcgctgaccccttgtacaggctaattaaaaggatgcgcggccattaataagcaatgcacttgtggtgcaatggtatgaccatttgcttgtgtaccctagcaccatggttcgactccctatcacggcagccttgttcgttcttttttttttcttcaaatcttcaatctacgtgcgtacattagtacatataaatgattaatgatgctctctgttttttaaatatatatatatatatatatatatatatatatatatatatatcagaatatatgttctacagcggcgctggcctttatactggctaaataaaagcaaaagcaaaagcaacaattaggtttggcttagctcagtggtaggtatttgaaaggtggcgttacagtgaccagggttcgaaccctctcctttatgtttttactaaactttttttttacttagttctcaacttgcggttttaactttttcaaagctcaggtatttttaagtccattcttttatttttaaatatgtactaaatgtgttattccttttaaatattttttaaaaaagtgatatttcttttacaagctcaagtgttgttttaattttaaaaaaacacgtgacattttagaataaaacttacccttagttctcaacttgttgtttattttttaaaaaaaaactcaagtttttttaaatccattcttctaatttcttttttataaaaaagtgatatttcttttaaaagttgtctctaaactttttttaatccattcttctactttttaaatttgtactaaatgtgatatttctttttaataaaaattaatttaaacaaaaaaaagtacattgaagatttgaagacaaaaacgaaaatggagatcatcattaatatatacgcacgtagattgatgattttaaaaaaaaacaaaaatggctgacctgggattcgaaccctagtcctcagatatagcaagaaagaaacttaccgttgcaccacgagcgacaccgttaattcattgccgcacatcggtctatttagggtgtgcaaggtgtcagcgccaagtgcattggcgctgaggccctgccacatcgcgcctcgcccgccacgctggcgcgatgtcagcgccagtcccgttggcgcagataagaacaacctcagcaccaaccgctttggcgctgatccgacggcctatttctggatatagtttttggtagggactagtttcgaaataagttttctgcaaggaccaatttgtcaaaaaaacgccctgctgttgtgttgcatgcgctgctagctggcaagtagccactgccacatagcaactagcatgcctcttgctcacatgcagtgttgtttgaccatcattgctatttttttttctctccccattttcttatatatacgtacttattcattacatatctttacacaatattttcttttaaaaatacatatatgatgcacgatcaaattagaatattatatttgtcttaattaaatcgttagaataatatatcacattgatgaaattatatatatagtcaaccattgtttcactatttatataaaattgtttcatcgcatgaaaaaaaatgtttcaactcacttaataaatattttatagagatgcaacatttaaaagaattgtttcattatttatataaaattgtttcatcgcatgcaaaaaaaaatgtttcaactcatttaataaatattttatagaatgcaacatttaaaagatattgtctgcaaccatgataacaattagacgaaacattaagttctatgttatagcatgcatcaatcatcaagttgtagttgttgaaaaataaaaaatattgctgaaacattcaaaacgccaacatgtgcaacatttacaaattacatagtgaacaccacgaaatatttattgcaacatctaattaacactacgtgcaacatttaagactgcaacaaactaaaaacccatcaaaatattatcaagtgagatcttattataaagatataatcgtaataaatccaaccgtgtaattagattatagatcggatgaatagttgaatagacaaaatcatttgaattttgggatttaaatgagtggccgactgcttcttcagactgtatggtcatggtccatgacgtcatgccgcacaactaacgctgatgatgtggttaaactttcatcagacggctaattataagcatttctggaatcagcatcttgcaagtttgtccgatgttttggttccgcccggacgaccgatcctcttctgctctgccctggcttgactttcgttagatcttcttctacacaaacatttatacggaactagaaatagtttaccgggattgctatatggcattcgaatgaaatttagggatgaaatcttacagattttagaccattggatctatgccaagattcgtgcatcggcttctctcctccaactccggcgggctcctcttcttctccggcgccggcgacaccccaacttcggcgggttagggtttgaggttggggtgagggtaggaggagggttgggggagnnnnnnnnnnnnnnnnnnnnnnnnnnnnnnnnnnnnnnnnnnnnnnnnnnngagcagggtatcatgcttacacggcggnnnnnnnnngnggggggcgcaaaatgctngaaaagggtgtataggacgggaaagagtagatagggggagggaagccatttttctatcgtgagaacgcaatagtcaggcgg

SEQ ID NO: 34618 - DNA, 14516 bp, Oryza sativa
  unsure (1)..(14516): unsure at all n locations
natataataatgttcaacttcttcggcgggtaattatgttctcaattttatgagagagagagttgggtggcttcacagccatacgtcttaagattaataataaagaacttaaaaggtcttaatatggaaacgattgagaccgtcaaggcattaattggagcttcaaaaagaaactttaatgccctaatttcggaatattaacacctataatataaaggatgtttttcggtcaagtttgtcgtagaaaattgagggttttaatacccaagagagtgggattatctaaagaagcaccttgaaagggaactggtttaccagggaggcctcaccggcgccgttgaccttttccggccagccagcgaggcggccggcggcgcggtggggcggtgacggtggtgccggcagcggatcgcgcgtgggacgggaggagggtggcggcatgatctagaaaccggggggagaggaggaagttagggttaaggggctgcacgaatcttaaagcacatccaatggtccaaaattcgaatgataggaggtgggattttctgtcacatgatatatagacagcccctaaaaaaaataaataatttaccttcttgtccgagtcctatgctgttgcatttgactcccaagtttgatgctcatagaagatgttctatatataagaaatattgctccaaacaaaattattaacaagggattatataccaattgtaacactcgagaaaagaaacgaatggtcaccagttgatacaagatttttctcttcatacaggagtactacacagaatcacaataatattcaattcggtcagttactaacaccaatcatttgttacaatctctcaccaggaagtgaaacaaagttattctgtctatgctttgaattgttcgtgtgatccatcacattgctgcacagtcaacaaattcaaacttctccagaaagttaagcgagcagaagtaaaatctcgagccttttgagatctgtacagaagaacagtataagattcaagctagaagacggcttccactgggttcttggcatcgccctcgcaccgtaggagctggaaacgcatctgacagagtcctgattattctctccacctggagcattttctgcatcggcaatctatctgatgatagctgacgcaaccgctcgatgaaatcctccatgttcttcaccgcattcatcttacccacatccctttcaacaatctcgtagatcaaggaaattgctgagaggatgcccttacgtgtcaccggcccacttgcatcttcagccatgacgatattcaccaattgcaaagcctgatcacagatttttctgaaaacacgtggggattttggcagacggtcaagaagaagcaggatcccatcagtgaacatgtggcattccagcagcatctgaggcacctcatgaaatctggctggttgctcgccttcaccatctgcgtagagtgcaaggatcgcagtggcagcctccgttatcacttcagtatcctttatcttgagcatacctcgaagcattttcattccaccagcatccagcattcttttctgaacatgtcaaactctgacaggacagcaactatagaagctaccttcgccaaggatgatgttcgcttaccacgattgccagccttcttaacaattttttttatagcacctgctaattcattctgtccagctaggatctccctgttttgcctgtgcatggtcagattgaggattattgtgagcctctcttcctcaagatcttgtgtccaactcgatttatatttcctcctaagatttatcagcactgggataatgtccgcatacttggcaaggcaaggttgcacccctttggtggttttagtgagtagctggatcagtttcaaagcctctcgttgcgatgcagaattccctgagaatagttttaggatgcgttgaatttgttcctcctctgaaggttccaagggagtggaaggtgtatcagaagtggtagatggggaaaggtccgagtgatcgaggcaccatgcagaaatcatgtcacggagaaggtggtttggaacagagagagagtagggcaaggagtgatcagtaaatgtgctggtatttgtccatggattctgccgtttttggttgttttggtatgtttgatcaacagactgcaaccaaacaagcaaaatatggttactgggataatccaaatcatggtggatttgcagaacataaccaccatagctaacttcagaaaaacagcacacagtaacttattgtggcaaaaaaaaaaagttttactaatcaatatatcaagcaatagaatgctaaatcgccaaaatgttcataagttatggtacaggatattatagaaaaaggggcaaaagactatgcatgaatggaaatgaaagaaactagggtaaaattattattttgtcccgtgttctatccttcaggatcactatacattctagtcattatatcataagatgaacttatgaaccatcataacgtgcatgaataaagtatcaaacctaagcagcatttgacaattcaaactactacagaaagcaggaagcgggtgttaattttaacagaaccaagagaaggttagcatttgatttgaaagattaaaaaataggaatctaagatttaagatgatgcaaactcaagagtaaatctaatccaagaggatttgcattttagtgttcggcaagtgaagcctaaaaactagaagtgcattgtaaataacaatatttaaacaaggacactaattactaccatccagtgtaacaagtgtataagtacaacgaatcaatgttttgtcaattggtgatagataatttgcctggtttctgacaatcttagctttttggcagaacattagctacaacaaacaaaactgaaaacacccagcagataattatacagaattccaactggataaaaacctccattatctaaaacaaaattggataaaatcctagcaaaggggcaatcttgtcacttacatatccagaaggcaagataacaggatcacgcattacttccgcttgaagcgtaccatcctgtgaacacacataattgtaggattagtgtaggtgggtaagaaatggatcaaacttttgattcgatgcaactatcatacgtatgaagaagcagagatgggtcaatcgatttgactgaatgcaactgtcaggcaagatgccatgggacttgcacaaatgatcgaattcgagcgcgtgtaaggaaattcaaccagatgctaattaataatgcccaactaaaggaaagggaattcttcattgatcataaatagcacaagatgtttcccattggtgatcactgatcacgatgcagggaaagaatcaaacagcaggcagttcttgcacaacaacaaacaaaatagatgcagaaagaaatgcaattgatctccttaggaaattcctcgtcctaaaacaaacaggaacaaagaaattcctactacccaccagcagcaaaaacaaacaagaaacagaacaaggaggcgggtttgcaaagaggcaaagatgacaagaacatgaacagagctggaagcctcgacaagaaatgccaagaattcagagtcaagagaccaaggagcaggcacttacatgagcaataggaataggccatcttgtggcgaactcgtaaggcagctctggaggcttcgctttgcggtaggtgaggtccatgaggccggtcatcgcctgctccatcaccgcggacgccgcctcctcgtcgtcggcagcagcatcgtcgtcttggaacttggccaatgccatccgcatcatcgcggcgtagtcagacctcgtggggccatcatcggcgcccgcagctcttgctgggtcctcgttcttgggcgcagacccagccgtggcttcatcagcgccggcatttcttgctgggccatcgtcctcgggcgccgccgagcccgacgtgccggcaacatcagccgcccacgccggcgggaactggagcgggggcgggctcgatggtgtcctcaggggcgaggttggggcggaccgccaccctggcggcaatggcagcggatacaagccggcgtggtccaagccgaggctgctggagcgttgcaacccagacatgtccgccttggccttctttgccaactccatctcgaggcgaagctgcgcttcctccgcctccggatccatggccggcggtgtcctccttcccgaggaagaatcgctgcttcccgccggcggtgggtgggtgcccgtggcctcgagccggcggtcgaggagttcttggtttcttgcgttgcggggtggagtggagcgggtcggtttcttggagggaaaaatgtgaagaggtgtttggatacaaagaagcctggggcctttctatttataagccttgagttgaggacttgatgaccaggagatttctggttttgctgcccctgtgcagatgtaggacgtgaagcttctgacgagatttctggtttgccttgagtgaaacatgtaactctgcatcatggtgtcacttgatcatcaactgatgaacactgatctgaggtcttgacaggaagacgcatagaatggatcgatggttcttgctatctgggaaattgatcttgctgccatcagatattgctactagaacaaccactctgatcaagatcaattcgtatgtcagcaagtatgagccgtgtagctgagcctgagcgcaaccccgcataggcgacatcgatcacacatctagatctcttcaatctccactgcccggttgtcatcgtgtcaagacatctgccccagtgacacatgaaagcagaaggtgcccaattgggagccatcatgtccatggcaacagtgctctgcctccgccacgccatcgcggcaacccggtcaaaccgagcatcctggcccagatcccactgtacgttcacggcggttgaccctgccgcgcgctcatccccgaaggccgcagctggaacagcgccttcccctcgtgcggcatttcgtcgagcacctgagctgcatgccttgcccgcaagccccctctcttcgcggtcagcaccgaggcaccgagcgcccgcaccagcctcactcgccaagcgccaccgccggagacaacgcctcccaccacctcgccggctgcctcctccgtttgcatcctcctcgcgcccacgcgacggagaccgtggcgaaagcgcagacacgagtggtggtagcattcctgtggagtgtggagtggtgggagcccggccgccgatctagattctagagacatctagccctctaggccatataagcccaataaatctggccggaatttcccgctaactgcacttagagaatgttaaataaaggaataagttcacctgccatccctctttgacatcccttatcctctgtaccaaaaatcttcacccataaactatataaaactgtgcagtttagtcccataaacgtggcagcatagagcgaaacaaaaagtatgtagggcccatgtgtaagtgagagaataatgtgggccccacatctcttttttcttttctttattctcctctctccttacttctcttctcgggcgctcggcctctcgtcctcctcgctagcagtagatgggggggaggtggccgccaagcccgcccgagctccgccacctcgagaggctccgccgccgccacccccaacgacgacgacctttcttctacttaccgtcgcatggatcccgccgcggcctaggaaaggcgtcgtgccagcgcgggcgggtcccctatcggcggttcttactcttcagccgccgccgcatggatcccgtcactggcctaggaaggcgtcgtgccagtgcagatggatcccctttcggcctctcctcgtcctcgccgccgcggtatggatccccccgctcacctagggaggcatcatgccagtgatcttgccacacctcacccacctaccacccccacctccccatcaaacactaccaatatccatatccacccattcacgcgagcgactaatcaattcggtgagagtcaacggcggcggaggaggaggtggagaaagaggaggagagtagatctggcgggcggcagcgatgatgaagttgttgttgccgcaaagccagctgtggcaatcggcggcaactttggcagtgcagtcttcgggaagaggcatggcgtccggcggcgtcaatggggctggctccaacagtggcgcatggatgatggtcaacaacaaaacatcgttggtggcgagatgataccagtcgctggcggtgagaaaggcggggtgcttggtcaggcggtggagcacacgcacatgtcgtcgtcgtcgggtgcagcggcggcgaacatgggcgccgccctggcgcgtgtgcgtcgtcatcgtcatcgttaggtgcggtagcggcagtggtgacgacaaagcctcttgagatggcggagctcgcccaggcttgccggtcacctcttccccatctgccgccggcaaggaggatgagaggtcgagcccccaagaagagaaggagagaagagaataaagaaaagaaagaagagatgtggggcccacattattttgtctcacttacacatgggccccacataccttttgttttctctatgatgccacgtcggcaaaaccaggcatctatgctgctatgggacctaaattgcacagttttgtataatttatggggtgaagatttatgatattatggataagggatgtcaaacaaactcggtgtaaagttgaggaatgacaggtgaacttattccttcaataaacgtgcaaccaacgacatctaagagatagctaaactaccatacatacaacaacagactattaacttgctttcaccaattcaaggtttcaatgttttaaacttttaatcgtaacagtcccttgttccaaggagttgggcattgctgcatgttctatttttctattgtgcgccgtgacatgtagagagcccacgtatgtgcagatttgcataagcgcgtctaattagtcacgggcttttctctatacagtttactccctccgtcaaaaaaaaagtcaacctacctagtataatgaatctggacatccctttgtttatattcgcatcccttcctaggttggcttttttggaacggagggagtatttctctgctaatatgctaaaatcctactatataataattagattagattattaattcgctattgtactcgctcttacattactgcaacaaaaacttgccaagctggcaaacgagaaaaaagttttgagtgcacaacagaggcgacaacggcaaaacagtatcgatgcatggagatagagccgacttagatgatactaaacaaacttgtaataacataaacatatcctattcacataagcttttaatatatgttttgcatatcaattagcaaatataaccgaaaattttagaaaaaaaaattatacataaatttctaattacacttgtatgtaaattttatcttcaaattcattatattttaactgtaagaaaaaaaagataattctgataaattttaactgtaagtttcgactcatcaactctccaactgcccaaaaaataagtccgccatttttacatgcatcatcaatccatctaaacatacaccttacagttttcagtttgcgacacaacatacaacctgtgaaagtcctgctgataggggcaggcaggcactaggcagcgagggatgctgcggtttggtatatgggccatggcaaagccaacgttgggaaaattcttttcctcaatggcaaggtgtacaacatattatacctttctaggtgaaagaatccaaaaataaatcaatataaatggctccagaatgcctcatcaaatgttgcatttgtcgtacccataaaaccatgagctgggatcactgcttttggagacctcgaccgactggaagggcttgaactcctctcgccattgctcatcgccgaagctcccacctgtgtcgtatctagcggggccggtctcactaggctcaggtgactgtacaacattgctgggcagtttggattcagcgagccgctggtttagcacaagaacttcttggtcatgatcccttttcaagttgtcgatttctgcaaaggccttgttcatctcctgctctgctaactcagcccgcttctgcagcaaaggaaaatattgttcttagttttgatgaaatagtgacatcaactcaattatcattgttctaatttttcaggttacttaaattttagttgatactgcacaggtttaagataagtaacgagaaccagataaaaaaacaatgcaaatcatgaaaggcaaaataattggtagtacattatttccgaatgggaaattaagatgcatcaatggatattagcctgagacaagggtgcaattggctcacaagagttgatttgaacagaatttcatttggacgcagaagtgaaggcatggaaccataaaaaaacagaacaagggaagaattaggtgttcggttttaactgggagtatcgatgcaaacatcatcagattggctttgtactggagtctaaagcagagcatataaaaaagatgcttacactcaggatcacttactcgaggaatttagcatgtgataaatagctttataaattatagaatcaaacttaatgtacagtactccctccgtactcgtaaaggaagtcgtttacgacaatgtttaagtcaaatcttgggaatataaatcataaataactctcaagttgttgagtttgaaaatttaaaaattatatgaatagatttgtcttgaaaaatattttcataaaagtatacatatatcacttttcaataaatatttttatagaaacaagaagttaaagttgtgttttggagaccgtgtcgctgtccaaaacgacttcctttacgaatacagagggagtatgcgataactacgtaccaaggttccaagcatatctatgtatgcaaagcagaaaatgttacctgcgcaagtgatgcagcttcctcagcatcatttaaccgtacaagaagctcaccagcagcttgcacagcttcagcagtatcacttagctgttgctgaaggcctttattttcatccatccaaaaccgacgctccttctctcgctcagctcttaaaattgatacttgcctagcaagagcattaatgaacttagattcagcccctcgcacaccagcttttgcagcttcctttttcacatcttcaatcccatcattgatggtgcgacacattgagagcaaggatgcatgtttttcctgtaattcacaatactgttctaaaattctagcatgcccctgcattgccatttccaatgccccctttaattcctctgagcattgcttttctgattccacttcaagctgcaaacgttcagatagagatttactcttctcaagctcaactctaagctcttctgtaagagtaatccatctactctcagcagcatcgacaatgctgtggccgtcatcaccagcttcttccaaagccgaaatggttggacgatctgagacagtactaattgcctggacaagttcaactggaggcctacacaatgccattgatgatgacagcatgtaatgcaactgatttttcaggtgttggatttcctccagtaaaacttccttctcatccttgaagtttctgtacctctccaattcttcttggattctttcaagctcgattttagcactcaaaacttcaggatggttctcatacttctgatggagaatctgtttttgttgatacagagacatgtttaagaatatagctttgctcagttcaaaagaaccaagtagatatttggcaacatagaaaataaatggaaaagcagaagaccttgttttcgtcttggagagagagattctctgcatgcataagttcttcagttggtaaaatcccatccacaagtgtttcaagccttgcaattttttcttctcgtatttgtgcaattgcagcattgcattcacgttcatgcttatattgttgcacctgcaaaaggaaaacacttcagatcgacgaataaaagatcctaaaatctgatagcatgggcaaggcaccaaccaaacgttttagctgttgaatttcagcagcttgctttgcacactgttcatcacgtaacatctctcgtctgatggctccagcaaggaccttctccacagcctataggaataaaacaaacccttgcataagttgtcatgctgatattgcagataaatggtgcacacatctgcatagtaagttagtaacctactttaaagacttgttcctgttgctttagatcattagagggtattgatccatcaactgttactaactgtagatttatgcaatcagagatttctctgtttccatctgtagttgcttcaggctgattgctaggaattagagccatagtgttttgtcttggttcagattcttcggggtcggtttgaatagccacatcaactttgcaaactggaactgaaagatgagcgtccataagtctagtgttaagacctaatgatgatctcctccaagtaacactattccgatggctttcaatgacttgaaggcccttctgaatgcttgctgccaagtttgacttgcatctacttgtttcaacatccccgtgaggaaatgaagacttgttttctaaattacaaggcttttcaacatcattgtcatcaatctccatctcctcatcactatcatctttgatggtggggaatgcagttggacgactcaagctcattttcaaaagaaagctattttgagaattccacccagtggaagggctgccattgcttcctggcaagctcccatttgatctcacgtgttgaagctcctcctgcaataacgatagagccaattaattgaaaatcatgattaccaaaaagaaattaaaataataccttcagctgcctgatttgctcacggagaacattgacatcatcctctctttgttcattgacaacagcattgttttttatatcttttgcacggtgagcaaatcttagagtgcttagtgtttcactcttacagctgcagaagaaaaaacaaattataagcacatgaagaagcaagaatggcaaaagaaaatagcatgtcagtctcaaacagtacttctgtgatggtgaaaccgcacaaatcattgcgagcttagcattaccaccaagtgattcttgcaaaagaaaggttaatttcgaatctcgataaggaatatgatgcctttgttttccagactgggatacctccgccagtatattaatcaggtttctgcagcaacaataagtagaaaaataattagtgaatctttacttccctccgaccatattttttttatgattaggacaagatttggtcaaccttttgaaatttgatcatcaatgacttttcaactgcttattttataataaaaattggtgtatgcagatttgccttgaaaaatactatcataatattatgaacttattagaatttataaagttatataatataaaacgaatggtcaaattttcaaaagtttaatgaaatcctatcctaagcttcaaatatttctgaattctgaccagcgtaattaattttaaaatgcaaatgactgaatgtctatggtttgttagttctaaagaactttttttttgtgtggggggggggggggggaaggaacataatgtaactgtatctaggaaattttgcaatcatatagcagtataatgcaagacataaaggatcagttaaggagcccacatctagtccatgtcaaatcagtatgaaaaggccataaagaaatccctgggtatttgtctcaagtttagtaatttttcctgtcttcaatacatatttgtttccaaatgcattgtataccaggatgtatgaaaacattctcaaaatcatattaaaaaatgaaaatgacagtagtttcaaattcatgtaatactctccatttgttttatgaaatactgttcaaatatgaatttcaaatataaagggcacaacaatgcttcatatacatttagagactcacatctggccaattctatgatgactgatactttattaggtacactgaaactaatggtgcaacgtaaagaagctatgctaaatttatgatggcaacagggaatacttgtacaaaccaaccataaatccttcagatgcaacagaaagggcaatagtaattaggctttcaacacattcttcattcattgaacaaatcataccccaattgtgaaagtgaacggtttatgttccctgcttcttttaagcgatcaccagctgcgtttgttaatttctgccgttctgatccagcaagatcaaccaagttgatcctacttgttcttgtaaagtttgatccgtcctccatattctgtcaatagtaacaaagttgaagaactataagatcatgctgaacaataagttattggaagcatatgaattgaaattagcatcagagtaatttacaggtacttcatatatacatgataatccctccatcccaaattatgagccctatatttttttttacacggtctgcaatgacatactttgatcattaattcattacatgttatgtttctagtgaatatgaaattagcatcacatgaaagtactttaaaatatgaatctagtgatataacatgcataatatttagcatagatatggttagtatgattattagtcaaaagttaccaagtatgattttccttaaaaagggggtgacctataatttgggatggagggaatagctcgttgaatttacagagacagcataacatgcaaatacatgagcaaaagatgaatcaaaaggtaatgccaccattttttcccagggaatgcccaccatatgcgagaaagctaagtgtgaatatatgctcagcatgccagcaaaacacatgaagatgtaacagattacttaagactctctaaggatgtcctcaaagagccatcaatgcaactttgcactatcaggcatcaaggaaataccctaatggtaatgcgtccaaaaaattacaactacaagtagctatcctacaattcagttaaagtttgcgttctgtagggaaaaggaaaagattgaggcaagggtaataagagctactccaaagagaaaatgtcagttcagaaaaagaaagcaacctattgttaaaaaccaacaatgctcctataaaatacactttgctttctaatgtaataaaaagatgcaatcatgtgctcaaaaggttggttgaagggcagggatgagggataaaatttagagtttcactcgagtatgaataaggtaatactttggattctgacttaatgaaacaagtaaaaacacagtgtgatcgtgagctttctgcatttgcagtagtagcctcagttcttcggtttgccaaaccctgcaccatcattaataaataaaatgaaattatccatgaaagagatgcacattgccaggccatagggcagaaccattattaaagacacttgcatggaaaattatcaaaacatgcaaaaacagaaaatatgcatcatttcttatcttttttcttatctaaaattatcttaggatcaatttttcttagctactagtggaacaaataatcttaaaacgacataagctatgaagtagcatattattattatatggttagaacatctacatcaataaagcacttctgagcagtaaatacaacttttgttaaaaattggagtaagcatttatcattacaactacatggaagagcaaaacaagcactggtgataaggttttagatgataagacaaacagttttaccttttctagcaactgtgtaacatcatttatcgtgaacacggattcctttgtcaatgactcaacataaacagaagaagtaccaacatcttctctaatctgaaaatgtacgagacgtatcagaacagaagcagcctacataaacagaagaagtaccaacatcttctctaatctgaaaatgtacgagacgtatcagaacagaagcagcctaggaagtattttaattaaattctgaaactccatttcacctgaaggtttctttgcacggggtccaacaaatcagtaatttgttcattgtagatctgcatatcttaaaaagtaattctgaatttctatcacaagagagaatcataattattgtgattttagaggcttaaatagcacttgcctcaaggaaagagcagcagcaatggtatactagttgtttattggagtgtttagcttgctcctgcaaattaacagtacatatggacctttaatttgcaatcaggaaaaaagggagctatatagcaaatcatgacgtacctctttgatgcgtgaaaacagtagttcaaaaacacgaggagtcagccccctctctttgctgaccgtatcgtcggacaaggcagacagtggcccccacatcgtgtaagtcttccccctaccagtcttacaaagtagaaatttgattgtattagtcaatttgctttacagnnnnnnnnnnnnnnnnnnnnnnnnnnnnnnnnnnnnnnnnnnnnnnnnnnnnnnnnngtgaagngcccatcccttntaacac

SEQ ID NO: 34619 - DNA, 718 bp, Oryza sativa
  unsure (1)..(718): unsure at all n locations
ctgtcccttgatgaccactgttgtagcncncacncnattgcgttgccctgcatgataagcagcaaaattgcggccttgttgtggattgtgaagattttctcgaatgaattgttacattaggggatattcgccgtatgggatttgaattacatggggacagtttcacaagtggagaccagctcaagcccgctgtacgtttgaatggtgaaaatatgtatttccattagaatagttctacgtaaataagtaatgaattggtgtgcatcatttcacttggtctggtctaggctggacactgattttgtttaaaccattgccatttaatgcgatagcttaaaatgaattctaaattgaatgtacatgctttctatctctgaaaggtaaaaacaaaacaatttacacaggctggcaaggaatgtgtactaattaatggagatgttgcaggaaaattcttcaaccatatcattgtgtcttactcgaggattccagtacgaggggaatgaacgtggattgctaacctgctttcctgatactgatttgaccactgcaaaaaaccttatggaagccagaggaataaagcagctgcctgtcgtgaaacgtggtgtcggccatagaactgaaggaaaacgcaagcttattggtcttctacattatgattctattggtcactgcttacggntagtcataagcttatatgtgttctttcaaactttatatt

SEQ ID NO: 34620 - DNA, 6266 bp, Oryza sativa
  unsure (1)..(6266): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattagatctatcattgagcatgtgatatcaatataaataagagtatgaaattcctatagagtttttattggacaattatatttcatttgaagaaaaaaaatcatgtaatatattttctacagaaaaattttaggcttcgaataacataagattgtgaacaggtgatgatagccaatcatctagcaaaaccggtatgtgtaataagtccaaatactccctccgttctcgaataattgacattggcactattcaaatttcaactttgatcagttgtattttttgtgttaaatttatataacacttgaaaacatattatattatcgaagtgtgtagcatcataaatataaccatacatttctatttttatcataatataatcacctaaaagtaatccatggtcaaagtgagacggatgtaatcagcagtctcaattatttgaggacggaaggagaacagagggggtatttaaacagacttagcacagcagattagcaatccaaacagtactgatcagattcttgggcacttttgcttgtcttgtttaggcaaatcacccatacagatcaagagccgagacacagcaccatattagtaactcaacggctcggtgctcacccatctccagaaccagaaaagactcacaaccaatccatttcctaacaggtgtaagtctgacacagaacaccatcgagaatagcaggtttaccgagtgggtgaaacttgaaaaaggtgtaccatttctaacctagaataaaccatcagaaataagatggtcaataaaatagcctagaaccttttttgtcctcttgtttcaaggcggaaattagatagtctccaagttgcagttgttaaatctaagtaaaccaaagctacatatgcttccacaaattacgagagcacggaagtaacgaatcccccaactcctccgggatctctttttttctccccaaaaaaggagtagacccctctcccgaatctaatcaaatataggtactattcgcagtccacctccacccacaggaataaaagaaaagggaaagatcttagtagaaaacatccaagagcataacaataataagctactaataaaaggaatagtaacaaatttcaaaaacaaaaacccccttacccccgagctgcttgggcttgggctcgggctgggcctgggccctggcgtcgaccggcggcgcgggcggcagcaggaacgaggctggcgacgaggccacggactcgtcgagctcggcggcggcgcggccgaaccctagccagtccgcgcccccgagcagcgccggcgccgccgccggctgctgcggccgcgggtcgccgccgccctgctgctgcaacgagagcatctccgcgggggcgggggtgcctcctccctaaggtgaggccgccgctcggccggccagatcgcccgggcagccgcaggcagcggcagatcgggcggagggggaaagcgggagggggttgcttcgagcgccttcgagaaggtgggggaagagagaggagagagagagcagtaaatgccgccgtgttgggaatcgggaatggaaaacggaagagaagctgcagctgctggctgctgcgggacggagagggcaggtgtgcgatatatacggcatcgaggtggaggagacctgcccctgtgcagacggagtggggaaaaaaaggaatttatttttgctcttttcttttttttatctactaaaagattgtccagattcgttgtattagactatattagcttttttttatgccaacatatataaacttttttagattggtacggatattatgaaaatatgtgtgaatgttttaagaaaatgagtgattggttaaaaaaaataagtagataaaagagtatagttacgattggttgagagggtaaggtaggtggagaaataactttattttgggacaagataatatactagaaatagctatattttaaaatagaggtagtagggctacgcggcaccaggaaaatattctttttattttgtgttcttgcagctctgattatcttcttaaacctcatttacttaaatgcaatataatatatactccctatgtttcgaatgtttcgaaatgtttgacaccgttgattttttagcacatgtttgaccgttcgtcttattaaaaacgtttgtgagatatgtaaaattatatgcctacataaaaatatatttaacaatgaatcaaatgatagaaaaataattaataattacttaaattttttgaataagacgaacggtcaaacatgtgataaaaagtcaacagcgtcaaacatttcgaaacggagcgagtataaaagatccgaagcaatttacggcaaaataatttagttaccgttagacaaaaacttcgttgagttgtaaacacgactttttaggctcagtcttgtaggagtataaccgttaggtttaatttactattaaactaaggtttttcttgcggaaaatattaaactaatgtttgataatatatatctccatcctaatataagtgcatcctaatataagtgcacctagtaccaatatgatatttcatggtacaacgaacctacacctacacatacagctatccaaattcattgtactataaaatatcacatccagtttcatgtgtatttatattgggaaggaggagccccatcggttggcctaataaaccaaagcaaaagctaaaatttgatttttgaactgaattttaacaagattttaaaatattttcaatgtaattttgctacaaataaaagtgtaaaagttttacctataaattaattttattccctaataagccaaaccgatggggctagtagtatcctcgcatgattctttcagtacattccaatattacaataacatggttgtaacacatgaaaacagtctagatccaaataatgcaatactttcttctatcataaatatttgatatctttgtataaaatttagaaaaaaaaacttcactcattaattttacattatgacaagatgataaaatttattaagtttatgttgctaggatagtactccaaaacattttgtgtgtatgagaattgggaccatatattaacgatgtagtatataattataagtaactattgtataaatgaactattaaattggttatagatgatttggagctagtagttggctatctctaagcactttcaacaaaatggcattatcataatccactatccaccataataccaagcaaaacatcagcacacagaaccaatattttgtgaccaagcttaaagcataagggagagaaaagtccctcgtttttcatgcgcacgcttcctaaattgtaaaaggtatgttttttaatatatatatatatacatacatatataatgttttttaaaatcgtattaatctaccttttaagtttgaaataattaatactcaattaatcatgcgctaatcactcacttaaatttatgtatctttttaatcttcctattttccctcctctcaaacacacccttagtagttaaggcatactctgtagcaaatcatcacaagaacattgctcgacgtaggaggacaacagtaatgtgacataataatataactaaaatataatatattcatttgttgcgtagagatgttattgttattgacccatatacgtgtaacccgccctcttgccctacctgaacctgccaactactcatccacctcagtttcatactactcgcatgctagtactaaggttggtattcaaggaaaagcgtgaatagtaggtcttcaaacgtaagaatgaggtcgtattagagaatatgtaagccagaagtcattggatgatggtaacccatggtggagacgatgggaggtgagcaggggcttggcctccctcataatttgaggtttgcaatgttaatcactattgcttaagtggttttgcgtaaaattactatctctctttgtcctctttagcagaaaaatgaaaatagaatttaggattcttgttgtgtcattggagccgatgaaggacccgatgaagagaactagggatgagcatagatggtgctttcaaaatggtgctgcaataaatgttcataattgaagtcaacagttgggaaatcaagcttctccaaatttccaaatttgtagtacattttttattttgaattccatcctaaaatataagacacgatccattttttcccgtgtctcataatataaggcgtgcatgtatgcatacattaactatcaccttttaggccgcgttcgttacctcccgttcccaacttcgctccctcgtttttcgcacgcacactttttaaactgctaaacgatgcgttttttgtaaaaaaaaattctatacgaaagttgcttaaaaaatcatattaatccatttttcaaaaaattagcaaatacttaattaatcacccgctaatcattgctccgttttccgtgccagggagtgagggttcccaacccttactcccgaacgcagccttagatctataaatttggtttattttaaatcatgtaccatcaagtattccaatcatattgcttgcatatatggatgtgattcaatcgaggaggtgattaatcttttcttggtttttgtgttagaagtggttgagccttatattttgggatgaagggtgtagtacacttcatattgaaaattcataattggttattccatgttccaccaaaactcagctaaccgctggttgaaaatactactccatccattccattttgatcaccttaaaatttttgaggtcttccgaaaacagtcattatctaacaagggtctctttatttatttgtgcagagagtacatgtgcataattgaatgtattgcatgcatccaaccaaaattaatttctattgatgcaatggcatacagtatttaaaacatgagaaatccgcaggacacaaagcgatgaagcaccttaaccgaggaggattaatttaagaatgataaatatttttgggatccatagtcttggtgtcatttgcttatgggatgatcaaactggtatggagggagtattactaaacactagacacttagggtccgtttgatgcataggagttatcaaaaacatattcacatgaacttcgtaggagtcaattcatattatctagatttcaagtgcctgaaatttcccaaaaaaaaatcatatgccttttctaatccatacttatcaactatcactccccagtagtttgaaatctaacatagaaaatgtcgacgtttgatgtcgtgattccggtatttgcataatatggggatcgttggtactaggatatatgcgagactgaggtaaaagagatggggacgaggatttttatataggttcgggcccctgaattgtcaggtaataaccctactcctgttggccgaaaccagtcgttgctcttattcatcataatcacaccagtacaatatttggggtagcctatctatctgttgtcgacttggcggccataaaaccatcccgtagccgacaacagagtagtcttcctcctcgaatctgtatccggcgagatcaaagacagcgctatgtctctcctgatagtatccgtagacaccgtaggggactagccatgcttatctctgaagtcgatatccggcgtcttgtcttggtgtatgttgacttgtatgttgatcttgtgtattgatctattgttccgtctcccctctcctcctagggggccttgtatttatacccataggtgtccccttgtccaagtagaactaaggaaactaatatggatacaatccgagtagttcttgttgtttccatgtagaactctagtcatcctcccttatgcggaactcctcctatatccgaaggttgtttccatataagacaaggtatgtggtgggtcctgccgagatttagtcaactactattaggtatgtgctatccataaccctgacagaaaaaaattacaaaattagatgaaaacaaacttaattataactcacaaacaatacaaagtcacataaaaatcaaacttagacaaaaaaaagaagtaaaactatctataacaacatatttgcttttgaaatgaataaaagttgcacattgcaacttagggttagtagtgtacaattttaggtgactagaaatttatannnnnnnnnnnnnnnnnnnnnnnnnnnnnnnnnnntatcgactatcaacnngtacacgg

SEQ ID NO: 34621 - DNA, 10845 bp, Oryza sativa
  unsure (1)..(10845): unsure at all n locations
atgtgccnnttggatggaaccccnctctnnnnnnnnnnnnnnnnnnnnnnnnnnnnnnnnnnnnnnnnnnnnnnnnnnnnnnnnnnnnnnataccatatacctaatagtagttgactaaatctcggcaggatccaccacataccatgtcttatacggaaactgacctcgagggagttccggataaggaaagacaaccagagttctacatgaaaacgacaaggactactcggattgtatccatattagtttccctagttctacttagacaaggcgacacctataggtataaatacaagccccctaggaggacagcgggacacccaccatggggtgatcaacacagacaatcaacgacctcaatcaacacccaacacgttacacgggacaacatacaagcctacatacgccaagacaagacgccggatattgacttcagggataagcacggctattctcttacggtgtctcaagatactgtcaggagagacgaaggcgctatctctgatcttgccgggcacggattcgaggaggaagattaccctgttgtcgactacgagtcagaccttcagaccgccatgtcgacaacagttagataggctaccccacatattgtactggtattattatggtgaataaagagcaacaccggctccggccaacaggatgtagggctattacctgaccgctcagggacccgaacctgtataaaaatcctcgtctccatctcttttaccttagtctggcgtatatcttagcaccaacgatccccatattgtccaaataccgtagtcgagacatcaaacgtcgacaaaatctagcaattttcattcttgaaacaattgtttagttttatgaaatcatactgttatattcctaggacacgcgaaagttagggtttgattgactcattaccgagggcatgttggaaagagttgtgtggctgttgtgcttattcttgcacatgaaactgaacggatcatcactagcacatgattagttaaatatcagctattataaatttttaaaaatgtatttatttgatctttttttaaaaaaacttctatatagaaaatttttatacaaaacatcacaagtagcagttcggaaaatgtgtaaatgaaaatcgagtaagttgtcgtttggagttgttggaaataacagcctaagagtgtgcgaaggcacaagcctctggaatacatatctaaagttggtcataataattctttgtatataagcaattcttctttatcactgggtataaatcaaccgcggctctgataaacaaacgttttgaataatgtctaaatacaaagatgatatgcatatcttggtgagcaccaaacaatgctcgacatcatgagaaccttatcccttggaaaaaagggtgctgtgctatctttttcttattaagtatgggcgtgaagcatcagaaggggtttcattggttaggcggttgagcaccgcaaccttcttggctcttttccacggagagtgagacacatgcaaatggagaaagcgactgagagtcgatcgatccgttaatatgaacactgctctggctctcgatggagtctcctcgatctcctggagccgacaattcaagagccagcccaactgtgatggaggagggaagaatcatctccgccaggtctagccaaacacaccaattaagtgattaacctgacagattagcttgatcggatccagtgtgcagacgcgtgctgcgcctcctcttgcctaggtctagttcttttctttttaacttcaaacttcacatttctcgtattttattaacacgattttcaaactattaaatagtatattttttaaaaaaaatattagattgtttgaaaaaaattaaataaatcattaattgctacttaattaattatatgctaatgagttttatcttttgcgtgtgctgaaaatctttctctaacttgagagactcagcttagaataattagatatcactgctcgatcaatggtttgggttagcagtaaaattatcatggcaaaatccatactgtaggtgagagtgtgagaccatgcatgaaacctccttgcaaatggaaaagaatatagaaaagaaagtagatattcgatgttcatgtacacatagaccagtggttagtaaaacactgccacataggtgtttaacggttcataggaataacacaatgattttcggtatcgatgtaaatcggaagccttgaaatagcttttatacgaggatctcaattaattagaaatgctcaaatacatgcatatttgttagatcctgcgaaatttatctgaagttatcactcgttctaattaattaaggcctccttgaaacctataaatattccatatatgattcatgtgcaaaacaaagttgcattcttacaaaaccttacaaaattaagccctttgattcaaaggaaaatcatagaaattttagagaattttatttttataggattttctatataaaattatttgaatcaaaggaataaaccctatgaatcctaccaaattcatatggaatgtctcattccaatgtaagttttgaaggaaatttaacaagaggtagaacctcatgaaaagttttatttgagtctttatctctcctcaaatttctatgcttttgtgtgtgtctattgttagaaatttggtcataattcggcatattttaatccaaaatattaagataatacatatgacatttgtaatttgagtagatctagtgaaattgctagatgtgtacaacatgagcatgcttaatatagaataagtatcaacatagacaagagaacgcaataatattgcgacctacagttataggaaacgaagaacgaacggtaatagtgaaacgttatacaccgagaatggccatccgctggagtttgagacagtattgcctccgttggtgttgacgggaggctcctcctccttgtcaccagtgttgttgttgtcgccggttgtcgacatgttggtgaagatgatgcagagcagtcgcgcttgaagcgctacccaaaaacatgatcgcccgcctacccgtgcaggttctcaagcggacggagtttcggaggcacctgctcgttccgatcacctgtgtgcacgggatgaacagaaccggggaaacagagagacatcacaggaacataaggagagtatcaccaagaaacaatagcagaaggaagacacaatctttgagagcctctgttttgctttatatatagagagagatctccattaccatacaaataaatctcatttattgtgaaggttaccacaaaataaatctcatttgttgtgaaggttaccacacaatgaatctttcatttgttgtgaaggttacaacaaataaatctctcatttgttctggatgttacaacacaatgaatctcttatttattgtggaggttacaacacaaataatttcatttgttaatggtgactttattctcgtctgttacaaaacggaagagcagcaggcaggctcggctcggtcggccgcctcgtctcgctacgcccacggccgaggccgactcggcacgcgcgcatgcgtgtggcagtccaaccatcacctcaaccggtcaacaagaaatccccaatatcactctatttaagttgaggttcttccacctaaattttcaatgcagtattattgtctctaacattacttgtgggctattaagattttaatttaattaaattgggcctagcccatttattccaacatccattgctcctaatcaaaaggtcattccggtgttttattatgttttacaatcctatattttatacttatattttgtcaaaattctatatttttgttccttcttttttattcctacaattgaaaggggcatagtgtattctaaattcctctggaaaatactcaggacacttggcaagccaatcgagtcacggttgtccaagttaaaaaaaaaaaaagagccatggttggaagctgccgtagaagatcatttggtggcaaggaaagacaactgccgcgaagactacagacaagcctcgccgtgtcagtcaactccaccacactcatgtctccacgtttattattctgcaaacgattttccctccccaatttatattattccactcaaagagtacattagtaatttcgaacgaattggtctggtctagtttgaagactatatagtgtgaaaaatgtgttaccttaagaaaaaagaacttcactctagctaatcgataatacgatttatgtgtcgcgctcaaaaaaaaaaaaaagcccatcaatgccctcatgtacgcattgcatgcatatgctgttggaaatatggttatatatcggtatattttaatccaaaatattaagacaataattatggcatgaacaatgtggggtgatctagtgataaaatcaaacataaacaggagcacgcttaagatagaataagcatcatcatcatacatagaacgcaattgcattgcgactaacagagatatcaaaaaccgaaataacagtagagagttataccctgtgaatgtccctccgctggattgtgaagcagagctgcctccattggtattgtcgatcggtgcacctggtgcggcagctcttgctctggctcccggcgcgccatctccaggtgcagatgcggcagacatggttgatgcagacgtacggtcgacgacgaacagaggacgaggagcagtcatgcggaagcactccccaaaaacctgatcacccgcctacccggtgcagatctcaggcgaaggcgtggttccggaggccctgctcgttccgatctctcgtgcgcgcaagcgatcagaaccggggatgtagacagaagcagcacaggcagcggcggcggcacgcggaggaggaagaaccagcgtttggaaaataaccgagaggatctgatcgggttcccactttccttatgggcgcaggagagagatccgcccgtggaggaagaaccagcgtttggaaaataaccgagaggatatgattaggttccctctttccttatgggcgcaggagagagatccgcccgttaccgcagtaacgacgcgatcaatgggtattgaatcgggttccctctttccttatgggcgtaggagagagatccgcctgttgccgcagtaacgacgcgatcaatgggtattgaatcgccctctttccttatgggcgcaggagagagatccgtccgttgccgcagtaacgacgcgatcaatgggtattgaatcgcctacccgttgtcgcaacgccacgtctcgccctggccggctcggctcagcgtgcgcgcacgcgtgtggctttccgatccccacctcaaccggtcaacagggagcctccaataactccctatttaagttgagatactcctcgtttaattcccaaggtggtaatattattcttaacatttattatgggccttttgagatttaatagaaaaatcaggcctagcccatttattctaacatatgcctccatccacctgttacacaatgcacacttgaaaatattttttttcctacttatatagtttagccgaaaaacatagctatacataaatacaagagaattttctatttggcctccaaagttgatcgattttctcattttccccacgaaattgattgtccctctaatgccttgcattcgtaacttttgtcctccatggctccatcttttattttgtttgttttccatcaagtaggtgggtaaaaatgacagctttgcctcagcttgttttatgcatgtcagtagtttttatttttcttttgggtgggattatactttgttattatggaccaacggttattgaatatttctcacgaacctaaatgttattttgagtaatgaagcgttatgaaaaaccctttgaatttgataaataacttttgagaacgaagggggagccaatttcgtaaggacaataggggaaccgatcaactttggagcacagataaagaattttctcttcgtactacttgagtgaattgcagtttagaccacccttttatcgttgaagtttcactttagattatcccatatattaatcaatatttcttcactttgagctaggtaattttatttttattgcatatcaataatcttgagtacacctgtccctgtaggttgatgaactctatcacctatgcatgtacctttactaaaggagaggctagacatgattagagaagtgagttggagtggtccataatgcaaaagtataaagttacctaccccaaagtactccctctatccgtgaatataagggatttttttttacaagaatcaaggaagtagtaaaataacatgtgatgagacaaaaggtgatggataaaagaataaagtagtataaagttagtaggtgggagaataaattagtataaaagtaaatgatggagaaataaactagtatataagttggtacatagaaaatatagtactgtcttgggtcttaaaaccccttatgttgtaggacaaacttgatggagaaaattccttatattatagggtgaatagccgaagtggtccttcaagtttcatctgaggctcagtttaatccttgatgtttcaatctttccatattagtcctttaagtttttattttagtttaaacttatccttgaaccaacaactctcttgataaataacacttatacccccatcattcacatatataagagaaaaattgtatgcttgatttttttatagataatgtatagtaaattatgtaaaacgaaaataaattatgtactagcaagtgtatacgatagcaattgcttaagtttcatgtgcacatgtagaaataatgggaagtatatctacaatgttatttattcatcttggttttatcctttttatatatagttgtatataaattaagggcaaaagggacattttctaatagaaatattgactaaaaatagccatatggcatgttaagtgggcccaaggatgatgtcaagccaaaacaaatatttagaggagctatgtggacaaaataaaaagtgaaggaccaaattgagccttcgataaaacttggaggactaaattagctattcaccctatattataggatggatggagtagaaagattagtgtacaatatacaagctgaaaatttgataataaaagttgagtcaaaatggaattcactctagatactttgacgaagagtatctcattactgttgtttcaatgtgccaaattggaatgtgatgcatactccctccgtccaaaaaaagacaaaccctggtttccgtgcccaacgtttgatcgtccgtcttatttgaaaaaattatgaaaaaaattaaaaagacaagtcacgcataaaatattaatcatgttttatcatctaacaataataaaaatacgaattataaaaaaaattatataagacagacagttaaagttggacacggaaactcaggatttgctttttgttaagacggagggagtacatgcgtggccaagagttgttaaacccgctgaccacaattccagaagcatatgaaagctgaaattgtccatgcatgccagccgagctaaccatgcatgggttgacagctatcgcgttttatgtacggaaaggtcgtctcaatttaattggcatacggatcatccaacaaacgggagtcgaaatgaaggccccatacaaatattttataccctctcgtatcgaatgtttaaacacatatataaagtattaaatataggttaaaaaaataaccaattgcacatattacaactaattttgcgagacgaattttttgagcctaattgctccatgatttgataatgtggtgctacagtaaacatttactaatgatggattaattaggcttaacaaattcgtctcacttgtttaataacggattctgtaagtagttttttattagtacccgaaaaccctatgcgatatcctactacctctgtcccaaaataagtgcagccatgagtttccatgtccgactttgatcgtccgtcttatttgaaaatttttttattaatattttattgttattaaattataaaacatgaatagtactttatgtgtgacttatttttttagtttttcaaaaaaaaaaagacgaacgattaaagttggacacagaaacttatgactgcacttattgtggaacggagaaagtactactcaatgtgatatacacccccgaaatttaaagggtaaattggaaacatgccattgtaattttacaaagtttgagatatgccatcggtatctcaatgatatataggacccacatgagtcaatgacatgtgggtcaggatagtatatcttaaattttgtaaaatttataatggcatggttccaattttcccaaatttaatttaaaagctaaggtaaggagtaggcatcgtgagagatatggtacgtaggcccatctggcctttctaccaaatcgccaaccacgcaccttgattccgtatcacgcgacctccagcggttgacacctgtgccgcttctctgtcgcaggatcactggtcagatcggattcgacgacggggaaggagacactcgtcgcgggcagcagcacccgacagaagcacgcggggacgtctccccgtcggcgccagctgccttgcaaagccaaaactaaatgggggcatttgcaaatttgccaccgattttttcaatattgcaaggatgccactcgaatgatagttttaatggtatttttgtaattttctagtgacagttttataataacgattcaagatagtgataaatttacaattgccccaaactaaattaccccaccaacccgtaaaacggagcaatcactagtatatgattaactaaatattaattttttaaaaaaagtaaattaatatgattttttaaaaaactttctataatattttaaaaatacaccccgttcagccgtttgaaaaatgtgtgtgaaaaatgaataagatgagttgagaagtaagagtggtaagttgggaaaggagaaagatcggtgaataactccactattccatcttttcaaaaaatacattagattgaaaacccaatgtacatagccatagtgctcgactattccacgcagttagacgtaaaatgtgtcaatttcctgttcttgttcatattaaatgcctttaaacttagcatttctttcttaagaaaaaaaacttggcatttctttcatgttagaaactagcagcatttactaaggggtaaactcgtctaaaatgtccagcactatatggaacgatatacattttcgtccattctgtaaaacgctacaacaataggaaatatgattaatgaaatattcctggaaaaatcctttgtcttgacgaaataaagtgtgcattatatttttgttcatagattcatgtcaccgcttgtgtcgggaatactatgtgtatcactcaagtaaaacaaatgttttgtaggaaacatgaatcaaccgcatgtgttgggaatacatattttttcaaagaagatgaatggtcaatcatatcccgttatatattaaaaagttggagggagcaactattataaagttaaaaatatattttttttgatttttttaaacttgaatataacctttttcatatatcgtttagtagttaaaatatgctcacaataaatgaggaagtagcccaatgcaacagctcttcaagctctgttcgatgcggcgattggatttagttagttattagaacatgattaattaagtgtaaacaattatattttaaaacataaatatatttatgtttttctttagaaaatttatatagaaagtttttacgtgaaatacgcactgttagctgtgagcttacggtaaacaagagatgaatcgaacctaatctcagtttataacacgatcttaagtatcctaaggaagatatatggcctgtttatattagtgttaaaatcaacctttccaaaatggtcgtcaatgtttggtaggatatgctaaatgtattgccgccaagattctctagggattaccaatctcaatcttcacatctatatctttatcaattatactaaaaattttatatgattcaaaattacaccaatctgaacaggctcatacatactttggtatgtcagggcttgtttggttcaataccctatcaaaatattggtagtgccaaaacctaggcaagttttggtactaccaatttttttggtagggtagagttatatttggtttgagaccaatttagaaccaagcattgagtagaatatagaaaatatcaaattgggcattggcaatgccaatgatttggcttcaaaccaaaatcaccagatacactgttcaaactaccaaagtattggtagggcacgtttttggcactaatccaaaacagccctcattctccccgtgttggaaactaactttatggagaaacgcaatgtttctaaaagcacgatcaacagagggagcaaacaacaccatcaaattccagcacgaccgagcaagtgttgattccaaatatatttttggaattgtttggcacaaatccatttaaactgagagtaaagttgagtggagctcagccaaacagtttcagctccacataaactaggagcggagctgggtgaagcgttatcacaaaatgaactagagatatggagctgggttttggctgctccacaacttcactccagacccaactcctagagccaaattttggagttggagttctaccaaacatgacttttttttaaaaaaaaccctcaaatataaaaatactcgagtctactctacctccatccagtttttaatttaaaccagcgctactactgctccagccacttcattcaaggccgtcgtgtatagaaccagctgattcggcaaaacaatgantcatccgg

SEQ ID NO: 34622 - DNA, 1007 bp, Oryza sativa
agtacgagattcgagtcaatccgcggaagacacctcctacttatttcgaacgaagattgacacgacttttctaaggaaaatcgctagcgccgatgtgaaattgaaagctgctgagttaagcacctccgacctagttactttcccgattgctagcccctggaagagtagtgacaataagcttactaagagcctctcacggaactccttaagaagagaatgaaaattcccccctcacttctcctcccttcctcgtcatcatcctccattctcgaagccagacccatacagcgatgagggtccctcttctcgtccaagctctcccgcgcgcaggcctccccgccgccgcggccgccgcacgccgccgcgggcggcggcggagacgcccacacgccctcgtcgcacggccaccgccaccgccgcttccccaaggagaacgtcgacccgtccccctccccgggcccgtacgaccaccactccgcttaccgctccccgtcgggcaagcagcagcagcagcagcccctcgccgccaagaaccgcagcctcccgccgcggcccccgctcaagcgcaagctcctcgacgtctccgccgcctcccccgcgcccgagggcgcgcccagcggcggcggcggcggcgattctggcgtccaggtaggctagggtttcggattgggtggagccgagagggaccttggctggatctggttttgatggttgtggttttgccgtggcaggttgtggtgagggtgcgtccgccgagccgcgcggaggaggaggatgagggggccgggaaggaggtgtgcgtacggaagaccggccctggctccgtcgagatacatgggcaggggttcaccttcgattcggtcgctgatgaggcctccacgcaggtaggaggagggtatacgattttagttccaattttagtgtgttcagatttacacgtttgcagttgtgtggggtacacaactcaaattcgcgctgtttcaaacgattgtcaacaaaggggcgcg

SEQ ID NO: 34623 - DNA, 1242 bp, Oryza sativa
  unsure (1)..(1242): unsure at all n locations
aaaggagaagaagcgccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaataatgtactaccaattattttgcctttcatgatttgcattgtttttttatctggttctcgttacttatcttaaacctgtgcagtatcaactaaaatttaagtaacctgaaaaattagaacaatgataattgagttgatgtcactatttcatcaaaactaagaacaatattttcctttgctgcagaagcgggctgagttagcagagcaggagatgaacaaggcctttgcagaaatcgacaacttgaaaagggatcatgaccaagaagttcttgtgctaaaccagcggctcgctgaatccaaactgcccagcaatgttgtacagtcacctgagcctagtgagaccggccccgctagatacgacacaggtgggagcttcggcgatgagcaatggcgagaggagttcaagcccttccagtcggtcgaggtctccaaaagcagtgatcccagctcatggttttatgggtacgacaaatgcaacatttgatgaggcattctggagccatttatattgatttatttttggattctttcacctagaaaggtataatatgttgtacaccttgccattgaggaaaagaattttcccaacgttggctttgccatggcccatataccaaaccgcagcattcctcgctggctagtgcctgcctgccctatcaacaagactttcacaggttgtatgttgtgtcgcaaactgaaaacctgaaggtgtatgtttagatggattgatgatgcatgtaaaaatggcggacttattntttgggcagttggagagttgatgagtcaaaacttacaatttaaaattattaaaattatttttttttttttacagttaaaatataaggatttggaagataaatttacttccaagtgtaattaggaaattatgtttaattttcttctcttaaattttcggtttttg

SEQ ID NO: 34624 - DNA, 744 bp, Oryza sativa
  unsure (1)..(744): unsure at all n locations
gtgtgcncnnnangtagcgactnnnnnnnnnnnnnnnnnnnnnnnnnnnnnnnnnnnnnnnnnnnnnnnnnnnnnnnnnnnnnnnnnnctaaagtttagagaccaaaagtttataagtcaaaagtttatatatccgattcaaatttgaatttgaattcaaataattttttatatatagtatttctatacatctaaagtttatacacctaaagtttatagacctaaagtttatatacccgtttcaaatttgaatttgaattatatctgaatcaaatttgaatttgaattcaaatattttctatatatagtatttctatacatctaaagtttatacacctaaagtttatacacctaaagtttatagatccaaagtttataagacaaaagtttacgtacccgattcaaatttgaatttgaattcaaatattttctatatatagtacttctatacatctaaagtttatacacctaaaaactatagacccaaagtttataagtcaaaagtttacatacccgattcaaatttgaatttaaattcaaattttttatatatagtatctctcccttatccaagaaacaaaaggggacctctctctctcccttatccacactcacagaaacaaaaggggaccgggcggccctcgggagaggcggcggcggaggacccgacggcccttcggagaggcggcaatggtggttcggcggtaccccattcttnctccccttctttcttcccttctnccn

SEQ ID NO: 34625 - DNA, 741 bp, Oryza sativa
  unsure (1)..(741): unsure at all n locations
tgagtgnnnnangtacgacagtctcttttnnnnnnnnnnnnnnnnnnnnnnnnnnnnnnnnnnnnnnnnnnnnnnnnnnnnnnnnnaccactagtggaaaattgtttggatggcttcaacagttcaattttcgcttatggacaggtaaatgtggcttcagccacctttcatttttctgctctactgggggttctgtaaagcaaattgactaatacaatcaaatttctactttgtaagactggtagtgggaagacttacacgatgtgggggccactgtctgccttgtccgacgatacggtcagcaaagagagggggctgactcctcgtgtttttgaactactgttttcacgcatcaaagaggtacgtcatgatttgctatatagcttcctttttttctgattgcaaattaaaggtccatatgtactggtaatttgcaggagcaagctaaacactccaattaacaactagtataccattgctgctgctctttccttgaggcaagtgctatttaagccttttaaatcacaataattatgaatctctcttgtgatagaaattcagaattactttttaagatatgcagatctacattgaacaaattactgatttgttggaccccgtgcaaagaaaccttcaggggaaatggggtttcaaaattaattaaaatacttcctaggctgcttctgttctgatacgtctcgtacattttcagattaagagagatgtttgtacttcttctgt

SEQ ID NO: 34626 - DNA, 742 bp, Oryza sativa
  unsure (1)..(742): unsure at all n locations
gtgtcccnnanggtttgacnnnnnnnnnnnnnnnnnnnnnnnnnnnnnnnnnnnnnnnnnnnnnnnnnnnnnnnnnnnnnnnnnnntgccctccggacgtggtgagccaccaaagtctccatgcatttaaagggggaatgacagggatgtcccccgtgtcaggcgggggacggcgctgggccccacccaaggacgcacagccaccttgcttccggttgaaggcacgaatggcggtctaatcgaggcagggggggttcctctcccctggaggagtaggtatggacggtgcatgtggtatccccttgaactataaaaggaggacctcgcccaccgaaaaaagtgacgactctcagatagttttgagttcgagaggaagaacggctagggtcccctccagagctcaagacatcctgtaaaagttgatcataatcccatgcacaggagtagggtattacgctcgatagcggcccgaacctgtataatcctttgtcttccacacagccccgagagcgatttagtaggtaaacgccaagccgaagtaggcccttgatcatcgcgctgtatcccccggtcgaactcacaaaggggggggggggtctcacgaccacccgctagagagggaagctcctcgacagaacccatcactggaatggaaagcgaccttaaaaaaatggggcccagttgcaaccatagaaaattggttatagaaaccgaagaactaataataaccccaaacattcaa

SEQ ID NO: 34627 - DNA, 773 bp, Oryza sativa
  unsure (1)..(773): unsure at all n locations
catgtgggttttgatcgcctgttgtttagngtcnnnnnnnnnnnnnnnnnnnnnnnnnnnnnnnnnnnnnnnnnnnnnnnnnnnnnnccatttttttaagatgactttccattccagtgatgggttctgtcgaggagcaaccctctctagcgggtggtcgtgagacccccccccccctttgtgagttcgaccgggggatacagcgcgatgatcaagggcctacttcggcttggcgtttaactactaaatcgctctcggggctgtgtggaagacaaaggattatacaggttcgggccgctatcgagcgtaataccctactcctgtgcatgggattatgatcaacttttacaggatgtcttgagctctggaggggaccctagccgttcttcctctcgaactcaaaactatctgagagtcgtcacttttttcggtgggcgagggcctccttttatagttcaaggggataccacatgcaccgtgcatacctactcctccaggggagaggaacccaccctgccttgattagaccgccattctggcctttaaccggaagcaaagtgggtgtgcggtctttggtggggcccatgggcgtcccccgcctgaaacggggacattcctggcattcccctttaaagcatggagactttggtggctcaccacgtccgggggcacccctggcagattactgacaggaccgggcggacctgccccatttcgcctgacacaaggcgggacgtggggcgctttgcgccctcccaaaacctgggaccggg

SEQ ID NO: 34628 - DNA, 710 bp, Oryza sativa
gactgtgcccattgaatgcactcgaactctcgccgccttcaacgccatcgggaccctcaccgtgtacctcatcatcatcggtaacgcaccacagcatatctccccccgagccgtacacccagcgaacctgcagcgctggtcgccgcgtgcagacgagtgatatttccggggattttggtgtgagtgttcctgcaggcgacgtgatgtccggcacgacgagcgacgggaaggtgcacgacggggtgctgacggagtggttcgggcagcaatggtggacagggcgggaggcggtgctggtggcagccgcggtgctcctcctccctcttgtgctccggaagcgtgtcggtacgtaagggagcccgcgatgattgttgtttctcattaggaccgacgagcagactctagatccagtgccccaaactaaaccgcattttcagtcatttggtcgaattctaaattcccatttccggaccaatttccactacgatttggcaaaactggacggtgtcgtatagtagtatatgaattttgcaaggttagaatgccttatgaatttgggaggagctacgacatttgaaaaatacctgaataccgtagtccctgaagtcataccctttaatttgctgtgacctgtgactaaatgcagattcactgaaagtcacatcagccgtgtccatcctactggcaggggtgttatgttcatcagcccg

SEQ ID NO: 34629 - DNA, 763 bp, Oryza sativa
  unsure (1)..(763): unsure at all n locations
gtgctccccagggtagatcanctggtaccctaacgataacgaaaatactgctgctcgggcgaccggcgcaggggggggggggatcgggcgatttaaacaacgcccgatttaaacgattgaaacattttcgatctacttagtgaaacaatttcaatatacttggtggaacatcgtgcaacatttaaaaataattcaataataagctaaaaaaaattttcgtcgaaatatatccatgtgttgtcttgttttaaagatttaattacaacgaatttaatggtgcaatcgaatcatgatttggataaataatttaagagaaaacgtagtttaaagtggttttgccgacatacgtcatgctgacgtcaacgctcgatttttccccctccctatcgggcgcccgattctaagtcgttccctaaggatacataattcatcgattattttccttttctgtgttcatgtccatataagcttcgaataaatttgttgatgttatgttttatgcactggcaggtgaggaacttgaaggaccagcactttacagaactctatcatctgtacaataagatatctaggaagcaagaatatgtggatagccaaatgccatctcaaatgcctatagaacagtatggaaagatgaagaaatttaaagaaatgttggagcgcatactgcggttcctgcaaatttacaagggcgannnnnnnnnnnnnnnnnnnnnnnnnnnnnnnnnnnnnnnnnnnnnnnnnnnnnnnnnnnnncagtcct

SEQ ID NO: 34630 - DNA, 2006 bp, Oryza sativa
  unsure (1)..(2006): unsure at all n locations
atggttnncagtgnagaccnnnnnnnnnnnnnnnnnnnnnnnnnnnnnnnnnnnnnnnnnnnnnnnnnnnnnnnnnnnnnnnnnnncaaatcttttagtttaaccaagtttatagaaaatttagaaatatccacagcaccaaattagtttcattgaatatattttgatagtatgtctcttttgtgttgaaatgttgatacatctttttataaacttaaaatgtttgactagaaaaaagtcaaagcatcttataacactcttttgtgtcgaaaatgttgctgaatcttttataaacttaaaatgtttgactagaaaaaaatcaaagcgtcttataacatgaaacggaaagaaatacataccccaaaagcccatgtatgtaaaaaaggaaaaaaactcttgggaaacgggggaaaaacattattaatatatcatgatgcgcgtttgatcagttttatatttctatggaatatcgtcttgttatatttgtggtatttaaaaaaattatgtaagttggttacccatatctaaaatcctcgatattccactagacttcattccattttccctatgatttaggatgtgttcgttccacctcgttgggaacatatctcttgcgcacgtaaaacggaaacggagcagtacattagcacgtgattaatttagcattagtttttttttgaaaactagatcagtatgatttgttaaagcaactttcgtatagaattttttttgcaaaaacacaccgtttagctgtttgaaaagcgtgcgcgcgaaaaacgagggagatgagttgagaaagttttggaaagaactcagcttagtctcatttcagttagtagttctttagtttgtaagcccagctcaacagaaagtaattagaatgtttagtctttcagggactagttgatttagaatttttcagccaatcgtagttggttattttgcacgcagattaagggagactataagcccaaaaaagctgatgaagtttgcagcgcaaaacctctgccccagctcttcttgttctgctttcatctttcgtcaagtactgtagctgttcgacaacattcacaacagagctatggtagaaagagtgagttcaggatttaggtggtgtttggatccaaggacttaactttagtccctatatttagacactaatttaaagtattaaatatagactacttacaaaactaattatataaatgaaaactaattcgcgagacaaattttttaatcctagttaatccataattagagaatgtttactgtagcatcacatagactaataataaattaattaggctcaatagattcgtcttgcgaattagtctaatattatagatgggttttattaatagtctacgtttaatatttataattagtgcccaaacatccgatgagataggaatttaaaaagttttagtcccctctaaacagggtctaaagtctgaagggcgatttcggacacactacacaactgcaccagtacaaacatatatatatatatatatatatatatatatatatatatatatatatatatatatatatatatatatatatatacacacacacaccaacgtggatctatgcatcatatgcatttagggtacttgctctaataagctccatacttgacaaaaaatagcaagagtgcgagtggatggactccagatgcacaatatatcttaatagaaactctttgcatttagcaaaagatgtttaacctgagtgacctatagaaaaggggggacaagaattaagcgaaaagcaacgtgtttcgatctagatccataagggcactgggcccgggaactggaaaggccaaatgaagcttcaaggacaaccctgtttatgagggcgaaaataccggacaatttttttgcactgggagaaaaaggctcttcatggaggattaggcacgcctaatctataaaactctggaggagaagctgaaaactcctcgcttgaaaagtatggcagcttccgcttggttaaaaaat

SEQ ID NO: 34631 - DNA, 5007 bp, Oryza sativa
  unsure (1)..(5007): unsure at all n locations
cgtgtacnttttgatagtcctgtcggtacccgacactccagatgctcaagagcaagcaaggtaagatcaagctcgaggacgtggccggtttggttggtgcagaagtgcatatgacgcttttccaccggcagcagcagtctgattgcctggctgtaggttgccatcaagcgaagaagttacaagtgtcattgacgacggcttgcagagaagcaggccagggttgccatgagcagcaagaacttggcagctgtgctatggctgcgttatttggctctgtttaggggagctttagattctgagaagcagctatttggtagccagcttttaaaaatctggaaaaactctgaaacccagtttctccagcttctggtttcttagtttatttttcagaatctgtaactacagattctcagaagctgtggactgtttggggcagcttctagcagaagcagcttttgagaaaagctgcagctgggagaagctctcccaaacagggcatttgctggagttcctaactcctcaccctcgttttccgcgcgcacgctttttaaactactaaacggtatgttttttttaaaaaaaaatacgaaagttgcttaaaaaatgatgttgatctattttttaaaaaaatagctaatagtacttaatcaataacatgttaatgcgaacattgttttacgtgccgggaggaggaacacgacctatctatggtggtagtgagctagactaagatatccatactgttctttttttttctttcgtaggagggtaaaagctttgcctcatatatatctattattatatactaaaagtccataaaactttatacaaacactctcaagccgtcacgtggtacctctacaatcgcttctagaccgccacgtggcaatatctaatctcaccgttgattttcatttaaatcggtggacccgataatttagaccattatattagattagttgtattttgacaccctaataaatcagaaaaaatccttaaaaactaaactcccttcgcccaaccctcctggctgtccccacacgtgcctacgtacgtagcaggtacgtttgcctccatgtgcacaatccagttcctcccccattctctatttttttttctaattagatcaatatcataatttctattctattctttctactattattattattattattatataaaagtctattaaacttcctgcaaacgctcttataccgccacgtggcgctctaaaaacactctcaagctgccacatagcactgcaataaaatagataaaatcttagaaattctgagaaaaaaaacctaaccctcgatttttatttaagttggtagaccattagtttacaccgttagaatagatccattataaataaatagtaatctatcccttctaacttaccatgtaatacttacctaaaaaatattggcagaaataagccaagaaggcatacgtgcgtacagagttaaccactacaaacgagaaaagaagaaatgatatacagcataaaagaaaaaaaaacatactgcatatatacgtactacgtactactggaaaaaaaacattgtttttcaaactggattttcacttgctctgtattttttatgacggcgttaaatatttagttaaactaccgaaagaaaacaatgatttaaattagattttctattatactttctttggattttttttaattttagtgaaggtggtagtataagaaaaatatattacttcataaaacatgcacaccccaaaatagatctataatataatataaaatatcaaatgaacgtatcatctatactagcgtaaaaaaaggaggagttttgccttccaatcctacaggtgaaatcaaatccaacgacccgtgatcaccttacaatccaatggctcagatcactccccaacgtcccacgcggccacgcaacgtcccttgcgaactctagcgtcttcctctcaagcgccgccgcagtcgtgttgcctcctgatcatccgccgccagatcgccgtctttgctgtcctcttaggtgcagccgctgcgcacacccacggtgcgcacctcccttccccggttccccagcccagtgctgcccccctcccttcaccgtgcaaaaccctaagcgccgccactacaagcaggtacctttgccgccaggagatcgccctcatgtcacctcgctgccgtctcaccagatcatagacgcaccgcctcgccataccggtccggcgtcgactctgcacacgcttcaggtctaccacgacaactctttcaaggtagtcccagcatattgaaggtagtaccattatgaactttctcatgccatggctaactatcggcctatcattgtagcattatatatatctatatatgttggtgttcacttacaatttcatgcctctttgataatcttggtaatattctggtcatatctccacctgcgcaaaatttccaaatcctgatggtcaattggttaccatgcactatatatgaatcgatatggaatgatgcatgctttattgttgcagttaatttcaacagagtaaaacggaaggagtgatggattctctacgccttgcaaagttgcaagtgcaatatgaaatgctggggatacgacatttcagattcatgcttcaagtgatcaccatatgctgataagctgagagtatgctcaaatgatcagccagaccttctcttagaggtaattcaatcatggatactttctatttttctctgcaagttcacttgcaatatattagtaagcaaattatatatattgcaaagtataggagccattgtcatttttgttatatatggcttccatcaccccattgattactggccaagacatggtatatgttttttccatgtagattgagagggaaaatacattgtgactcatgatgtttttaaggtccaaattaacatttcaaattatactgtggcttctgaccctgtagatcaaaattattgcagttgcattatgccattagatgatttcagaaattcctgaacattgcataattcactcaattgacttaacgttgcctctgctttagcttgtccatgccatgctttgtttggatagctccaaagatatatttgctattgatcagaatcaaaataaaactcacaaagtttagagcttgtatgatatatgggagtcctttgtttatatctctcgaatgttcactctgatataatcatgcaaattggagggtatgtgtgtaagcgccagttcgattattgtatttacccaaaaataatgattgctgtatacttgcatattaggttgtgcaatgcatactctttcagatgttgtactgcaactgcacaaatcttgatctttttttgtccctgtattttcaccaggtttcacttgatgaggaaatgagtttatagatgtgtagagaatctgaaaaagatatttgggaagagatggtaggtgcatttaaaacaatggcaaggagccaaggaggtaatttctgtcgtgcgttatgaattagaattagcgatctgtactactgtctacactgcaggcacgttttccatttcttgatgagaatgtgatcaaaacgactttattggaaataccaggttcagaggttgcttaacttgatgaacctattggaaagggtgacaaagatttcagcaggtttttacttgttttgagcttaatccatatgggaactgttacagtaaactgaaattcgcatttgtaattcacatgtaaaccattgtcatgacagtgaaactactggccattttgctggtatagtgatattagggccatacatgaattatagttcagtctttttttataaactttggcgatgaagtttagatctcttcctgttactgtattgaagctacaatcatttcaaaaattttggatctcaattctttttctgatggtagcagtatacatgtcattttgctggtttttttttcttttttttttttttgctttaaggggatcagggcaggacagaaggaacactatgaccatgtccccatggcccatgtccatgtacgcatcaagctcctaagtgataatctgattgcctgctgatcccaggcgccggtggaatcaaccttgacccatcaatgatggtcatcccccattgacgatcacatggtccacagagatcatggtgtcttggacaccatcattatttctgacggtttaagctttgtctccacaattttttatctctgtatttgcttctgatggtttatacttcagagttcggaactgaatgttcatactctagatgatcatgtacttgaaattttgcacatttggtactgaatctgcactaaagtgggtttcttgatttggttaggtacattgtataagctaggttcgcattttgtacaattgattaaagaatatggtttgtctatttgcgtagcttcaaatgaatgatgtttaacgctattctgtctgtaaatctacagagcaatatatttgattgaatttagtttagccttttcgtgcattgcacgtgcattgttactggccatccatggaattaaatgtgttgtagaaactggcaagtgtcaattcagagtgaccatttaggattccatggtgtgcatgctttcttgtggcatactggtcttaggagttcaaatagagttttagtgcatagattaaagtgagataaaagtttatgcctgaatatataatttggtcatcttaattcattttcaggaatgttaatatgtatttatgtttccttttttctcataaaataaaactcaccgcagagaatgtatggagcataaatatgttctttctaacagaagttttgagtacttatttttgtgcagctttcttaaactagctagccctagaatgatcctgtttgttgaatcggctgtaaagatggagggcatctaggtaaaagatgannnnnnnnnnnnnnnnnnnnnnnnnnnnnnnnnnnnnnnnnnnnnnnnnnnnnnnnnnnnnnagactggcgatccatcaacaaggccac

SEQ ID NO: 34632 - DNA, 7733 bp, Oryza sativa
  unsure (1)..(7733): unsure at all n locations
atgagcctattgnattgatggaccagtctnnnnnnnnnnnnnnnnnnnnnnnnnnnnnnnnnnnnnnnnnnnnnnnnnnnnnnnnnnnnnnnnnaccatgtattaatagtgttttatgtaactattgaatgaatgagctattaaattagctatagatgaattggagctggtagttagctacactattaaacttgctctaacatcagcagcacaagcaacacaagagataaacctttaatggtcatataccaacattatctaaagttccaaacacatgtaacgctgaaacatcttagttcagagcaccctaggagtttggtgatttaattaggtacgttctttttcaagtctccagagcaaccacttgaacatgggattgtatgtcctaaaatccttgcacagaaggtaccatatggttgttcatttcctaactacagccaaacaaaataatctcatagaagccctatatttgtctaatgtgaatgtttgccaccctaatgtggctctgctcgctaatggaggttcccaatcggaacagtatgcacggaaaacggagcggtctattagcacgtgattaattaagttttagctattttttttcaaaaaggatcaatatgactttttttaagtaacttttgtagaaaaactttttttacaaaaaaacacaccgtttagcagtttaggaagcgtgcgcgcaaaaaacaaggcaaagagagttgggaatgagcacttacgaacagaggctatgtatggtggcttggggattcttagtttggaatatacgtgttgggctcttaggaggtgtttggatccagggactaaactttagtccctgtcatatctaatatttagccactaatttggtcagataaatggttgcagggtagggccacttcagagttcgcccctagcttgttcaagttgattgctaagaaggttgtaaaacgacatacagtggctcaagcattggatagtcaaacatggatcacatatataaaaggagttcattatgcaggtgattagggactatcttccgatctgggatttattgtgcttggggtaaacttgcaacaacatgatccactggatcagcaccgttggaggtcatcaggatttcgtttatactctagcaaatcagcatatgagattctctttgtcagggactatcagattaatttgctccatagaggaggatttggaaaagttgtcacccctgaagtgcaaacttcgtctgtggttcacggtaaacaatcgccgttggacgggcaatcgcctgtccaagcgaggattgccacacccggctgcctgccctttttgtgatcaagctgaggagattgtgcaacttattttgtcacttgcatttttagccagcgggtgtggtcattggtccttcacagattaggtttcattggcctcacggctcacgccaacccatgacacacgccatttctcaagctggtggtctatgccagtgaaagacacccacaaagaaagaaaaaaagaaagaaagaaagggctaaactcgcttataattttggtggcatgggaaatttgaaaacacaagaatggttgtgttttcaatggttcaattccaaatatgtcaaatgaggcttcaataagtagcatatgaaggcgctctttggtgcttagcaggagcttttaagctctaagaggtgttggctaggtcgatagcccttgcggctttaagtggacttgtttagtgtcttttagttttttaatgtgtgttagtgtttagggtcgggagtttccggactcccctccctgtgtgtaaattcttctttcttattaatgaaatgttgtgtatatcttccgtgtgttaaaaaaaaggtcctgctccagggagccctaatcagagaaaggggatgagagaacaaagaagatgggaaatatctatcagattcccaaaaccaaattgaatccctaactttaaatagctcgattgtacagagctggccaacctcctaacaaacaaaatttatctctaaacacaagtataatgtaaagtttgatcgatgtagccatcccatgtattgaccatagttaatatcagagaagggggatcatgttctgcgcgtacgcgccggcaaaggaagcggcacgcactttggaggccctaatagcgcttagcgctttgctaatggcgcttagcgtagttttttttctggtttttctttttggataaaaatttgccatgcatctgtttcttccctttgtttagttgactaaaacaaacttccaactcatatttattccggatttaaaaactttcaagtctagatttgaactcagattaaaaaattttcaagtcaagatttgaatattttcaacttaaaatttaaaattatcaatcagattttgaaactttcaaaatcatgatttgaaaattttcaagtcagatttgaaaaaattcaggtcaagatttgaaaactttcaactcgaatttaaaaactttcaactaaagattttgaaaactttcaactcagatttaaaaactttcatctcaaattcaaaaatattcaacttaaaatttgaaaactttcatctcaaatcttaaaaactttcaactatttaagtcaagatttgaaaactttcaagtcaaatttaaaactttcatctcagactaaaaaatgtttaactcaaatttgaaaactttcatctcaaaacttaaaaactttcaactcaaatcttaaaaattttcagctcaaattcaaaattttcagaaaaaaataaagatgaaagattcaatttctaaaataaaaaagagaaaaaatcggcacaaaatatttacggcctcccacgacggaaaaaaatagaaaaaggaaaaaaaaagggaagagatggctacgcgatggcgtgggtcttacatgggccaggaatgtgcgccgcttacgctaatagcgcgtacgtgctaattagcaatcgcgtcagagaagctgggtgaattaaaccccattcatgccatatgatacatcgtatatatatctttaaatttttattctgtccttcattccataaaattattgctcagactaaaatgaactcagttctccacgaacgatacaaaacataaccccagaatcccagcaaaacttaaatgcgaacttacttgttgggggaactctcctgtttccaactgcatattgattaattcttttgcagcacgatgcagtggtgctggatcccgctccatctgacatccaaatggttatagagatcattcgataaaaaggtcattcctatcagaattgaattgaaaataaacaaaacacacctgtcctgcacaaattaaagctaacattgcccaggcagtattcactgcatgagcttgatcatctttaatgtttacgtaaacctgtttggtatcataaaaaataaaaatcagtgacgaaatcttccaaatggatttataaaaatttgcaccagtccaacttcttccctcataagatttcttccaaatggaagcaactcttgttgcaaatgaaaaggaataactccaacatgcacaacagatcaaatggatgagcttgtctatgttcaagccccaaactcagcagggtgcttaggctatattcttcctcctcatttcccaactcacctctcttttttcacgcgcacatttttcaaactgctaaacggtgtatctttttgcaatagttttatatacgaaagttactttaaaaaatcatattaatctatttttttaaaaaaatagttaatatttaattaattatacgctaataagccactagggttgtgagtgttcgctccacaataccttccgtaaaggccaggagtactcctttaaaaaactatggtaatcaacccaccgctatgtatcctatatgccaattatcataaaacttgcaacaaaacgagcaatatatgtttattcaaccacaaaaattcaaaaggaatgatctagcgagctagagattaaaaaaaaaaaacctaccttagtaatattagagacataactttctccccacccaccagtatcgagctgctttgataatataaagtcgcatgctttcctgatggaagaactattctcatatgttcttccagcagcaattaacccttttactgaaagaaaggccccataggtgaaacacacaccccaagtgcctagcctgccaaataaccaagttattgtgttacaaattgttaaaatagaagagaaaaattatccaaagacagaaagtcagtatatgtggtgctcttgttacaaaccatgaaccatcttcgccttgtgtgctctcaataaacatcgctgcgtttctgacacatttttctatctctttaatacggtaactagggtgtagttgtttgaacagcaccagagcttgaagcacagaggaggtgcattctggaaatctgccaattcatatggtataaagtgatcagttacgccaggagttatttctacaaagggaaaagggtgttaattattaggattttctaagcacaatgatgcgctcagcacttacggataatcaaccactatgtttggaaaactctcacaaggactgagaacctaggttatataaaaaaaacatgtcaggactacaaatcgcatggccataagaaacatactggtgattgactagttcttcaatataagtgtactgaaacatacaagatgtgctgaataagtttcacaaatttgaagtgcatgaatcatgctggtgttattttaacatcataaattagattgatcgtgtcatgatgtaggcacaggcatggagttttcgtgatgttatttataaagttgttgctggtgttatttataaagcatatcaatcagggcattagtgtgcagaaactcacctctatccaagtataagttcttttacattcatatgtagaaagggtaccatctttgttctgcaaggagaaatgaacacattaaccagatgattttcacatattaaaaccatggcagcgagagagaagggaactatatgcatggcagagttacaatcaccatttttaggatttttgacattttggttacataaagttggcaacaagttgcgtaggttatgagcttggattttttttaaacggaaaacagcacgagaatgccttttcattgaatagagcaggagaaaatacaacccctaagggtaaagcgaaaaaagagagaggtcaccgtaagctatacaaaatgcgggacgaactcgcgcaatcgtttagcccctgctagagcccaaaggctagcctcttctttgattttcgttaggaggaagctcgttgccacctatttgtggtcgaaaatccgccgatttctctctttccaaattttccagacaattagcaggatgagggattgaagtcccttttttgggacattgggcatatttgctaggttctcctaccgctgttggactgactgggcttcctcccattgggccggctccatttgctgatagcccacccatctagcaacgaaatgccaaatcctcttggtgtatctacacgtggcgataagatacaaggccgtctcaacttcacaacggcagagagggcattggccgttgttttgccaacccctgatcgcaagccggttggatgtccagactctattctggatgatgagccaagtatggaatttgcatttccctggtgcccaaactttccaaatcaaggaattgagacttgggctaggcgccccacagcactgcacgcatggtaggccgaggaggccatgtaacgcccgttacttgtgaatttccaagcagtctggtccggttcttcattgtctaagtgcacattctgaaccgcttcccacagggtaactagctagtcaacgaggttgactatgataggtgagtttgcttcgagggtcagatcttgtacccaggcatcatcctccttttcttggcgtagggactttcctttgtttttggaaatcgcgtagaccagcggcatgaggtcttttggtctgcgcccatcgatccatgcagagtcctagaagcgtgtcgtgttctcatcaccgacagttatttttgttgatgcggcgaagagatccctgtcaatttcgttgcaaggcatctccaatcccacccacggttttgtcgggtctttccattcatgccacaatcatcgcagccttaatccccttgtgaatttggtttagaactcccaggctggtaaggtcaattggagcttggatttgggtttcacagctgcactcatactgagttccagaaaaggctattagcatatcacaccccattgtttggtgtgtaagattcttttaacctatcttcgcttagtacaactaataacagtaaacaaaaccataatttttcacataataatgaattggggctagtctgcaaggaaactacaagatcatgtttaatagctgtgcttaaataattccataccacgaaagataggaggcaatcaacagcatcatgcagcctttctatttcaattggatccccgaccacgttgctagagatcttttccagtaacagtacagcctggaaatgagattatgtaagatttcaagagtagacaaaataaaaatttatgcagaactggcaacagatcgggatcaattttttgtataagcatgagcttcttgggtgggctatcactgattaagactaggttaatacgatagtacaaccttcgtgccaaaatataacaacttttaaccattaggatttgttctaaaatataacaacttctccaccaacattcttttcccaaccaatcacaacactccaccattcacttttcccacctatctccactattcatccaattacaaccctccaccattcacttctacctactttcttaataactgtgtccaactctaaaactttttatattctaggatggagggagtagtacttatttgaccgtttcaaggattaattaattatttgcctcccttgtttcaatggtgcattagtaaaaaaaaaaagaagaagaagaaagaacataatgaccttcagcgcttctgctgtagtgtcagacacagcccatccattgtctgctgacgaaagagtccatgaaccctttgatctatggcgatgccagtaactttggtcaccaggatgattcctcataatcttcaagaaagaacatgcaatttatgttggatcaccttatgcactagttaatttataaatttaaattattaaagtatagactctgaacctgtgaatttttcatgaactcgtgggctctcctaacagttgaaccatactcatttacaagatcagtagcacaaaacgcttgaattataaatgctgtttcccagctctggcaaccatcatatatctatcattcagataaaaatctgtcacagtttttttctgtttcctcattagataaaactaggaagctagcccacgcatctgtgcggacatgtatcaaatactgtgtctgtgtaggaaacatatatataatggcagaatattaaccggataacacctacagcactttaaaataattatttctccataaattttcttcatcaacattgctggtataaattgtcaagttgtttgttagctttaaactatccagtatttacttcatacctataagaaattaattataatattcttcattatcttgaaaggaggttgacttaaattgtttaaaacaataggtttaacaatattaaggggcagatttaaaattaggggcctttcccttttaaaccgcaaggtaaaaatgctctattc

SEQ ID NO: 34633 - DNA, 1319 bp, Oryza sativa
aaattaaataaaggtcctttccttttaggtgaatgttaaaatctttattttgtacaatcctaaaaatttattatcaataattgtgtttatttataccatagagctgccctccctcaatttggttcatatactcacgtaatttttccctttatatatatatatatatatatatatgtgtgtgtgtgtgtgagtgaataaagaaaagagatcaacataccttgtttttttatatacttaatttgtagtttttatttaaagtcctaaaatataaattcaatagtaataaatataacttttaaattaaccaactacttattgtcttaatttggattatatatgtaataatatgtggagaaattcataatgcgacggtatatggtatagaatagattgaaggatattagtatgcaaacacttaaaaaatggtgatggctagaataggcaatgtttgttccaattaaagtgaaaagtaaaaactttttttatggtattttctccaattaggtaattgaccaaaaatgaaaaaaaaacacacacacttccacttccatccctgtcgccgacggtgatcaaagccattcaagccaccaccgttttgtctccaagtccagcagcaagaatgacgtcgttacgctgcagcagcgcacgtgtgctcactgtcacctccgagcgcaatggcggccatcgattgccgcccgccgccgtccaagcccatcattacgcgcctcggcaaggacgccgccacctctagggatgtaagcggggcggataagcggtttttttagcccgcttatctcacttctggtttattttttctttaagtttttttactaccatgtgaaaattgaactagcaagcgggttttatgcgggtagcgagactatccacttgcatccctagccacctcgctgtacaccatctcggtcagcggcggcagtgcgccgctcatcgtcaaccttgccggccagctgctctggtcgacgtgcctgtcagcgcaccgcatcatcccctacagctccaacgtatataaggtcgcggatcagaccggagccgggttttaatctcaaccaaatcaacggcttggaatattggatccactgagttaaataaaaattaagggatggattttattaacgccacatgtcagtttgagagtgttttgaggattgccacatggcagcgttatatcgttttaagaaagtttaatggacttttagtataggaaaatgtacgaattacccccgtatcaatcgcggtcgtccgaattacccccctgaaccacaaaaccggatgggtacggcacgtcatcaaaggtccac

SEQ ID NO: 34634 - DNA, 1104 bp, Oryza sativa
  unsure (1)..(1104): unsure at all n locations
ctgttcaagttggctcnnnnnnnnnnnnnnnnnnnnnnnnnnnnnnnnnnnnnnnnnnnnnnnnnnnnnnnnnnnnnnnnnnnnatccaacacagctgtagaaccaattggtgttgaaattggcttgcaattctccatcttaaaccgtctcaaaagatccttcgtatacttcatttgatgcacaaaagtaccttgaggtgtttgcttaatttgcaatcccaaaaagtacgataactcatccatcatgctcatctcaaattccccacacatagtctcagcaaaatctacaactaaagcgtgagttgaacaaccaaagatgatatcatccacataaatctaaacgaacagttgattatcaccatgcttaagaacaaaaagcgttttgtcaacctttcccattataaaacctttcgcaagcaaaaagttcttaagcctatcataccatgccctaggagcttgtttcaaaccatacaaagctttagacaatttaaaaacatggttgggaaaatcaggatttttaaaacctggtggttctttggcataaacttcctcctgtataaaacaatttagaaaagcacttttaacatccatttgatacaatttaaaaccttttgaagcagcaagagccaacaaaagtctaattgcctcaattctagcaataggagcaaaagtttcatcaaaatccaaaccctccacctgagtaaaaccttgagcaacaagtctagctttatttctcacaatcaaaccatcctcattttgtttatttttgaaaacccacttggttccaataatattatgtccagaaggtggttcaactaaagtccaaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccgccactggaccgttcaatttgtca

SEQ ID NO: 34635 - DNA, 964 bp, Oryza sativa
  unsure (1)..(964): unsure at all n locations
gtgtttaattgtacgtcnnnnnnnnnnnnnnnnnnnnnnnnnnnnnnnnnnnnnnnnnnnnnnnnnnnnnnnnnnnnnnnnnnnagagttctacatggaaacgacaaggactactcggattgtatccatattggtttccctagttctacttggacaaggggacacctatgggtataaatacaaggccccctaggaggagaggggatacggacaatcgacacccaccacaatcaacatagacgccacaaagccaatacaagccaacatacgccaagccaagacgccggatatcgacttcagggataagcacggctagtcccctacggtgtctccggatactgtcaggagagacgaaagcgttatctctgatctcgccgggcatggattcaaggaggaagactaccctgtcgtcgactacgagtcagaccttcagaccgccatgacgacaacagttagataggctaccccaagtattatactggtgtgattatggtgaataagagcaataccggcttcggccaataggatgtagggttattatctgacaattcaggggcccgaacctgtataaaaatccttgtctctgtctcttttacctcagtctcgcgtataccctagtaccaacgatccccataccatgcaaataccggaatcgcgacatcaaacgtcgatagatccatttgataagctcttggcctgaaggaacataaaatttaatagctcgtcggacaacaaactaagattgaaacctacaaaaattaagaacacattggagcttctcatttcatatgttttttttctactgcacctccagtttactatattgacaacatactccttctgtctctcttgtgtagcaatgtgtctactgggctagactnnnnnnnnnnnnnnnnnnnnnnnnnnnnnnnnnnnnnnnnnnnnnnnnnnnnnnnnnnnnnnnnnngctctaccttngcccagc

SEQ ID NO: 34636 - DNA, 770 bp, Oryza sativa
  unsure (1)..(770): unsure at all n locations
cggtgccattgtagacatnnnnnnnnnnnnnnnnnnnnnnnnnnnnnnnnnnnnnnnnnnnnnnnnnnnnnnnnnnnnnnnnnnctgcctgacatggcggcgatgaccctgtcaggaagttcagcgggaccatccttgactggtggctgctacattacttgagaaaaaatttccatgggtacatatactgctatgacagcatgggacccactaacctgcgatactcatatgcgacgttcaggggtacctgatggcacatatatcagatgtctacgatgagcctgatctgcagtcgcctgctcagttgaagaatctaaaagctgtcagacttagaagcctcgtgggaagtatgccatggaacatgatataactcatctgcatgatactgcaagatgaccaatgttacaatacataccggtgatgctgcatagacacagtgccttgagagatctatgctagtgccggacagatgtactctggaggcctaacgggacagctgctgatacactgacgtgacttaagagcaggcgtgctaagtttggcattctgaaacggaggtggtagttctccggccatcaatcatangctggtacgacatttacaagtgtacaactggcgacatgtataagattgcacgacagtgtgtatgtttaatgcacggataccgacatgttatggcatattgcctgacacgtaggtcatgggtgacactctatcttcagaagtcttctcagaaagtagtgtcatctcggcaagtaacttcgtgtgaa

SEQ ID NO: 34637 - DNA, 3084 bp, Oryza sativa
  unsure (1)..(3084): unsure at all n locations
gtgcgcccaggtagacagtgctttgtacgagcnnnnnnnnnnnnnnnnnnnnnnnnnnnnnnnnnnnnnnnnnnnnnnnnnnnnnctagtaatagtagcagtattttttggtacaatatattccaccaaaagaacgctgctactacgcaatagcctaacgtgtgcctgacttctgagacaaggttgcccatgtaacaacaacaaacacatacactttgtcatacaccttgtcgaagaggcggaagtaagcaatcctccatgttttcttgaacaagatggtacagaaaaccacccaaagaccagccacaaatcctgaaccaagtccagagtacaagaacattggctcagaatctctttcccttctctgttcaacaccatgctttgatgcactgctgttgtctgagcaatttctccgaagaggatacccacaaagaccagtgtttccattgtacatagacgggttttccgcatagagggtgtcgagttgaccccctgatggtattcttcctgtgagatggttgtatgacaagtctagcctgcttagagatgttatgtttgataggtttgatgggatttctccagaaagattgttttttgagagatctagtgattccaatgattgcatgacactaatgttgcctggaattcttccactaagctgattccatgataaattcaaatttttaatgccatcgagaagagttagctcctccggaatttcaccagttaagtagttcaaagacaaatcaatggtcacgatatctaatactatgggtagtttgtagtaaagtttttggcccttggtgtccacagacatatttgcaatgccaacattgcgaccataacgaccagaaattgagtaacgatcgaagaccattacgatatcacaatgaccacttttcttcatacatattaaattggacaaatgcaaaggtaaaacacccgaaatagaattatttgatagatctagttgaacaagccttgtaaggttggtaatgcttgttggaatatttccagagaaattgttattgcttagtcgtactattgctagattcgacagctctccaatccagatgggcaatcctccatagaagtcatttgatgccaaatccagcatctctagattatgtctactacgcaaaaatggcgggaactttccggacaaaatattgttgctgacaaatagcttactcaaaaacactggctggaaacatcgaggaaattccccctccaaaagattgtccgctaaatctaagtaaacaaggtgatgcaaatcacacatagagtttggaatatggccagtgatacgattggagaagagatgcagataagataagacaaggtcatctccaaagttcgatggcagaggtcctgataaagagttccttgagatgtccattatttcaagtgcttttggcaacaaaggtatttgaccggtaagcttgtttgatcccatatatagtctagataatgtagtcataacctccatgttcgctggcaagctaccattgatttcgttgttggaaacatctaaaagttgagcattcaaaaatgttgtagaaaaccagtttggaagcctatcagtaatacccgcaaatgacatattaagataagtaatattaacctgttgtttcagccaaccgggaaagcgagggcccatatggcaaggtgaaaacaatgcaacctcaagactaaatagaggtaaccattctgaatccaccaaaatcttcaaggaattaccggataagtccaatgtcttcaaacttctcatactagtaaagtgttcatctgtgatcactccgttgaggttgttactgctaaggtccaagtaagttaaattactgaacatgcctatctgaggaggcaagggtccagagagtttgttatgagagatgtcaagaatgaccaagctagttaagtgatccagacgatttggtagaattcctgatatattattgtctgacaaatatagttcattcaatctgttgtacgagcaccgcggtaatctctgtagcaactttgcaatgtccccatgaatttgactccgttcgagatgtatgattctcaagttgcatagatttgttaggtttgttgtcacgatgtctatgttacatgtggatgacaagtcaagaaatcgtagggatccaaattgtcctggaacgtttggaaactggccatagagtttggtcgacccaaggttaaggtacttgagtccttgtgcattccagaaccaacaggatgcaattggatggttgaaatagttgacagagagatcaagctcctcaagattggtcaggttaaagtgtgaaaaagattgatccgcataaacaaggttgcagtaagcaagatgaaggaccttgagagaaggaatgttgttattacattcggccaaacatggtccatgctgaggctcgtatggcttatgtcgaggtgcgttagagaatgcaggcgcgctaaccattggatatccgtgaagttgatgcctgtatctgacaggccaagatagtgtagatttgtgaggttacccagctggggaggcacctcaccggaaaatggtatgccggagaggttaagatatctcaagttttgcagagagcccaagaactccggaacacggccggtctgtccctggagctggttcttgctgagatcgatgtgctccagatacgtcaagttgagcagagagggacttatctcgccggccaggtcgtacccggaggtgatgaagtcgtagtcgttgctctggtcggcatacacgttgcggaggtgaagcccgacgacatggccgccggcgccgcaccggacgcctcgccaccggcagcaatcggcctcctcctccgcctgcccaggcccagcgccgtcgtacttccatgagtcgaggagacccattatatcttcggtgatgcctgccttgaacgtcagcagcgcgtcccgctcccgcggcgagcagccggccgccgtcgccacgttgccgtgggcgggcgccggacggcgtgtggcgccgcgtggcagcgcggccaccgccgcctccacttcatggttggtcgtggccaaggcggcgacggcgaggacgctgaggatcag

SEQ ID NO: 34638 - DNA, 2879 bp, Oryza sativa
  unsure (1)..(2879): unsure at all n locations
tggaatatgatttgaattcactggtaccccggttcattattatggcctaccagaatctggatctccaccaatttgtaccagccacggatgtcgcgcattcgcggaattttttttatttttaattttttttattaaaagttttacaaaaataatttttcatttttgaaaattgacagaagtggtcgcctaccgccctctgggagggtgatttttaaaaatcgccatcccagaaggcggcgaaagtgacgtggcagatggccgttcgctctcaggcgacggccgtcaacgaaatttgcaggcgacccccttgccgccctccgctagggcgattttgtactgtgcggggggccgcctgcaaaatgggcggcggggggcctggaattttgcaggcggcccccttgccgccctgggggagggcgattttatactgtgctttatatttttttataaatatcaatagttatcaaatctttttatattgaaaactatacaagattaaaatctccaagactggtaaaatataattttattattttttagggcctatttggaatgttaccgtacaaatttttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttcaatcgaaatcaaacacaagtactattcaaattaccaaaatattggtagggcatgtttttggtagcaatccaaataggcccttagtcttacgcatacaaaaaatcaccaccataattaaacattgtaatgataagatagataagaagtgccatcgatacacggtacaaatttgtcgatcccgacgaatcaagcatgcggtaacctatcggccccttctaggtcggtcagaatgcattgcattctcgtggtccttcaatcgttgatactctacttgtgtttctgactctgttatcttctgtccatgatatgatggagtgacattgtcgatccatcgagtaaatccacacatccttggattgccctgtaaaaatagtaatgttattaagtttgggtagtaattttgtgcaaatcatagcggattttgtaaatggttagacatacaacgaaatcgttgtctacattggggcagacaaaatatctccttccaaatgtttgttcagcaaaggatgtagccacctgccagcgatctctgcacccacactttggacgctcggaccatttaggtaaccctaatggattgttcctccagtctaagcttgcaatttccacccgacgttcgtactccatccaagcatgaatgaactgtatggtcggttcaggttgcgttatcggcccgccacttgaagtaactctgactgtgtcaatccattgtacgaattgacatttccttacatcctcctatgtacatccattttgggatagttaagttaatgatagtactaaggagtgatgaaaagaatagttgtaattaccacgaaatcatcgtcgacaatgtttggacacacgaaacacctttgtcctcgagttcggtgccttacggaccttatgacctgacaacggtcaccacaacgacactccggacgctcacgccacgtggggagtcctaggggatttacgtgccattctaaagcctcagcagcaattcgacgttcatgctcatccttccgccttagttagtccgatcttgtttcactacgtgggtaagcacgtgttccgtcgttttgtgggttctccatgtctacccactcgatgaagttgcacattggacgatatgtctgcgtaagatgttacaattgtgtacgaagaagttagtttttttatccatttgaacttcgaatagatgaagcatacctgatcaaagttcgcgcattggaagaatctccttccccgagtttgtatcatgagggaagacttgagtatgcatccatccccacaatcgcacaaaggacggtcacaccatggtggaaaccaaccagcaaaaggatcgcttcgccagttgagacgctcaaggaatggcgcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcaagcgccgaaagttgatagtgacaactcgagctgccgcttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgannnnnnnnnnnnnnnnnnnnnnnnnnnnnnnnnnnnnnnnnnnnnnnnnnnnnnnnnnnnnnnnnnnnnnnnngtcattcacaatccct

SEQ ID NO: 34639 - DNA, 10526 bp, Oryza sativa
  unsure (1)..(10526): unsure at all n locations
ttgatccnattgatggatggnnnnnnnnnnnnnnnnnnnnnnnnnnnnnnnnnnnnnnnnnnnnnnnnnnnnnnnnnnnnnnnnnnnnnnnnnnncagatattgctgaaagaatgatcatcacattagatgagcttgaaaaggcaactaacaactttgacaaagctcgtgagcttggaggtggagggcatggcactgtttataaagggattctatcagacctacatgtggtagccatcaagatatcaaatatagtggtcccgaaagaaatagatgatttcataaatgaggttgccatcctctcacaaatcaaccataaaaatgtagtaaaactaattggctgttgtctagagactgaagttccattgttagtttatgaatttatttccaatggaaccctgtatcaccatcttcatggtgagggtccaaggtcgctatcatggagcaataggttgaggatcgcagccgaaattgcaaatgctctttcctatcttcactcatcagttacaatcccaataatccatagagatataaagtccagtaacatacttcttgatgataatctgacatcaaaggtatcggactttggagcttcaaggtatatcccaatcgagaaaacagcactaacaacagcagttcaaggtactgtaggatatttggatcctatgtacttttacacgggtcgtctcaatgataaaagtgatgtctatagccttggtgttatgctagtggaattgctcacctaaagaaaactattttcatatttgtcctctgaaggtgatggccttgttgcagattttgtcaacttacacagtgtaggtaatttggtccaaatgctatattctcaagttatagaagaagggggcactgaaatccaagaggtttcccaactagccatatcatgtatagaattaagaggtgaggatcgacctaccatgagacaagtgaactgttcactcgaaggcatcctctcacaaatcaaccaaaaatgaattatgtcatctgagaaggatgcggaggatagttcactggttggtggagaaatttgatcttcgagaataaggtttgatggttattaatcagttgtatgtaaactattgaagcgcaaagcacggggaaataagcatcgtacttgtaacatgatcaggttttgatgtttgtgttggccatagatatgcaatatatatttaatgttaatacctaaacatttaaaaaagttttatactcatttgaattgggtatatactcaatttcaaccatggtgcccaggcaccatggagcactaaacaattttgagtggtgccagttgattttgtggtgctgtgcatttatgttgtgactggcgattgcaactttgatgtccgtaggtgttgtcttcctcctcggaggcatcgatatgtgggttgcacttctttcaggtgaaaccctagttcggtgatccggatgggcgttggtagtatccttgatatttgtttcctccttggaggcttcgcatggaagtttgtgttccatggttgggcaggaagtcggagctgcctatatggtggggctagcttggcaacaaaaaaagtcagatgcccattcaaaatttttcatttttctcttctttcccttttcatttgcttttttgttcttcttcttttagacgccgaagctccgtttgtcaatgtagagttattgatgataccacgttggcgcttatgtggcatgacacatcagtgccatataggatcttggaagggctgtgacagtttgggatcggaatgacacattttgtcgagttctggtatctaaatatatattttgatagtttggggatctagatgacatggccgtacaagtttaggaactgttcgtgccctttactctttcctttaatttacaatgcgattatgttgttttcaggcctggttttcctcaaacaaggccaactcttttttcttcttaataattagaaaccttatccttcttcttgatgtttacctcaaaaaaatccataagggtttactcccttcggtttcataattcttgacattttagacaatgttgaggttaaacttttgtaactttgactatcagtaactttaaaattattttgtttaaaggaactagaacaacatatataaatttatgtttcgaagtactataataaaagtaaacatgcatttatttattgtatatgttacaataaaaaaaccaaggtcaaagatatattttggagaccatgccattgtctaaaacgtaaggaattatgaaactggatagagtaactagctagaagcttgataacaaaaatctcccagtttcatcggcgaactaaaagaatttaatttagaaacaagttttgacatattaattccattgaaatcattatcatgattaatatttcgtgatgaacaattggctttgcaaatgacttatttaataaaaattggttcgtaaatatatgtggatgttggtgtgggtacgtgtgactaatgttggtcaggttatgatatttatgcctaaatacatttgctttgcctttttgtctcttcaaatcaagctatcaatctttgcaaattgcgtaatctaaatttgatcgaacatagtctttgcgtcaacgaaccatgaaccagacctttcaataagaatggttacatcagagacattgcaaagtaagtaaacgtagtttatctactttgcaaaattggtgtcttcagatcagaacttagcctaggaaactatttgagtttacgtttgcaacaaaccaacatactagtcacattgctgcagttttctatctctacatgacacattaatctgttttagatttgtcacgaaaatagaagatcttttttggaccatgaatctaggtattctattgttcttattgaggtcaaagtttgtcagtactactggggaaagtgaacggctgcactatgacaactcgagttctgatcttgtatgtactaaatttatttcgctccgatttagtagcatgttcgcatgtacttagttgctaaaactcataggcctgacgaagttgcgataaaccaacatactagttacttcttgcatgtacttagtttgcttattttgcacattaattaagggagaatataagcccagaaaagctgatgaagtttgcaccgcaaaacctgtagctttagcgcagaaaagctgatgaatatacctattttgttttcatccctcgtcaggttactgtagctgtttgacaaaattcagaacagagctaaactgagttcagtatgaagggtcatttctgagacactacacaactcttctagtacaaacagatacaataatatatacatcaatgtggatcaatgcatcatatgcatttaggatacttgttctaataagttccatctatgacaaaatatacaacccaactaagagtgttgtagacctgctccagcttctttgtcttcgtctattcatagtattcgtcagagtcgatggatgaccatgcgacctgcgacattcgcaatctttcatctgttcttcctgtcaactttgcccagacaacaatcaccttcacataaacctcatcatacatattgtccaagaagcaaaagtaagcaatcctccaggatttcttgaacaaaagaatatagaaaaccacccataggcctgccataaatcccactgtaactccaatggaaaatgaccctatgtgaaaaccttgtttgcttctgatctggtaaccttgctttgaggcatcatacttataacaacttttttggagaggtggcccacaaagaccatcattgccgtcatacagatgatggttttggtcatagaggctacaaagttgtgtccctgatggtactcttccagtaagattgttataagataggttcaaataacttaaatatgttaaatcagataggctttgtgggatttcaccatagaaattgttcttcgagaggtcgagtgattccaatgacttgatggccccaatcatgtatggaatttttccattcaaattgttccatgacaaattcaaatttataattccgtcaagagaaactatgccttcaggaattacaccagtcaaaaaatttgaagacaagtcaattgtcacaactgttactttttcttggttgtattgtagttcctgtcccttcatgttcacaaaagatttgtagtcacatccagatagtctctcttcatattttgtggtatcatggtttatcatcattcctgttaaatttgacaaatgctgaggcaggggacctgataaaccattgctggctagatccaaatgagaaagctttccaaggttggtgatgctgtcaggaatacttccagagaacatattgtgcttaagctgcagaaattctagcttgttaaagtttccaatccatgtaggcaaagtcccagagaatttattccatgacagatcaaggaaacttaactttgtccaaccctgtaaaaaagatgggaagttgccagaaaaactattgttacttgcacgaaaaaatgataccctgctcattagagaacattgagggaactcgccctcgagtagattattggacaagtcaaggccatttaatttctgcaattcacaaatagactgtggaacatcaccactgataaggttatatgatatatctagtagcataaggtttctcggcatccgaggaattcgatcagctatgtggttgcagtccaaatataatttttccaatgacatgttttccatatttgttggcaagcctccagcaatttgattctgcgacatctccaaaaacgtggccttcgaaaatgttgtagagaaccagtctggaaatgtatcatttattccagcatcgctcatagcaagttcaagaatatcgacttgtgattgaagccatgagggaaatgagggacccatcgaagtagatgcaaagtatgccttctctaatctgaagggaggtaaccattcaggatccactacaatctccaagtaattataacacaaatatatcgacttcaagctcgttagattggcaaagtgctcctctgtgatgacaccatccaggcaattgtaatggaggtacaagtttgtcaaatttgtgagcatacctatctcagaaggcacttgtccagtgatgttattattaaagaggtcaagagtgactaagcttgttagcctccctaccaattttggtaaattcccagtcaaattgttattagccaaatgaagttccttcagtttgttgggtgaacactgtggtaaactctcaaatatttctgaaatctctccatatgccagtctataatcaaggtcaagaacttccaaattgcacagattcttcaagtttgccttcatgatgcacatgttacctttcttcgaaacactcatgttgtacgagaaatcaagaacttggagggacagcatgtttcctagtgcttgtgggatctcaccatacaaactagtcgaactaagattgagatacttgagggatgtcaagctccaaatccaactagattcagcttggtcactaagttcataattgttggaaagatcaagtatctcaagttgcctgaggttaatctgtgtgggatactgatttgcactctgaagtgagcaagaagaaaggctaaggaacttcagagaagggatcatattcagaacatgaggccaatcgagtactgtgctaaggtttaccccgttaaggttcagatattgcaaattggacaagtgtgctaaccatgaagcatcactaatgtacagaaatggagccatgctggagggcaacatcccggagaagtcgagaaatttcagatttgaaagcttaccgagctgaggtggcaccatgccggagaacactataccagatagattcagatatctcaagcttctgaaagagcccaagaactcagggacatgtccagttggacctgccaggttgttcatgctgagatcaaggtacctgagatgctccagcgagatcagagaatggcctatctcgccaaccaaacctgttccaacgtcggcgtaatcgtttcgaaggttaagcttaacaacatggccggtaaggttgttgcaccgaacgcctctccattggcaacaatcctcttccagcagctgatcatcatcatcatcatagtggcctcctctttgccagaaggagaggaggcctgcaggatccttgacgatgccttccttgaacgccagcagagcgtctctctcccgcggtttccagccgccgccggtagtgatcatgaggaggaggaagaagaagaagaaggagcaggtggtggtggagacgatgataatggccgtactcatggtcggccggccaagtgattagctgctgtgtctgtgcgatactgtgatgttacttcacactactgttagcttagctactggggctttgatgcaagcatgtgttgttgctcggcattaataagcgtttcagactttcagtgtagaagctaggtcaagtcgtcggtggtttggctggccttctcccctcctacaggatcggctggtgttaatagatggctccattaatcaattgtgtattaaaagccgaaggggcttgatgagaatcaatgccgagcattatgcactactggagaaaccatctttactgggttaaccaaaaaccacattagtaccggtttgaaacaggactaaacttttttttcccgattaaaaagcctaaccgattttttttatctttagtaaatatcacttttagtcccggttccaaaatcgtcagggacctcactatcttcagtcccggttgtttataccaaccgggaaaaaaaaatctcgcgcatccccaatccttatctcctcgattggcacggcaaccacgcgccggcctcagctcctcatcttatctctggaactaaaccacgcaaactccacgtctcctcttcctcactccatatgcacgcctccctcccatctcctctcctcatccctttcccttctcattcccttctccccttcccctctccggcgggaggcgggaaatgaggcgacggcggcccagcggaaggcagtgcacgaggcggcggcggcccggcggcggcggttggcggcctcccctccactagatatgggaggggaggcggcggctgcagcggtgttgggggcaatgtcggcaatggccgtccggaggcgcacggctatggtttttttttaagattttgtgaatgatctgtagatttttttagatttgtggatgattttgtgaatgatttgtggatcggcctatgaatttgtagatgattttgctgtggatgacttgtggggatttggggggtgacgtcgttggtgctcaaagcacaaaacaacggaaaaaaaaaactttaatagatggtagtgctacatggcgttaccatttttaggttaccaaccggggctaaaaatggatctttagtcctattattttaactaggactaaagatacctatttaatttagtctcggattcggggtcccgatttgctactcaggagtaaagggggttgcaaaccgggataaaaaggcttcccccgtagcgatggtggataataatttttaaagtcaaaatttttgaaagttgaataaccaagttaatagaaataaatagtaacatttatggtataaaattagttttattagatctaatattaaacatattttgatagtttctttgttttacgtttaaaatattactatttttttctataaagttggtcaaaacttaagaaatttaaaaagaaaaagacaaaaatgacttataatataaaatgaaggtagtaacttctatatagttcggtgttttgcaaactgcttggttttaatatatatgttgcatactatatttattcccaaaattttgtacaattgagatattctatatagtaagacatttttaactttttccatccttaatttaatccatataataagcataatatatgatatactcctccctccatttatatatgttgttctgaactagccaacgtcgtaaataaataaattaaaggagggaccgattaagttttaatatttacaataactaaaaagataagcaaatcaaagaacaaacacaagtaattaataaacggcgtgtacatactcaagctgtccatttgttataagacggttaaagtttataatactaaattagtttcattaaatcaataattaaatatattttcatattaaatttgtcttgggttgaaaatagtttgactttgaccaaaatcaaaatatcttataatctgaaacggagtgagtaggagaaaatctcgttagtctagctatagttgcatttcatatcatgtgtatgtgtgaatttaaataccacacgtactggtgctggtaggctaagagttagagaagaactttgagagacaaacttcacataatagtttcatgtatttaatataaataattaaaaagaagataaatatatatccactctcgaagtccagatatcatccacctacactgccactttatgctcgtgattagtatagaccagatcaacggcgacttccgtgggcatgttgcttgttttgcagttgatcgagtcgcttcaaattactatctatactatcatcttttgacagtcacagtcagtctctataaatcaccatcacaacctcctccaattaattattttttgcatattttcttagtactcatgtccactttaaaaattaattatattttaagatggggtagcagtaagacatgttctaggagataggcagtactccttggcagtcggaatgacacaagtgattgcaacttggaagaaatatatcctatacacacaagtatttttaccggctaacaaaattctaccaataattcaagaaaaaattgtgttacatctatggattacgtttatggatggataaggataacgtctgatcttataattaatttaaccaaaacgacaaaattctaacaaattaagaggtcttaaaactgtcagaatttttatctcttttattacggctaaaatagagtgaatttaattaaggttaagaatttacacacaagtatagtactattgaagtacatgtacattttttttaaaggtttagtaaaaatttgttcgttggtgtgcatggtgtgttcatataaagcttttgtgttcgcaactaagatgttggggtaagatttcttctacatatagtaaaattctatagcagaatttttaaaaaaatgataactaaagtgaaaaacaatctttccacataagtttaatatttgcaacaacataaaaatcattatatatacatcagcagtacagcaacaccgagcactaacataataactactccattcaattttgctgttacattattgctcccaccaatttaaacattctatacagtttgactttacaagacaggaagcttaatcgagcgctaaaaacagctctgaaatcgtcacttaataaaaagatgcaaggtaaaaacagctgtgaagccgcgcaaagattgagatttttttatataggcccttggtttatctcatactcctattaccgttacggagaaaagggaaggagagggcaacggcggtggcggcgttgtggcgaacggcggcggtggcggcggcgctcgcggtgttgacttaggaggaactcatctcttcccgcgtggttgccttcgattcggcgaggagaatcgtggagcgcatggcgccgccaccctaccccggatgcggagcgggatcaaatccgctcctgcatgcaggcggcgacggcgaagaactgaaaaagccttgtcctcttggagcaaactggtgatacctcccctcctttcctcttatcccctgttttgtcctctgttttgctctgcttttgtggtgagattggtcagttcaagaaaacaaaattagtttccggtaagattaatctattatatgcatatgcgtgcagtaaagcaatgagatgatactagacagctaaattgaagaatgggtgaatgaaccggacccaaatcatgattcagataaattttggtgagtgggggtgctttctctgaaaatattgatcccgggtatatactactatggctgagaatccccttacagtttagggaatctctgaaagtaagaacgattaacacaaacacaatgaatctgacaaagaactaaccaagctcatccacaactgatgatacaaattataacatggtggactacattacatatggttagtggtgggcagaaaattaatcaactatcagacaacattgactgtcacaccactaacacaggaaacaaaagtatacagaatgacattttcttttgagtgcctctccactttcatttattcattcataccagtaaacctgtcagttgtaggaagcagaacaagcatatgatttgaagtgcttaatttgcagttgcctgtctaattaacctggcccaagtaacaagtgcaaaaacatacgctttgtcgtataagttgtnnnnnnnnnnnnnnnnnnnnnnnnnnnnnnnnnnnnnnnnnnnnnnnnnnnnnnnnnnnnnnnnnnnggagtagtattacatnnggcacagtcg

SEQ ID NO: 34640 - DNA, 1576 bp, Oryza sativa
  unsure (1)..(1576): unsure at all n locations
tgcattgacgccagttannnnnnnnnnnnnnnnnnnnnnnnnnnnnnnnnnnnnnnnnnnnnnnnnnnnnnnnnnnnncagttcaagaaaacaaaattagtttccggtaagattaatctattatatgcatatgcgtgcagtaaagcaatgagatgatactagacagctaaattgaagaatgggtgaatgaaccggacccaaatcatgattcagataaattttggtgagtgggggtgctttctctgaaaatattgatcccgggtatatactactatggctgagaatccccttacagtttagggaatctctgaaagtaagaacgattaacacaaacacaatgaatctgacaaagaactaaccaagctcatccacaactgatgatacaaattataacatggtggactacattacatatggttagtggtgggcagaaaattaatcaactatcagacaacattgactgtcacaccactaacacaggaaacaaaagtatacagaatgacattttcttttgagtgcctctccaccttcatttattcattcataccagtaaacctgtcagttgtaggaagcagaacaagcatatgatttgaagtgcttaatttgcagttgcctgtctaattaacctggcccaagtaacaagtgcaaaaacatacgctttgtcgtataagttgtcggcttggtggaaataagcaactctccatgatcttttgaactatatggcgcagaacaccacccagagaccaatcacaaaccctgacacaagcccaaaataaaagaacatcacagcctcagtatcctccacacttatgttttgtttcccatgctttggtgcattaacgcttgaacaattcctttgaagaggaggtccacatagaccactgttgccatcatacatggatgggttgtttgcatatagggtgtcaagttgacttccccgtggtattcttccaacaaatttgttatgtgacaaatccaaggagcttaaatatgtcaagtcggataagctcagtgggatttcaccagaaagattgtttcttgagaaatcaagtgattctactgatttcatgtccccgacattgtctggaattttccctttcaagtgattcgatgataaatttaaattcaccaatccatcgagacaagttacttgatctggaattccaccagttaattggttttgtgacaagtcaatgcccaccagatcaaaacttccttctgcatgatagttaagttcttgatgtttcatcactagcgacagaatatctgtgagtaggacataatacgttaaagattcgtaccaaccaacatcaattctcgtcggatgtagtgtcattgcttttaagtttaccaaagttcgaggaattgatcctgacatgttatttgctgctaaattcaagtattgaagactgccaagatttgctatatttactggaatatttccatggaacatgttgtgacttagctgaagaaatcgcaaattctccaagtctccaatccacacaggtaatgctccatagaacttgttccgtgaaagatctatgaaagccaatgaccatgtgtattggatgcatan

SEQ ID NO: 34641 - DNA, 4260 bp, Oryza sativa
tggccccttgatgattgcacatcgatccccatgggaaccttgtccagttctttccatatgaccttgctttggtacattattactcgaacaattcttttgaagtggcggcccgcagagaccactgttgccattgtatatgtcagggtgttgattgtagatggtctcaagttgtgaccctgatggtatccttcctgtgagactattatatgacaagttcaaataacttagaaatgtcaaactggataggcttgctgggatttcgccatagagcttgttctctgataggtcaagcgatgccaacattctcatggccccaatcttatatggaatttgtccactcaagtgattccttgatagatttagatttactaatccaccaagagagactatgtcttcaggaattccgccggtcaagaaattggaagacaagtcaatgttcaccacttccacattttcctcattatattggcgctcttgcccttttgtggccacaggaaaagtataagttactcctgatgctggaggagtctgatcagcttcttcatatggttggcctatcatcgctagtatttttgacaaactatttggtatagcacctgaaatattattgcttgcaagatctaaatgatgaaggtttgtaagtttggtgatgcttcttggaatatcgccagagaatgaattatggctcaaacgtaaaatttgtaactcagtcaagtctccaatccatttaggtaatattcctgataatttattccatgatagatcgatgaaatgtagctctttgcatttgcgcagaaaagatggcaagttaccagataatctattattacttaatcgaagaaattttaggtttcctactcccatctcaaaacatcgaggaagttctccctcgaaacgattgttacctaggtccaaggcctccaaagctcccaagttgcataaatatcctggaatatgtccactgatttgattggagtagagattcaggtgagcaagatttggagctccaatgttggatggcaaaggtcctgataggtaattgttgaagatgtccagtgtttcgaggtttattggcaattcaggtatttcaccagttattaggtttgaatccagataaaatgtctccaacaacatggtttccatatttgttggcaatccaccacggatttgattgttggagatgtccaaatatgtggcctttgaaactgttgtccagaaccattctggaaaggtatcttttatacttgtgtttgctatgtcaagttcaataatatcaacttgtgtttggagccatttaggaaacatggggcccatttgacaacaataaaaatatgcatactttagtctgaagggaggtaaccattcaggatcaaccacaatctccaaggaattataaggcaaatatatcgactccaagcttgctagatgcgcaaagtgtttctctgtgatgactccatctaggttgttgaagcttaggtccaaatatcctagatttgagagcatacctatctcagaaggcagatgagaaaagttgttgtggcctaggtcgatataggccaaatttgtgagcatacctatctcaggaggcaaatgaaccaggccattgtagcttaagtccatccatgtcagatttctaagcatgcctatctcagaaggcagttgtcctgtgagatagttttgtgagaggtcaaggtatactaaactggaaaacactcccattgatattggcaggatgcctgtgatattgttgtatttcaaaatcaattgctgcagtttgctggccgggcatttcgccaaattatcaattaactcagttatgtttccagatgagagactctgtgtgaggtccaggatttctaaactgcatagatttctcaagttctcagccatgatagtgatgccttcgatggcggcatcatcgtcaccggaggaagggggtgcttggctggatggaagcagacctattggtgagataggtacaggacgattaatcgaaaaatcgaggacctggagggatgtcatatctgccagtgcatcagggagttggccatataatctgttcccagaaagtatgaggtccttgaggcttgtaatgttccaaaaccaacaagaagcagcaggatgattaaactggttcccggagagatcaagtctctcgagccgggtgaagttattgtgaaggtgagtcagcttttggtctgctctttgaagtgagcaattagagagattaagaacccttaaggaaggaagctggttcatcacatgaagccaattatcaactgcgctgaggtctaccgaattaaggttgagatactgtagcaaaggtatgttccttaaccatgtcatgcctgatcttgactgcatttctagccctatgcaagatgagaggtcaagaaattgcagctttgagaggttaccaagctgaggcggcaccacgccgatgaacggcatgccagagaggttcagatatctcaagttcctaaaagatcctatgaaccctggaatgtggccatctgaaccacttaggttgttccagctgagatcaagatgttgcagatgctccaaagaaagcagagagggacttatcagtcctaccataccgtttccgacgaggctcatgccatcatcatcaaacttgggcttccaaagttgaagcttgatgacatggccggtcctgttgctgcaccggatgcctcgccactggcaacagtcgtcgcctcgccgccaaaacttgagctggcccatcgggtcatccgtaatgctgttcttgaactctagcagcgcgtccctctcgcgcgggatgcagccaatgggagcttgtgcttggccattggaggtgaccatgaggaagacgatggaagtaaggaccacgatgaaggtgcacatgggggaattcatggtcaagtgattggggctgcttgattgctatgatttggtgcttggtgtgtgttattaagtgcagttcattccattgtgttttatagtaaccagttccagggcatcactaccacgaactctttcctcatctgtgacgggttgtaaccatcagttccaggacatgcacagtgaatgtatttttggttcaaaaattcggaaccctctgcccccaccgcaaggcatttttttggccgaaattttccattttctcaaacttttgtgtattttcccaaaatttattgaaattcagtcaagttgtgctaaaattttcaataatttcagtccaaaaattgcctaaatttcaggagtttttgtgctatcgaaattacccaaatattaagcgaaaatcgaaagtgaaaaatcctgggcatgcaatcatacatacaagtcaagtcgtcggtgtggatgtacagttttgtgtcaactggaattaatactgcgtgctagttaatgatcaaggcttctcaacaaacaggcaagttgtccactagttacccctgtaacggccacaggacatccttaattatgcccgaaatccacgtcttactggtcttaggtcattcaataagcagaaatgtggcgtgttagtcggccctctctaaaattccttctctcgatctatggaaatgccatttttaggtgcacatataaatggtcattttcttattgtgcacacacatagttttatgcataagaaatgtgatcagctgattcaccatcgttatggaaaataacctcacatatcttgatcagtgctagtaagaagatggacctctcagatcgtaccgcattcctttgtccgttatactacatgaatctgtgactgatgctggcatgccaattgacctggacatagttataagaggaccttcatagttatgtatagcatgtgatcaactctctcatgacctcccatctcaattataatggtgttttccactaagctgggaccaacggtggatacaggaaatttttagagccgaataaaactacctaccttgaatatttactttaaaagaatgtcttcaaattgctgcactaacatcgaaattttattatgtgtttgcctaccagcctaggcagctgccggagttgtcaggtctattagaacaggtgtcgaatatattagttctaacaggttacagttcgatttagaattattatcgatgacacgggtagggttagagttgacctccataacgcggcaacccttaaaactgagagagagttgccataatgtaaccatggtacttccatgtagttgcggttaggccacgactggattaatgctggtgtgggtcgagtgcagtcaacaaggtggcg

SEQ ID NO: 34642 - DNA, 1627 bp, Oryza sativa
  unsure (1)..(1627): unsure at all n locations
aacgggctaacttacaatctggtgcgctgtataataatagttcttgtaggctatttatcaaatccattttaagaaatatacatttaatatctataataaanaatagatagtctgatgtaataattattaaataatatgtttcaaactagccgataggcttataacttaaaactaggttatcacatctatttagtatgggtaacccgtacatggtctcggatatataagtggctcaaaaattacacaaacttgtttctctatgtaataaaccatccctacaaaaattcaattgaatttgataagttcttatagtgtgaacatgagttcttacagagcaattgctatgcacgtaatttattcgcacgatttaaggcgacagtgaaatttttaaagtatcatggattcagtctaagcatgcgagaagtgtagatgttggatttattagcttggttcataaaaaggaaggaagtaagggtcttcatgtctggtgagtttgatttgtctatttggtgatgccatctgttattcggctatgaattagattaaatcaaatttaagacgatagatggaggtgaacatgtattcttcaggtagtctatgatgtgccagttgggaaggggtccaattcggcttcggtaagatgactatggtgataggttagatggtgtagcactgttgtagctggagtcaagaggaagaagttatggggatagcggattcttatgattacggtgagcctgctgaaggcttgtcggggcgactcatcatgacagcgaacggatcaactcaagttcaagtacacaaaggtttgtgtaggattaaatagcaagaattaagccaaccaaaggaggagggtgaatagctggagtacctaaaaccaaaatttttagcggaattgaaagaagtacgaattaccgccccgaactattgtggtcgaccgaattacccccctaaactcgaaaaccagacatcgtttacatcaataccggacgaattatccccatcgacccaatccagagcggttttgtcctacatggcgtatgggcagcggttcagtaagcattttatttataaagaaatgtgggacccacctgtcatactcctctctcactctttctctctctcttttcctctctcctatctctctctcactcttcctctctctttcttgccggtcagcggcaggcgggggacacggagctgcggcggcgggggacgagaaggcggctggggccgtagccactacgaggagccgccccatcgcacggagacggattgaagctggtgctgcccgtggtgccgtactcgggcacagacaaaccccccggtggcatgcttcggctccccatcctcggcgtggggctgtgccagtccttctacgccggcgacctgctattcatctagcatacttggcgttggcgcacgctagatgaggaggatggcgctaatgctgatgatcatcatcttccctgtggcccggcctaggtgtcgttagggatgcaagctgggtggccctctacccgatttacaccgccggtgctcgactattatttcgttgctctgataaaacttagaacgccaaatgaaattcactttgcgtttgctcggaaaacaaaggcccgtttgg

SEQ ID NO: 34643 - DNA, 6732 bp, Oryza sativa
  unsure (1)..(6732): unsure at all n locations
gctggantaggatcactgtcgnatacngcnnnnnnnnnnnnnnnnnnnnnnnnnnnnnnnnnnnnnnnnnnnnnnnnnnnnnnacggactggatgagctagtctgagtccggcagcggggtcatcggcgggagggagaagtggagctgccgctgcggacctcctgcatggtgagcagggcggcaacggtgttgcagaagatggtctgctcggcggcgtcacggagaggaggtcggcggcgtaaaagggctggcgcaggcgctaggacgccgacaatgacggggaggcggagcacgccgccggtgcgcttctccgtctccgcatcccgcgccgccgcccgcacccacctccatccatccctgcgccgaggggtggctgctcgtcgtggccacggctgccgctgcctcctcgtcccccgcccccgccgcagcttcgcgtcccccgcctgccgtcgactggcgagaaagagagaggaagagtgagagagaggaaaagagagagaaagagtgagagaggagtatggcaggtggatcccacatttctttataaataaaatgctgatcggactgccacgcgtacgctacgtaggataaaaccgctctggattgagtccaggggggtaatttgtccgatattgaaagttcggagtgaacgatgtctggttttcgagtttaggggggtaattcgatcgaccgcgatagttcgggggtgggtaatttatactttttccttaaaagttaccctcgaatcgatgaagatcgatctgaccagaattgatgtgccgatttgacatcccaaagacctttggtctaaccggtgttagtaatccggtttgaccgcccggaatcgccatcgttgcttgttcccaccgccagtgtgaccaatgaggtcccgccagttgaaccaccgaacctgagaaaaacacaaattgcaaatctcccaaagtagaatgaaactttcttacttctatttgtgtttacaaaatacaacatcatcactcatctcagaaatcttgactaaactcgaagtcctaactttctctaaactcaacttactaaaaatcaatactgggaggcctcactttatatttatactcgaggtaggcagcataagcctataatctaacttatacaagaagccctaatatcctaggaaaccttcctgtataaaaaaacaaacttttacaaactctaatggtaccaaatttggactcactccaaatttaactcctcatcccacacgaacacaatatctccatcacatgccatatggaatctccatctaccacgtgcattgatcttcagcctaagcaccccgcaagatatcctgatcgttcagacgtaatcttcccccaagttgactactgatccatctccgacaatgctctccaaaggcatcaagactcacctacacatgaatcaaataagaaaccatatttgagcacaagttcactctaactttactcaacatgagcacacaacaacattacatatgcataggaatcatctaaaagtcataaacacgaattaatcacgagtatccaattaaacgacccgaaaccaaaaccgacgcagagccggtctgtcataccgtcaggttggtcggtctaactatgcaacacacgccagtctgaccgacagcacctgcccggtctgatcgatcccgttagacaaaaatatctgttcacaatatgaaaaccacatatcttcaaaaccacttcgccaaatatctctaaatatcaaaaccaactatcgcacatgccaaatgttcatcacgaagtaataatccaaacacactttgatttcacaggaagaaatgccatagaagatccaaaactgataacccacgttggccccataatttcttaatccaatccgcacagtaattatcttcttaatcctccctaaattctcacggacatgtgggccccaccgtttttaatttctatttaaacatcctattaatccttgagtcgcttacatgtgggacccacctttgtttatccgttctgcgcgcccggtccatgtgcatcgggacactgacctccgggtcccacgagcaccgacccgtggatcgtgagccgatccaccacctcaccgcgccatgtgctcggtggactcggtagatcgtgcaccgaacccccagtgccactgacagtgggccctacgaggaatattcttccagaatattcctttccattaaaaagaaactctttttcctttcgttctgaaattaacttgaacttcataaatagatatcttgcaaacggtaactccgtttgactccgttcaactctcaaaatctctataaaaatgagatctatctattggcaatattatcgcctactattttaggtactttagtggcttttgtgttgatttactcctttttgcgtgtagttgccaagcctgaggacgatccgtaagccattcttgatgaggaagaaccacgcaggaccaaggcaaaccacctttggccatattgcttcctatatgtacaaaattatgttgtttggaaatatgcatgcttagattacacgttaaactgtttggtctcggtttgcgaatgcaaccgacggactcacctattagtcgcacttgaatctagtaggatattgaagtaacatgtcctggacagctccacagataatgcgtcggtaacttaccatacaagtatgatcactgaggtagttttgcttagctatgctgcgattgcattgtcgtatggggaaacatgggtttccaaccaaatattcaaaacccgagattttattttggtgtgtttgataaatgaaactggattatgaacctggatgatatgtaggctgaacctgtgtgattggctatgtattgttgttaaggaccgattcatttgggaattccatccaagcatcttgtagtacttagtttgtttgtgcctaccttgtgtgtcagtggttggggacaacggggatgaggagacggagttttgtgttgtgagattttgaccattcatggcaatcgtctctattgtgctgcttacggtacaaataggtgtaggagcatccttgactccttgttgtaccccgagtagacgatggctagccagcctgatgcttgtcgtgcgattcaactaactatgtggcatggggttttcatgaactagatttagaaaggccttgccacaaacttctggtgtcgacgggtgaccgttggtagtttcgtgccatgtgggtaaagcgtacaacctatgtggagtgtaaactgttcgaacagctgtgcttacggtcaagggcgaatgtgaggtgattttcttagcgtagcactgattttgaaagctttttgaaattggtttgtgggatgggccggaatcgttccagagccggtctgtgtggcagacggagaacctgagtggtttcaaacaggtggggtgtcttgtggcaccatagtggagctggaatagttggttaagatgtgttgcgagatgagatggctccgcggttcctagctataagcagtactccgtccgtcccattttaagtgcaacaatagttttccgtacctaattttgaccttccgtcttatttaaaaattttttgaaaaaagttaaaaacataagttatgagtaaagtactattcatattttatcatcttataacaacaaaaatactaattataaaaattttttaaaataagacggacgatcaaagttagacgcggaaacttatggttgcacttaaaatgggacggagagagtaagaacttggcagctgatcgagctacgcgtggtggcagagtgagccggactgacaaatccatatattaattgtttataaacacactagctagatgccagagtttgctgtggaaaaaataaactactagaaacaaaatgtatagatatctgaattgactcgcccgttcactgccagaaaattgcctaccgtgaaaggtgggcacagacacatgccctgtttaaatcccacctaaaatttttcactctgtcaaatcgaacgtttaaatagctgcatgaagtattaaatataggcttaaaaaattacacagattgtgactaattatttgcgagatgaaccttttaaaccaaaatgctccttgatttgataatgtggtgctacacaaaacatttgctaataacggattaattaggcttattttcacgtgcggtccacttaagaggcccgcacgtgaaaatcgatttttccgtacggtcctcttaaggagccgcagatgaaaatggagaatgatttccgcagaccgcaatctaaagagctccttgtacagaaaaaaatcgtttttatagtagtgcaaccggcccaacccaagcttcaaactcaagactcaacttctaaagcaagccaacatagagatacaaaaggagatggtttgagaaataacagaacatcggaaatgtggcatcctggtggccaggcttggcacctcggcgatctatctccgacttcccttcttcttctactaggtgtccttggctttcaaaacattctagtaatttatatccccttgcttctattaaagtttatgccgaatatgtgtataaagttggttattatttaggacttagagttttaataggtgtatggtagagatagagttggactttgtcttaggctctttcttaaatagagatgcgtatatgttgtaaccacatggtgacttagcttaggcgagagagaacggatgcaagcggtgtcttgccaagggttgttgtaactctgatacgatatataaatatgctggatcagggaggaacgtccgtaatcagtgtcccagagatataggctatggttggactccattatcaaatatcgttcctcagtgttgtcaccagtgtggatcttctatggagtttcattcacgtttagttattgatggtgatttcaagctggttttataacaagtggtatcagaatttgccggagattcatggtagagatatgagggaagtggtttacaccgcaacaactacttaggatgtcaaatgatggacatggacacaaggtggagcacaacagcgatcaacggaatttgatcggttgaatcgaacacttcaatggttgctttcagcgacagcagtggtctgaactattcaatggttgctttcaacagggagacgaccagacgtggtgctcgggttgatgttggcaaaagtgattgatgatccaattggtgcaattggatactttggacgggtgactcgaaatttctggtgagctacttctaagttgtcatacggttagaacagggtcatccctctgttgaagagagagcctaggatagagtataactctaccctacacctattactactcccaagtcgtaaacaataacctacttcatacatatattcggcacaaactctagcatcttcctctttctcccttacaccaaacacttgtttgtatttgaatgttcctgtgattcactgaagtaggtttctaacaaggagtgaactcataaccaccagaacagaatacaagtgaacatgctctgagcatactgatcctcgattgcggcgtatacttatgtgacctcttccttgtagcttaggaatctgtgatgtaatgaaggattgacactacaaattgatctgaaaagaacagcaggtttatcacgactgactatcaaattaacaacctacgatgatacagattaacaacgtacaacactgtcagtgatggaaacatagtgcgtttctaggactccacatgaattgatgggcgcagaccgaaagacctcatgtcgctagtctatgcgatctctaaaaaggaaggaaagtccccaaggaaaggacaacgacgcttgggtacaagatttgacccttgaagcaaacccacctatcatagtcaacctcattgaccacctagtagccttgtgggaagtggttcggggtgtacacctggatgacaaagaatcaaaccagattgattggaagttcacaagcaacggacgttacacggcctcctcggcctactgcgcgcagtgttgcgggcgcctagcacaagcttcaactcttgatttggaaagcttgggtgccagggaaatgcaaattccatgctgggcttatcattcagaacagggtctggacatctaaccggctcgcgatcaggggttggaaaacaacggccaatgccccctctaccggtgcgaagctgagatagccttgcatcttgtcgccacgtgtagatacaccagcaggatctggcatcttgtagctagatgggtgggctaccagcaaatgcaaccgggtcaatgggaggaggcccagtcagtcgaacagtggtgagagaacctagcaaatacgtacagtatcccaaaaaaaaggacttcgatccctgattctgctagttgtatgggagatctagaaggagaggaatccgcggattttcaaccacaaacagatggcgacgagtttccttttgacaaaaatcaaagaagaggctagcctctggacccttgcaggtgctaagcgcttgtgcgagttcattccgcactttgtatagtgtatagcttacggtgacctcacttttttctttacccctaaggttgtattttctcctgctctattcaataaaaaggcacactcgtgctgttctccgttcaaaaaaagaaaaaacagcgtacaacacagaaannnnnnnnnnnnnnnnnnnnnnnnnnnnnnnnnnnnnnnnnnnnnnnnnnnnnnnnnnnnnnnnnnngacgatcatttnnaccac

SEQ ID NO: 34644 - DNA, 1294 bp, Oryza sativa
  unsure (1)..(1294): unsure at all n locations
ncaaatgagttgaanaatgcaatggatggaccattttgatcataaatatcacgccccacaaatagaaattgatcagaatgaacttgtcttgaaaactaaatcatcacagggtttcatcatgccaacaaatactttaattacacaaatcacgagcactagaaaatatttattaattatattaattcaatgaaaactaaatcctcgaacctaacagaagctgtaaaatgttcatccaccttcatatataggaaaccagtgctcttactctgaagaaatggcagtagcatgaacagttctagttaacttgcaactttcattccagttaggctaccccaattaacaaccacaaacacatatactttgtcataaacactgtcgaagaggcgaaaataagcaatcctccaagttttcacgaacagcagagaaaagaacacaacccaggaaccaaccacgaaaccaacgccacagccaaagaggaagaacatttggtcatcagaatgtagttcaggtatctgctgatccccatgcttttcattagaaagatcaccatcctttgatgtgctattgccggggcaactcctttgaagaggaaacccacaaagaccattgttaccactatacatcaatgggttatacgtgtacagtgtttcaagttgcccgcctgatggtattggtcctgtcagattattgtaggacaaatctaaaatgcttaaatatgttaaatttgataagctgggaggaatctctcctgaaagattgttgtttgagaggtctattgattccaaagcatgcatactcccaatcttgtgagggatattcccattcaattgattccaagataagttcagatttaccagcccttcaagacttgaaatgtccattgggatctcaccagataaattgttaggtgagaagtcaatggtcgttatatccaaaacactaaaaccttagtatttaagctgtagtctcttggttattacagacagttcaccaagcctaagtcgataaaaacgaattgaggcaggaggatatggatttgctgcactatattcatataccatagcacttagattcgataggcatggaggtatcataccagataaccgattttccgcaagattcaaatggcgaagatctcttagtccagtgatagagcctggaatatgcccatggaacatgttgttgttcagtcgtagaaaccgcagnnnnnnnnnnnnnnnnnnnnnnnnnnnnnnnnnnnnnnnnnnnnnnnnnnnnnnnnnnnnnnnnnnnnnnnagtgcattcaatgccacg

SEQ ID NO: 34645 - DNA, 746 bp, Oryza sativa
  unsure (1)..(746): unsure at all n locations
atggcgatgaacccnnatggaacgccagtctnnnnnnnnnnnnnnnnnnnnnnnnnnnnnnnnnnnnnnnnnnnnnnnnnnnnnnnnnnnnnnttctacgccaccgacctgctcttcatcaagcatcagcggcgtcggcgcacgcaggaggaggaggatggcgctactgttgatgatcatcatcttgttggtggcggggcgggggtgtcgttagggatgcaagtgggttgtcccgctacccgtataaaaacctgcttgctagtttatttctcgtatgatagtataaaatttagaagaaaaaatgaagtagaagtgggataagcgggaaaaaaaaagcccgctagcctaccccgcttgcatccctaggtgccgtcagtcacgtgaaaagaaggcggcggcagcggtggtgaggagcttaggatggtggtgaggcgccgtagccttgcggaggtcacggcttggttggaggagtacttcctcaaggccagcgtcaccggcgacgctgtgttgaaccacctcgaggccagcaacgacgggttcaagcgtaagacactagcaactctactacttaattcgcacattcacagagagcatgagttgcagaacagaaagttttcttgccactagtgaatgaattgaatttgctgcaagtggaccgcacagcatcttgggcgcactttgctgccttgtcgcgccatcggtgcgcacgaacgcgtcgacagcattcaatggcgagcagaagcatn

SEQ ID NO: 34646 - DNA, 1312 bp, Oryza sativa
  unsure (1)..(1312): unsure at all n locations
tgtgcaaatgacgccagttattttnnnnnnnnnnnnnnnnnnnnnnnnnnnnnnnnnnnnnnnnnnnnnnnnnnnnnnnnnttcttttttcaaaaaaaaaaaacttcctgtttcccctcatttacttttcccttcctttccttttgatctgtttgccacctaactctacgctttttgtttaattttgcatgtaaagttggaactgaaaatttgtacaaatttatgtgtgtttctctttatttatccacagattaagagcttgaaggaccaatactttactgaactcactgatttatgcaatgagatgagatgtttcaaaagctacagagacacatgccacctcagattccaatagatcattatgaagagatgaaaaaatttaaattattcttggagcgcgcattgcatttcctggaaattaaaaaggagaacattcagcctactatttgggaaaaaaatcccagaatacgagaggcaaattatcaatgccataagttcacaaagaaggcagcctgtgcgcaaacaagaacaacagtttcaccaatcatctacgcaaattactaactcgaacattccacagcaaccgcaggcctctccaggtgtgcagtaaattttttgcaatctttcctttggtcacttctctctgtaattttttccagttataagcatgagcagatttcactcgccgatgccatcccttttcatgccgtttgtagcttgctacttcctctggattgataatacttgtcattttggataatggtgaggtcaaagtttaaaatctttgactatgaataatttctaaaatatgattacttttaaaaaatatttcaattgttgatatttttatatatgacgacaagtactatcgaccccgaagggagtatttgataacatcgccactaatgtatctttttgtgtgctgacaaccttgacatttatgtgccatctacgtactccactactcaaacaacacattcaggttcaggtgattggcaagagtagttgtatcaaatggtaaggcatgctaaaatcactttggctctcccaagcttctaattcatcatgacttctctagagttcataataaacaagctccaaaataaagaagctgagatcatcctgatctagattaaaagaaaacgaaacaagacataaacttgagctttcttttcctcgaatatgaaggagcgtacacaatatctaaaatatcaaatannnnnnnnnnnnnnnnnnnnnnnnnnnnnnnnnnnnnnnnnnnnnnnnnnnnnnnnnnnnnnnnnnnnnnnnnntgcatcaacaaagggccagc

SEQ ID NO: 34647 - DNA, 4560 bp, Oryza sativa
  unsure (1)..(4560): unsure at all n locations
ccgagcaagcttcaaaatttcttcaaaaaagagaggaggtcatgccaaaatttctagtgaatttactttggtgattatatacaaatcggaggtgcctaaaaggttagcaacttcatcctccaatgtttttttggtcatattacatctggagctatgttttgcacacttttttgtctccaaaattttgttgtaagttgatgagagagaaaattttgtgtgggaaaagaaagatatattagaaattttgtttatttgataaagaaggttttataaaatagttgagtaggaaaatatagtgaaagttaatcttaaataaaagaaaacaaactaaattgaaaattaaaagaatttaaaacttcaaaaaaataaataaaaattatttggtggactattttataatttttgtatgaataatgatatgtcattattgtatgactattgacaaagtttgtgattattttatcattattgtatgactgtcattattgtacgaatgattatttgtgtatgattttttttcatttcatgtagatgaatcggcaatggatgtacgttgaccggcggtccaaagagtttattgacggcgtgcattattttttgagagtggccgaagctaacaagcataagggttttatttgttgtccatgcaataagtgtaagaatcagaaggagtattctgcaataagggtattcatttccacttgtttgagtcggggttcatgctaagctataattgttggacatcccacagagagcaaggggttgaaatggaagaagatgaagtggaagaggacaatattccagactttgctcagtacgctggatttgaaggaaatcaaacaggcgaggaggacagagatgctgattataacgacgttgcggaagatcttggtcagatgttgcaggattccaaggaggactacgaaagtgaaaagggggcctataaattggacaagatgttagaggaccatagaacgtcgttgtacccaggttgcgagcaggggcacaaaaagttggataccactctggagttcttgcaatggaaggcaaaaaatggtgttagtgacaaggcatttggcgatttattaaacctcgtcaagaacattcttccggagaaaaacaaattgcccgagacaacgtacaaggctaaaaagatagtctgccctttaggactgaaagttcagaagattcacgcatgtccgaatgattgtatcctatatcgcggtgaggagtacgagaacctataagcatgccctatttgtaaagcactacgatacaacattagacgatatgatccaggtgaggttgacgggcagctaacgaagaagagaattcctgctaaggtgatgtggtatttccctataataacacggctaaggcgtttgttcaggaataaggggaatgctagaatgatgcgttggcacgctgaaaaacgtcaacaggacgggatgctgagacaccccgccgatggttcgcagtggcgaaacatcgacagaaaatttaaagactttggaaaggacgcacgaaccatacggtttggtttaagtacggatggcatgaatccttttggagagatgagcagcggccatagcgcttggcccgttacgatgtgtatctacaacctcctcccttggctatgcatgaagaggaagtacataatgatgccgattattattcaaggccccaagcaacctggtaacgacatcaatgtgttcctacgaccactggtcgaagatcttaaactgttgtggaagaaggaaggtgtccccgtgtgggacgaggacaaacaggaggagtttaacctacgagcgctgctgttcataaccatcaacgattggcctgcacttagcaacctatccggacagtccaacaaggggtacaaggcttgcactcactgtatggatgaaacagaaagtacgtatcttaagcactgtaggaaggttgtgtacatgggttatcgtcgatttcttgctgcaaaccacccaatacggaagaaaggcaagcactttgaacataaggcggaccaccgtacaaagcctaaacatcgcagcgggaaaacaatgtttgctatggtgaaagatcttaaagtagtgtttggaaaggggcctggcagccagcctatagagagcgaagatggtcacgcgacgatgtggaaaaaaactccatattttgggagttaccctattgggaattcttggacgtccgccacgcaatcgacgtgatgcacctcactaagaacctttgcgtaaaccttcttggcttcctaggtgtatatggaaagtcgaaagatacactggaagcacgtaatgatctgaagcatatggaacaacgcggcgaccttcacccggaaccaaagaagaaaggcagccattacttgagtctagccagctacactcttagcaaggcagagaagaaaattatgtttcaatgcttggagagcatcaacataccatctggatactccacgaatataaagcgaataataagcacgaaggagaaaaagttcacaaacctaaagtctcataactgtcacgtgttgatgacacaactgctaccagttataataaggggtatcctcccagacaatgtccaggcaacaataacaaagctatgttctttcttgaatgcaatttcgcagaaggtcatcgatccggataggttagaagccctttagaatgatgtggggcaatgtcttgtcagctttgagttgatattttcaccttcattttttaatataatgacgcatctgctttgtcaccttgtcaaagagatcggtattctgggcctgtgttcctacacaacatgtttcctttcgagaggtacatgggcgttctgaagaagtatgttcgtaaccgtgctcgtccagaggcaagcattgcgaaggggtatggaacagaggaggtcattgaaatcagcatagaatttattgaatatttttacccaatcaaggtacctgaatcacgccatgaagggagactacggggaaaggggacctccggaaggaaagcaataatgacggtagacaacaatttaatttcgtaaagcccatttcacgggttctgcaacaatcttcattgggggctccttacatcgaggagcacttggctctagttcacgccaaaaacatcggtaagtccgatgcatggattacacggcatcacattgatactttccccgcgtggctgcgacaacatctcatgggtaacgagacgattaaccaacaactggccttcctggcgagggatccatctggttcgattgcgacattccagggatatgatatcaatgggtacacattctacacaagagcccaagacatgaagagcacgaactagaacagtgttgttcgtatcgatgccatgggacacgatggtaccactggtacgtattacggtgccatcgaggagatatgggaacttgactatggacctctcaaggtccctctgttccggtgccaatgggttaggttgactggtggaggcgtaatgattgatgacagtgggatgacaacggttgaccttaacaaggttggatactcagacgaaccttttgtccttgccaatgatgtaacgcaagttttttacgtgaaggacatgtctagcaaaggaaagaagggcaaagggcctgacgagccgaagcgccacgtggttctcccaggcaaaagaaaaatcgtcggagtagatgacaagactgacgaggattacgatcagtttgatgggcaatcccctttcacggtgacgattgactctagtatcctcctatcaaatgaagacaccccttacacatgtagcgatcacaaggaaggaacaatagtgaggagaaagtacatgcggacaaccgtcaccgccgatgtattgccgtaattgttttgtacacgatgtaaactattttggatgtattgaatatgctagttatatatgattattaacaaatttaaatcatgcatatgctaggtatatatgattattagaatttttaaaagttttaaatcatgcatgtggtatttacatatgttaattagaatttttaacaatataatatcatgcatatgctaattatatatgattattagaatttttaaaagttttaaatcatgcatgtgggatttacatatgttaattagaatttttaataatttaatatcatgcatatgctaattatatatgattattagaatttttattaattttaaatcatgcatgtggtatttacatatgtttattagaatttttaacaatttaatatcatgcatatgctaattatatatgattattagaatttttaacaattttaaatcattcacgtgcttattatatattatccacttaatttactatagacaacgataatttttcgaaggttttgtcattaatttttcgactttaaataattttaatgcattatttactattttagaaacacatatgcaacgaaattcaatattcagtgatattatctttagtcccggttcttaaccctnnnnnnnnnnnnnnnnnnnnnnnnnnnnnnnnnnnnnnnnnnnnnnnnnnnnnnnnnatagaagcgtcaaacatnaaacag

SEQ ID NO: 34648 - DNA, 11221 bp, Oryza sativa
  unsure (1)..(11221): unsure at all n locations
gtggtnattatgaacgccttgttnnnnnnnnnnnnnnnnnnnnnnnnnnnnnnnnnnnnnnnnnnnnnnnnnnnnnnnnnnnnnnnaacgaacgcgaacgaaacgtgtatgaacgcgaacgaacgtgaacgaacgcgaacgaacgtgactgaaacgcgaacgaaacgtgaacgaacgcgaacgaacgcgaatgaacgtgaacgaacgtgactgaaacgtgaatgaatgcgaacgaacgtgaatgaaacgcgaacgaacgtgattgaaacgtgaacgaatgtgaatgcacttttactaaaagtgtgagaacgagcgcgagcgaaacgtgtacgaacgagataattaaactattggtgaacttagcatatatatatatatatatgattatatatacttgaaaacgtgaaatacaatatatgttcctttgcgtttagactaatacattttttttgcatgttgcagagaagacgtcgtcgtcgtcgtccctcaagccgaagtggtagctagccctcgaaggaattcgcgcaggcaagtgatgtaaagatgtgattgttagagatataatataagattgttagatttctaatataagattattagattatcagagttagcatatgtgagtgttagagattatcagattattagacttagcatatttgagtgttagagattgttagagatttaatataagattattagaggtttaatatacgaaacttaattagacttagcatatgcgagtgttagagattgttagagatttaatataagattattagaggtttaatatacgaaacttaattagacttagcatatgtgagtgttagagattgttagagatttaatataagattattagaggtttaatatacgaaacttaattagacttagcatatatgattatctagggttctaatacacgacacttagacttagcatatatgattatttgagttttaatacaagattagtagagttttaatattacgcttagcaaatatttcttctatgaacagttggctgatcgcgatgaggaacagatattgtacgatacaatcgtagagggaagcagccagtactggaatgaagaagaggggaacgaggatccaaaccagtacttgaacgaggaggggaacatggagagggatgcggaggggaacgtggagagggatgcggaggggaacgaggaggaggctagtggaagtcatccctccgctggacagaagagggcacgcggacaacgaggtgccgcgaagaagatagagggtcggcacatcataactgaggtggacacagacggctaacatagtgccccggcagaaagcagccaagaattttgtacgccacagcggttgggttgtgagggataacgtgcctgtcagcaaggtgtactggcacagaacaagggctctcggggataatgacagctttgtcccggaatcaaagaaagagatgctgtggaccacaatgctcgagacattcacgctccctgcgggtacggagaacgtagtgaaaccctggactcgtaagaaaatggccaaacagttccagagcttcaagggagatctgtacaagaaatacatcctgaagggactaacaccgaacttcgacgtattcccaaagctaagggatcattgggacgagttcgttgcttacaagacagggcaacaagggcaagcgatgatggtcaaaaacaaggaaaacgccgccaagaagaagtaccatcaccacttagggtcaagtggttatagaaccggccaccgctaaatggccggatcgatcgaagttctggtactatgctcacggtggaacgcttaacccagttgatggctccctggtcttcagcgatcagatacgcgaagctgccagtcgactaatggacgcagtggaagcctcttctcagggcacgttccgacccgacagagagaaggacgagctgtcactcgccctacagactcccgagcattcaggacgaacacgagggaaatgcatgattccctggaagattggattcaaggaggacatccacacgtacaggagttggatgaggagcaagagagataccgaggcgaagattgcaaatcttgagtacagggtatcgagctacgagctcagcatgcaagaggaggtggcaaggaaggtggatgaatgcatggcagcacatcggtcccaggatccccagccgtacatacctcctccaatggtcagcccatcaggcaatcgtagcagctgcgcctcaacggggcaggtaggatcatagagcatggacgccatgcaaacccaagacaaaaccacctgcccgttgatgagatcactagtggacaccatgtgagctgcatattcccttcaagaacttatcaatcaaggtatgctcgtagttttatgatttttgacttgtacgttccgcaagttgctgcttaggttgattactaatagataacctctcatcacgtgaaggtggcgtcgggaatggccatcccaacggacattttagggacttaccactgcaggccaattctagcaggatactcgagggtcgaagttgagctggtggaagccgcgtacgaggacctcgagttggactacccaggaggagacggtgagacgcatctacgagacataagccacgccattatactatggcgcaagcgctacatcatcctccctgggcgacaagcggcgtctcgtgcaccatctctgccggctccgccgtctcctcctgcaccatctcctccagctcctccgcctcctccacctccacctccaccgtgtccgcctgcacctcccaagacaaggtctcgctaagctccacctcctgccagcacaagggcaatgaagaaggccaaagttgacgccaccaaaaacaaggagccgccatacgattgcagtcaagaggagcttgacgcttatgtggcaggagaagtgaagaggcaactcaagcctcggagtcctgaaaagaagatacctattgacccgagcatgaagaagttcttcaagggaatgttcaccacaaacaaggaggccttaaagctatcggactatgaccgaacacttaggaaagcctattacaagaagtccaaaccagttcctcaacttggagaacaaccaaaccaagaggtcaagccattggtgaccggcgaagactttggcataacggatttcatttcggacaccggtctaactgtggttcagttggttggaggcgcaccaatcccgaaggcggaagtggcatacaagtttgaactcggtaaaccgcttgtcaggcctgagcagctgcagtccctaccgacacaaatgtacaaattccgtgaacggcacatggaaatgagcgccaagggtagagagatgttcggagcgaggatcagaaaccccgacttcttgcaaggagaagatgttctatggatccatttcaaggatgtcttcgatctgtaccatctggatgccctcgatgtctctcttctgagcacatggattttgtaagtatctttgagttcgatttgtttcgttcaataattagctcctggcatatatgtaagcaataataatttcctttcatcgttgtagaatggagattcaaagggcccgacggcggggggtttacgatactgggttcatcgaccctcggaaaatcaacaccgaaatgatcgacaagtacgagaaagacacaaaggacaatctcgtccatctcctaacgcagcagcatttcaagacgttcatactactgccgtgcaacacagagtgagtttttattgtcattcgaacaaatttcattcccatatatataacatgtacattctgatatttatctcatctcacgcatattccagattccactgggtcctattatttttcgacttggacgcatgcagagtcactgtgtacgactcaatgaataaagaggagaaggtttttgacaaggtcttccaactgatagacaggtaatataatgccatctattccaaagtcgcgggactctgttgctattatgttgatcttgggtaataattaattaatcatagcttgcaactgcacatgtagggcttgggatcggttccatcaattggtccgcgggacttggaaagaaaaacttgacggaggttttattttccagtgagtacatgcatgatccaaaattatattgaattgaatctataattatagttaatataaagagtatattaaatctctcatcgtttctcatgtagtgtgcaaagcaggaccagggaactaacttatgcggctactacgtatgcgagtatgcccactgcctatcaaaccaaatatacaccacacgagagctcgatgtacgtatacataaaccattcaaaatttcattgtgtatcgatttgttaagttgtttattaatttcatatattgatatgtcattatttttcgaatgatagcgtattcacatgagggaaaatctcccacacaaggattttatcacgactgttcaagaacaactaatggggttcatcaacgaagaagtctttaatcccgatggtgaattctactacgacggatcgacaattcataacgtcggtccttcctcttctgacgtaacgccggcgtcgaagtcgtagctatagctagtgagaaaatgaattgtacatatatatatttatatatgtacgtacatttactttagtgttaatatatattttggtaacatatatgcacataaaatgttaagtgctttaaattataaatatgtgtgtaatatatgtatttatacatatacacatacgcacatacatatatatatatatatatatatatatatgtattctatatatatgcataatatatatattacaatgcatatatatgtattggaatatatatatatatatatataatcaaccatgcagcaaacagggccatgcaaataaaaaaaatggtacacagatctttagtcccggttggtaacaccaaccggaactaaagatggatcagccggccacgtggctgaccgatctttagtcccggttctgttactaaccgggactaaatatcgatctttagtcccggttatttcacccgagactaaagatcgctatctttaatcccgaattcgtagtcccggttggacaactaggactaaaggggggttacgaaccgggactacaaacggtttctccaccagtgtcagtattctaaattcacaaacaaagagacctgttcagacacaaggacaccaacagtctgatcaaacggcctggcaagctcctggatttaacatttcacagcagcagcaaccttcataaggtttggagcagcatgacggttgtacttatatttatgtaaatgctatatccaggaatttttccacttgttagaggcaacccttgttaaaaaaccagccccgaaatcgacatcgatagctaaacatggaagaaaacgccataggagatccaaaacaatgacgacaccgagacacgatatttggtaacggagttcagtcgtagcctacatctccggagcactgattacgggcgctcctccccgatccagcatatacagcgtatcagagttacaacgactcacggccggtcgccgccggcagccgctccctctcgctatgctaagttgccatgcggttacaacaggcacgtccctctatttatgagagaacctaggatagagtctgactcatactctagtcctaatacctattacaactccaagtcctaaactgtaaccaactacgtacacatattcgatacaatctctaacaaactccaccttggcgaatatgtcatgccaatttgaatctgttacttgcttgaacctccgtgtaccaggacttgagttggttcttccgccgctcacgccgagccgcccgatgagcctacgctaggctcgccgccttcaggattgtgcatagcaataccagcatacccatcttccatgactccacctgcaacagcactctcttgtaacttgtacaaacatgagcttgtcctctcaccagtcataatagtcttgtcgtccttcatgatattcatgatcttcctattagaatccacctgatacaaccaacctgtctcatgtaggctcccaagcgtaatcaaactcttccttagtcccggcacgtgtctcacatttgaaagtagcacttcgtttccatcatacatcttgaacttgacatcacccactccaacaacacgataactcgtgtcattgcccaagtaaacaacaccaaaatcaccagatttgtatgaagagaaccactcccgctttgatgtcacatgataggaactagctgagtccaacatccacgcttctccagacttctcgttagacactgtgagaatctcatgactgttgctatctgaatcattaccatgagctgctaaacttgcaatgccacctttcctcttctttagtaacgggcaattcctccttatgtgtccaaactcatgacacttatagcaccgtgccccttctccttgctcttcggcaccctcgtttcatgatcatgctttgccttgactagcaaactctcagcctgagaagcctccgttgcctcatttttctttgatcttctcaagtctcgtgcaagcaacgacgaaattatctcctcagttttgacagtacccttgccgtgtgtcagggtagtcaccacatgttcataagacggtggaagcgagcacagaagaattatggccttgtctttatcatccagtttcacatctaacttgcttagatccacaacccactgattgaagacatctacgtgcttcctaagatttgactcctcttgcctccgcaaaccatagtaccatacagctgttgtttgagatacaacttactcgtcagcgacttggacatatacaagcttgccaacttgtcccaaatttcctttggtgatttttcatccatgacctggtacatgacaaaatccgagagcctcaaacgtattgttgcagctgcctgcgccttcatctcatcccacttgtcatcatccatcttttccggcatcgtctcctcaagagccttggatatcccctgctgagccaacagatccttcagcctcatctgcgagagaacgaaattcctagtgccatcgaacttcaccacctcaaatttggaaaccaccgtcgccgccatcaacgataatcaacttgatcagctgtcgccctgattaaattgatctaccctgatttaattgacccactgactaaacttgcacagtcaccagccggacaaaaccaaccccttttttctccaaaaaaaccggttcggttttatttttggttgaaaaaaccagtcaaaccgagcggtcaaaggaatcagatcgatttctctccttccttcggccctctctcgctccccttctcccgatgcgccgccacctcctgctcctcatgccgccgctctgcgccaccggccccgcaagaaacaccgcctcctgcctcagaaaccgcctagggcgtcgccgcctcctgccgccgtcacctgcgccgaccccgtgaggagccgcctaagggtggacaaaaagctcgaaattcgtggctcggatcggctcgtagcaagctcggctcggatcgactcgaactcgtagtcttaatgagtcgagtcgagctagccttttagctcgtgagcttaacgagctagctcgcgagctgctcgtttagctcgttagtataaaatatcactaaattttcatgaacttagtatttattgactagtgcttagtcttttagttacatcaaaactattcatattcagtaagtattatattagttagtgtttattattatgttaatatataataaaatgttaaaattgaaattattaatacgatattaataagatatagctcgttaacgagcctaacgagcttaacgagccagctcgcgagccgagccgagctagccttatagctcattaacattaacgagccgagccgagctggctcgttaagataacgagctcaaacgagccgagccttaacgagacgagctggctcgttatccagccctagagccgccgcgtcgccaaagtccggcgccggttccacgccggtaaccgccgccgcaagcccctgctcgagctccgacggacgccgccgagtaccacgccgcctgcaatgatgcctctagccgcccgtgaactcgccgccccaaaccacgctgcccacgaaatcggaggtaagatctcgcccttgccttgtggtttgtttcgattactttgttgcaatcccgtggtgcttttattgggaaaacaacgtgtccgatttccagtccaaatcgaatccgtatcaaactccctcctgtgtcgaacgtggtatccatccagcttgtcttcggtcgtgtccatgccgtgaccgacacatagataactccatggccaagtcttcctctgcatcacgaaacaccaaaccttgcacgtcctggctcagcccgctccttctcggcatcaccctgatctccgccgccggctcggcttcgacgcaaaacgcgcacaccgccacgaccctgaccttctaggcttcttcgtatctccagcggaacctagcaccaccgccaaacaccacttgccgactacagcaatgactagtgccactgatctgttgtcatcgtgattttcttgatctgtgctagaaacagttgaactagacctgtctagggttggaaccagcaccagatgccagtctagacgccctaggcttagtcctgccatccaccgctaatacgccgcctttgaagtgcaaatacctcgtcaacacctccaaaacagcctataggatccaccccctccgacttccgattgaacgccatcaatctagtcacgagccaaagccgacaagtcgcatgtcgtcttccctgccgccgaatgacccgagcgctatgtctagccgtctccctgtcgaacgcaactcatcgaaaggcccgggccaccccgcccagagtgttcgaatccactgatcaagaacgccgatcgcctccagcttcaatcaatccgagcgtgcggccgcacatctccctgtcgagagtagctcatcggaaagtccggaccacccgcccgaagtgtccgacccaccgattggatcgccaatcgcttccgccgccatcaactcgagcaccacgtctagtcatctccctgttgaaagcagccatcgacggttctggccgccgccagaagtgttcaatccaccgatcaagactctgttgatcgccgccgtgctccaccttgcgccaatgcccctccctggacattacaagcaagctacgcagtgtggggcacctccatcgcgcctctaccatggacctcccgcaggctctgataccacttgttataaaaccaaccccaaaatcgacattggtagctaaacgcggaagaaaacaccataggagatccaaaacgatgacgacaccgagacacgatatttggtaacggagttcagccgtagcctacatctccggagcactgattatgggcgctcctcacagatccagcatatacagtatatcagatttacaacgactcacagccggttgacgccggcagccgctccctctcgctatgctaagtcaccatgcggttacaacaggcacgaccctctatttatgagaaatactaagatagagtccgactcatactctagtcataatacctattacaactccaagtcctaaactgtaaccgactacatacacatattcgacacaaactctaacatatacagcaatttttccacttattagtggcatccctcgctatgttttgctggcttgatatttgatgacttccatttctttttgttaaattttgacagccttgctcttgatgcagtatttgtagactccactgctcaaactggacgtccaggtacaggtgactggcaagaggatttatatcaaactgcactctgttggaactttccaatgttcatgttattttagaaacgtcttcctaaagttcattgaaaagatttatttttgaattccagtactcccattcatgtagccttttcgacagattttttttatatacatcaacagattaaaagattgaaggacaagcactttgcagaactcagtcatttgtgcaataaggtatcaatgaagctagaatatgtggatagccaaatgccgtttcaaatgcctatagaacagtatagaaagctgaagaaatttaaagaaattaaatgttggagcctccaggcattggacgtctcaatgaacttcttgtcagggtctttaccttaaaatttggttgtccttatcttataaaacactatgtggaaccccgcgcattgctgcgggaatttaatatgataacaaataaaaaaataacgtgtaagatagctagataacatcagattaagtaaattaatgtggtttatgataatttaaatttaaatagtatgtagaatggtgattcaaatgtaaaaagtaagatggtatgactttatggaagaagaaaagaagggagatagtttggaccgtagattaatcatctaaaggctaaaaacaattgatgtgatatgacttaattagagaaaaaaaaagaagaaagataatttagaccatagattaatcatttaaccactaactaagtgaggataaactatatatgtatataggatatcataaaacataataaagatatacattgaaacattatgtgaattatgttggatcataatttaacatgtttgtatttgaaaagctgttaaattataaaaactataaagatataacatgtttgcatgatgtttaaatgtgataattgttagtggatgatgatgtgtcatcttgttaattagtggattagtggatgatgatgtggcatcttattagtggatgatgatatggtatctttgtatgctaagcttaaggagttagtgaggataactttatagtagtaagataggatttcttgtcagggctcctttgaacctgctcatgatgttgttgttttccctaaaaaagaacccagctgtaatgcacgcaatattactggataatttgtaataatcagccgtgatcagagctagcatatattgttttcttgttccagataaggttatcctcttgatttgttttttctgagcttcatgaactaaaggcaagaggctaacagtgtatattaccataagtctagaagagctctgtgctcatatagtcatatatacatttattnnnnnnnnnnnnnnnnnnnnnnnnnnnnnnnnnnnnnnnnnnnnnnnnnnnnnnnnnnatatagt

SEQ ID NO: 34649 - DNA, 752 bp, Oryza sativa
  unsure (1)..(752): unsure at all n locations
gctgggnnnangatgaactactnnnnnnnnnnnnnnnnnnnnnnnnnnnnnnnnnnnnnnnnnnnnnnnnnnnnnnnnnnnnnnnnnntcgcccttgccttgtggtttgtttcgattactttgttgcaatcccgtggggcttttattgggaaaacaacgtgtccgatttccagtccaaatcgaatccgtatcaaactccctcctgtgtcgaacgtggtatccatccagcttgtcttcggtcgtgtccatgccgtgaccgacacatagataactccatggccaagtcttcctctgcatcacgaaacaccaaaccttgcacgtcctggctcagcccgctccttctcggcatcaccctgatctccgccgccggctcggcttcgacgcaaaacgcgcacaccgccacgaccctgaccttctaggcttcttcgtatctccagcggaacctagcaccaccgccaaacaccacttgccgactacagcaatgactagtgccactgatctgttgtcatcgtgattttcttgatctgtgctagaaacagttgaactagacctgtctagggttggaaccagcaccagatgccagtctagacgccctaggcttagtcctgccatccaccgctaatacgccgcctttgaagtgcaaatacctcgtcaacacctccaaaacagcctataggatccaccccctccgacttccgattgaacgccatcaatctagtcacgagccaaagccgacaagtcgcatgtcgttt

SEQ ID NO: 34650 - DNA, 928 bp, Oryza sativa
  unsure (1)..(928): unsure at all n locations
agcgccgatggaacnncnnaatgatatgtcaagtctnnnnnnnnnnnnnnnnnnnnnnnnnnnnnnnnnnnnnnnnnnnnnnnnnnnnnnnnnnnnnnntgataaaaacaatagttatggacagggcactatgaccaaccctagagggagatttgtcttttaagatggtttttcttattagtttctttgtaagaattggctttaacttctctgaaataaaatccagaatgaattccatcatcttaaaatagaaaaaaaatagttatgggcactatgaccaaccatagagggagatttgtctttaagatggtttttcttattagtttctttgtaagaattggctttaacttctctgaaataaaatccataatgaattccatcgtcttaaataaaaaaataccgtcttaatttgagagataccaagaggtgccaaattttacagtagaaaatgcagtacctccttgtacctccccaaggaccgtaaaatccctctcttaaaaatatctagttgttacaaaaattggaattaatagatatggagttgtttcatcgctttattaatttaatatgaatttgaaattgtcgacgtttgatgtcgcgattccggtatttgcatagtatggggatcgttagtactaggatatatgcgagattgtagtaaaagagatgagggcgaggatttttatacaggttcgggctcctgaattgtcaagtaatagccctacatcctgttggccgaagccggtcgttgctcttattcaccataatcacaccagtacaatatttatggtagcctatctaacggttgtcgacatggcggtctgaaggtctgactcgtagtcgacgacagggtagtcttccttctcgaatccgtgcccgattagatcagagacaacgctttgtctcttctgacagtttncgtagaccc

SEQ ID NO: 34651 - DNA, 1078 bp, Oryza sativa
  unsure (1)..(1078): unsure at all n locations
nctattctcgggttttccctaatagcacgctggatcataaggagtagaagttggcttgcagccactatatccaaagtgactcaaaatcttgtccacatagtgggattgcacaagtgtaatctcaccctcatctcctctttgtagtttaatgttaagaataacatcagcctctcccaaatccttcatttcaaaactcttggacagatagtccttgaccccctcaatcacattgaggttggtcccaaagatcaatatgtcatcgacatataagcacaagatcactccttctcccccaccatagcgatagtacacacatttgtcagctccgttcacaacaaagcctgcagatgtaagcgtggtgtcaaacttctcatgtcattgcttaggtgcttgcttaaggccatacaaggatttcaacagtttacacactattccctcctgaccttctagtacatacccgtctggttgatccatatagatctcctcctccagctctccgtttaggaaagctgtcttaacgttcatctgatggacgagaacaccatgagaggctgccagagcaagtagtactcgaatcattgtcaagtgagcaactggtgagtatgtgtcgaaaaaatccttgccttccttttgggtataacccttggccacaagtcttgccttgtacttttcgattgtaccatcagggctaagctttttcttgaaaacccatttgcatcctataggcttgcacccatatggacgctcaacgacttcccaagtatcattagacataatcgagtccatctcactgcgtactgcttccttccagtagtcagcgtcaggagatgaatatgcctcttctatggttcttggggtgtcatccactgaggtatacaatgtagtcatctccaaaggattttgcaaccctttgtctcttactcttacgagtatctacaatgttgtcctcctcaggattttcctcaggcgtttgatcattgtgttctatcggtgcaaagtgcttatggggcatgacagtttcttgactagaaaagcttagtggttgtttaataggaaaattattcttaaagaatggtgt

SEQ ID NO: 34652 - DNA, 1975 bp, Oryza sativa
  unsure (1)..(1975): unsure at all n locations
tgtgaatgagacccagctnnnnnnnnnnnnnnnnnnnnnnnnnnnnnnnnnnnnnnnnnnnnnnnnnnnnnnnnnnnnnnctcacagttgttgttctcaagttccttagtcagcatctgaatctcatgagcttgttctactacagaacggtcatcgaccatcttgtagtcataaaactgctccatgacatacagctcactgccggcgtcggaaactccgaacttggcctcaagtgcatcccacatgtccttcccgaaaggcatgtgcatgtacacgtccactatattgtcagcgagtacactgatcaatgctccacggaacaggcaatccgaagccttgaatttagcctcttcctcaggagaaagaggtggttcacttcgtttgccccgtgaaacatagaagcattgcatcgctgtcaaccacaatagtgcacgtgctttccacctcttatagttagaaccatcaaaagcatgtggtttcagtgcagcagcaaagccactaccgaaaatgacctatcaggtttttggattgttggaaatatggtcatatatcagcatattttaatccaaaatattaagacaataatcataatcatggcatgaacaatgtggggtgatctagtgacaacttatagcataaccagtaacatgcttaaggtatcatgagcatcatgcacatacccataccaaggacgcaattgacttgcgactagcatgactaacagcggtatgaacaaatgaattaacaacaggagaaggacataccccgagaatggccctccgctgaattgtgaggcagaattgcctctgttggtgttgacgttcgcaacggctccggctcctggcgcgtcatctccagaggcagcagcggcgccggcggcagctccggctccaggcgcagacatggtggatgaactgagcagtcgtgcgggaagcactccccaaaaacctgatcacccgcctacccggtgcatatctcaggcgaaggtgtggttctagaggcctgcaccttccgatctctcgtgcgcgcaagtgatcagaagcgaggaagcgagacagcacaggcgcgcgcggaggaggaagaacaccagggagaaaagcaagcgaatcgttctgatcggactagcggcctccttagatagcaggagagatcccgccagttgcaacacacgcgtcgtggaatcgtgggatcgtgcacgcaccgttacggaggcagtcgtgggaacgtgggatcgtgattgcaaaagaatagagacgtgacgtgacgcacgcccgccagccacgccttgccttgttctcggccgggccggcgcgcgcgcgcgtagctttccgactcccacctcaaccggtcaatagggagcctccaataactccctatttaggttgagatactcctcgcttaaattctgaggtggtattattatccttaacacttattatgggcctttgagattttaatagaataaatcgggtctagcccaattattctaacaatccccaccaaatttcaaggctcagaagaaatgttctcaaggttgtgcctgtttgatatagcagtgttttggtggagactgttaagttgaacttccacctagaaaatgagctacatcagaccacaactgaacaatggactatgccttgaattgtcagtcttgtgtgatcaggtttcactcaaacccttatctggtattgggctgccgttcgcatcccctctgtttggagcatataagtcaaactccaggcctttaataagtatttagagatcgcccaaacctcatagattgtgactagcagtcgaactcatataggtgtgttccttctgagatgttctgcacgtccccctctgtgcttggaaaagccactcggaacacattaaggtttgagccatnnnnnnnnnnnnnnnnnnnnnnnnnnnnnnnnnnnnnnnnnnnnnnnnnnnnnnnnnnnnnnnncgacaagcgatccaaatccacgct

SEQ ID NO: 34653 - DNA, 7586 bp, Oryza sativa
  unsure (1)..(7586): unsure at all n locations
tcctcccgacttccttatacgctataacattatacgtttcttctctttcttctaacttattttgtcatgcttacatactcgngagtctcctaacttactcccctncnccncncnccgagtgcccctgatgatacgcagtnnnnnnnnnnnnnnnnnnnnnnnnnnnnnnnnnnnnnnnnnnnnnnnnnnnnnnnnnnnnnnnntgttggaaatatggtcatatatcagcatattttaatccaaaatattaagacaataatcataatcatggcatgaacaatgtggggtgatctagtgacaacttatagcataaccagtaacatgcttaaggtatcatgagcatcatgcacatacccataccaaggacgcaattgacttgcgactagcatgactaacagcggtatgaacaaatgaattaataacaggagaaggacataccccgagaatggccctccgctggattgtgaggcagaattgcctccgttggagttgacgttcgcaacgcctccggctcccggcgtgccatctccagaggcagcaacggcgccagcggcagctccggctcgaacggctccggctcccggcgcgccatctccagaggcagcagcggcgccggcggcagctccggctccaggcgcagacatggtggacgaacagagcagtcgtgcgggaagcagtccccaaaaacttgatcacccgcctacccggtgcagatctcaggcgaaggtgtggttccggaggccctgctccttccgatctctcgtgcgcgcaagcgatcagaagcgagacagcacaggcgcgcgcggaggaagaacaccagggagaaaagcaagcgaatcgttctgatcggactagtggcctccttagatagcaggagagattccgctagttgcaacacacgcgtcgtgggatcgtgggccgttacggaggcagtcgtgggaatgtggttgcaaaagaatagagacgtgatgtacgcacgcacgcacgcacgccagccacgccctcggcctcggcccggcccggcgcgcgcgcgcgtgtggctttccgactcccacctcaactggtcaacagggagcctccaataactccctatttaggttgagatactcctcgcttaaatcctaaggtggtattattatccttaacacttattatgggcctttgagattttaatagaataaatcgggcctagcccaattattctaataggaactctgggataggaccctctccggctatcctgagaaatctcgggagagcttggaggttgttcatgctaagatcatggtgcctcagatgctgcaaggagagcaaggagctactaaccttgccggacatagctgcctctccaccatccgtgttgcggaggtggagcttaaggacatggccggtgaggttgctgcacctgacacctctccaatggcggaagcagtcttctccggtacgccacgaagcgaggcggcccacggggtcgccgacgacaccttccttgaaggccagcagcgcgtccctctcgtgcggcacgcaggtcgcgccggcaatatttggccgcccatgatgatgctcatgtagtgcatcggcgacgaggaataagctgccggtgcaggctgctatgacgacgagaagcagccatgaagacttggtagctgatgaggggtattgcatagtggcgatatgggtaacgagcagtgatccaagctatctgcctatgcaactcgatcgcccgtggttatttgtgcttgagcatatatttctttcatcgatctacctttgtattaatacattataaagacaaggcctagaaatttactaggtaatactaaaagataaagaaaaaagcattagacaaatcgtttcggttggtagtgtatattctttgcaccataagccttatagataaaactaagagatttgcttcggtctagcaaaaagtacatcgagatactggtacttcacggtaccaaatcgttttcgatcgttggatatagctgagcaaaattgttattgttagatccaacgatcggaaacgatttggtaccactactagaaaaaccatttttcctagcattgtcctattattttcattggtggaaaaatgtgaaaaccgccagcaaagtcgtaatagataatcttcgctggtggtcgaattttactggcggtcacttgggtgcgccgctggtgaaaatagataatcttcgctggtggtcgaatttttcctgccggccattaaacgaaaccgccagtgaaaacccaggtcagtgatccaaaaatatcttgtcacattaaaaccacccacctacctcatcctcttctccttctctccacatcccctcctcttttttccatatctggtcacattatccactcctcactctcttcctccctcctggcctccccaccggcgacggcggcggcggctctggcggcggtgaccggcggcgatgaccagtggctccccatgccgcccctgccctcccatcccgtctcccagatctgtccgaggggaggaggccgccggcggcggcgcaacagaggtggcggcggggaggacggatctgccccgctggcggcgcgggcggcagatgtgcatgcatgcagcagcggagctgacgacgacgatgacgacgacgctgcctgacgggtggcgccactgccctccccttccgtacccacccctttcctcccctaccctcttccagatctggctggaggagaggcagccgacagatgacggcggtagcggcggctcgtccccgatggcttcagcggctagggttctcttgtgtgttttggtttgtaaggatgttaagttaatctgtgtgttgttaatctgttctgttgatgatgccaatgtgttgtatttgaattgatgccaatattatgtgtttgtgatgctctggatttggattgatgcttgaatgatgtttatatccagtttcaatagttgctaggcccctaacgagctttaatcccggttgatgataccaaccgggaataaatatctctattcccgtgtcatctccatctctcgcgcgctctctctttccttatctcctagtatagcgcgcgctcagcctactctcttatcttctttctattccacccctcccctccacactctccttcgtcgatccctatatcatttggaattccacctgttaactggttgagtgacaaggcaacgataaccatataagaaatttcagctgcaccatactttagttcttgatgcttcattacttgagaaaaaatttccatgggtacatattttcctatgacatcttggtaccaactaacctccgttaatatcatgtgacgttttggtgtcattgatgttaattttatcaaatgttgaggatgaccctgatatgttgttgcctgttaaattcaagaatcgaatgctgtcaagatttgtaatactgtttggaatatccccatagaacatgttataacttaactgcagatattgcaagttcaccaagtctccaatccatactggtaatgctccatagaacttgttccttgaaagatctaggaaagttagtaatgatatactttggaggcataacgggaattctcctgaaattctgttgttacttaagagtaggagaaataagtttggcattctaaaacagagggggaagttctccgtcaattaaattatttgactagtccaatatatacaagttttacaacttgcaaacagtaatatgattgcaggacagtattagatctttaatacatggagaaccaaatttttatggcaaattccctgacaagaagttcatggagacatccaatttccggagtcttctcggcagctctggtatctgcccagttagtttgtttgaattgagaaataatgaatccaaccaagtcagattctgtatacctactgctataggtccactaatgctgttgtttttaagattgagaaagcttatgctctttaagtgagatatctcatttggcaacattccagtcatgttgttgccttgcaaactcaagtatttcaatgggcttaaataacatcgtggcaacttctcaacaagctccgttatgttcccagatgatagccccccatcaagtaacagtgttgtcaattcacaaagattttgcaagtctactgtcattgtggctctgttaccgttatcgaaaaaatatagctcttggagggacctcattcctcctagtgcctcaggaaagggaccatcaagataggtttgagagaggtcaaggatcttaaggcttgttactttctgttggcggatggcatgaggcccttcgactaaatctgccgaaacccgtggcgaaggctatggagcaagaacggcgtgaggcgaagagtcgtacgagtgccttgccaggccagaggcgtctcaggcgaagggtgcaaggcgaagactatctgccgaaggaagacgacttcgccatagcaagttcgcccccacgagggccgaggaagcctttccggcccatcaagcctaaggcctacagggccggcgatcaccagatggcccatcaggggcccatgagcccctataacattatgtacccctgtaaatgtcccttttgtgagggtaatcatgtaaattcccctgtacaacctaaagcctagtagtaagaacctgtaatggggctataaatagtcccctagggccatgtaatggggggatccaagaagaagaattcaaaaattcaatacactttgtttccttccaaccactgttgagtaaccacgtccttcgacatatgcagttatcatttcgacaacactttccaaaaccaacctgatgcgattgatggccaaagtggttcccagagagatcaagcttctcaagttttgtctggtttatgtgtgtgaaagtctggtttgcacttgaaagtgaggaacccgaaagaataagaacctcaagggatggaattgtgttcaccacaagaggtgatcaatatatcatttactgcgcttaggtttacgctgctcatgtcaaggtacttaagttgatgtagattggttaaccatgagatatctactgagtacatatcagtatccatgaaaccgaggttaaggtgttgtagatttgaaaggttaccaagctgaggaggcactctaccaaacaatatggatgtttcagacacatcaagatatcttatgttcttcattgaaccaaagtactctgggacatggctggcttcaactggatagccaaacttgttaatagagacatcaagctccacaagttttgcgaggtttcgttgtgtcaatgactgagttttgcctggaagcgaggagcaagaaatatggagggccaccaaagatacccaagtatcacaatggtggagcgacaaggaatcagggtagtacaacctacacgaattagtgcgactactgggtaggtccgtcggtttggcacgcaaaccgaggccaagcaagttaacgtgtgattctaataaagcaagttgcaaacaaaataataatgattttctaattataggggcaattggtcaaagggtgacttgccttgctcaaggtcttcacgaagcttcacgaatcttcgagaaatccacgattgacgaaaatccggtaaccgcaactatacgcaaacaatcgaaatcctaaacaaaagagcaaaagaaagatcctatttagactaattaatagttccattggatagatctcaattttacggaattattggaagtggaacggagtcaatcggtgttacgaatcgggagacatgaattttctaaggattatttgattttctgtctaaaggaaaaggaattattaattcccttgaaaaagataatggaggagggaccggaatcagacttttaggccaagcgtgaggcgcagcccaaggaatttgcgtgcgcggtcgaggcgagtgggtcggcgcgcgggagtgacggcccacggccgagcgaggcgcggcccaaacggacaagacgcgcggcaggaagccagtggacctcggtccacgacgcggggtcccaggatggggcccacctgtcggtggccaggttcaccgaggagaggttttatgcggcgctgcgctagggttttggtgggtgcggtttgcgcgaggtgcaccgagaaggccaaatggcggtgggcccacttgcagccgcacggctcttgtggaccgcgtgcaccaaagaaaagggacggagggggcgctgaccaatcttgctgacccggttgcgaccaatgtggcgccgacgtggcacctatgtggcagctacgtggactggcgagaggagaacgaaggaggctggccggggaacggacggcgggaggcggcggagttcaccggagctcgacctcgacgagacgtcttcggccaaagggagcacactggtgtgaagagggatacgagaggaatcaatccgaaggctctaattcgccggaaggagtttgacggcggaggatttccacggtgatcgtcggcggtgagcaaaggggatacagcggaggggagacgaggattcaatccaaggcgacgaaagcatctccagggttcgagggactcgttcccgggctcggatggagcgaggggactacgagggaggctggcgaccagcggcgacctccgggagcgggcggcgacggcggccatgccgatcggtggcgccgctaggaattagctcctacgcgatcggggcgacaatgccgagctatctagcgagctaggagaggtcaagggatgggaacggagggactaccgtgtcgggaagaggcgccggaagatggccgacggcacggggcgtcggcctcaggccggggaaaaggaaggagatcgagggcgcccggagtcctcgtctcgcattcacgcatgcaccggcctccgacgcgtgcgacgggcgaagagacgaagacaagaggtgggagcggcggcaaggcgtcaacaatggcgcgacgggtgtgaggcgagcgaaaacgagagaggaaggggtttggggtggcctgggttttacactgtttcaattaagagcgaaatgcaaaagttctatcttgttagtattgcaagtttatgcagcagatgttgcagtcatggcatagaacaaataaatgtatatatgactatatgagcacagagctcttctagacttatggtaatatacactgttagcctcttgcctttagttcaggaagctcagaaaaaacaaatcaagaggataaccttatctggaacaagaaaacaatatatgctagctctgatcacggctgattattacaaattatccagtaatattgcgtgcattacagctgggttcttttttagggaaaacaacaacatcatgagcaggttcaaaggagccctgacaagaaatcctatcttactactataaagttatcctcactaactccttaagcttagcatacaaagataccatatcatcatccactaataagatgccacatcatcatccactaatccactaattaacaagatgacacatcatcatccactaacaattatcacatttaaacatcatgcaaacatgttatatctttatagtttttataataaaacagcttttcaaatacaaacatgttaaaatatgatccaacattattaaaa

SEQ ID NO: 34654 - DNA, 878 bp, Oryza sativa
  unsure (1)..(878): unsure at all n locations
ncatgcttcaagaagacanccacatgggcaagggcatcttgttaggcacaaatgncagaggaaagncgaagacacttcacaccaatagcagaaaggttgtggnaggtttgtttttngtcggttatatcgcaagcctggtaccaattctatgtttcatgcctcactatcagacggctcataacatggcagaattatccaatgctgttgttatgactaagagtatattatagttttaaactcggttcatgtcactgctgcgaaactgaagctactagccactgtatacacatcaatttgactttgcatatcactgttgtgactcgtgagagatctggctagcacgtacttatgttcagccaaattcttcaaactggatgcaattgaagcacctggtgtttataagaaactttttgtgctattagcatcaataccctcttattctttactttaaaatttattatcacaaaatattcgttggcaggcacggtgcttcctcaacttagcaaccttacaaagctgcagttccttgacccctctggctgtcatctgatgaaatccgaatcaggaatggcatggctgttcatcttctgatttctctctttatgaatagttaatctaaaagttaatttctcacattcatatatagctttagtttatgctatgtggtggaggcttaaagctcaagagatagtacagaaattgttgggcaggttcatgggtttacccaaaccccaatattatttgatatatacgcgggcaggagtgtggtctggcgagcaacaactaatgnnnnnnnnnnnnnnnnnnnnnnnnnnnnnnnnnnnnnnnnnnnnnnnnnnnnnnnnnnnnnnagactgacgatcaagcatcaaaaaatc

SEQ ID NO: 34655 - DNA, 1379 bp, Oryza sativa
  unsure (1)..(1379): unsure at all n locations
tggatgtnnnnnnnnnnnnnnnnnnnnnnnnnnnnnnnnnnnnnnnnnnnnnnnnnnnnnnnnncccactatgttttaaaaataaaaatgctgactggactgccacgcgtacgccacgtagaccaaaaccaccacgaattggatcgaggggggtaattcgtccagtttgtatagctaggggtgaagaatgtccggttttgtggttaggggggtaattcggacgaccgtgatagttcgggggggtaattcgtactttttcttttagtatataatagatagatagatagataacaacactagattgtactttagccgctaaaatatttgacattggcagtattaggattagtactcccaatgtcaattattatttactagagggagtaataggattataggacaatttaatttttctagatgaaacatatttttccaacttagagtagtaccagcaggaaacagattgatcatgttagcctcacttccacacggaattagtcccttaattatgcataaaagatgcaaaagttaataataacctgtgccttcatgccatcttctgaaagccacaggaaatcaggtatccttgcaagatgccgcttgaatgaatctgaatttggatcttccacccagcagcagaccatgttaagagcctgtgtattgttaaggacagaagaagtatgacatacccttggctgggaatcaaaactaacaatcaattataatgacatttgccacataatgcatagatcataaaggggaaatattccagccacatacatatatactccctccattctaatatataagatgtattagcttttttacatgctctctagcattatacttcaaagagtaaaatacaccagcggtccttaaacttgtcgggaggtttcacttaagtccacgaacttccaaagtgcacgtcgaggtccctaaacttggtttatggtatcatcccggtccaaaaccgcgtttgaccgtgagcttgtctacgtggcaccccacatggacgatgacatggaattttttctccctttttttctcccttgttttttggacccgccgtccgtctccacgtgccccagcctagccccccacccccgccgccgccgccaacgacgacgactaagcccgagagcctacctgtgaaaatgaaaaacaaagcccgagctcaatgnnnnnnnnnnnnnnnnnnnnnnnnnnnnnnnnnnnnnnnnnnnnnnnnnnnnnnnngcgtaatagatagacgatnctaatnnnnncacatgggggggggggggnnnnntaaataatcagaaaataggaaagacgaacctatntaatagaaatagtaatgagaattaaacatgaacgacactaaacaggggacggggggg

SEQ ID NO: 34656 - DNA, 12076 bp, Oryza sativa
  unsure (1)..(12076): unsure at all n locations
tgttactgatccntctagctgcccttatagccgaatgcaactgtacagcgaggccgtggaacctgcggcaacggacgcggcggtgcccaaccgcctccatatcatgggcggcggcggtgcccgtgccgtcctcgtaccaacgccggaagcgcgcgccgttcttggtggcgctcaccccgaaggagatcgaggaggacatttatgcgccgtggtccccctccctcccgtcagcgccactatcctccccaagtcgccgccgtccccctccctcccgtaagcgccgctgtcctccctcccgttgtgcgctcgcctccggcacggcggctcggcgagtggagcggaggctgatggagaaggagatggaggcgtggctgtggagctcacggtacagcggccgccagagagaaaaaaaaagaagggagaaaaaagaagaagagagagaaaaagaaggaaggagggagaaaaaaataaaaaatttcatgtcatcatccacgtggcgtgccacgtaggcaagaccacggtcaaacgagactttggaccgagatgatacaataaaccaagtttagagacctcgatgtgcgttttataagttcgtggacctaagtgtaacttgacaataagtttaaggaccgctgttgtattttactctactttaaatatcattgatttctttcataatatattataaaaaactacaaaattaacatcatatatatgaaagtatttttcaaatacgaagaatatagtgatattacatgcataatacttaaaaacacataattttgttagttcaatcattagtcagaattttctaatgttgttttttttggttttttttttttttgccctgaaagcaaggtcggtcgcctatatttcaaatttaccttgttgacaggacataggcagaggtactgtgagttttcatcttcgtaatggatatgctccatgagtctatccaaagctctctccctcagtttggtcatcggcctgctggctagcaccggctccacccacttgtagagcgaagtccccaccacattctgcagcagcgtgcgcgggcagaccaaatcctcctgccatcaccaatagtgtagtatacacacttcaacaggctgacacacagagagagaagaaacccaataaagcaaggcctagttacagactaagagcatccccagcagatgctctatccaatcttccatctcaaatatagcacatgggaggagaaaatcaggctccagtagatgcgccatccgagcctccaaagataacgcatgcgctattccggagaaagaatcggcagatttggagtttctctctcctaacgccatcccgtaaccgccgcatccatctggttctcccgccccaatccggatcaaggcatggaggagcgaaggtagagaatatgcgcagcgctgcacgccatgccgtcgtcgccggcgaaccgcgctccggccagatccagccgctcctgtcgctccgctgctcgcgccgcccctccgctcccgccgtcggccagccgcttgcgctgctcgcctctcctccgcgcggcggctcgcatcgccccgcagcccgcgccgccctccgcccccaccgcctttggtacccaccgccctccacccccgaccgctggcggcgcccctcgcccctccgctcgcgttgctccgccgctggagaagagaggactggagaagagagaaagaggagagctcgagaggactggagaagaaagagaaagagagaagtaagagaaaggtgaaaaaaagaaaaaataatataaatggatggtagttgaaagatactaataaaatataggataataaaatataggatgatatgatatagagaacgtaatataaatgatccgttggagtgaggaggaatataaaggaggaatcttttttggatggccatctatataggcatatggaggatcaaatttggatgagttgttaaggccttgttcagttctcaaatttttttttcccaaaaacgttacattgaatctttggacatatggagcattaaatttagataaaatgaaaaactaattacacagtttgcatggaaatcgtgaaacgaatctattgagcctaattagaccatgattagctataagtgttacagtaacccacgtgtactaatgatggattaattagtcttaataaattcgtctcgcggtttccagacgagatatgaaactagttttttcattcgtgtccgaaaacctctttcgatatctagttaaacgttcgatgtgacacccaaaaaattttctaaagtcaggttcaattcttttgaagggatcatttcattttcctcgttcgagtgtctgattacattcttcaactatagcccgagtccgatttactccctcaacttccaaaaaaaaaaaaggccaatatttatttgttaccttggagcatgcgttgcaggcttgggcccagtcaatggtgtggtaggggtccgtgtatatctcctctcgcagcgccagtatggttggcgtgatgggccccacgaacttcttgccgtacagataggccatcggcacgtacaccacgcgggtcgggccccagaatttgcctgcagataaataattatggctcgttaattttgctatcatttttaaccttatctaattttttttacaaagttaaaaaaaatggctacatttaatttgttgccaaattttaataagtacatataaaatcttaccaaaatttgacaaccttgctaaaattttgacaaccttactaaaatttagtaatgctaaaacttggtaaggttaaaaatagtagcaaagtgaacaagtctttagattcataacaaaaataacgaaatattatattaaagtttcagtcccatgttgacattaaattgttgtatatactgctgtgtttggtatagtgcttccttcaattttttaaaatatgacgttgctcacctttaatataatatttaattattcacttcttaaaaattgtgtaaatataaaaaaaataggtcatgcttagagtacctctaatgataaactaaattccaacaaagtaaataatacatatagttttcaaaaatatgaatggttaaatatcatatttaaagattaaatattatatttaaaagttgttaacgttatatatttaaaaataaatgtagtacaactgtgcaatacatgcctggatgaaacggaaggaattgtggagcaagccataactcggggaagatggggttgtttcctgaccactcatacactccaattatctgcgatgaatccaaacttaagttgatcaaaattaatttaacttcttactactacatactcagaagatgccacggtttctatatatataatgctctgaacggtttgaactggctaccgccgtgctacgcaactgtagtaaatagttgtagagctatgctggcacccaactgactttggcttacttcttttcatcaacttcctcatttttcgttaatatgctttccgaagagttaaatgatatgttttatgttaaaatttctatatagaattttctaaatcaaataaatctaaattttaaatttataatagttaatacataattaatcatgcgttaataatctgtcccgttttccaatccacgaacagctccaatcaaaatgctggatcgaactgtgccttagcatgccctgaaagttttgttaaatattaggtaccaatactgatatataataagccgtatagcgtattagctaaaaaattaataatttataggtaaaacttttatatatatgtcattagtgatgtaaaagtatatctaaaaataaaaattaataaaaaaacttcaaaatcaatttcaaaatctagttttaaaatttgaattttaacggcggctaattttatataggcaaacgataagaaccttaattggttggcaagatgtactgataattaatctaacatacataccgacagacatatctttccccattgcggaacaagggtggcgccaccatgtgatatgatccaggcgtgtcctctagctaattgctcattgcttggctcctcgccgataagtctcagggtgacatagtttaagcatgtggcaaacatcgtgcttgatcccaagattagcatgccccatcccccgtcctcgttctgcacatgtaaatataaaaaatgcaatgtttctgtacaacaatatttaattattactccttccaattataaatatttaatattaataagatctggtcgaactgactacaataatttctcaaatacttagtttaaaaaaaattatatgagtagattgacctagaaaattataccacaatatcataaatttattatattttataaactcattttaacataaaactggtagtcaaattaagtttcaaaagtttttgatcgaaacttgtcctatgcgtcaaacatttatgcctagaggggtacatcaaaactatatgtgcatattgttttgtttgagcaaattattcgtgagttgatcaattagcactttctgcatgtgtagaattaagtaaattaagtataactgtcgttccaaactatagcaatatctggatggagggagctagaactatcttttctaataaaaatctattaaagccatgaaggcatgcgcatgggtatatttctgagtccgcctatatatatatagcatttttttttaagatgatggacctatatatataaataaataaaaacctgatggttatagatgtagcgacatatctccctccggtgttctgatgatatgacagtgtccagtgatccagtggcatacaaagaaaatatctgcatacagaaactaggtcactagaaattaatctcgaaataattgaacatgaatattaatattaattagccaaaaaaatcaaattaataccaagacaggcatgatgaatatagcaccactgaggtcgccaggccagtggccatcatctgcttgcagagaggagaactcatcgagagctcgcctcaaggaagccatcacagtttcttcagtcacctgctccttctcgccaagcttattgacggccggtggaatacgatcaccacggcgttggtgattgttttctcttgcaaactgcaacaagatcatatctcagatggtcaaactaacatcgaatcgatcaaatgaagctagctaacagtgatcctgtttcaaattacataaatttcagttcaaattaacactattaactatatactccctccgggctgataatacttatcgttttaaaacagagtgagatcaaactttaaaatatttgattataaatcatttttaaaatatttattttccaagtacggtgaaaagtactttaataaaatcataaaatcatatatttgttaacacttttatacatattataatgcgaattatttggtcaaaattgttttctgtagatgaccgtgtccttctccaaagcgacaattattatcaagccggaggagcacacaacacatacctgcatgcgcatgaggagatcggcggactccgggcggcgaaggcggtggtcggtgaagtcgcggcgcaccctctcgacgttggctcggtcctccggcgtgccgtggtcggggtcgaactcccacaccgctcgcccggcgaagccgttcgtcgaccgcaacaaagcgccgccgccctgggccaccttcagcctccacatgatgttcgcgatcgagcaccagctaagctagagccaaccaacgtaccggacaaggagacaatgcaaagacgacgaccagctatatccagtatatatactggctgcctttttattagagctactgtggggggcttaactacagtatttattacaataccaaactgtgccactcttcaaataacacttttggatttgttgttacatatttagcagacgggagagataagactatttcttaaatttttttctgccactttaactaacgtggcacaacacgttgacatgtcagcgtggtgtacactaatatctctatctctagcagttggactatcggtattaattactagcaaatacttcgtactactatatattgaggtggttgtgtccaacggtcccagacatgtagtcctagtgattgtgaatttcagacgtgacactaataaaaagacacaatatatctagtgattggactaccggtattaattatagcaagtattgaggtggttgtgtccaacggtcccggatatgtattagagcaccccaacagttcatccaaatttgatcatccatatgcacaaatagatggccgtttaaaaggattactccttcgtatccattttcacttattaaacagatcatccatatcacacccttctatatttcagtaatatctttcaactaaccatacatttatattattttgtaaggactatattttgaacgactaaatttttaatggtgttatttattgcgttaatatttcaaaataagtaaattttaacagatatatttttaattagtagttttttaattgatatatttgcaatgaatgaaatatttttatttcaatttgatgtgttcaacagctagctttccaacggctagctcattaaaattgtgtccaacgaccatgcaacatgtaaaatttcagccctacatataccgctacattgcttgctgtctttttctccattcacattgttgtgaatccttcttccatcaatcaatgagcttcattttaattttaagacatcttctgttggatgagtcatcgtcatctgacgatgaactcatcgctgcagcagcaatagttacacaagatgaatatgagcattcgaatgctccacgacatggttatgctgttcctggaagtcaggttgttcgtcgtgatcgtcgagcggcccatatgataggctgcaccccaactacatctcggagcatcctacgtacaacccagtcttattccaatgaaggtatgcaattaatcaacatattttggttggtcccgttttgtgtgccacttctcttaattcacataatcttaaaaccaatattctttaagaaagctagacgctaactcaattaaatgattacataatcttgaaccgttattctactttaaggtctattaagaatttgctcataatacccatagaacttgtgaacttactcttgaatggtaccccaatgattgttaattgaattatggttacgatctgaaagataattactaaatttataatagatgaagtacttttcacaacaaatctacatgtactgtcttcataaattcagtctaggcatcataaaaatactgatgctaaactttgaaaaaaaaatggccacacatgtgctgccgtgctctgaaagatacttgtgggtcgagttagtgaaactctaataaaacagcaaaacaaagaaacaacacatgtatgcttgatcacttatttctataaacagaagaatataccgtggatatcattttgtcgaagtccaaaactaacaacttgatccgactaaaattaatgtatcaatccctggatcagtagatgttgatacatacaatataactagttcttcattgcatacgttaaagttttataatactaagggttttacaataataggtactcacctatttgattaactagaattaatatacagcggaagtttttatacattctgactagggaggtaaaacctttagggattctctaaattatcgtggtcatcgtagtaatagtcataggggtcctcctcttgacccaaatcttaaaaggggttatgagagcaagaatgagtattcacaatactcagcaagttatcatggaaatatgttatgcattagcatatagcagggttctttgcaaaaagcaataataaatattctggaagagttatagcaagaatttataatcatatagattttagatttctaaccagggtaccatatgagtcctggtactcaactccatgagtacggctattcgaatagtttcaaagatattctactgcagcagatgtacgctttacctgcagtccacgacttgctgataatcatcggctttagtcaaggcccagtattaagttattaacaattgtggcacctgttccatgaacttgtatcctcatatgccctgaacgtaatgttaatagcagcaagaggagttgtggcgttcccgaggtatttaaggggaaactgatcgtatgacaccacgtcatctcgatcagggtttagaattataccatatagtttatactcgagtatcacaaaccatttacctgtacatggtaatggttaaaagttgcccttcgcggctatagttgcctcctgcgcgaggacttaaaaataagaaccactatacagaggtgccatattgctaattaacataataactaggtctgtccccattctagaaactgcggtcgtacccgttcgttcgacataagtacctagtaaaacttatatcgatcgagacagtactagccacccggaaatcaaccaaatcttacgtactgtcccaacctaagtataaggtattttaaccagattgtaagcaaaataagcaatactaaattatctgggtttctatgattgaattatgcatataaaatagaatattgaatagaaggctataaataaataatttataaaatataggcttaaatgatcaaaaggtatatagtaacttgccttgctcgatgtcttgagattgattaatattatttagtgagtcagaagaatcctcaagacctagggttaaacatataaaattcaaattcaaaaggaattcaaataaaatccaaaaatggagaaaataaaataaaatacaaaaatagcaaaaaggggctcaatagatagagaatgattttagaagaatattggtccaagtttcactggaattggatctatattttgaaaatcaaataaaagtgaaatggcactgtgtgtgggtcccacctgtcagtctctctctctctcttctcttcttcaacctccggccgttccccaaaatcggtcggcggcgttagggtttgggattgcagtggcgctagagggagctagggatctctggcgatggcgagcggcggcggaggagctaatttgatgcgtggacggcctagcggctagggcggcggtggcacagttaggccgtgatggtgatcgaggtgacgagagttagacatggttaggggagggattctagagcatctatgaggtgcctagatggattccaacagcttgccgacctttggcaaggcgcggagaatacttgccgacaagcgcctccattggcggcggccgtgctcacgtcggaagcccagagggtggcatgatagtgcaaaccgattgcaaaaatagactctaggtagtatgtagatggttgaaacggaagaactcaccgagatcggttgaaacggcggattgcggccggaaaaacttcgcggcggcaaagaacagagcaacgcgggggcggcggtgctcggcttggtgcggcgaggtaaaactcgacgcagggcttcgattagggctcactatgctagaacatggttgatataaggtgttctaaggggtatttagggcggagaatgggtggagaggtgtggagtcgatcgcgcacaaagtgttcgaccgacgggcgatggtggttgatgggattgattggcgaaacagagcttcggagttgtggggttatggttgttgatgatcgatgatggacaaggaagggattggggtcctatttatagggctaggaggagcggatgagctcggacaccgtcatcgccatggatgagctcaaactttggatacggctggggcggtagaggctgtgagagggtgggcaagatcaatttgagtggcgggaggccacgttcgaatacttaccggcgaaggattggcttgaccgcggttgaaattggctggcgacgtgttggcgccaatccaagcgcgacgcgcggcggcggcgagggtgaaaatggctggctcaggggtgaatggtttgaattgtgagaggggaaaccaccgtctatcttcaattcaaccgtgcggcaaaaattggcgcgattcaccccggatagaaacaaaatcgcactcggcggcggcttggatgggagcgcacggcgtcgagtgtcgattccttgcggcggaggtcgtcccggctttgtcgtcgtcaagattggtgtggcaacggcgacttgaaggcgttggacgggtgacggcgcgccaagacgatcgggcacgcgcaagcggccccgagtctgacgcgcggcggctcggcgcgcggcgaagtcggacgccagggcggcgcgcgcaaggggaggagaaggtcaactaaaccacggtttttgagtgggatgtggtccccaaggatccaacatagactttgcacaagattgggtggtaattgggctgctctagctgggctgggcattttgtcgagcaccttcagtgcaatgaacagtgttttcaggaatttttgaatattttcctagaaaagaatgaatttaatctatgaatttggaagagtttcactagggtttgaagtatagcaaatcctcactaatattggagtaaactaagaaaatattctatagtttgagatttgagagaatttgttcaaattcactaaagtttggaataaagggaataattatggtaaattagtagggctctaaggaagtaatacttgaaccaattaaaaaatcaaataaatttttaaaacacactaaattaatcaaaagccagcatgctgcagtcaaattttaatttaaaatttgaggatgttacacatttctagatctctgagcttttttttttcatcgctaatggctaccggctgtgacgtataaaagctcaaaataagttttagaaacaccagcagttctgtatacgcaggttttcctaatgattcaaatgcatgttttttcctattagaagtctgttgacgtgataaacaacataaaggcggaaatatgcttagcttagtgcatgtcttaaattttgatgaagtgcgtgtgtgccagtcagtctgatactgtaactgacaagatatcgatgtagcagcgattaaccgataggttaaccaatcggctgttggagaattggagacccggacgttgatgacgattgcaggctcgagtctcaagtgtgccaaaagcatgtaccagccgatagacgatagccgatggcttggtgtagaatcagctgaaggatctgatgctggtacttagcgccgaacggctttgtgaagaccaaccgatattgatggggcgcctctgaacgaacgatcggcagcaagggtcgtgccgtacgacgagcgtggcggcaggtcggaaagatctgcgttgtcgagctgctcagggcacgccgcgtcagggagaaggaggggcgcgctcgccactgtcgcttcatccagggatgcggtacgtcaatttctttcaccgagcggatcgcagcagtcgtctctatctgcatggtacgcacgcatcatgattggggagaggttcgagagccgtgacgagttcttggaggagctagctctccgagaaggtgaagctcctcggtgtgttcagcctcgactgttagacttgaagtaatccagtgccggtgtctcaaagttatcctaggaagctatctgtagcgtttcatttcttttctcgcacaccgtttattctcttttgtcgagtctgtcgtgcacactcgcctgcgcgcgatgtgggcgtcgtgttccagtgatctagcgagtctgtagaagtagtgtactagtgtgcgtgcctaaacttcgacgtgggggatggcacacgtcacaaggagtggtggcacgcactgcagagtccctttcgtatatgttataaaagttagtcgatatagcgaaacgacgactaaccttctcgatcgcttcagtcattgatcacccaagacatgccagatgacgacacaggaatacacgatatttgttaacgaggttcagccgaagcctatatcctcgaggctctgattatgggcgctcctccccaaccaatatagnnnnnnnnnnnnnnnnnnnnnnnnnnnnnnnnnnnnnnnnnnnnnnnnnnnnnnnnnnnnnnnnnnnnnnnnaacaatcaaangacacac

SEQ ID NO: 34657 - DNA, 2609 bp, Oryza sativa
tcaacttcgcttgtagactttcagtatccagtgcggtgtctcaagttatcttagcaagctatctgtagcgtttcaattctttttttcgcacaccgtttattctctttttgtcgagtctgtcgtgcacactcgcatgcgcgcaatgtgggcgtcgtgttccagtgatctagcgagtctgtacaagtagtgtactagtgtgcgtgcataaacttcgacgtgggggatggcacacgtcacaagaagtggtggcacgcactgcagagtccctttcgtatatgttataaaagttagtcgatataggaaacgacgactaacttgtcgatcgcttcagtcattgatcacccaagacatgccagatgacgacacaggaatacacgatatttgttatcgaggttcagccgaagcctatatcctcgaggctctgattatgggcgctcctccccaaccaatatagctcctagccgctacgagtccatggcctcgctaccatcctctccctgcgtgtctacgctacattgtagtcaccatggttacattgtggtgcccccctctctatttaagagagttgccgggttacagagttcgactctaactccaccccctaacacctattacaactctaagtccaaccgtaaccaaataggactagtatattcgacacctattctaacaaactccaccttggcgaatatacaccacctagaagtagtagaatcaccatgtcgatccacctgtcctccagacttgggttatcttctttgcagctttaccgcaagctgccgggcgagtctgcgccagacccgccgccttcaagatactctgctatccctgtaatttcttcctcttagactccacctgcaacagtgctccaccttctcacctatcatctcagtcgtcttgccaagtgaaattggattcttccttagctgtcacatcataaactcctcgaagaccatgttcaactccatcttccgtctttgatttgattcgatctaatccatggccagataacccacgtcatcaccaaataaataaatcaaactcaccagacttgaagagaaccctttcttccttgtcgacttatgaaccgagctaataaatccaacatccacgcttttccgcatccgtagactgagctccatgataaattgagaaaatttaccgtttccttgaatcacttgaagaattaccacgatagccttcgctcttcctcttcagtgacgcagatttccatatatccccatcatgccgacctgcatatcctggatatatcctgtactgccaaacagtattgtcgaccccatcaacgatatttgacccgctgttgcccgggacttttcttcagttctggcttaactccatatatctcaactcctcgtcgaatcctagatatatcttgtttccgccagatatttttatatgcgacctgaccagcctgtcgccaccagtctactcgtccttcacacttgcaaactatccatctgtagaaccttcttgtccttcttttggatctgttaacaagttcctgtaacgaaccacacgtccgttgaacccggtctaaccgtccaaactctgcagtctaactggtccgtcgatctgatcaccctgctggcccgacttaaccgatttacacgcacctctcttgcacgcttcaaccaagccttctgtctcgatgaccaacactatgattttagcctgcatgccaacgttgagtgcccttgcggtcgtgcgctgtctcgtttcctttgatccttcgacgtccaaagtccgaattgaatatatatgcagccgacttctccctcatcacctcggatcgtgtactacgatgaagagtctgttacaaactccctctccaaacagcacccaactcaagtgtggagattatgcataccccatacctacacggcatgtatagtccgactgggtatggggtgccatgtatggatagaatatctttaagaggactcgggttaagtaccaaacttgtatgtcaaggaaacacccaggatcctagtcggttacgattgtattttatctgtaattacctattccgttagggatatggtctgtactttgtaatacggacctcttcccctatataaggaggggttcgggtgcctttagggacacgatttttctcccagatcatacgatcaataatacactcggcggatcaatccccagacaggagtagggtattacttcttggttaagaaggcctgaacctgtataaaattccttgtctctgaacccatccacttttccagcttgatagccatccccttttagtattgccgaaatcttgtttcgatagttggcgcaccaggtaggggtagcatcaagttcttcgccgactagtgcgatcggttcagtctccggcatcgacgacttcgtattccctcccaggcaggcgttccggtttggcagcctcgacttcggcaagatttctctcctcgaactggaatcgaaccaagcggggaagaagccagatactcggttcgtttggtattccgaacttcggccgaggttaacccaaaaacatttctaacgagttgggtttaaaccacattggacgagattcaattttattcaacacgaacagaacaagg

SEQ ID NO: 34658 - DNA, 1240 bp, Oryza sativa
  unsure (1)..(1240): unsure at all n locations
cgcatagtaagataacatgacaatcggcgnnncagcncngaccctatatggccgacaatgagacggcaaaacagcgccaagcccgagaagcggaagaagagcgcacacgaaaagaagctgaacgtcgccgactgaaggaagaacaacaacgacaagagtgagaacgactgcagcgtgaacaacaagatcgcgaacgggctgcaaaggaggttgaggatcgacgacagcgcgccttggaatctgggcgacgagcacgagacctcattgggcaacaagacgtcgacgggacgactgtttttcgcaccctccccaacagaacgcggttgcagcgatcaccctcctcgacagcctcctcaaggaagacgcgctcaatcagcacgtcatcaaaatcttgaaccaaacgaagaccatgatcgccgcctcggtcccggctaactccgcaagcacccgcacgccgactggcagccgagttccccctcttcgatctcaagactatcaccaaccaagcctcagcatcgccgacgcgggatccagtcgcaggagcaggggtcacggtgagcgatctgtccattcgcctcccgaacgacacagggagcgtcgagttgaacgacctcgctccccacatcgcaggcgccccgtcgatctttgcgatactatcaaccagcgccgcgcggcaagaggctatgctccccaccattcaccagaccgctacgacgatgacgtggacggagtagctgccttcacaagtgacctgcgtcgagtggattggccggctggcttcaagccgactggaatcgagaaatatgatggcagcactaaccctgagtcttggctcaccgtctacgatctcgccatccgcacagtaggaggaaacagcaaggccatggtaaactatctgcccgtggccctagcggattctgcctggtcctggcttcacaggtaccccgtggcacaatcggatcatgggcggaactacgcgaacacttcatcaccaactttcaaggcacctttgaacgtcttggcacccagtttgaactctacaacgttatcaagaagcccggagaatccctccgagattacatccgacgcttttctgagcaacgcaacaaaatctccgacatcaccgacgacgtcatcatccccgcgttcaccaagggcatttgccacgaagacctagtcggcaagttcgggcgcaagcctcccaggatggtcaagcagatattcgaaaaagccaatgagt

SEQ ID NO: 34659 - DNA, 1148 bp, Oryza sativa
  unsure (1)..(1148): unsure at all n locations
cggcnaatgaatcgccnnnnnnnnnnnnnnnnnnnnnnnnnnnnnnnnnnnnnnnnnnnnnnnnnnnnnnnnnnnnnnnnnntactagaagggtatagggactcaaactggatatctgatgctgataagataaaagccacaagtggatatgtgttcgcacttggaggtggcactggttcctggaagccttgcaagcagaccatcttaacgagggcaacaatggaaggagaacttacagcactagatactgcgacagttgaagccgagtggcttcgtgaactcctgatggatttgccggtggttggaaaaccaatgccagctatcctaatgaactgtgacaatcaaacaatgattattaaagtgaacagttcaaaagacaacatgaagtcatctatgcatatcaagagaagactgaaatctgtcagaaagcagaaaaactccggagtgatagcattggactatgtccaaacggctagaaatctggcagatcagtttaccaaggggctaccacgtaatgtgatagacagtgcatcgatggaaaagggcttgatacccacctaaggctgcacaataggggaaacctgtccattgagatcggagagcccgtgaatttggacggcgaaacaaactattgggtgcctgagagaagagacccttgaaaaaggctcattttcatgatgaacttggattccttcgtgaaaggtgggatggctcaaaaccattaacgtgaaccgggcggcttctccaaagcacagatgtagaggtgtagaaacatctaagaaggaaacatacctatatgaacggacctgctaatgacaatctatgaggttagggccatctctaaatacttatgaaaggcctggggtttgacctatatgcctcaaacagagggagtagcaaacggcagttccacaaccacttaagggtttgagggaacactgagcacacaacacttgaaatgtaatgcataacaccatcgttcactaggagtccggatgagcttcactccaaagggcgaagttaaaagttaacaggcattgactcaaaacacctggtttataaaaacaggcacaaagctttgagaaccatttattactgaagccccacaaatctcgcggcggaattgctaacaaaaagacggaccctgc

SEQ ID NO: 34660 - DNA, 1295 bp, Oryza sativa
  unsure (1)..(1295): unsure at all n locations
tggttgaacgtcaactttgctagggcaccttaacttgggggaaatcgatctcagtacagtggtcaattggccccaagtggtgaacatgattcctttttagggtccttggtctaggtggttgctcactcactagtgccaaccaatccttcccacaccttaaccttacgaatcttgaggaggcttgacctctcctacaactacttgaactcaatcgagtcttgttgattttggaacctagcgagcctcaagaaactcaaccttgatgctattggcttgcatggcatatttccaaatgtgctcggagacatggtttcactccaggttctagtattatcatcaaatgaaatgaccatgaaaacaacaaatctgaccaccctgtgcaacttgagggtcctacaactcaaagagtcatattcatacggtaacatatctgagctaattgaaagtttgccgctgtgcgcgtttggcaaattgcaggaactgtatttgcaagggaatcatttcacaggaaccctaccaaattggttggggcagttgactagtttggtcatccttgacttgtccatgaacaacattactggacctctgccaggtatttttgggaaatttactgatttaagggaccttaatcttgctggcaatcaactgacagggcatctgccatcccagatcagtatgctcagtaacttgaccaggttggatctaagcaacaatatcttggatggcctcatcacagatgaacactttgttggtctaaagggcttagagtatatagacttgtctcacaatagattgaagattgtgctgggctcacctccctttaggttgaagaagcacattttacaaactgccagatgggtcctatgtttcctgcatggcttcagtggcaggtggatctttcttaccttgatattacaagcacaggtatagttgacaagcttccagattggttctccaactccctttcaaaggtcatatatttggacatttccaacaatcagatcagtgggggattgccaacaaactgggagatcatgtcagtggaacagctctatctgagttcaaaccaatttaccggcgaaataccctcattgccaagaaacattatcaccttggacatctcaagcaactctttaacaggtaatctgccatcaaatttgtctgaaactccaatgctagatacgttgatgggtaccgagcagatgtcaaacaaannncaccatggggggggggnnggtgttatgacgcccggatttaatctgcacattgtantataccaaaaccagtttatttat

SEQ ID NO: 34661 - DNA, 1447 bp, Oryza sativa
aaaaaaactaatgttaattaatcacgtgctaatgtactgctccgttcccgttttacgtgcgcaaaaaatatgttcccaccaaggtggaacgaacacatcctaaatcatagggaaaatggaatgaagtctagtggaatatcgaggattttagatatgggtaaccaacttacataatttttttaaataccccaaatataacaagccgatattccatagaaatataaaactgatcaaacgcgcatcatgatatattaataatgtttttcccccgtttcccaagagtttttttccttttttacatacatgggcttttggggtatgtatttctttccgtttcatgttataagacgctttgatttttttctagtcaaacattttaagtttataaaagattcagcaacattttcgacacaaaagagtgttataagatgctttgacttttttctagtcaaacattttaagtttataaaaagatgtatcaacatttcaacacaaaagagacatactatcaaaatatattcaatgaaactaatttggtgctgtggatatttctaaattttctataaacttggttaaactaaaagatttgttactatggaaaaatgtcttatcgaagggagtactttgcaaaattatgagaagactggtcatctcccggagctaattcttttatattttagccctttaaaaaatttattttacaaataaatctctggaaaaacttaacaaacgacactagcatcgaggacccatatgtaactagaattctaaaaagggttaaaatgtaaatgttttataaaaataagcccccaacactagaggggagccctaatgggcgattgatcgcccgctaatgggggtcttgatacgagccgatccgagccacgaatttccagctttttgtccacccttaggcggctcctcacggggtcggcgcatgttacggcggcaggaggcggcgacaccctacgcggtttctgaggcaggaggctgtgtttcttgcggggccggtggctcagagcttctgcatgaggaccaagaggtggctgttcatctgtagaagggcagctagagagggcccaatgaaggagagaaatcgatctgattcctttgaccgctcggcttgactggttttttcaaccaaaaataaaaccgaaccggtttttttggagaaaaaaggggttggttattgtccggctggtgactgtgcaagtttagtcagggggtcaattaaatcagggtagatcaatttaatcagggcgacagctgatcaagttgattatcgttgatggcagcgacggcggtttccaaatttgaggtggtgaagtttccatggcactaggaattttcatctctcgcacatgatgctaaaggatctgttggctcacacagggatatccaatgctcttgatgaacaatgccggaaaagaaggatcatgacaagtgg

SEQ ID NO: 34662 - DNA, 735 bp, Oryza sativa
  unsure (1)..(735): unsure at all n locations
ctgcgccaaagtaagacantcgntcgnacccnncaatactngatttaaatttgaattcaaatttaaatatattttatataaaatatttatatacacatagtttatatgaacaaagttagcaatgtatatatgtgtgtgtgtgtgtatatatatatatatatatatatatatatatatatatatatatatatatatatatatatatatatatatataaagtctatgtacatgaatagtttttagtgtaatatattttttatttttttcacacttatttttaaattgattttaaatttacgaagaacccacgactaattgcgtaacgcagcgttgcttttttttacacgaagaaacagcgtgcgggcgtgatttctgatcgctggcctccggcgccagcgatcggtcgcgcagcagccacccctgtagcggagcccactggatgtgtttaaaattttcacgggggaagggagggaggtacccccccccctcatctgttctacaatcacactcccccatcctcatcgataaagagcccttccaagcattccctccgctctcaaacctattagaacgccctctatagggcacgtataccctcacctaactcctgaatccattctgacctatacgtattcttacttataaacatcctactgcccaggataacagctattacgctttatgagctatctgttttccccactccacccgaatcacattcaaattcctcacaac

SEQ ID NO: 34663 - DNA, 4229 bp, Oryza sativa
  unsure (1)..(4229): unsure at all n locations
cgtggactagaatcactggtaccagatcacgcgtgggcgtgattcactttatgtcaacaggcagcgccgaaagttgatagtgacaactcgagctgccgcttttcatgtgtgctgttgtggactgtgcgcgctactggatctgacactaccgtgaagcgccgaaagtgtgttgtcgtgagcataatttgttctagcaccatatgaatgaaaagaactatggtgacgaagacaaacacaagtagtactgcagtagtaatagcaaaagtagtactgctttacaagtttgtaagccaaaagaaacggtcacataaggactgaagaggtagaacactactgacgaggccttttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtaccgaagatcccggctgcaaatcctgctggacaaggaccatcagtttcatacaggtatttaatagtattaataaaaagtaaagtaccgtgtgggcgagggatcgacgctccgtgagaggaagagctggcgaacgcgcccgaagaggtggcgaacgccactgcggagctcgcgaaagcgccggtcgtgcctgcgaacgcgctcgaaggcagacgaggtcctgcgatgaggaaacgtgcagttaaaacatggtgacatattcgtgcaaaagctgaaccaaaaatgaactaatctttgggctgaactgtaccgtgcgaaaccggtgctgtaggtcgcactgctccgaagctaggggcgctcgaaggcaaacgaggtcctgcgaggatggaacatcaagttacgacggggtgatgttttcgtacaaaaacagaaacaaaacttaagaaacctttgggctgagcagtaccgtgcaaaacaggtgccgtaggtcgaggtcctgctccgacggtaggcgcgcgaggccgtggttgtaccggaccagctggaggtacgacgtccacggcgctgtgacaggagaagacgcgcatgaccgcatgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtaattgtcctatattatgcaagataaatgaaataattgtaagaactaatacaaattcgacgtacccccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaacctcgtctcacctggacgtgagcgtaacgacgctgcaataaacatgatcggaattagacatgttatgtgaagaaaaaaaagaagacgactgataaacttgtaacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagcccgaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaatgttagtacaaaacactctgttgatcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatccaccttccacccaaaaacaccgtccacgggaccaactggtgctcccgccagcggtagcccgagcaggtacgacacgtcctgtagtgtcggagccatctccccacagggaaggtggaacgtgtgcgtctcaggtctccagcggtctaccagagcggcaaggagtgaccggtctgcattccaccacttcgctgggtcacggtcgtccgccgccgcctcaacaagcctacaaagtggtagaaggcctgccgcacgtaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttgaacagcgccggtgtgtcgtacgccatacctgcatcaaatagattgatcagaaacatataaataattagttcaacataagtaataaatgttcataagcgaattattaacacatattaaacaagagtacaaacaaacaaaagtgtcaccatacggaatatttctgattacaacaataactgcagttacacgatatgagtacttagtccgaacactcatcacgataacattatgatacaacaccgaatagttcgcaatactactagtacaacaatagtcggaggtactcattacaacaacattcaattgaaattacacgatagaagtatttagtccgaacactcatcacatcacaacagcattttatttcctaaatcgatagcattgttacaccatggaatcgcctgctgcgcgacaacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagaccacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacgacttgcttgtgatagataccacgcctgctcctatcaacacacattatttcatacctatgcacttgagtgccttgagcaacaactatatgagtgcgcggccttttgattatatctacatggaccttggaacn

SEQ ID NO: 34664 - DNA, 2387 bp, Oryza sativa
  unsure (1)..(2387): unsure at all n locations
agaggaatnnattgattagacttctcggtcccattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctaatataacaagtccagagaagtcctcatttgcccaatcagtggccattacatcaccttcctcatcggatgatgcgtcgtcgtccgcttcctcattatcagaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctaaaatgtgaccttatttgacattgtgcctgatgaaaacaataactgcgttaacctcgcatttctgtactacgccctaagttacattctctacaatattgttctccaaaattctaaaagtaggttatattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctcccctctctctctttcgttttttttggatttttactgaatataatgaaatttcagagagagagggctgggctttataggggggaggcaaaaatcgccctcccccagggcggcaagggggccgcctgcaaaattccaggccccccgccgcccatttgcaggcggccccccgcacagtacaaaatcgccctagcggaaggcggcaagggggccgcctgcaaatttcgttgacggccgtcgcccgagagcgaacggccgtctgccacgtcactttcgccgccctctgggatggcgatttttaaaaatagccctcccagagggcggtaggcgaccacttctgtcaatttaaaatgaaaaattacttttgtaaaacttttaataaaaaaaattaaaaataaaaaaaattccgcattcgcgcgaccagtagctatccgtatgactgacactttttttttttttaaattacactgtacaacacatacactcagaacgcacgcgcactcacccctatgaacacacgcacgcaaaccctacccctataaacatcttcgaagactgagccagcaaatcctggagagattgacgaagtcaccataggcgcctcgctgtcgacggatacgtggcctaccactgaaagcacaacgccgaaaaatcctggaaaattcgctcccatggggagtcgaacctaggacctcaggtgctactgaggcttttgtatgactgatattttttttctcgggatataaattgtttcaattttgcacagttg

SEQ ID NO: 34665 - DNA, 10282 bp, Oryza sativa
  unsure (1)..(10282): unsure at all n locations
ctgtcgtttgacnccnaatggaatctcaagtctnnnnnnnnnnnnnnnnnnnnnnnnnnnnnnnnnnnnnnnnnnnnnnnnnnnnnnnnnnnnnnaacagttagataggctaccccaagtattatactggtgtgattatggtgaataagagcaataccggcttcggccaataggatgtagggttattatctgacaattcaggggcccgaacctgtataaaaatccttgtctctgtctcttttacctcagtctcgcgtataccctagtaccaacgatccccataccatgcaaataccggaatcgcgacatcaaacgtcgatagatccatttgataagctcttggcctgaaggaacataaaatttaatagctcgtcggacaacaaactaagattgaaacctacaaaaattaagaacacattggagcttctcatttcatatgttttttttctactgcacctccagtttactatattgacaacatactccttctgtctctcttgtgtagcaatgtgtctactgggctagactgtaccgagtcaaactgtattgctcattccctgccaatggcaatataataaagtttcggttgtcaagaaaaagatgctaaactggaatatgaaaaaataaactactgtatatatatacaacgttacttctttgctgtcattatgtaacagacagttgtattttggctgcagcaacggcattagttggtttgcagaaccaaatggaagttacccattagctaacctgccctaggtatgaacaataaacactacaaaaactctctaggattcttttgatttaacggcagagtgcaggacaccactcagaggccaaccacaaactcttacaaaagtccgaagtagaggataattaagtctatgaatagtttccaattctctgttcactgtatgctcaatattgtttttattgcctgatcaattcttctgaagcggagttccacaaagattgatatttccgtcaaacatcgatgttttgtgtgcgtttcagttatgctagccttcaatcagtaaaccaaaaaaaaaaaaggacttgattcaatgacttactcaccagctataaatttctggatttgttgattattcccatcaaatttactaacgcaaactttactattaagaagtatgcatctggatgagaaacaatgtaaatatatgtactaatacgaaggattaggattcattgtaagcctgatctacaaaagagatatttaggtgcatggcttaaaagttcctcaaaattatatgatggtataatttgaaaaggtttcagagcatgcaaatcttcaggaccttaaatttataattagaatttttttatgtttatttaattcataaactaggaaggtggcccgcgcacatgcgcgggcactttactaaattagtattggttaaatttgtattatgaatccttattatgtggaagtgactattttaaaaggtaatagtctgaattacacccttaaactataatgaaagtgcggatgcgaattgttccggttatatctaaactcgtctatcaccatcattcgctaacatatgagttaatatattttttgttttgttttttcacctatgcatgttcatgggtaatatacgatggaataatctataatgttaataattagcatatcattatatagatgggaatgatataattaaaaagatataatgtggttacatgcgacattttcgatgctatatatctatgtttttcctggcaaatattaagtacatatttttttcctctttttttgacaaatattttttctctcagtgtaggtgtgcgtatgcctatttttatgatgggtgtccgcatgtttatatatgcgctcgagattgcctttaacattaatagtaaaaaaaatgctttcaagaaaattggcgagatggcgtgtagcggtgctgtgcagcgtggcttcttcaacagccttgccaggagtggtcgctactcatatacacaatttgtggaaaatctcagagctgcaaagaaagaaagagaaaactacttgatggggctgatcgtatacacactttctttttttcctttataacatctgttgtgtacgtacatagtgagggattacttgaatagatataatataatgattgaaaataatatatccactggtttatgtgtaaataaacagttatattttgcttttcttaatatattttttcttatatgatcactaatttattagagcgtcatgcggcatcttggaagtgcaggaatgcttttagtcatagtcgtaatggattacttgaacatatctaatctaatggttaaaaataatttatccaccagtttaagtgtaaatcaatggctagatgttttactttttcttataacttttgttagatttaccctaatttattagagcgtcacgtggcatcctaggaatgtatgtaggtgtgtgggaacactattacccaataccaatatatttgtagtcaactattatttgttgtggcttggtggtatcaatacttacatatcatttgttgatggtttctcacttagtattgtccattatcagtacttgataacacactgcatattagatgtcatctaattattaggtgcattaagcacggatgcctcataagtaattaatatgacttgataattggtggatagtgatttgtatatgaaacttatacacataggaattagtagggatatatgattgatatatttggttctattcctaattgataaaatatattatatactatatattttatagtaaatttaaggttgagttctaaaatcttattggattggctagtccctttatggtgagatgtttcctggaacgatgcatgttttcaaatactttctatgcaaagttttttaaaaagatcaaataaatccatattcaagtatgtaatatttaatacttaattaatcttaagctgacgacattcttttttttcgcatgtcttagataagctcatctaatgaggtagaccgaatgaagcctaagagataaaaaatacatccacatggtgtcaaaaaatatatgatcgttaattttccaaaaatatatgaataaaggaacatataatatatgaaaatatattcatgataatttaataatgtcatttgggtatattatacagtagggagtgagtaaatttttagaacgctgctcataatttaaattctttttattttttgaaaatataagtccaatttaactatgttcttaagagatatacaataatataatctacaattttaatttattaatatttttaatggatgttttgatgagatgcgctatttagaataaaacttgaaatagcatatatttttacaactttaatttaacatggactttttagtttttcatctaacctaagaatataagaagaagaaaaaagaaaaagacttacacgggatacgcgtacgtatacaggtccatggggacaccgttgggtaacgtgggaatttttttttatagattgaattgggttttttttaacaaagatctaatggtttaaaatattgggtccaccagattaaatgaaaaatcgatggccagatgttttgcttttttcttagaatttctaggatttattaaaacgccacgtggcaatctaggagcgtttataggaacgccacatggcgatctaggagcgtttgtaggaagtttaatggacttttagtatataatagaagatagatagatagatagaagatagatagatagatagatagaagatagatagatagatgtcaattcaggtaaagaccaagatgcaaaaccttgttgtcggatggtatcagttttaattttgctatatatatatatttttaatttcttcctttctgtgttgctagaaaaatctcaatttctatatcctctatcaatatgatttgcaatgataaacctttagtttttccaattggccatctgtgcattgcaacatcactcatattatcgattatatgagtatattacaatcaccaaaaaaaaggaaatttaatatgcacattgtcttcccttttctcacacactcatattatctaattcatgaactgtgacatgctaaaatacaaattttccttattatgacctgaaatgaaatcaattatcaatattgataatggaaagtcaagctgagaaaaataaaggaaatgtgaagtaaagtgcaaaagttctttcctagcttgtagggaattaattaaacatgcgaagtaagaaactagaatactgtgagctgatcgctggattttcttttcatccgtaatcaagcttaatcagcagtgagatgttaaaatgtgtgcatattttggtgcttgatttattagctacaaaagttgtacacgtagagcacacttccattagtacaataagaaggggtaccttgcctaatgtccatgcaagcaatttatcgagcatctgatggtcacgagggcagtcgggatgggggagagaggagtgcgtgatgccgatgagaggtaggaagaggtgatcgcgtcagctttaagccttttaagccttttaaggccctgtttctttcttttagcttggaattattataatccagattattaagagtaagctgaaagaaacagacaacttattgaagtagcttattataatctggagcccagcttattataatctgataagctcatttaggtgagctttttctagattattgggtgaaaaattacccaccatgctaccccactccctctttagacttgcaaacccaataatctaagctctaataatctagaaaagaaacaactaaccgcttattctactactgattataacaatctagcttatagtaatctgactcaataatctaggttataataatcctaagctgaaagaaacagggccctaagtcagtgctcgtcgatttgggctttcatacctggatggaggaggacgaagatgggattctccactccaatcgccccggcagtgaatcagggaagatgacattggtggcgaaaggggcgtgggcttgttggtacgaagaggaggcggcaccacatggcgcaggttatgctgcccgtgtgtatagtgagaggaaggagacgtcttctcctcatcatccgtgtctcctttcctcaacaaggcagagtcggtgtgctcgatgagacagctgacacatttggcgactcccccaacaccatccatcacgccggtgaggacgaagcgatggcggtggggagggtttaggaagcggttgccgtggggaatggggaggaggcggcggtggatgggggtggtctactgggacttgggatgtgggaggacatgtttgcaaaacaagtttctggaaggaccgaaaagagctttcaccaattgtaggatccaaccgctcacaatgcttggaggaaaaattggacggcctatgttttcagcatgacgtggctattgtagtttgaatcatgtccttaaacccgcaatactaagatataacgtctcttaactcatagaaccgacttacgtgaatgatttgtcttgcttcttgtcccacgtaacattgacgtgccactgaaaactaaattaaacaaaagaagaaagaaatgaaaacaaaacatataggttccatatgtcagtagttcttaccttatctcgtctcctttctttctcctcccctacttcttatctcctctccctccccaaacgggtccctgcgtagtatgccggtgttgccagcattcaccaagagcttggccggaccgctgcccctcgccatgtgcgcaaagccggcgtgtgcggttcaccaatgtcatctgcccggggaagttgacatacgtccatggcatgccgaatggccactacagaccggtgagggagacgacggagttatagcgacgcggaggagatcggaggaggcgaggtgaggcgaggacaacgaccccggtgtaccgttggtcaccggcgatgatcgatcatcagtggcagcggcgagttgaggcgacggctgcgctccgggaaagagggagcagagattgcgcgtgaggggatggatggacaggcgatccgtacgggacggggtttgtaggggagagagtatgggggaggtgggagtaacgtgaggcgttggatttgattggggcgatcctgaccgatcaatgtggaatgaggatgtaacataccattggtgaattatagggtagatagaagaagactagtaatatacccgtgctaacgctacgatccttaaatatttttttaataaatgactaaaattttgtgttaataaaagtaatcagtttaatggtagctttaattcaaattatgccatatatttaaggcaaattataaagtaggtacttcactgcacctatattttcaataattatcaattaaacatataccgtgccagtgtataagcagccgaataacacgtgacttagcgtgaagactggtatctctactattataaaaattgaagatgtttttgacataatttttatccgagattgattcccatctgcttgcgtcatcgtggcgtcctacgatctccgcattttctctccgctgcggtatgctacattattgttacggaaacgcgtgtgttcacaacaattgtttccaaagcatgtacatccgtgagaattgattctttacttaatccgtttcgtttgtcgtgtccgaccatgcttcgttggaagctttgatgctaaccagaaacatgcgatagttgtgctcatcgtgaacttggatttgctgcttgagtgtatagatgagatatcagtattgtgctaatgaatacgtattaaagattttgcgctttgttacatgtatatgtaaatatatgtttgcattcgatcaccaaggggatcaaagtaggattaatctcataactaatactttaattaaaacataatattaataatgattagttatatcaaattataaaaattaatttaggaatatcttcgctatctacccatagaaaaatctttgtgttttcttttatcatccatcatcctgcggatcataaggattttttttttatcttggggtggattttgatatatgagaatctgaacaaattgtaaatgaggaaagactgattaaaaaattaatttgaaaggtaaaagttgaattcactttcaaatttctgaattgagtttgaggaattttcggaaaatgtcaaagtacagatctaatgtttattgaaattttagtttgtcccattgcaatacacgggcactttttctagtaagaagaaaaaactgaaaagacacgattgtcgttacatccttttcttttattaactaaaatcactgtgtacattggcttttgctgtactgattaaagagacttcaacccatttgagataaacaacagggcacccaaggtgaaaataacggaataaccgaatagccgatttacgaatctctcggtttcaagagagagaatcaggaaggatacctaatcacacatgtcaggagtttaaaggacagaaaattgttctcataaatgccaggaagcatcaacagaaactgcccagggaagagaagaatctacacataaaaatgtacttgctctgtaaaaaattctattatcctgttaatatcgtgtttgtctattatgcaccaaaattagccaaatgtatcacctatgttcccaatgtatcagtaatacaagaaaaaaatgattaataggactgaaaggcaaacctctgaatcgtgatccatataatctcttgtacacctctttaatcatggaactgaaaaaacacattattcgtttgaaataccaccaaaatacacacaatttctcaccaatagcaatttactttgggaggtgtttggttgtcacgctcagaaattcgctaacccgaattccaagcagaatgtatattgaatctctgtccaggaccagccagagtacacagatgataatttgatatagttccacaacttacaaaaatataaaataaactcagaaaatcagcggaaaaactaaagaccatctaaacttaatctttttagcaaagcgtagcttcctccaaatccacaggcaaaacctcgatgtccggcacaagcctaatcttcatagaactcaccattcaaaacattctctgcctcttgggaggaggggtgagaaataaagcaagactgagtaccaaccaccgtactcaacaagtcatactgaggcagagatattcaaaggagtggctcataggatatttgtagtaaaagcagcatttataaatcataagatgaaagcagtaaaacattatatatttaattgagcaatattaaacatcactgtacaacgctaaatccacgttgaaacaggcacaaccaaatcacctgaactatacccgttcattaagtcaaattattaataaagtgagactaatcaagacgagctggtcgaataattttactttgatcagaggtgtacaattttactcacaagacacagcctcaacatcgtgtctaccatgagtcgcgataccgaagtacccgaatagaggtcgtgacagaacccatcatataactctccctaatgaatacacccaccttaggtttcaccccctctcctatacaggcagcgggcagtcccctctcgtgcctaggtaaattcggaagcagcagagaccaaaaatccaagtctgtcctgcaccatcgccttacccttgccatgatatgttgactagttcgagttatactctaaactcagcctggaccacacgctggcttgtgattagtatgggtatatcttctagggattcccaagaaccggtccttaattgttatgggcacaacttgcaaaaccatgcacccacaacccactattattgcatattttagtttatttaaatatacaccaaggtggcatataatcattaaacaattaaggactaaattaacatgaatctcattctgagctaattgatctaagaatggctaaacattcctaaaccaatcatttagtcaaattataacccaagttatcaaaggtacagggtaatcaaaaggctgagtacggtttatccaatcccacatgatattcgaaaacaatgcaatttaatagaaaagtagggattttgcaaaataggctcaatatgatcaatgatatatgtgtgacttggcttactcttcaactgatggaacctcggcgaccacttcgaaataaacgggggcttcgaaactgcctaattctaatcgacaaacaaagcacataataaatataagctataaacctactgaaacaaataaagaaaccaattttattggattcttgacattttaacgaatttactgcaatttgaatggattaaaacggagcttggattatttagatatgaattttacaatatgagctacgtaattactattaacgggaaaacattagtcatttatcatagattaatgcccatagataaataggaacaaaggaattagatcattggtaagcaagcctcacgagttagtgactcaacgagccaactcatcgtgtcacgggaccatccaaacctaaagaacgactctgacgactgaacgaactaaagcttcgacaacacacttaccaagctagtaacaaaggctaaacagcaactaaaactctattttaacgagaccacagtcgctaaacgacatggcaaacaactaggccggtggcggcggctcggcacatggcagcggcagctacgagacgcggcaacggcggcgcaagacggcggcggcgcggcaacagaagacggtggcggcggcacaaccgacggcggcagcggcaactgggcgtcgacggcggcacagagcggctaggtgttgatgcgaaaaataccaaatttggtcgttaacactagggttaggggttaggaaactaaaacgaccactaaacaaagacaggacaggggcatctcaccggaaaatgacgacggcggcgaggaaaacgatggaggcgacggcggcaacctccgggatgacgacgatgacgactggattaaacctagaaccgagtagattagatgattgaaaaaatatgtatggttaaaatcataccaaaagaattgaagaggagctcaccggcgacgcgagggcgacgacagcggcgattgcaaccggcggcgacgacgataggagcggcggcggctagggcggtggcggcgcaaggtggtggttaaggttttggctaggactccaataaatttatgtgggaaaaaagaggggatatgatggcttatataggannnnnnnnnnnnnnnnnnnnnnnnnnnnnnnnnnnnnnnnnnnnnnnnnnnnnnnccatcatact

SEQ ID NO: 34666 - DNA, 8088 bp, Oryza sativa
  unsure (1)..(8088): unsure at all n locations
actgtcccnnttanagtacagtcgtcgtnacccaacagcccaactcccacgccgtcatcacgcggcttccttagccacttctgtctcttgaaacgtaaaaagatgaaaaaaaaaagaaaaaggaaaaagaaaaaaggaaaatcttcaccgaaggcaatggcggcggcggcggaggcggaggaggaggtgcggcaggaggtggaggcggtggcgtcggtgtacggcgacgactgccgcgtggtgcgcggcttccctccccacctcgtcgtccacgtccgcccccgcaccgccgacgactcctcgcagcaggttagtgctcgccgtcctagctccacgggcgagccgcttcgcagcatccggatccctcccgatttcggtgttccgttcgtggattcggtcgatcggtcggtcggagacggtggcggcggtgctctgctgcctcctaaccctagctcccagataggaggaggaaggaggggattagtgtggttacctgagcctttgtgtttcgtggttgatgtagtttattactccctccatccacaaaagttagatatatttcacatttaactttttccaaataagttgttcctatttgtagtctttatgcatctaagacttaaataaagagataaattaaatgtttgatgagagcccaaggagtcatctaaatactcattggttgcatgcttgcattcactccttgattttgtaacatccaagatgatttaatttcttcttggtcttggtgacaaaagtaatatgtgcaacttttgtggatggagggagtagtatggctagtaccaattgcgttactgattgattatcccatgatgaaggcatcaattctgggccttgaaggaatcaattgtggggggcttttccttggagcccatcggggcggagcggcgcttcagttcagtagtagaggagtcaatttggtaacataccttttcatttatgagtacaggtatttttttggggatggagaccactgttaaggtgatcagtgaaggggatattagataaggaggcagaatgggagagataagggtaagtgggatattaaagatgtgagaggaggatgggtacttcggggaggcagtgggcattgtgtggtggtgaagggaataagaaggtgggaatgtggtgtaaggaatggcaacttcaaaggacggtacataaattggtggtaaccaagactgtttcttttctgttccatccgatcaagagtgaggcattccacattgcctcccaacatataggtatcccttggtctgtccataataaaatggtagctagtaactgccgacatgaccatgagcaagattgagcatgttagttaaaaggtccttgggtggtatgctctctcagtgacccttgaggtggttgtaattgtcgcatttcctgagtgtgtttcatgtgaccagaagtgtggaaaagaagatataattgtcctttattatcaacttttccatgttttacgtatgattacattattcaagggatccatgtatttttgtaagccaatattgctcttaatttcagttgcttatgttgaaggagttttatcatcatgcatttagatttgctaatgaccattttcacttttgcagttcgtggagctatttcttggaattaaagcatcttctcaggtatgaattacaaacttctacctcctttctagattcagttctatgcatttatttttcatggtgacttgttgttggaaacaatttgtttaactgatcggcttgaaatatctttttacctggttcttacatatggttatttgttttgtttgtgtcttttagaactcctgtcggtttttatctcactgttgatcatgagttcctatattgttattcattatgaacatggaaatacttttacatatacctgaccatcatgttaaagaacatgacaggttaatcataagacataactgtctttgtagtttgtacacttaggctcactctttattcatttacacaactgcagttcttcatggtacatgcctataacttgtattgaaaacttactttgttttgggatgatgtaaattatagctctttgttgggctggctctcaattgtaatgtcttcgaagcagtaatgcagtttcactgcattgaggcaactctctaatatctgtgatatcataaattcggaacaacacaaatttattgtggaggacaagaggcacctctttttgcagcaacccagcagacaacttgtgaatcattttttttttaattcatggccagcctaaatttcacaaccaactctatgctgtaacttacaaacctttccaatttcaatatttgtattaggactggtgctggtttgtaactttactatccttcaccattctgtatgcttctgtcattcacctttgcttacacaccttgattagagcactttatagctggttatgttctagctcagtgttaatgcattagattttttattcttcgaattgcagtatccaaaagcacctcctcatgtttatgccgtggaaagtaagggccttgatgagaatcgacaggtgtatcttattagcagcatccagaacaaggcaagagaactttcctgctacccgatgcttgtgacgctgtgtgaggtactattccattcattgtcttcttatagagtacagagcaaaacttgcttcgtctagtaatgtcttgaggattatgcatacttactacatgtaaattgaaactatctgtgaattgcatagtctatggcagtttttagaagcggtactcaatttacattattgtctaattggcattcatttgggagtgaagggaaattggatagtgccaacaattgacactgactgctgctattcgaactataacagtgtctttgggaagtattagatggtttttttctctgtttgagaaattcttatagatgactccagaaattcaaaattttgtaagacactactatggatttattgcataccacgatcagatccactttatctgtaggtgttatggaattctgtaacaaaaaaaatgctcatatgcattgtagcagtttgctgtctaagagggtggattttgatttacatgaaacctatctgacttctcatgcaggaagctgtggagatgctctcaaatatgaatcatccagctggggattgcccactttgtctatatcctttagtcaaagagaatgatggttctgctttgccatttatgaagttgatgtcgtgctaccactgcttccacaggttgacttctgccacatactgatatgtgcaattgcaagaaatactctgtagtagtgtcttattattttggaatttcagtgactgcattatgagatggtgggaatggctacagaatgatgatactgactcgaagaagagtagtacagcagcaactactgaaggtgctagaaatatttcattttgcctttttttttttcacttctgtaaaatgtgttttttaatccttttcaactgcctacaattatttcatgcacttttgggtcaaagatgcttacaaatacaaacataatttaggttgattgacagttatttatgttaaagatgcttgtatgctgtccctttttaatttccccaaggttccagtctgtgcgaaggaaacaaggatagtcacattctggtagaatcatgtataaacttgctgtcgtaatgaagctagtaaaatagcagcttacctgtttaaaacttctggtgtcaatttactttcttaatagcctcatgttggcaacatgattaccattgtttcacatagatattgccttatgttctttgatgactttcacatctaaatttccatcctaacaaatgaaagcgtctgaagtccttatcgaccagcctctgcccttaagagtaatgagcttcaatcttgtattttgtttttgaaccttaagagtatgaatttaagcttttgtgtgcatcagtgcttgacattatgctgattttattttttttcattaaacatatattttaaaggatgcaagtgcagtttatatcatcagtataccaattatcgacaatgtaaatatgatcgtttatgtagttaacatttttgttggttggtgtgttaatcagtgttaatcttgactactgctactagttattcatgcttctgaaggattggatttgtccagctcagctaagcatcacaatgtaagtcagcacaaaggactatgtccagtttgccgcaaagtgtttgatgagaaggatattgagcatgttcgtgatctgctaggtgcaaatacttctcaactggtatgtatcagtacaagttaacagctttcaactttttcatgcactgtcagttttgatatgcctgtaccgtattcattggttcacaattatcttctatcatcactggtgttcggttttcctcacaaacttttatagagttatttaaagtacaattacatcctcgtacgtttttcagttcacattatatatttcaagtaaagcctgtcagagatattgtactctgaaaacagctataattgatatttacccttccacctataggcatctttatcgattgatctggacgaagatgaaaaagaagtacttcattctgagtcagagaagatccgtcaagaaaagttcgcatcgctgttcaatctacaacaagaacgaaatggcctgattgaaccaaagaaagacctttccatacagcctggaatgtacatccctcgtcctcccagcgcgcctactgcttccgaaggagacaccgttgatgattcttgtgaagacaccacaacttcaacctcaggaacggagccactcaaccagacaaacagcactggtggtaccaccaagcacaacagcagttcaggtcatcgaaggagacatcgatctcatgcttcaagaagacaaccacatgggcaagggcaacctgctaggcaacaatggcagaggaaaggcggagacacttcacaccaatagcaggaaaggttgtgggaggtttgttttttgtcggttataatcgcaagcctggtaccaattctatgtttcatgcctcactatcagacggctcataacatggcagaattatccaatgctgttgttatgactaagagtatattatagttttaaactcggttcatgtcactgctgcgaaactgaagctactagccactgtatacacatcaatttgactttgcatatcactgttgtgactcgtgagagatctggctagcacgtacttatgttcagccaaattcttcaaactggatgcaattgaagcacctggtgtttataagaaactttttgtgctattagcatcaataccctcttattctttactttaaaatttattatcacaaaatattcgttggcaggcacggtgcttcctcaacttaacaaccttacaaagctgcagttccttgacccctctggctgtcatctgatgaaatccgaatcaggaatggcatggctgttcatcttctgatttctctctttatgaatagttaatctaaaagttaatttctcacattcatatatagctttagtttatgctatgtggtggaggcttaaagctcaagagatagtacagaaattgttgggcaggttcatgggtttacccaaaccccaatattatttgatatatacgcgggcaggagtgtggtctggcgagcaacaactaatgtgctatcaccttgggtttgttccaagtcaaatttccttgtgcttgaccgacgcatttaaaaccggtgtataccaaaacaaattagtatactacggaaatatgttaatggtccatttaataaaactaattttgtgtcatagacattatgtttttttttacgaacttgatcaaatttaaaagagcaacgtgcgtttgacttaggacaaatccaaaaatgaccgatggaacggacacgcagcgcggatagccacgacccatcctatttgcacccttaagtgcagtacagtacatataatttactctatactctctccgtactcatgaaagaagtcgttttggacagcgacacggtctccaaaatacaactttgactttttgtttctttaaaaatatttattgaaaagtgatatatgtatacttttatgaaagtatttttcaagacaaatctattcgtataatttttatattttcaaacttaacaacttaagagttattcatgatttatattcctaaggtttgacttaaacattgtcctaaatgactttctttacgagtacggagggagtatacggagggagtatgcattgacgggaatgccgctcacgcccatatacctgctgagtacgaagctctaaaagtctctgtgtgtgccgaattgtcaattaaattcacagtcacgtaacgttggtccgactaatcgtgtccatatacgtacgtaacacaagatcagcattaacaatcctcgccgaattaacgtctcgactctggagtacgtagcgacacgatccccgtccatcgtccacacacaagacgcccgggcgcagtgaaatggtgatgtgttgctgctgatgaattccatggaagacacggcacatacgaaattaattagaggctgcaatatatatattagcggatcgatcagcacacactgagcagtgaaattaattaggtcgacttgcccaacgagacaaatataatccagaaacacccggtagctttgctagaatctacataaccttgccgagtagctagcgctccccacggaggtctcggagacggcaaaatccaacgaatcgcatatccggcgcatatgatatggcttgcccactacttacaggtatcgttttctttgtctattttcacttgtacaggcaacattttagagaacaaacacaaacgcacaaacatttactactaggtcatattaagaatgttgtcttgtccaattagcagtataccctcgccatatttatacccggcctagaaatattctgactaggagctgctcgagcctgcttctcatgcagtcctgcctctgaccctagtaccaaatctcaatttctatcctcatatagtttttttgcagattgatgcatgctttcaactcaatttacttgcaattagggagagaatatataagaagatgaccaacttaggacattcataggattttatggttgactaaaatttggatatctgatgtgggagtggatccacatttccaaatgaacttcttgcgatgaatatgttcagaactatagtgttgatgggtcgttaacatatagacacggtaatcgaaagatgaaactaccttttgtaattgcaattttatcttcttgttatgaaatttacttagtattaactttgtttttttatcaacatatttaatatatgattatgtaaatatcttttcctataggcttgaaaggagtaaacccaattttaaaatgtattttacttctatgtcatagtgtgattagttttatgtcttacttttagtcctgcctattgtgatctggggtagacaagcttggatatcggataaatcctgggtctgccacagtttgttatcctgaggtggcctaaaccattttagcaggcgtttacttttttttttcccttttggtcgattgtggaaaagaaagccaaaattctacgaaaatcatttttgtagtagtgatctttttctcagaaaatagtatgtaccactgcttcttgtgttaattacggccttgcaggaaagaagttattatcatcactgctagttgtggtgtcgaccaccctgaccttgaagcataccgctgccagcaccagcagcctagctttcgcggcgttgcccggctgcccagacaagtgcggcaatgtcagcatgccgtatccttttggcaccatagatggctgcttccggggaccacccttccgcgtctactgcgaagacgaccatgcggtttatctccaggagcacaagaagttgaaggtcttgcgattcgagctggcccagggcgaggttctcatccagaagcgcatagcaacaagctgcggcgtcaacctcaccggtaaagccgtnnnnnnnnnnnnnnnnnnnnnnnnnnnnnnnnnnnnnnnnnnnnnnnnnnnnnnnnnnnnnnnnnnncgaccaacttgaacgc

SEQ ID NO: 34667 - DNA, 2067 bp, Oryza sativa
  unsure (1)..(2067): unsure at all n locations
ntgaagtagtgatcttttctcaagaaatagtatgtaccactgcttcttgtgttaattacgcccttgcagaaaagaagttattatcatcactgctagttgtggtgtcgaccaccctgacctttgaagcataccgctgccagcaccagcagcctagctttcgcggcgttgcccggctgcccagacaagtgcggcaatgtcagcatgccgtatccttttggcaccatagatggctgcttccggggaccacccttccgcgtctactgcgaagacgaccatgcggtttatctccaggagcacaagaagttgaaggtcttgcgattcgagctggcccagggcgaggttctcatccagaagcgcatagcaacaagctgcggcgtcaacctcaccggtaaagccgtcggcattccatgggtagtgcacgatggtggcttagcagatgactatccctatctgacaatctctaccaagaaccagtttgcagtagtcgggtgtggtatcacagcgatcatcgttggtcagggagagaaccagcctgattacacggtcggatgccgatcattctgtgatgatgtcgatagcaatattgtcgaagataatagcacgcaatgcaatggcaacacgggctgctgccaggcttccatcccaggtaatctcaaggctttccagccctcattcttaaaaataagcggtgtgaactactccggcgtcccgtgtgtctacgctttcgtcgtggagcagaactggttcaaattcaagacctcatatgccaaatcgatggaactttattcaaagtatcgaaataagggcaccggggttcctctagtgctcgacttggttgttggtaacgaaacgtgtgacgaagccaaaaggaacgcattatcctatgcgtgcaaggctacgaacagctcttgcatcgacagacctagccgctcagggtacctttgcaactgctctcaaggttatgaaggaaatccctacctacatggaggctgccaaggtgagaatgctctccaaaaatttccatgcccccttttcttgcaactagaaacatacaaattgacaccacttctttttaattccctggcccaacatcgtttgatggacagacatcaatgagtgcgattatccatggttgtatccttgcaaaggtaactgtcgtaacaagattggaaactatgcgtgttcgtgcccatctggaactcagagcaaagatcccaagatcataccctgcactccaaccataggtatatatataatattcactagcttttttgaaaaatatttttgcacaagtcatgtttggggaagtaacaaactattttcatgggaaacttttttttattaaaagtggtaaacaaatatctatatatatatatactttcaggtttaagcattggtataggagttggtagcgcaacaggctttatttgcattgttctcattgcaatgttccttaccagacggataaagcacaggaggaaaataaagctaagacaaaagttcttcattctgaatcgtggacaactgcttaaacaattggtatcccaaagggcagatattgctgaaagaatgatcatcacattagatgagcttgaaaaggcaactaacaactttgacaaagctcgtgagcttggaggtggagggcatggcactgtttataaagggattctatcagacctacatgtggtagccatcaagatatcaaatatagtggtcccgaaagaaatagatgatttcataaatgaggttgccatcctctcacaaatcaaccataaaaatgtagtaaaactaattggctgttgtctagagactgaagttccattgttagtttatgaatttatttccaatggaaccctgtatcaccatcttcatggtgagggtccaaggtcgctatcatggagcaataggttgaggatcgcagccgaaattgcaaatgctctttcctatcttcactcatcagttacaatcccaataatccatagagatataaagtccagtaacatacttcccgatgataatctgacatcaaaggtatcggactttggaagctcaaagtatatcccaatn

SEQ ID NO: 34668 - DNA, 736 bp, Oryza sativa
  unsure (1)..(736): unsure at all n locations
atgataanctangaacacatctcggtacccctaatttttccactgtaacatgttccacaagcatggttaaaatcttgagtacttgcctacataagacttatatagttaacttatatatgttgtcatcttttgggggaaattatcaagttggacagccaatgattaatagtagctttagctgctgatggagaaagggatttcaaagattcaggcactttttgctaatttcaaatacttcagcatttcacatgtatgcccatagatttattaattagcttccttttgggagatattaattagcttcctcagctcggtagcctttcaaatctcaaacaccttgacctcggtttcatatcgaatatgtgcacaacagatatctcatggttaacccgtctgcataagctggagtacattgacatgagctttataaatctcagcacaataactgattggcctcttgtggtaaacatgattccatcccttaaggttctcagcctgtacaattgctcacacacacacacataaacctcacaaaacttgagcaccttggtctatcaaggaactactttggccatccaattgcttcaagttggttttggaaagtaagaaccataaaggaacttggtcttagtgaaacctatcttcatggtccatttcctgatgcactagggggaatcacatccctccaacagctagattttaccaataatggtaatgcagccacaatgactatata

SEQ ID NO: 34669 - DNA, 740 bp, Oryza sativa
  unsure (1)..(740): unsure at all n locations
ttgtgcccaagttacgtcnnnnnnnnnnnnnnnnnnnnnnnnnnnnnnnnnnnnnnnnnnnnnnnnnnnnnnnnnnnnnnnnnnnntacatatatatatttatatatgtacgtacatttactttagtgttaatatatgttttggtaacatatatgcacataaaatgttaagtgctttaaattataaatatgtgtgtaatatatgtatttatacatatacacatacgcacatacatatatatatatatatatatatatatatatatctatatatatgtatatatatatatatatatatatatatatgtatatatatatatatatatatatatatatatatatatatatatatatatatatatatatatatatatataatcaaccatgcagcaaacagggccatgcaaataaaaaaaatggtacacagatctttagtcccggttggtaacaccaaccggaactaaagatggatcagccggccacgtggctgaccgatctttagtcccggttctgttactaaccgggactaaatatcgatctttagtcccggttatttcacccgagactaaagatcgctatctttaatcccgaattcgtagtcccggttggacaactaggactaaaggggggttacgaaccgggactacaaacggtttctccaccagtgtcagtattctaaattcacgaaaaagagacatgttaagacacaaggacaccaatcagtttgataaaacggcttgt

SEQ ID NO: 34670 - DNA, 733 bp, Oryza sativa
  unsure (1)..(733): unsure at all n locations
ttgtgcccaaatattnnnnnnnnnnnnnnnnnnnnnnnnnnnnnnnnnnnnnnnnnnnnnnnnnnnnnnnnnnnnnnnnnnnnnnntctttggcttttatctactttgaaatattatggtcttacttttgagaaagtacctctctttttttataacacaagtgctactaacattgctaagaatcctgttcaacactcacgcacaaagcacattgatattcgctttcactttttgagagatcatgttgagaagggatatgttgaattgcagtttttggacacaaagttgcaacttgctgatattttcactaagcctttggattctaatcgctttgcttttcttcgtggtgaattgggcatagttcatccttttggcatggtttgagggggagtttgtacctcatggttttatcaagcgataatatgacaatgagaaaaattgagaaaatagagctttggttatgcaaatggtattttcttgtgcatgctagcaatactttgaaggtttatttgtctctagcatagcttgtatgtattctagtcttttcatgagatttagattttgcttttagggagatgatgcatgacacttaaatctatacttgaataagaaaatatgcaatgttgatgctagcatatggtttgattaataaatgctttatatatatatgctttggtggattggtattcctcaaatagccttaattgctaatgtgaaaagagaataaaaaatn

SEQ ID NO: 34671 - DNA, 738 bp, Oryza sativa
  unsure (1)..(738): unsure at all n locations
cagtggtnaaggttgatcnnnnnnnnnnnnnnnnnnnnnnnnnnnnnnnnnnnnnnnnnnnnnnnnnnnnnnnnnnnnnnnnnagtgtcaattgttggcactatccaatttcccttcactcccaaatgaatgccaattagacaataatgtaaattgagtaccgcttctaaaaactgccatagactatgcaattcacagatagtttcaatttacatgtagtaagtatgcataatcctcaagacattactagacgaagcaagttttgctctgtactctataagaagacaatgaatggaatagtacctcacacagcgtcacaagcatcgggtagcaggaaagttctcttgccttggtctggatgctgctaataagatacacctgtcgattctcatcaaggcccttacttttcacggcataaacatgaagaggtgcttttggatactgcaattcgaagaataaaaaatctaatgcattaacactgagctagaacataaccagctataaagtgctctaataaagtgtgtaaccaaagtgaatgacagaagcatacaaaatggggaaggataggtaagttacaaaccagcaccagttctaatacaaatattgaaaatggaaaaggtttgtaggtacaacataaaagtgggtgggaaaattacggttggcatgaattaaaaaaaaaatgatttacaagttgccttgctggtttgctgcaaaaagaggtgcctcttgtccttcaaa

SEQ ID NO: 34672 - DNA, 771 bp, Oryza sativa
  unsure (1)..(771): unsure at all n locations
gtggcncnaaagtgngcactnnnnnnnnnnnnnnnnnnnnnnnnnnnnnnnnnnnnnnnnnnnnnnnnnnnnnnnnnnnnnnnnnntttcacacttatttttaaattgattttaaatttacgaagaacccacgactaattgcgtaacgcagcgttgcttttttttacacgaggaaaccgcgtgcgggcgtgatttctgatcgctggcctccggcgccagcgatcggtcgcgcagcagccacccctgtagcggagcccactggatgtgtttaaaattttcaggggggaagggagggagggaccaccccctttcccctgaaaacccatcatcatcttcccttgatgggaactctagaaggcttccttccttgcttaatgctacaataccccgcttgaagtgccccatagaggttattcactctttccaaatcaccaaaggcattctattcggtagcgtagttgcacgcattggaaatctacttgtctgatgattactgcaactttgtctacagttcggaattttggtatttactttctcaaggttcgtcttattgtctttattactccccttaattttgttactttttcttgtattaaaaataaaaaattatgggttaacattgccttaatgaatattgtttgggggttttccaaaccttgcatgattaaccgtgtgtttacctttttttttagaaaagccgttataagaaagaggtaacgtggaagagaaacatattttaactcattcgttcgagtgttatctacggtattt

SEQ ID NO: 34673 - DNA, 2435 bp, Oryza sativa
  unsure (1)..(2435): unsure at all n locations
tatgtnnnnnnnnnnnnnnnnnnnnnnnnnnnnnnnnnnnnnnnnnnnnnnnnnnnnnncgatcgcccattcagccaccatctagggaaaaaaaaccgtcaccaagctcgactcgtatctggagctctgtttttttctcttctcaaaaattcattttttttaaaaaaaattactagtgaactgtgacaatggtttacgtgatatagtaccaagttattaactaggaaaccaatccacctataagtttatttcattaagtacaattacaatttctaatcgttttcttttgtattatactactaagtttggttatttactactccccccgtcccaaaatataactacttttagtcctcaagatttgtcccaaaatataacaacttctccaccaatattctattcccaaccaatcacaaccctccaccattcacctttcccaactacctccaccgcctgcttggttggagggagtttttaggagggattgggagtttagagggatgaggctattaactgttttatttggttgggggatatgggaattttggtgggatggggatgggaaattgagaaatgaactccctcctttttaatacctgggtaggggcaggtaattgggaggcaattcctcatttacttcgcctaaacaaatctcagccatccattttcattaatgacctaatctccaactaaactccctatcaattttcaccacctctaccaaataagatactgggatgaaaaatcaaattcccatcttaatctcaccatcaaatccctcgtgtaaactcccaatccccttccttgaagttgccaaacaagccgccactactcaaccaatcacaaccctccatcattcacttctatctacgttcttaataaccgtgtctaactctaaaaatacttatattctgggacagaggtagtataaatttctccaaactcattccaccttcgtcccttcccatgtaccataatataaggctattgtttttcaatgtttttttcgatgatcttttaattaccatgtatcataacgatgcttatgagctcttttctgctaatccaaattattggtcaccttaactagtatttgtctgaaaatgagtagttcacctcctaaattgcttccatatacctgcatttttttacctgttcagaaatggaatagctcacctctgcgtcaattttattggtagcatgatgcttgtagtgcttctctgtgcttgttacgatattcaaaaatagtgttccttcttgtccccgtgatattcaacatacatatggtattctatcttactataaagttatcccccactaactctttaaacttaacatgcaaagatgccacatcatcatccattaacaagatgtcacatcatcatccactaataatcatcacatttaaacatcatgcaaacatgctatatctttatagtttttataatttaagagcttttcaaatataaacatgttaaattatcatccaacataattcatataatgtttcaatgtatatctttattatgttttatgatatcctatatataagtacttatatagttcatcctcacttagttagttcttaaatgattaatctagggtccaaattatctttctcctttttttctctaattaagtcatatcacatcaattgtttttagcctttagatattaatctatggtccaaactatctctctacttttcttcttccataaagtcataccaccttactctttacgtttgaatcaccattctacatactatttaaatttaaattatcataaaccacattaatttacttaatctgatgttatctagctattttacgtgttattttttttattgttatcatactaaattcctgcagcaatgcacggggtttcacctagtattttcagaagcagtaccttggacaccctttaccaggcattaatcaagaacagtcattagctatcctctttatgtctcggtaactcactcagcagctatcctagtcattccagtcattcctagtctctgtcagagcttgcctggtgtcagccagagatatctgtggtactgaacatgtgcaattcttgggttttctttatggcaactaaggacgaaacttttcaacgctttcgtggtttgtttcttcgatcggatcttgaatttcctggttctttgaaaagaattcgaagtgataatggtggtgaatttaaaaatgcttcttttaaacaattttgcaatgaaagaggtcttgaacatgaattttcttctcctcgtgttcctcaacaaaacggtgttgttgaaaggaaaaaccgtgttttggttgagatagctagaacgatgttggatgaatnnnnnnnnnnnnnnnnnnnnnnnnnnnnnnnnnnnnnnnnnnnnnnnnnnnnnnnnnnncatagacaagtgtatccaccttngagcacac

SEQ ID NO: 34674 - DNA, 3311 bp, Oryza sativa
  unsure (1)..(3311): unsure at all n locations
tcctgattttcccanccatgtttttaaattgtctaaagctttgtatggtttgaaacaagctcctagggcatggtatgataggcttaagaactttttgcttgcgaaaggttttataatgggaaaggttgacaaaacgctttttgttcttaagcatggtgataatcaactgttcgtttagatttatgtggatgatatcatctttggttgttcaactcacgctttagttgtagattttgctgagactatgtgtggggaatttgagatgagcatgatggatgagttatcgtactttttgggattgcaaattaagcaaacacctcaaggtacttttgtgcatcaaatgaagtatacgaaggatcttttgagacggtttaagatggagaattgcaagccaatttcaacaccaattggttctacagctgtgttggatccagatgaagatggtgaagctgttgatcaaaaggaatatagaagtatgattggatctttgttgtatctaactgcttctaggccaaacatacaatttgctgtgtgtttgtgcgcacgctttcaagcttctcctcgtgcttcacattgtcaatcggtcaaccgaataatgagtatttgaatcatacacttgagtttggaatttggtattctacttcatcttctatatgcttaagtggatattccgatgctgattttggtggttgtagaattgataggaaaagtactagtggaacatgttattttcttggtacatcattgattgcatggtcttctatgaaacaatctagtgttgctcaatcaactgctgaatttgaatgtgttgctgctgctagttgttgttcacagattctttggcttttatctactttgaaatattatggtcttacttttgagaaagtacctctctttttttataacacaagtgctactaacattgctaagaatcctgttcaacactcacgcacaaagcacattgatattcgctttcactttttgagagatcatgttgagaagggatatgttgaattgcagtttttggacacaaagttgcaacttgctgatattttcactaagcctttggattctaatcgctttgcttttcttcgtggtgaattgggcatagttcatccttttggcatggtttgagggggagtttgtacctcatggttttatcaagcgataatatgacaatgagaaaaattgagaaaatagagctttgtttatgcaaatggtattttcttgtgcatgctagcaatactttgaaggtttatttgtctctagcatagcttgtatgtattctagtcttttcatgagatttagattttgcttttaagggagatgatgcatgacacttaaattctatacttgaattaagaaaatatgcaatgttgatgctagcatatggtttgatttataaatgctctatatatatatgctttgttgaattgttattcctcaaatagctttaattgctcattgtgaaaagagaataaaaaaatatgaaaaaaatgaataccgaatccttggaaacagtcttgacgacaatgatgtattcgatgtgagcaaaataatggatgccgaatccctggaaacagtcttgatgacagggacgtacccggaataaaaaaaagagaaaaatatgagcaaaaaggctcaagaaaagaaaaggttcaaaaattctctttgtttttttgtgctaaaacgttatttgagaaagagtgataaatgcaataggtatatgtgtttagtgtttattcttcaacctatgtacttgttaagatgttgcattataaatcatataaaatcatgaattttgattgttgattcaagcttaattgtaaaatctttggttcatggttatactttaatgcatgcttgttatgttatagatgggttcatctcctttttattgcaacacatgacttgatatgcaatatgtatgctaagctcttatacattaatgaacataattcttatgcttgatgaaatcattgtcaaaagggggagaagagatgagttttggaggaagcaagatggatttttggagttgttgagaagagcatgttgtttttggttcaattgggaatttctttcttttaaaaagggggcgaagttttcttttggatttttgagcacgatgtgtacatttgtacgaagtgtgctttttatcacttttgtttatatttttccaaacatcaaaacattttaaaagggtttgccaatgtgttcatcaagggggagattgtaaaatcaaaggtgtttttgattattattttgcgatgaacaattgggcattggagattattggttttattgtttggaatttatttacgaagtggttttggagatgattggatttacaggtgaatcacaggtactgttatttcatgcgaccggtcagaccgggcagtgtgtgccggtcagaccggcgtgtatcgcgcggtcagaccggcgcagcccgtggtctgaccggccgacgctgtgtcagtttcggtttcgggttgtttatttggatatccgtgattatttcatgattatggcatctagatggatactatacgtatgtaatactgttgtttactactaatgaatcaagttggagatagcttggtctcggaatatggtttctttgattatttcatgtgtaggtgactcgatgtctcgggtgagtatttgcggtgatggaccgggagtcggcttggggataagacgacgtccgtggtggtcagagatcatgcgggatactaaggctagagttgatgcacgtggttgatggagattccataagacatatgatggagttattgtgtgcgtatgggatgcggagttgaatttggaaggagtccaaatttggtacgattgattatgtaaagtttctttcttgtactagagggtttcctaaggtgtttaggactcctagtatgagtttggttcgtggctttaggctgcctacctcgggtataaatagagggggagcgtgaggcttcccggtatcgcttttgagagcaattgagttgagttttgagttagggtttcgagtttagtcgaaatttttgtaaggagtgctgttggtgcactttgtaacacagagagaagtaataaagtcgtcatccactttaagagttcttcgatttgtgttttactgggtttcggtggtctaaccgacgacacaccggcggtcagactagcggcatcgcggcggtcagaccggcggcggcgacaggtgccgcagggattttagggcggtccaaccggaatatctatacccggtagaccggcagctacgctttgtcaaaccggttatctactaccgtcagaccgat

SEQ ID NO: 34675 - DNA, 2085 bp, Oryza sativa
  unsure (1)..(2085): unsure at all n locations
agtaagctttggtcagaccggctttttttttacggtcagaccgatttccgtcaaagtcgacagtacttttatttccgctaaagtttttggtttttgggtatacaacccattcacccctcctctagttggtttagttctgctattcgatccttcaaggcatgccacagaacactatgatcaatggcttcacacaagaagcttcacaaaatgcttatgctgcatcatggcgaatgacaggatcgcagcaacatccatcggcagcttccaccgcgacaggtttaggtgttcagccgatacagcagcccaacatttcattcaaacaggagcaacaagagttacttggccacaagccaaatgtacaagagtgtcagttaattggtcaacatgatgcttctgtgaacacactgtagagaattatgagacgcctcacgacacaacgtgggagggcgattgtatttatatatccaatacaatagagattacaacaaactcttaaataagagttatatacggatacaatcgatacaaatctaatctaactctaatacccgcccgcagtcaaagtgggaggaacatcacgaacgcaaagactggacctaaactcagtgaataactgaactggcaagcctttggtcatgatatctgcgaactgatgtgaggacggaacgtgtaaaacatgaacttgtcctaaagcaactttctctcgaacaaaatgaatatcaatctcaatatgcttcgtctgacgatgatgaacaggattagcggtcatgtagacggcgctaacattatcacaataaacggtagtggccgaagcaagtggaatatgtagttcaagaagaagttgtcgaagccagcaacattcggcaacagcatgtgctactgcacggtactcagcttcagcactagatcgagagacagtggtctgtcgcttggaggaccatgagaccaagttttcaccgaggaaaacacaataccctgatgtggaacgacgagaatcaggacaacccgcctagtcagcatcagaataagctatcaaagagtcaactggtgcagttccgatgtgaagaccaatgtgtagagtacccttgatgtaacgcaaaatccgtttaactagagcaagatgaggctcacgggaatcatgcataaacaagcatacctgctgaactgcataagctatctcaggccgtgtgagagtaaggtactgaagagccccagctagactcctgtactccgtaggatctgaaacgggagctccatctatagcagaaagtttacatcgagcatcaaccggtgttgcagtaggatgacactccgacataccagctcgccgcaataagtcaacagcatattgccgctgagaaagaaataaaccgtctgcagatcgagtgacagaaattcccaaaaagaagtgtaagtcaccaagatcagtcatagcaaactccgagtgtaggcgagcagtaatatgctgaagaagtgaagtggacgaggcagtcagcaggatgtcatcaacatacaaaagtaaatatgcaatattatctccatctttataaatgaagagagaagtgtcagatgctgaagatgtgaaacccaactgacaaatatatgttgcaaaccgttggtaccaagcacgaggagcctgcttcaaaccatagagcgatttttggagcaaacatacagcagtaggcgcagaaggatcaacaaaaccagatggttgctgacaatacactgtctcctctagattgccatggagaaatgcgttcttgacatcaagctgatggataggccaagaccgagaggcagcaatactgagaacaacacgaatagtagcaggtttaacaactggactaaaagtctcatcatagtcaataccatgctgttgagtatagtcacgaacaacccatcgtgccatgtgtcgagcaagagtcccatcggaatgaaacttatgtcgcgaaggtaaccgaccagtcatcaaannncccacggtgtggtggggatgaagttgattaacgtaatgttagctatgcatttctcatcctttatcgttatggtgtaggttgttatatccatgtaggtataggatacaac

SEQ ID NO: 34676 - DNA, 1767 bp, Oryza sativa
  unsure (1)..(1767): unsure at all n locations
atcggccggctcgccctcagaagaaggaaccgaccggtagagaaaccgaatgctcaacgtccaagaaggcggaacctccggctttagaaacaccctatagaagaaaatcaaaagaagaagcagtttcgggaatagctgcaaacgggaatgtctgttcataaaaaaccacatgacgagagatgaaaacacgacgggtagaaatgtccaaacaccgatagcccttgtgagaagccgggtaaccaagaaaaacacaggcagcggattgaggagagagtttatgaggagtcgtggcactaagattaggataacagaggcaaccaaaaacccgaagattagaataatcaggaactttgtgatgcaggatttgaaacggaatagagttgtggacggaagttgagggtcttcgattgagtaagtatgtggctgtggctagagcttcggcccagtaagaaggaggcatggatgcttgtatgagtagggtgcgaatggaattgttgattgtgcgaagcatgcgttcagctttgccgttttgaggagaagtgtaaggacaggataagcgaagcaaggttccacggctagcgagaaacgaggtagtggcttggttaacaaattcggtaccattatccgcctggaaacacttaatggaagagccgaactgggtcgtaacataagcaacaaactcaacaatatgctggtgaacatcagacttatggcgaagaggaaaagtccaacagaagtgactaaaatcatccagcaccactaaataatacttaaagccagaagtactcaagacaggagaggtccacacatcacagtgaacaagctcaaaaggagaagatgtactagactgagaccgagaaaaaggtagacgcgtgtgtttctctaactgacacgcatgacagaaactatgatctatcttagtacatggaagaatagctaatttgtggagactctaaatagcagctgaactgggatgaccaagacgacgatgccacagggtagaggattgggccaggaagctgtgggcagcaatagtaggtgcagcagtaggtagagtgtagaggtcaccacgactattgcagcgaagaatcatgcgccgggtacggaggcccttaacagaaaaaccaaactcatcaaactcaatggaacagttattgtcacgagtgaattgacgaacggaaagtagattgcgaaccaaagagggggcgacaaggatgtttttaagatcaaatttagtggttcctataggtagaaaagaagtgccacgacaaataacaggaatagtatgagcattgccaacggtaatgaaggtatgggaattgggaagacgagtaacgagaataccgtcggtagaggacatgtgtgaagtggcttctgtgtcaagcacccaaggacttggactttgcacggacaactgattgagggcagcaatcagacctgcctgatcccaattgggctgagattgctgtattggtggcaagcccggcattggtggagagacatatgggcctgcaaatgtcgtgtgtgcttgaggatatgggcccaggaggccggcactgttgctgggacgccagggagactgctgctgctgcacagcccatggattgaaacagacccatgggccggtaggtcgtggcccagcctggtgctgctgctgctacaaattgttcccgaagttgnnnnnnnnnnnnnnnnnnnnnnnnnnnnnnnnnnnnnnnnnnnnnnnnnnnnnnnnnnnnnnnnnnnngacggccaatataggcacag

SEQ ID NO: 34677 - DNA, 2444 bp, Oryza sativa
  unsure (1)..(2444): unsure at all n locations
gatgtgnccnattgttgagtgacnnnnnnnnnnnnnnnnnnnnnnnnnnnnnnnnnnnnnnnnnnnnnnnnnnnnnnnnnnnnnnnnnnnnnnnnccggaagtgcaggcattggcttgagagacagccaccaccatggttgtctcagcctggaccttgtgtgcattggcaactcgcagctctttgagcaacaaggtgttgcgcgccgaggtgaaggagggcagaacaggggcgctggtgatgttgtcggcggtgctcgaaaaacgagagttgaggccactcagcatgttgaggacaagctgagattcggtgacggggtggccgacgtcgcggagggcatcggcagcagtcttcaccttctgacaataaatggcaatgggcatgtcaccttgcgtcattgagtggaactcgtgactgagatagatggcgcggggttccttgtttgcttgaaagagatcgtcgatggcgagccataggtcgcggccggtctggtcgggttccataacgacgtcgaggatagcatcggaaacggagccgaacagccagtcccgaacacaacaatcggcttgtgcacaagtcgagtcgtcgggacgagggggtgcagtgccatcaatgtgaggaaggagcccaaacatgcaacacatagaagtgaagaaggtcttccacttgttgaaattggggtgcttgagctccagggtaattggtatgtgagtcttgacgttgacggtggcatacgggttgacgaagatcgagccggtagaatccccggtgctggcagcagaagatggagtagagccggatgatgtagatgccattgttcccgaggttgtggaagaggaggtggactcggtagacatggcagagaggcagaataatcacgacgcggcgaagatagaaggcggcgcagcatgagcagagcagggcagggcgcggcgtggcgcgatgggggcagagcgcggaggcagggcgcggcgcggaacgagcgaaggcgcggcgcggtgcgtcgtggcgcggtggggacgcggaaggcgcggtggggctggggcgcggcgagatcgtgaggggaaatcgctggggcgcggcgcggtggtggggacgcggaagtcgcgtgggcagtggaagagaagcgaacgcggaaaaagcgaaggccagaggaagcggcgaattagggtagaaggaaaccggtatctgataccatgtagagaattatgagacgcctcacgacccaacgtgggagggcgattgtatttatatatccaatacaatagagattacaacaaactcttaaataagattccatggttcagtcaaatggttccatgtccctgcatcagtcacaacaattggactcccagggttatcttattatgacaactctacagcagcagcttcttgaaactgtgccaattgtttctgacattccacggatgcatatgcgaaaacaagtaaagatggaggaggttcagcacccactgcatgatcaccagcaatggatgggtttgatgcaacctcagtctcagcacaaccagcaacatcaatcacagcggcatattatggcagcgttccagtctcagtcgaatcaactgcagcaagaattggggatggaacagaagccttcagtgcaacaaagctttcaaacttcagccgggatgttcttgcaacaaaataacattgatgaacaaatgcaatatactcaggcacagtgcggccttcaagaagttccattcagtagtaagttgatctgtgcctacgtttcatcaaacgtgctttcgaatttcgatccgtgtaaagtcgcagtaattttgtaaaggctactctgcataacttttgcaatctgacctttagttcattgttgtggttttagtttttcgatagcaggcacaaaaaagtccacatgctaccggcatccattctatgttgtactagcctgctattgatgccttcttttttttcatcaaagtatcttgtttcaggttttgacaatctttttctttttatgcagcaactatgcacattactactcaaactgatcatccaggtcaatgttatttgcaagatgagatatatgacatggtaaggtatgttataatcccttaagcactctgaagctttcaattcacatggatctagattgttgatagaagaactagagaatgttaagtattcttttttcaaaaaaaaaaaacttcctgtttcccctcatttacttttcccttcctttccttttgatctgtttgccacctaactctacgctttttgtttaattttgcatgtaaagttggaactgaaaatttgcacaaatttatgtgtgtttctctttatttatccacagattaagagcttgaaggaccaatnnnnnnnnnnnnnnnnnnnnnnnnnnnnnnnnnnnnnnnnnnnnnnnnnnnnnnnnngtngataacgaacagcgatcaacaaaaggcgcca

SEQ ID NO: 34678 - DNA, 1060 bp, Oryza sativa
  unsure (1)..(1060): unsure at all n locations
agtgtttttccgggggtaccccctattgtgtaaaaaccagaacccccgcctataaataaattaaaccgctcacgcccccgacctcccggcccagttagtatgtaaggaaaaagggaaaagcccccaaatccccaaccctcttcccgcgggggtgggcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacggcagacatgacagcatatggtctcgggctaggggccattatgacctgacctagaactcaccctcaccctcaccctcgcacgggggcgtcggtggcggcaaaggtgggagagggtgcaaagagacgggaggccgatgggagtggcctaggaaggccatggcgagcggcgaactaggcgaactcagtggaaggttgcagaggaaggcgtgtgaaggaaaatgggcggcgactgatttgctggcatgcgtaatttttggccggtgaccccgcgtgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 34679 - DNA, 758 bp, Oryza sativa
  unsure (1)..(758): unsure at all n locations
cgcgctatgaatatccttcccgtgaatccntnccanangcccaatnnnagctcggnacccagatggcggcaaatctgatcacatgctgttcaattataccataatttcaattctaccattttttaatccactgttctgttttcttaatggggtaacttaaagaggtttggtggtgtgccatggactcatgggaaccttttttgattagtggaggtttggtggcctcttggccaagcataagaccaactcacacctgctcatttattccagatttctgaccagccttgacacggtaaatttttcggagggggggtagatctgatctgctgggtttgtgggaaggggcatataaggagctgaggcctccctctgagtgcatatcgtaggcagcttccctctgcatacaagaggctgcctcccatttctcttctctgtcggtgttctcctcaagatctgtcttaagttcttgagatctggtaagattcttcatgatctcgtgcatacttctgcggttgatctgtagttcgagtatggaccatgcaagctgtgtggtttcctgttttagttgttcatctcaagatacttaatgctgtgaatctctgaatttgcttgagattcatgccttgcacatatatgatcccttgctagattcagtaacttgatttactctgtgtttgtgccattaaatttgtttcctttcacccctgtttggaactatttccttttattttactgcttgctcaatgctggtcttgtcg

SEQ ID NO: 34680 - DNA, 756 bp, Oryza sativa
  unsure (1)..(756): unsure at all n locations
aggggttgaattcaaaagagcttcngtacctcananncncannnnactcgnaccctncctatgcataggtcaaccacctattcgccatcatggaaacaggtggtgtatgataatgctcgtatttacattcactaagaaaattgagatcatcctgactcattgttatgaaactgatgaatgacataacatgcaggtgacaacacatgagcagtataggaatatatacaatattggatatcatggatatcatgcagaaccatgttggagagtgggacatgtaagaaaaacctaacctaaaaattcatatgaacaccaaagttgcaaaaacaagattcccttatcttcctttgtcccttttgtttcaagtaatgtcgagcacaattagaaaagagctatttcatgattttcttgggaaaagagaaaatgataacccttgacccaggattacagaatatttgaaagcatatcatgccactcatttcacataaaagaatccatattcttcctttgcaaaaagtttttcggatttgttaggatgcaggcaatcaggcactattgaggacaaagcttgcaagccaggcactagaggaaatagggcagggaggggtttataaacaattgactaccttatgaatggagttggattgctaaacttccatcgcacgacgttacaccactggttacacctcaaaggtaagtcccgatgacttcttattcatttggagaagtattgatacattacagtcttactcgtgg

SEQ ID NO: 34681 - DNA, 757 bp, Oryza sativa
acggtttgatgtcaatccctaacaccacaggccgaattccagctcggtacccagtagctaatgaatatataaactaagggcacctttgttatcatgcattttcctgaaaactgctatatctttactgttagagaaaaagagctagtggtggtggtggtgatggtaagtctgccataccaccaccatcaccatgggttctgtgcatacatgcacgtgtgtttcttttatctgaataattatatcatttgcacatgtggttcgtaataataggatcatttgtgaactgatgatcaatccgaagtctatatattgttcttgagttcagattttatatttatcctagatcgttgcaatgcatgagttggctagttcatttaataacctatttctcctctttctacttaaaatatgttaatttgattcaattaagcaactttcacatcttttccagtgactgaatggtgccctcaaccatttctcatataggtttggcatggatggagtaactttcattttgttgtgctgtttaatttgctactattccctgaacctttattccaactaatactccctccattccaaaatataaagcacagctacccttagcccaaagaccaagaaataattattatcaccttatagtttggattaatctaataaatgtaattcatgcacccaataaaattagagatcttgatggtggagaatttaaataataatattttagtagagaagatgggttagttaatggcatgct

SEQ ID NO: 34682 - DNA, 1557 bp, Oryza sativa
agcgcatttgaatcactactgataaccgactcacaagggcgaattcgagctcggtaccctcccttctctcttatagagggggtaaagcaatggtacacccataccggaagaaaactgcatggtgaatgggaggaatcaaaaggtaggttctaccttgatttcttcctgttaacccgtgtagtctctatacataaggaggttctcaacttttgacagaatgagaaaaaaatccaatggtgcagtatgggctcttttgttcttgttaactcaagacagcctagatttgtctgcacccgatcatgcgttgttataacactttcactcgggtttagataaggagtctgccatgtatctcaatacttccaccggaggttcgttcgcacacaaaacgacgttagaaagtagggagctcttggattgtatcctagagaacacctccttcgttcgttgtgaaaccgtcttgaaaataaagaatacacgtgaggaaccatcgacgaccgatattggattcgaccgttgaattctcacccaaacctcgagaactgaaggtagaagaaattcaacctttgaaattcccattccagtttgatgatgatctttttgaacattatggaaacacctcaaattattcctaccaaaagagaccaccggtcccgtgtaattctcccgcaccactcgatgagaatctcttcaaagagacggtgcagaaattaactaccatcatgagtgatgagtggttaatggagatggaggtttcttctgaagtaattcatattagctcccagtccttaactattccatatctgatgagagaggccatggtgcaaactctatataatcccactgttggtgcaaacattatgtctacaacctttgcattaaattgcttcgggggcgaactatttgcgccaacaaacaaaaacttctggagcccctctagtcccatcatcgaaggttatgggattcttcgtagagtgtcgatccagcacaatgatgtcgaagctatcctcgacttcaatgttttgaaagtctcttatttcgatcttttcgttggccatcccatagagaaacttctccttgatgtgccgcataccggagtccttgacattaaactcgggaaaatggtgtttttcattttgatcttgcgattgaaaaattctatgatggaacccattcctgattccgagccaattgaggaagtgatggctatctctccttttgaggcccccgaatccctcctcgaaaatgatgccaatgcattcgtcgaggagctaggacgatcatagagagatgatcgagttacccaaaactgatccacattcatgacctccagatgagctcaaatctcttctttcaggctttccttataccttcttgcatggtgatacggagtcgcccgtcaccatcagcgacaagctgtctactgacgagacctccaacctcaaagatgtgttagaaaagcatcgctctgttctaggctactcacttcaagacctgaaggggattggactggaccaacggtcaacaataaccggagcctctttgttggtcctgctg

SEQ ID NO: 34683 - DNA, 766 bp, Oryza sativa
  unsure (1)..(766): unsure at all n locations
acgtcaccgatccgagnctcgcatngnanaanncnagctnggnacccgacaaagatactaacagatattcaacttacgactgagaaaatggtagctgtctcctgcaaaaacagactacagaaaatagtggtcgaccggttctgtttccttatcgaatttcttcagctccagcagagcgctccaggtggggattcagaattatgcaaccgcgggcatgtctttgagccatgcatcaagcggcttgccgatagagtagacaatgaagccaatctccctgagcttctcaggatcgaccacattgcgcccatcgaagacaaatgcaggtttctgcatgttgtcaaagatcctctggtagtccaaggtcttgaactcgtcccactcagtgaggatgcacagtccatgggctcccttggtggcctcatacgcatcccagaccacactcacctgcttaaaagccgtggggctagttggctgcaggtgccttgggtggtcccaatcaaacttggccatggaaaggtcccgctggatctgatcttcagttacctgtgggtcgtagatgctgatttgagccttgtcacccaacaggccatggcacacatcaatggcaggtgtctccctggtgtcaccggtgtccttcttgaacgcaaagccaaggacggcaatcttcttgccagagacagtggtgaacatggaggccacaacacggttgacaaaccggctcttctggtagtcaataaatcttgatgacctggtctcagtaggcgan

SEQ ID NO: 34684 - DNA, 761 bp, Oryza sativa
  unsure (1)..(761): unsure at all n locations
agggtacggaacgactctgcntgggcaannnnccanctnggnaccctncatccctgtacgtgtggataccggtagaggcgccactggtttgcggtgctgatcggcgggggagtacggcgaggagaacgcacgaggaggggaaggtcgagccggtgcgatcgactactttctctacatcgacgcgctctacttcgcgagaattccttcgacttcttagcaccttgtttcgctgcgcagcgcgtcgagtggtaacgatctatgatctaatacttgcatggttcctggtttacgcgatagaaaattttgatttatgctatcgtagcctacgtgtatcccaacagtggtatcagagcccccttgtatagtttatgatctagatcattgcatatagttgatatgcgggtgtagtagatgagatctattatgttgtatataagtttttaggtgatcggagcatgagatgaaccgatagctgcatgggttgatgagatcaatcggtaagtgtgttggtgacttcactggaatgtctagtactcaccaaggccgagcgtgattgtgttcatcggatagtccaatgtccactggaaccgcacgccaatgacaaaaaggagccaatgagattgacttggtttcggcataatttgattacgcccgtaaaggtttcacatggcgaatcatagatgaaatctatgtaccctgtgaaactttcagggcgctgccctgaaacccgcgggaccgccgtgtgcattgcccctgagatn

SEQ ID NO: 34685 - DNA, 762 bp, Oryza sativa
  unsure (1)..(762): unsure at all n locations
cccgagttttgagtnaccgaccctcgatagggcgcctgtcgagctcggtacccccagaagaacggatctggatatattatgctaagatcgacaaccaattatcaagttggtgtgctagaagactaactgatgcagcagggtaggaaaatatggtttcgatcaacgcaggttcaatagcgtttgagaataattttctagcatgcatgttgctaaagcaacaagcatagcctggttagaaatgttgatctgcaggcatttacagactgaaaaccacatttgttttcctttgtttctagttgatcaaattaccttaaactgtgcctatatggggaggacgagtagaggacggctaggggagagttctcaccacaatcacgatgcggtgagggattaacagtggcaatcgttgatgagcttgctgtggcggcgatgaacggagaagattgatgaggagacggctctgacgatcttcgggcctggtgaagaggtagacaacgatgcgcatggaggtgctgacttgatggagagtacgatgaccacgggtggcgcttcgacgaggtaggaatgacagacggaggaagatgacgacaacagggtggcgttcctaaggtctttggtctgcgaggaggttaccgtgatggagtaggaaagatagccggcttgggttgatggcgaagatgaagctccggtgctgtgcgagcttggttgaagcatatactatggagaacttaacagagaaagaccggcgacagcgatggtgct

SEQ ID NO: 34686 - DNA, 766 bp, Oryza sativa
  unsure (1)..(766): unsure at all n locations
nngatgtcaaacagactttcnnatngnacnnngncnaantnnagctcggnaccctagtgtagcacagctaagccatataaatttgtataatgagtaaaggggctaatttagagtggttacaaaagagggtgcaagaatatcggtctacaaagaatgatattggtgagactattgaagatttcgatgaagtggagaaacttggacaagggtttacatcggccgatccattggaggaagtagacataggtgatggaactaaaccaaggccaacttttgtaaacaaaaatatgagagccgattaaaaggttaagataatcgagctacttaaagagtatgttgattgctttgcgtgggagtaccatgagatgccgggtcttagccgtgagcttgttgagcatcggcttccaattaaaccgggttttagcccttacaagcaaccacctcgtcgttttaatcctttgctatatgaccgagtcaaagaggagattgatcagttgttgaaggcggggtttactaggcgatgtcattatgcggagtgggtttctagcatagtcccggtggagaagaagggaagtggtaagattagagtttgcatggactttagagatttgaataaagctactcccaaagatgaatatcctatgcctatagccgacatgatgatcaatgatgcttcgggtcataaagtgattagttttttagatggtaatgccgggcacaatcaaatctttatgacggaacaggatatatataaaacgacttttag

SEQ ID NO: 34687 - DNA, 759 bp, Oryza sativa
  unsure (1)..(759): unsure at all n locations
agatgcgatgcgatcntcatngacnnnncnaannnagntcggaccactttctagcattatccacattactatagatgctaatgaatctagacacatatatagaactaacgtcttacgttgtgaaatggaggaagtatatgattttattaaaatattttttaagactaatctatacacgtagtcactatatttgaatgaaaaatattttagaaatgattcataattaaagattctaaaatttaacctcactcttgtatagaacgacaagtattatcggcccagagaaaatatactatggattctattccaataataaatatataccaatctataaatatattctataccacatacaatccagagttctagactcgccataattagtatttaaaagtggtgctcataggggtagggtttgctgtgtgccttcatagggttgagtctacgtgtgttgtgagtgattgcgttgtactgcgtaaattttttaaaaaaaattaaagaagagttgtgctgcgtttcagacctctacttatagcgcagtagtgccatcatcccattccgaaggaaaaggaagaccgaaaaaaaaaaaaacattagtgccctcactgcattacagcaatggcgcatgctaagagcaatggatatcaagccagtgatgccaccagctcgctcgacgctctgagagagctctacggcaacaccttcgccgtcgtcaagtccatggctctcaaggccgccatggacctcggcatcgccgac

SEQ ID NO: 34688 - DNA, 760 bp, Oryza sativa
  unsure (1)..(760): unsure at all n locations
ncgtgacgtcctagatcgctcngnccntncnaannnnnnntntgnncccctaaactttgggaattttctcatcacctggacactatggaatggtttgattattgtggaattgaattcaccccgccccctctattcaaaatccccaaaatggttttaggctgggctcggggtgcatggttttgatagtagcacctcggccatataaggaccggtcttcgggcctctgttgtaaagcactaccgtacttccacatgtctagtgggtaaggctttgtttgtggctcagtctggttataaacaaaagtacacggatggagatggacgaagtcgggggtcgatggacatctctagggcaaatgaaggctacacgagctgcggcccggtagtcgagatgtcatggcacagggccggtgtcctgctgctaggggctcagccctgcctacctgtcccgggggtcccggccgtaggtgggattgggtcggtactcttgtctatggctaggatgggttggaaactatgtcacgtctttcgtctgtataccgaggtggtatgtggcacgtggctacacgtgaggaagatgtgtcttgtgggtaaagatgtacacctctgatcagagtataatctattcgaatagtcgagccctcggatatgggcaagcctagcaatgtacccaagtcagtgttataattcttaaaatttgcttaacaactaaaatgtggaatggttggcctcgggtgccttgngatgagcttggacccacg

SEQ ID NO: 34689 - DNA, 21970 bp, Oryza sativa
  unsure (1)..(21970): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtctccattaccgatcaactcctccgcgcgctcgccttgattaattattgagttcgattgatctcgttgctgtttctgtgtagtataattaatcatcattaatttgatcatgatgttgtagttgtaggtgatcatggcgctgcgctgcatgctgatgagggcgaggacgacggctctccggccaccgccgtcgtcaggacagacgtcatctccggcgagcatcctcgccggcgccctccgctccccggcggccgtgctgatgacgccccacacatcgccggcggcggcggcggcgagttctcgccgccatctctccaccctcttccggcaggtgcgtacatagttcgtcattgatcgcttggcctcgtaaatcgtaactaattatacttttctccttccatcaacaacgtgtattaatttcaaaagaaattttaggatactttgagaaattaacttaaaatattttgttacctatacatcttgatatcttcttaaggatgataaattatgttaggaatttccccagcgatcgctagcaggaaaccagacgacacaacgcatgcgtactgtggctaagcctgcaaattcgcagaacagaggaaacagagcaaattttgtgcagcgcttttctcagctgcttttctgtttacttacatatataaaggaacgaatacaacggaaacaactaaccaccaagaccacttctcacgccatgctctagctgcgtccatccccacaaccacacgacgtgatccgagctcccagcacaagacgcgggcaacgagctaaactcggataccctcataacagactccacacgatggctatcacacaacacgtgagctcatgcgtttattcagaaaaaaacggaaacatgcagataactaatcaactaactaaccgtggcacacaagattactgctaacaaaactctccctaagcttgatgtgccgattatacaggaaacataccaatttgttcccgcagctcctgaaacttgattcgagaaagcggcttcgtcaggatatctgcaagttgcccttctatgccgatgtaactcggtgtgatttccccattctccacggcttcacgaatgaaatgaaattttgtttgaatgtgcttacttcgatcgtgaaaaacagggttcttcatcagggccagagcggattggttgtccaccctgagatcgacgacttcagttgctgcattcctgaggtcaccgaggagccgggcaagccaaatgccctggcatgcagctgttgcagctgcaatatactcagattcacaggaggagagtgctacaactctctgtttttgagactgccagctaacaggatttttgccgagaaagaaaattactcctgtggtgctcttgcgagtgtcaatgtctccagccatatcactgtcactgtaaccctgcagtcctccttcaccttccttcacatagcggcacccaagatgaatggtaccagcaacataccttatgatgcgcttcactgccgccaagtgttcgtccgtgggtttctccatgaaacgactgacataaccaaccgaatatgcaaggtctggtcgggtgttcaccagatagcgcaagcttcccactagacttctgtattctgtcgcatcaactagcgatcctgcactttccttgctcagctttagacatggttccatcggtgttgcacaggggttgcagccggtgagcccagccttctccacaatacgcgacgcatacgctgcttgctttaaagtgatgattccagcttcttgatgtacctcgatcccaagataaaaactcaaaggaccaagatcactcatcttaaattcagccttcatctgctctttgaatcccttgatcatgccactgtcacccccgacaattaccagatcatccacatacacaccgacgagcagtcgcccactgccatcgncgcgcgcgtacagcccatgctccaacgggctttgcttgaagccaagtttcttcagtgtgcagtctagcttggtgttccaagctctgggtgcttggcgaagaccatacaacgccttatcaagcctgtaaaccttgttctcctgtccatcgatctcaaaccccggtggctgaacaacatacaccttctcaatcagttccccattgaggaacgctgatttaacgtccatatgatgcaccatccaaccttcttgcgcagcgagagcgagcaacaaacgaatagaatcaagacgagcaacaggagcgaatacctcatcaaagtcaattccagccctctgcacgtagccctttgccaccaatctcgccttgtgtttgacgacgacgccctgagcatctttcttcagtttatacacccatttcagcccaattggccgatgtcccgaaggcagatcgacgagcctccaggtcttgttctcctctatcgaagagatttcatcgagcattgcccgacgccaatcctcgtcgcgttcagcttgagcgaacgttgccggttcttctccgctcaccatcatcagctcttcctggacctcacgattagcgagacctggcagcatggccggccccagcacattgtccatcgtgcggaaacggagtggtgcgtcgtcgtggtctgcatcaagattagcagctgctccagttggtggcgacacaaaatcaaccgccggcgcatcgccatgcaccgaaggtgttcggccggctgtcggtgagtctgatggcgttcgcggcgatgatgaagatcgagcaggcggctccccagcatcttggcgtgttcctgacagcgagccaggatggtacaccgtggtgtactcaacgacgaagtcggtgtcgagatcagcggccgcctcagcatcccagtcccactgggccgcttcgtcgaagacgatgtcacgggagatgtgaacacgccgagtagccggatcataggcgcgatacgccttggaccccggctcgtagccgacaaagatcattggacaactcctgtcatccagtttcttcaggttcggggtggtcgtcttcacgtgtgccacacacccaaacgtgcgcagatggtgcacggccggcggaacgccattccacagcgcgtacggggtcttgccgccgatacccttggacgacgacctgttgagcagatacacggcggtatttatcgcctctccccaaaacatacctggtagccccttcgccttgagcatactccgcgccgtgcccaccacggattggtttcgccgctcgacaacgccgttctgttgcggagagtagggcgccgtgagctcgcgccgcattcccagctcggcgcagtactcggcgaactgtgtagacgtgaattctcccccgcgatccgtccgcaacgcgcggagcttgcgtccactcttcctttctgccgccgcctgaatacgcttgatggcagccggcgccgcatctttggtggagaggagggcgacccacatgtaccagctgtagtcgtcgacgagtagaaggaaatagcggttgccactgggtgtcgccggcgtgatcggtccacagagatctccatgtagcagcgccagcggctcgtcagaccggcaaagtgcctgccgcgggaacggcgacctccggtgtttcccggcgagacaggcctcacagacctgatcaacctgcgacaaacatggtagaccacgtaccagctcctccttgcccatcttgcagagcgccctgaagtttatgtgcccgaggcgagcatgccagcgccacgcgtcttcgtcggcgtgtgccgccaaacagaccaggcgcgccaggttgatgtcaagcatgtacagtcgccctggggtgcgagggatccgggcaagcagacgccgctgctcatcccagacccgcatgatgccatcctccgccagcactttgaagccggtctcatccaattgcccaatgctgataatattggcagcaagacggggaagataataggtgttcgacagagtgcggtgctcaccattcttgcaggcaaagagaattgtgccccgtcctgcgatccggaccacggatccatcgctgagtcgcacgttcccggtgatgttcgtgtcgaggtcggcgaacgccatcctgctgcccgtcatatggtttgacgcgccggaatccataatccagcgcccgggatcatggtcagccacgtcgtcgagcgctgcaaatactttcatctccacgagttccaccacggcttggtggggcggtgtgggcgtgtcgccctccggcgccgccgcgtagaccgtgtcaacgcggccgccggtgagcaacatcaaggtgtgctcttcttcatcctcctgggcgacgtgagcctgttcttcgcgcttggacttgctcctacagtccttcgcccagtgcccaagtttgccgcaatttcggcatttgtctcccttgcgcgccgaaccagagttcgtgctctcggggctcgcagtcccgccgccaccagtgcgccctctcccgccacggcgcttgccgcggccgccagagccgcccgagtcaccccgctttgcctcttgatccttcttcttctgacgttcagcccactcctcctcagttaggtacagcttcccaccggcggtgtgcgacgaggattgcccagaatcctcagcggctttcagtctgccagtaacttcctccatggacagagtagagatatcgagaagagtttcaatagacaagatgagttgattgaacctgggacgagctacccgaaggtacttttcgatgactttatcagcaggttcaggatcaccgagggttgcaagctggttgacgatggttgtgagccatagagcgaaatcttccacggtctcgtcaccgcggaacgcaagcgattcatactcagcgcgcactttctgtgcactcgccttgcgaatccggtcgttgccgactcgcattgtcttgatgcattcccaggcttcccgggccgacgctttggtcgccagggtgccaatcatctccggcggcacggcactgcagatagcgtcaagagccatccggtcctcatgcagagggacgtccacgccgtcgggctcgatcgccgcccacaggcagtgagcctgcagcttgatcttcatcagtagcgcccagtcgttgtagttggtcttggtcagcagcgggtagttcaccgagccgcctccttctttcaccacgcggtggatcaccagcccgcggtcacccccgccgctgcccgtggcgcggccgccggagtcatgaggagtgcgcacgatcggtgacgacgagcgacgacgcggcatgaagacgccttccaatgcgcggtcacgagtccacttcctaaaccgtgctctgataccaattgttaggaatttccccagcgatcgctagcaggaaaccagacgacacaacgcacgcgtactgtggctaaacctgcaaattcgcagaacagaggaaacagagcaaattttgtgcagcgcttttctcagctgcttttctgtttacttccatatataaaggaacgaatacaacggaaacaactaaccaccaagaccacttctcacgccatgctctagctgcgtccatccccacaaccacacgacgtgatccgagctcccagcacaagacgcgggcaacgagctaaactcggataccctcataacagactccacacgatggctatcacacaacacgtgagctcatgcgtttattcagaaaaaaaacggaaacatgcagataactaatcaactaactaaccgtggcacacaagattactgctaacaaattataccctaattttaactacatatattggtatatacgatcccaaatcaaattaataataagcccaaattacactccctttgatcgtatatacgtgcatgatgttttaaatgacagattggagaaggctacaatccggtcgcaaagaggggattatatgtgagggatgttcttcaacggtttggactaacacataaaaggaattgtagctcttctgcctattctgcacagtattcaaagatcaggcatgatccgagtttggaacttggattgaggaggtaaatatttactgcctctggcacaacgttttttttttcagttttgaatggttaaaacaaatagtagcattgtggagtcaattcagtgttaatcttgttattacattggaggatgttgcaccatggttattaaccgtggcgtcgcgaaaacaatgtggcggtcagcgacttttagggtgtcccgccgcctcagtctcgagcctatggcgtccgccttaagggtaaaagcgaccccgtgtcgttgttgtggtgtcatgaggtatgcactacagatcagagtgcggggaaaatttttagccaaggacatatataaactcaccaagtccaaacacgttggatccctaatagagtgagagaaatagagaaaaagaaatagatggctcccctagaaaccctagatgtagcgtcggtaatccaaatcccctttatcgccacccagacatcagctcctctttgaatatacactatagttaaaaatgacctttaactatctaaattgctgctttatatgctacaatctgtatgaagataggatatgtgtagggtgtcactaagccttatgccttaacactatgtcagtaattaagtggtgtggtgggtagccttaccttgccatatactggcttaataaaccattatactactaggccatgctaataatttatgaggagttcagcatattcaatatatagctggcttacgagaattatgatttgcccaccttctcctataactctaggggaatatgatttggttttatgcaatctataccaattgatcatcttaattaggaaatccataattccaaattttatggacactttatgacatgaaaaattaaagaaaatgcatatgccaatgtattgtatggtcatggaattaaatagacgtgtggttttttaaggcattaggacctatactaattagggctatactaattagggctacgtggcattgttagggttttctgcgacttaaactattaaacgtttcatgtttgctcaaaatttacactataaaattttatccttgaatatatatactaccactaatgttcctaactaaatactacctccgtttgtttatgtatgatgttgttgactttttacataaaatttgaccatttatcttattaaaaaattagtataacgaatatgtaatagtataaattaaagattatagtttcttttatgataaaacaaatcacaataaaataaattatatatattttttagtaagacaaatgctcaaacatcacgtcaaaagttaataatttatttatttatttattttattttcaaaactagcaaaaatgcccgtacgttgcaacgggtgaaaaaattgtaatgataatatactttttttcatgaataatcatgccaatcacaatgtttgtattttaatgagcagcttgttttttatataaacggtcttttttttcttgcgaaattttctcaaaccattcagaaatggcgcatttctttctaaagtttctttctagaatgtttttttttgcttttttatttacaacgaaaaccatatttttctccctttttttcttttcttttttcgtgtgtttttttgcctttttttacaattattttctcgcgcgtttttttgcttgttttttttcaaatgttctttttttttgctttttatcaatagaggagaatatatgatgaaataaaagccgtgtagtaggtggcaaaaaatcaatggatcctattctactcagagcgattttttcaatagacggtgtctttttcttgcacgattttttaaaaccattttttaaaatggcgcgttttttctgatagttttttcctcttatgtttttttaaaaaaaattaccgatgatggaaatatttttcttgcgcgtttttttatggaagatggaaagcctttttagcatgttttttttttgcacttttttttgacttttttctcacgtgtttttttgaatcgtttttattttctcgtgcattttctctttttaaatagttaggttatattagagatagaggagatatatattgattagaaatcagactttgttttgtccttttcattttttttcttgtgtgcattatttattttatatgaaccagctttttattttttagaactatttttttcgccactttcttagggaatcggacgaactttttaagatgtttttttcctttttttttgcgtttataggaatcagactttttcccgtttttaaaggaatcgaatctaatatttttgtcaccacttttttttttgccttttataggaatcgatttttttccgttcggatctatggttttttttcgccacttaggggaattgttgtttttcttttttttgcagcttttctttttctttttatgcacctttctccttttgttctctcttttattattacttttaacaaaaacgatgtcaagtaccttattgcaaaattatagggactcaaatgtaaatgtaaaagttacagtaactcaaatgcaaaagtacaaacccaaaaattaaaatcatataaaaatggaatgctcttgacctataggttccgttttttaaacatattttcaatctggcacatcattttgtttcaccaaaatgtgtgagatatcacggtatagaatgaaagagtggtggcgggtatatcgaactcaaaaggagtggcgtcttttatttttcgtttttaagggggaatcggatctatatcgaacttttttttccgtttttgagagggaatcggataggagtcgaacttttttttattatttttttcgctttttttttctttcatccgtttttttgatcggacaattatttttgggaatcagacaaattcattttttccccgatttttcttttaccgcgtcatatttggtttttcttttcttttttcgcacgttttcttccgcccggtttttttggatcggacaattttagtttttttcgccggtcttttctcgcccctttttctggataggacagatttgcagatttagtttttctttttttcgcacgttttcttttgcccggtttttttatcggacaattttggttttttttcgccggtttttttgcctcttttttctggacgttttctttcgctcagttttttagatcggataaatttggtttttttcgcccgatttttttgacggacaatggaagcacctcttatgttttaagtagtagagatagagatatgttaattttgattaatccagatcgaattaattaacatatttaaatatatgtaatgcatgccacgtactgcagattattggacggtttggattatcatcagcacagaaaaatgcctactgcagctctacttctccacaacaacgaaggcatgcgaatacactactgcgtcgatttagggacaaaattatccaaacctggaggtaacaagttttttttttcactattcaaattaagatgaaaattgagggtgacacttaatttgcacgtttacttcaagcaaatgtttatatatatgtaactaccccatctacacattatatatagttacttataatatgtgtttacgtcacttataaacattgttacatttacttttaaagaattatatatatatatatatatatatatatatatatatatatatatatatatatatatatataagatgaatacaatgaaaaaagacaatactagtaactattcaaatggagttgaaaaaaacaatgcaagcatcatctacacctgatcatcgacatgaaaggaacggccgtgaaacaggaaactaacatgactatagaattaacatactttagagcaacttgcatgttttgtgttctgaggaagaattaagtagtcactcgaattgttaattaatttttctagtaataaatagaaattaatccggtatgtagacaactaaagtttaaggaaaaaaatttaaattccagtcctcacaactgagaaaaattacagataatttatttagagtgtatatgcacttgtactagtaattaatttgcgtctgtcttttttttttttgaattgaaggcatgaagaaacacgtgagatgatactgaatgtctctgcaatgctgggtttggttgctgtcgtcgccgtcgtcggatgcattatgaagccccactttgaggcccagctagagaagcttgcccaagcttttgttttgttgtttctactggctctacttcaagcaatggtagaaatgcaaaaggaacgacggcaaaagagcctagaagatgatcatgctgatgattctgaagagagcaagaagaagctgaagccaacaaaaacttagaaacttttagtagaacaagttttacattgtgcacccatgcatgcacataggatcaaaataattatgtatacagcccggggagtagtggattattccagcaatttacatttttgttttgagaaacacagtataaatataggcgctcacaacatgtataagttcacatctataaacatacacatatatacacaccataccccgttacaagatatacaactttttaccaacagtgattaagtaataaacccacggtttcaaaaacattgtaggtgattgtcaagttgatgataatgtagttggttattttatagtctcctatagtctttttctgatctccaataatataggttgttccgttacttgttgaaaacggaatacctaagtgcaacggattagtttacagagaaattttgattagctcgtattatatcatacactttccgttatcacttggtaatttaacaacgtttatgggaatttggccattgtgatgacgggataggaagccagctttttttttctaactccaccttgactgttcattaataaaggacccccacccgtgacgcggtgcgacccttgcacccccaacacccacccccacatacacacttcctggtgtttcctcgggcactagcggccaaagaggaagcacaaagaggaaataagtggggtctatcttcctagcgccaccgctgcattcaccttaccgccgcctaggtgggcaagaaacaagctaggtgacaatgcaatgacctcgaccactccagatcttggtccataagtgccctccttgtcatcttcgccttcttgctgtccagccccccaccatcgcatgccacaatcgagtttgttctcaatctacgtctatcatgctcatcgtcaccagatcaattggaggggagagagagagaaagagagaggaggggaacgacgacggcgagatagggatggacaacagcagcaactgaagaaggaagcggtggaagcgagatagggaggggcaatgtctagatgggagtcattcgttcctctttgatttgatttgcccgaggaaggaatgcacgagagagggggaggatgggaaaaggagaggggtaggtggctgaaatgtggttctgttaggagggaagggtgtatgttaggtctttttttcacagggtccaagctgataaggtcttaattgatttggtaataaaaaaagtaaattattatgttggcaatgcacgaacttgttatgtggtggaacctgctcactagagttcaagtcctagacttgagaaggatgctcatatatacggctaattattctttttaaggtagtgatgagtttttcctaatctcaaaatatgttggctcggccttttgaaggttctcataaggtcataagggtaagttgtgcgcgcgtacgtcataaggtgattgtgcatatgttggagggtatgcatttgtaatttgtttctaaaaaacccacggcattagttttctttattgccaagtatacacaacattaattttttttattgccttcccatcaaaagtgtttatagagatagaatgtgtgcggatgtgtttataggatgattatatatgcaagtgttgtgagctcgtgttattttaaaaaaaaagttcccacaacatttaatttcctttgttgccatcccatcggagtgtacgttgattttacgtaccaatcgatcgacagaaacacgtactccctccgtattttaatgtattactccggtgactttttggctaacatttgaccattcgttttatttaaaatttttgtgcaaatatgagaatatttatgtcatgcttaaagaatatttaatgatgaatcaagtcacaataaaataaatgatagttacataaattttttgaataagataaatgattaaacgttggataaaaagtcaacgacgtcatacattaaaaatggagggagtactatacaccagccttgttgatctctcctctctctctctcgcgtcgctttgcgttgcgccatcgacgacgattacatctgttgcatcacccaaattaaggtgaaccttggtacttactgctggttcgtcatgtgcccctgtctactgcatgattgattccataatttgttttactgctcaattctgcgtgtgacgattctaggagatgttcggttagatctgtgatagtctatgatttattaattcttgtgattttggttgtagctaggatgccgagtggtgaatataattttcaaataagatatatgaatggtacgtcaaacgttggacacggatatccacgggtgtacttattttagtacggaggtagtagtaactatgtggtggggttagtaatcgagtgttctattagtgttcggtcctagcatactttggactgaccggtctttgcacaaatttgatttttttttcaaaaaagaaaaacttagctcaaaattcaaccgtcaacaaatatcaatatcaccctatacgtcgccgacacgacacaataataatcgatcttgtcattatttgcgttatttccgagacaaataagcttctcgtcgacctgttaattaattagatctcgatcttgatttggagtggatcgatcatatcatggcgctactacgctgcatgctcacgaggacgaggtttattatccccaaatcgtcagccaccctccggccagcgccgccgccgccggccgggctcctcgccgccctcggctgctctccggcggcggccggtcctctccgcggtctcgccactctctcgggtcatcagctggtacgtacgtacgtagaacgtagttcgatcatcaccggcctaaaattactatcgcttaaaaaaacgtgaatattaaagaataacctaatatcaaataatttaaaatgggtgaggcttcaaactcaggtcatctagcccaccaccttatggagctagctgaaagatccatgggtctcaattctaccgcttgatctgcagtttacatgcaattatattcatgcaagctagcttgattgattattactccacgcgttataagtgtctgcgcgtttgtactgtgtttctgaaaacataacaatgtaagacgcaactattattcttcatgtttggtaatacaagacgtgcatttatacatcaaaataattatcatatcttcttctaaatttgttttttttaatccttcaccctcaagataattttattggatacatacatcgtatttagtaattatttcttggtttttacgttagaggtagttacaccttatatttaggattgagtgagtacatacttccttcatttcatattataagactttctagcattgtccatattcatatatatatatatatatatatatatatatatatatatatatatatatatatatatatatatatatatatatgttaatgaatctagacatatatgtgtccctagattcattaatatctatagaaatatgggcaatgctagaaagtcttataacctgaaatggaggcagtacaagccatcgatcgacgattttatcatatcttttggtatatggtatatgaatatagtatatctcattttataatgggttatttagattcatgccactattaattttacagatttaaagtatgccactactatttatctatttaaaatcataccgctacaatttaacacatatttaaaatatcactacttacccttttcataaaccgaaatttatttatttattaccaaatttctcctatcttcttcccctgatccccttctctctccactccccttcctcctatgtcccatctctctcttgatctagaagagacctagttagcttaggtcaagggaaactgagatccaagagagaatgggaaggaatgagtggagagagaagaggatggataggggacgaagattttggtcatttggtccgaaaataaatcccaatgcattgaaaagctatgtagcgactttataaatatatattacattggaatgctatgactccaaataaatgaataatagtgatttatttcaaaactatgaaagttataatggtgtaattaactcttttttaataaatgatgtaattgaatttttttttcgttacattattctctttcataaaatatttttttttgcaaataggcagctaggcatgcttaaagtagttttaaatttttgaaagaactttgcttaactaagcatttgaataaaaagtgtttgtgaaaaagtatgagaaaacgataaactgcatcatatttaaaaagatggagatagtatcatagtatatcccaatcaaattaaggtatatgtacttctccaccatcttcaggcaggttggtacgtatgtagttcgtcatcgatcaacccagcctcttaaatcgtgatttatatattctttttctcccttgatatatcgatatgcagttaattaatcacataatcagatgcaatcaacaataatagtaataattatatagtataaataacactggacaaccaaatagcaacttcgtgtcaaataattaagaaagtgtaggcggcgtacccctttcgctatactatcatgtgcatttcattgatcatataccttttgatacccatttctcgatagaattaattaattaattgctcaaatattgttgttaagtttagatgctctctgctgataattttaaccttctctgctgataaattgttgtgacgtttaaaccgacaggttgataaaggatgctgtagcaatccagtcgcaaagagaggagcatttgtgagggatgttcttcaacggtttggactaagaaacttcagctcttctatgtattctcaaaagcatttaaagctgtcacctcaaataagtttatttttaagtaatcattgtgtcgaagtttataaaagaagagaataattatgttgaaagtagataaagtagaaaatagttgcattgaaatttgataaccttgggatattttaatctttttggtttattggcatgtgtcgaatcaatgaaaaatgaatttattttggaagaaaggtagtaaatatttgctgcctctagccacgaagtttccttttcactttttaaatgtagaaaattagaaagattttttccctataaattatgcgaatcgctcatcactcaccacttcaccagagaagccttcggccttctacaccttctctagctcaggtgatcaccaaatcattttcatgaagaaatcaatatttcaaatattaattgtggacactttattacatgagcattaattaagtaaatatgtgccaatatattgtattgtttggaaattaaatatgtgccaatagttgcagttttataaagcattagggccacataattggtgttatatacaccctacatgttttaatagatggtgatattgatttttcgacatcatgtttgttcactagttttattaaaatgtctaaatatcatttgtttttattgtgattttttattatcaaaggtagtttaagtataacaaatttattttctatttacactaaataagacaaatggttagacgcaacgtctaaaactcaacgacatcatcaattaaaaaatggaagaagcaaacgccaatgccataataaccaaggttttctacaacttttattaatttaaccataaaaccttttgttattttgttaaattttctctattaaatactacatcaaataaaccaataattcttccaaataagatattactagaaaaacacccatgcattgcaacgggtgaatgctattttaatcgataattgttagattttttctctctagaaagtatatgggatttatcaccaagtactagcaagcacaccatatatagttattttgatcatgttaccatgtatgcatgcatgtgtatatgaccatcaaacagcacaatcatgcatcacttagaagcttggcgtatttattttttaatagaatagtacttagaagctttgcgtatttatttgatagaagaaaagattactgttatttatttataggcacaaactttaggataagatcgacaccgagagtaccaaataaaccttacatatttttttcttatcgaaaatttgacttatcccattattattcatgtatctaaattacacatctagtcaaattataatttgactgcacacatctatttgagaaagaacatacgggagtaagtttcatgtctttgcctcactttttttttttttgtctagggaggagggaatacgcgatgagaaaaatactgtccactacagttttgggtgtatattttgccatggccgccctatgtctcattctgtttgatcttgaggattggtttcgtgattatttttcttatgttccttatattgctggaagaataaggaaaaaaaatgcacgtagcataatactgaaagccaatgctcgcggttctaatgaaagcgagagagaaacaaagcaaaaattgacccaaaaatcctcgagttttgcaatgtgtacctacaaaggaagaaataattgttcatggattctactaattacattacttcattgacaaaatggcttggaatgctccaagttcctgtggttttaagcaaattacagtaaccactatgcaaatttcagtgacatagcaaccaaggacataatattcaagttcatgtttaggttcataaggttcgaataacaggattaaagatcgtgcttaggatgccaatttagcttaacaaatgtgactgccacgcgacattaagctgtcaataccaagggcattaaaatctgcatgtagccttctccaatggcaccttttactgtctggttcaatagaatgcatgcactacaaatatcatagacaattaaacaaatactaagcaaaagcacaactaaaattcaaaaccaaaccacaaagcatagcaacagattgaattcctgaaagattggacaagacacgagcaaatgcagtcatacacaaaccacaacaaatgggcaaacagatcctcagcttcggatgatgatttgtattaaaagcagacgattttcagcacggtaaacataaattcagaggttcaaattttgctcatatctccctggctcgcacttgaaaagaattcttatctcctagcaagccctagaaccaagcataaattaaaacaaaaggtacagaatgtcgagcacacgttctggatataagaatgctatatctagtgcgatttgacatagtcctgcactatgttaaggccctcagactcttcaccatagtcctgggaaatgaaaatgaacagccaaacattacaaattgccatcttcaaaggaataattccaagtgttaaggtgagggatcgattagttaccttgacaacgacgcaggagcagcccacaaccttccttgccttgccctcagagtcaatcttgcaaagctgcaaatgacaatatgtattgttaaaaccaggacaagaaggcttttcatataactgtaaattaaaagaaatacacagaacaaaggaaggtggacaatgataaatcataaatatacgtgccaacagaaatgttcaaagtttccccacaaataaaacaaatatactacctccatccctaaatatatgacggtggttagttgaaaaatgaactaaccaacgtcatatagaaaagaacagagtataagaatatcaatattaacatatagtaggcacattctcctttaaacactggtgaaagaatgtctactcatcaattgaacctacatcctatatggccctcagtgacagagacaagagggatggccagtggcctggccccctccaacaattttttttcacataatcatttaagtagttaggtaattaagctaagtgacagtgtattcggccccctccaagagtcttaggcccctcccatgtttaaatcctgactccgccactgatgggtgatggccatataggcaccagttaacacaaacaaaggacaacaattaacaaggtatagctattaggacataggcagcagactaacacatatcaagaaaaacaattgacaaagtacttagaagaatcctgtaactcacccctgcccactcgccaagagtcttagcactaggcccggtaacaaggtgaacgttgtgctcagcacacagagccttaaccaacttgacataatcaggttggtcgcagtcctcagcaagcacacaaagctgagcagcatgcttctcgatggccttggcagcctcacggagacccttcacaagcccatcatgagcacttgacttcttcatcacaagctgcagagcagtcatcagatccatgggctccccaagaaccggggcagctggagtctcaactggggtctcctccctgtaaaagtgtttagatctcagcgaaaatgaataggctcgctacaatacatcaatgtttcaaagaccgagatgcacataagatctattaacaattactagtaatacactttacaaggtatttttagttctcttctaatttgactgctctttcaataatggaggtccaaatactttggcatgtacgtggtgttacatttatacaagaattgagcacccataatataaaaaatgcattgtttctcactactggtgacactgtacaaattcagtacttcttggatgcaaacaagacaattaagttggataattcaattccatataaacatagtttgataagcaattgagctttttttttcaatctggctgtgaatttaccgtctacactccttggtgctagtacagaacaggcacatatcatctgatatgaatcatgattgtatttgctaaactagacggctcacatacaacgaatccaccaactatactaccagctgccaaattctaaatcaccaagaccccataccagtacagcagaaatccgagcaatcgcactcatgactcccacatcctttcactcaatgatcccatcgaaatggaaaccaaatgacaatttccccaatcaaggacaactcaaacatgataagaccaaacgattcttgagcgagcagtagcgcagccaaggctcagcaacaattacacagtaataacagtgttctaccaacagcagcaacagcaagaacaggctagatccaaaatgctacgaggatagagagagaaaaaacatggaactagcagaggccaagaagaagttggttgcaagaacttacgccatctccgcgctcaaaagaccggaacaccgactgcgacgaaacgatctgcaacaaggaaaacaagcgttctcagcacgattagcgaccgccggcgcactgacgcggaggaacaagaagagcaacggcggcgccgcctaccttgtggcgaagagcggcggcggcggcggggttagggttttcgcgaggagggtgaggagtgagccgcgtgggagaaggtgttcttatatatcgcgttcactatcgggccctgatgggccgaggagctccccaattgggcctcataatgtccagagttagccttttgagcccacatgaggcccatcacgtgttgcagggatgcacatgggccggcccatctcatggcccacctaagatgagtcatgggctcttctggctttcactctgttgtgctaattgtggtgctttgtggatgagctctggcagactacggatctgtttggggagcttctagcagctgcagcttcttctaaaatcttcagttgccagaagctcccccaaacagtccaactttttatccagattttgagaatctgtagttgtagaatctagaaaatgaactataagccaaagctggatttcccagcttctccagattctcactagctagcttttcagcagctgcttctcagaatcttaagctccccaaacaggccctacatatgtcaccttcagaatcagaacactggtctaatgatgtgtcattagtgctaagaaatcagaacaaatccatgtaggagaataatataatccattgattgtttcttccttgaaaaggaaagatggggcgccaaacacatgtgcgtacatacatgcatgatgcatgtgtgacagttttaattagtgtttgcaaagatatttctgccacaagtggcactctatgaatcattatggccatagttcatccccactctaagtagccggtgagagatttttttttagacatatagttagtaattatttgattaagatcatttgtctctgagctttaagtctccctctctggttggctatgtcaatgtgtgggctacacgatgatatttgacaataccacttgaaaacgacatgatcacatactattgctgggagaagaaaggcttacttaattaactagtggacgcacagcataaattcttgtatacgcacacttcaaaaaagaatcaaattaagttaagatgagaaaatgaaatactcaattttcacatgaattaattcagatcctgcaaaattccttaaaaaaactttggtttcgaaggaggcctatactattggatggagtaagttttttttttatataatgctcgatgaagaacgaatattgcgcactatagattaatggttgtgaattgtgattaagcatgtcaataatccaatactttttattttctagatgacatggtccaatacatattgagaaataataatttctagatgacgtggtccaatacacatcgagaaataataattatgtaagtgggtctgaattacatagtaacatggaattagtttgctttatttatccagcaaaacatgagcttgggatcatgggatgtgaaaggttgtaaactgcaaagccctctagtccctactttaataaattaatcaaaataattagtggcttactttattctcccaattctcctctgcctccaagttgcatgaaactgaaaggcagataattatagtgctttgctttaatcccaaggaaaggagaaaatctcctgccaaattaagctggtattctttttattcagaaaaaaggagtataaagttggtatatatatatatattgttcgctttagaagaatcctaaaatttgtcggttggtatacctttgaagtttgaactagctttgagcttttgccagaaataataggtaaaaacgttgtattgctgcaaattaggaggtaaaaataatctataattaaccttggcaaatttgacaatatctatgtcggtgacatggggccgggggtatcgtgactagaggcttgggtagccgcggtcacccacgtggcctgagggcccgagggtgacgtggccacccctccctctgtccccccgaggggtcgggccgctcccgtttcggccccgagggctggggcgccccgaccccctgtggttttggcgccacgtgtgtgggttagatgagcacagcggggctcacctaaccgcatttataacaggttggacgagcgcgccacaccgcatttaatgcg

SEQ ID NO: 34690 - DNA, 2144 bp, Oryza sativa
agccagctagaggcccttgtggtgacccctgactagataaaaaggaggcccaggcctaggagagagagagggaagagaaaaaaagggaagaggggttgagactctggcgaatgggttctagaccctgaactcttgctcgctctccggctctctggattccttcacgcacagatccaccagaacacaggagtagggtgttacgcttctcagcggtccgaacctgtctacgtcgctcgtgtcttgtgcatttcctctctcgcggacgttcctcagatcgagggcgaagaacctcacttagcgcccccggccgaaccggcaaaggggggcctgcgcggtctcccgatgaggagccccacgctccgtcaatctagttgaaccttctttgaataatgatgacctagacgcgagctcccaactgtcaggaatggaacatctcaccagctcaaggacgtggcgtgattactagccaagtatactagcgatgcattttgatcatgaaaagggccggtttgtttttttcttttgacctagaaagaaagtactcactccatcctaaaatgtttgacgccgttgatttttttaaaaaaatatttgaccgttcgtcttattaaaaaatttaagtttttttctatcatttaatttattgttaaatatacttttatttatacatatagggaaggagggagtactttagtatgtacggagcagcttttgcatatagtaatccaactatatatgccagttcagctcgtgcgagtaggctcgggataataactccataggtagtatttgctatgtctagttggggggtgtttagatggggctaaaactttttagcccatgtcacatcggatgtttggacgctaatttagaatattaaacatagactaataaaaaaactaatttcataaatgagagctaatccgcgagacgaattttttaagcctaattaatccataattatcaaaagtttactgtagcatcacattgtcaaaatcatggcgtaattagacttaaaagattcgtctcgcgaattagtccaaggttatggaatgagttttgtaattagtgtatctttgatactccaaattaatgtccaaacatctgatgtgatagggacttggaataagtctctgaaaacaaataggcccgaatgggtgccatatgccaaacataaaccgaaaataaaatcatataataacaataaacggggtattgcgccgtggctaggaatgggaggccatagtgagagaaatacataatgaagcctaaaattgatagccatgcatatcccacggtattattatcgcaatcgacaggtagagaatggcggaagacacatagacagccaatcacgacgactcgcaaaacattgttaagctaatttagcttatgttggcctatcatgcccttctaattttagttctcgaccatagttatgatattttgggatttagcattctagttatgctattaattaagtattttaatatttcatataattacgatttagagggccctgattttaggaggcactaaacagtcgcacacctcacagatgctaccgtacggccttgcgtcgagattacaaagttgacttgtccactttgacactgaaatatccatcgtatattgatgcaagctaggagtttgagttgacaagttaattggaaatgccaaataaaaaatctgttaacatattaatcatatggatgtgcaaaactcgtggcttggctcgtttgaatttgcaaatgagttgagctaagggtttagccttgagttggctggtgagttagctcacgagtcaaatgagccatgacaagcctcgcaaaaaaaaaaaaggccatgacgagcaacataagctagcaacacaccagcagtctaactagtactaaaatgctaccctctccggcctataatatagggttatttggaaccatgccattataattttacaaagtttgagatatgtcatcgatatctcaatgacatgtaaaacccacatgagtcaatgatatgtgggtcaggatgacatatctcaaattttacaaaattataatggcatggttccaattttccctataatataagtgattttgggtggacgtgacacatcctattacaatgaatctgaatagggattt

SEQ ID NO: 34691 - DNA, 15802 bp, Oryza sativa
ttatattatgggacggagagagtaatctctaacagaaaaaaaaagaactccaacctagtacatgtgttatcctcgatttgggatccagttgtaatgcacaggatctaccgttcccggtgttagggagaacggagaccgtttgatcaggatcgaaggaatcgcattagctcacattgttctcctcgcatagtcgcatgaacagtacttctctgcagtactgtagatgatccgtcatcctcatatgtggcatttggccttctcgatcgatccctcccatctactagtcgtctcgtgccgctccgcttattcatagacctgaaaatttggactgaccttgctatatatacatgtgtttggtggattgtatgaaaatatgaagcaaactatgatttactatagcttggattgtatacaaacattttgtaaacttgaacagattaatgttggtttgagcgtgttggctcctgacattaacaagccaactcatgtaggcaaacgagccgggtcgagctaggcttaacgagctagtttagtttttgttattctatcaatttgttatcctaagtcagaactgagtccagttggcttgatatccagccatatgtgtgcacagtagcaattgaaaaagctataagaaatccattgacatataccaccaagatcgaacgtgaacaatttaatgcatatgttaattaggctttacgtatcacgcgttgcattatcttgagtcaaacttacgtgagtttcgtcctaagtcggactattccaataatcaagttcacaaagaaaagtattagcatgtataactttaaataaataaattataaaattatattttataatggatattatgctcatttgatatataaatatttttctaaagattttggctaagctcatgatagtttgactaaagaacaaaactaattttcaacggagggagtaacacaaggaaggatgtattcattagactatagctaatggagcatgatttcgagtctagactatgacatattcatggcaataattattctttcagtgatataagacatatccattaataatgagatgtccacgatgattttgtcaaatctcaatatataccaattcagcctttagaaaatattctaaaaataggacgtacatgtgtgtacgttcataaaaacaagtgtgtgcgtattgtaggcgtgcatgtgtgtttcaaagaaaaaagaaaaaagaagtccggacaagcacctatggttgagttatttttaaggacggatatatacgagtgcacgattgaggccgtgtttagttctcaaaataaaaaatttcacgctgtcagattgaatgtttagacacatatatggagtattaaatatagaaaaaaacaaattacatagattaagtgtaaattgcgatacgaatcttttaagcctaattgcaccatgatttgacaatgtggtgctacagtaaacatttgagaatgacgaattaattagcttaatctgtttcttttagaaatctaatttattttgttagtagaatacatttaatattttaaatgtgtatatgtatatccaatgtgacaacgtaccaagaacaaggcctgaattttgtgcgtgactgcgtgtgcgcagcgcgtcccaagcgttttcccttccgcctcgccgtcgtcgacgtcgccgtcacgtagcgtaggcaggcacatgcgcggcgcgtgtgagcgggcggttggacgacatgtgggcggggtgtcggcagcccaggcttcccccgccacgtggctttctctctcgcaaagcgaaaggcccaggagaagtactagtagaaccacacgaatgggccccacaacaagccaggtcctttcatatccactgggctttctttaattccttttacaattttattattattctcgtgaccaaattgcccccctgctgtgccatttagcgccccgctgcaactgcacgtgggccggtgcacccacagatacagcaccgttgccgttgcccgttgcccgttggatcctaggtttttccttcaaatctctttctgttatgactactcttttttcctttttctttttcatgccaagtatggctctttgttagcgcggcatatgccgacatggacaaatggacatgcccaagctttaaaaaaaaaaatgcatgcccaagcctatccatatatgccagtatgtacacacacccatgcttgcttgttttttatgttttctttttttctttccatatgcgcttctttccagttcatgtcaacatcacagctcgttctgttttttaaatagataataagtaccaatgagaatttaagagaatgacaatgttgaattgttctatacgaatgtaatatactactagtacatgtttactgaagttcgtccccctcccccttttaattttttttaataaagtttaatatcacgatgtcgaatggttctacataaatgtaatatatagtagtacatatttagtgaaattcatcttctccccgcttcaaaaaaaaagtttacacttcggtcatcatttataattataaatgtgtattaatttaaacggatacatacttaaattttcttaaccctatacttttccatcccaaaatataagaatctaggattaaaaaataagctatccatattcgtactactagaaaatgcctcatccagtttcttttattttgagatggagggagttcatacttaaacatgtagtttgtactatttatctaaataacttattgcgtgtttttcttacttgtcacacttaatacacttgataaatactttaatctttccataaattgaacaccattttttaatacatcccaaacactccccgtatcttcaccacctgtcaacctcgatcactctccatcgccaaggacacggcttcaaagggtaaaacggtcactccacccgtgaagtcaaaaaagaaggccctactgcttctttccagcagcaaaagcagcgaaacaaattttttttttttttgcgagggcagcgaaacaaaattaacaatcagatataggggcaatacagtaattcacgctttcctcctttgtctcctccccttcctttgcttgtctagtagtgtcttcttcctcctctccctttccttcatttggcaacctccacaactcatcaactccactcctcccctcccctcgcaaaccaaacccaagcaaagcaagcatccaatgcttccccccttcctccctaatcacccccgctaatcgctcccgacgccaccactaatcgaagccggaggagggaggcggcggcgggatggacaccgcgtcgttcgtgacgtcgctgctgacgtcgttcgtgatcttcgtcgtgctggtgctggtgttcacgtggctgtcgagcaggccgggcaatgcgccggtgtactacccgagcgtcctgctgcgggggctcgacccgtgggaggggcgggggcgggggacgaggagccccgtcgggtggctgcgccaggcgatctccgcctcggagggtgacgtcgtcgccgccggcggggtcgacgccgccgtctacctcgtcttcctctcctccggtataataataatagcaacaacatccctctcccctgcgctctcttagttcagttcagttcagtttatttcaggagttgagttggttgtgattttgctccaacggaaaaaaaaaatggtttcgtgcgatttcttcgagtattttcgggtcggggagttctaaattttaatttctaggtgcccctgtagtactgaatcccaggaaatttggtccagagatttcttctcacttttgtttttttgttatccttttgtttgcagaagtagtagtaccgtgtattatatataaaaaaactgataaaaaatatttttatgtttcaccgtttcatgtaccaacataaagataacaattactactaattcatgctttcttagactaaacaatttatttggagaaaattgcgtggctctgtaaggccttgtttagtttccaatttttttttcccaaaaacgtcacatcgaatctttggacacatgcatagagtatcaaatatagataaaaacaaaaactaattgcacagtttgcatggaaatcacgagatggatcttttgagcctaattagtccatgattagccataagtgctatagtaaaccacatgtgctaatgtcggcttaattaggctcaaaagattgtctcgtggtttccaggcgagttatgaaatttgttttttcattcgtgtccgaaaaccccttccaacatctggtcaaacatccgatgtgacacccaaaaattttcttttcgctaacaaaacggggccaatttataggggcaagtcgtgctgaatgaaaggttggctatagaaaactatgatgcatggaggattgccaagtatgaaattcagcatgttaattgatttatgctgcactttactgattaaatttggctaaggtgccattttggctaaaaatagctaagttgatataacatattgacttgccacctattatgacaatttgtttaataattttctcttatgttacagtgttgtccatcttggtgttctctgggattgtgctgcttccagttctgctacctgttgctgctactgacgataacctgaacctggaaagggctattggcctgaagaatggcaaaacaccccagaacttcacagagctcgagaaattagcactgggcaatgttcaagtaagtggcccttcaactcgagtttacttgcatggcttggcttgttaccagtttatgatgtatatgactataggaatcgcacggcaccagtattttgcttgctgagattgtcccttctgtaaaagaaaaggaacaaatataagcatgttgttatatacaaaaacatggcaaccatattccctgattgcttgttactatttacatgtcactgtatgatcattgatcagcctagtgttcctttctgttctgttagctccgccatttccaaagttttgatccaaatggatttgtgatgatcaatatccttgaataactgccatatcagtttacgccctatggccaattggcttgtagcccagtatgagggcctgtttggtacagctccaactcctaaatttagctccaagagtccaggagttgggtctggagtggagttgtggagttgcctaaacccagctccacaactctagttcattttgtgagagagctccacccagctccacttccagttttggtggagttttggtggagctgaaactgtttggctgaactccaactccaggaggggtggagctttagttggagctgtgccaaacaggccctgaattcttgatgtggctgcttgtaaagtctctcaacattgtattatgaatttgttcatgtgtaaattatgagcaatcaattagtacagaaactggtcttttatttttctgtagaaattgtagagatagaacttcctaatctccagtcaaggctagcattcaagatcctgattatcatataatcatactcacagccaaactcctttacattttctacaggaacatagccgaaggctgtgggcatttctattatcagtctattgggtctcttttgtcacgtacttcgtactatggaagtcctacaagcatgtttctaatatgagagcggctgcaagatcaacaccagatgttaaaccggaggagtttgctgtgttggtgagagatgttcctaagccacctcctgatcaaactataaaggattctgtagactcatatttccgagcacttcatcctgataccttctacagatcaatggttgtgactgaccacacaaaggtattgccactcttaagatgtttttagggggactgatggtccttgttttatctttcttgtatacttgtgcgacatgtctcagaatgtaccccaaaatccatgtattctgatcataatgcactttgcaggctgacaaaatttatcaagagattgaaggtcacaaacagaaaattgctcgtgctgaagttgtctatgcggagtctaaaacaacaggcaagcctgagggcaccaagcctacgcatcggattggatttcttggtcttatcggtaaaaaggttgatacaattgagtattgtaatgaccaaatcaaggagttgctgcccaaactggaggccgaacagaagactacccttcgtgagaaacagcaacaggctgcaattgtgtttttcaacagaagatctgctgcagcttctgcatctcagactctccatgctcagatgtttgataaatggactgttgagcaggctcctgaaccacgccagataatatggtctaatctttccaagaaaatatatgagaggcaaatcagacaggttgtggtctataccattgtctttctcacagtggttttctatatgattcctattactgctatctctgctcttacaactttggagaagttgagggagaagcttccctttctgaaggtggtggtggaccaaccgaaaatcaagactgtcctacaggcttacctcccgcagcttgcacttattgttttccttgctttgctgcctagtcttctaatgttcctctcaaagctggaggggattccttcacagggtcatacagttagggcagcagcagggaagtacttctacttcattgtgttcaatgtcttccttggggttactattagttccacattgttcagtgctttgacaaccataatcaataaccctcctgggattgtgaacatgcttgccagcagccttccaggaagtgcaactttcttccttacatttgttgcactgaagtaagcaatgctttcttctcacattatgtacctggtattgtcagctatttccatcctacacgtctgtacaattcagaaagtaacttttcatttgtttttgttgccagattctttgttggttatgggcttgagctctctcgcttggtccctcttatcattttccacctgaagaggaagtacctatgcaagaccgaggatgaagtgagagcagcttgggctccaggcgacctaggatataacaccagggttccgaatgacatgctcatagttacaatagtgctgtgctactctgtcattgcacctctgattattccatttggtgttgcttactttgctcttggatggattatagtgaaaaatcaggtgagccaagagttacttgctttaaccgaagttttaacacactaatattgaaactgaattggaaaggacaaattaattagtagtttcccattgtcgaatgtaggttatgaaacctacttcagcatgaacttctgaaatccgctttcaatcctttttaatactcttgagtctctgatgatagccattgctagataaactttgtgacggggtaacctttcttttaacgcaggttctccgagtttatgttcccagctacgagagcaacgggcgaatgtggccacatatgcacacaaggatcattgcagctctactgatttaccagatcaccatggttggtgtcatcctgctgaagaagttcttgtactcccctgttcttgtgcccctcatcccaataagcttcatcttcgcctacatttgccatatgcggttctacccggcgttcgccaagacccctctcgaggtggttcagcacaacgtgaaagacacgccgaacatggatgccgtctacacctcctacatcccggcttgcctgaagcctgagaagctagaggatgtggatatcttcgaagacgcccagttgcacaccacctccagagccccatccatctaatgcaagtgctggttgcttgtgtcgagaccggagagtattactcatcatcactgcaaacgaatttctgatgaatttccacgttgaaatgaacccctgtgaagtgtgaatctgctattgccaggataggaaaacttatgtcatgtccgtgtacataatatgcactcgggattgcttgccttcttaatgtgtgtgttgaggtttattctttacttcatagttctaggtagctgctgtggatatcgcgcctttttaagtttaagtttctatcatatgttcatgctcgtggtgactgctaaatctagtcctcttatgtgtaacaaaactcagaaatctgttgcctagtgcaccgtaacctgattgataatttactgatttactcattgttactgttcattgaagctagtatcatggctgactcggtgtccgagaatgttgtcatttttgctagaatcttgtgtattaaccctggagggcaggcaggtcgtgagttgcaagttgcaaccgctgcactcgccagcggacggtggcctcgccgtcgtcgtttctccccgttggcatgggcctttttgggcccagacatattggcccggccttggcccatctaaccagcccaccgcgttgggccggagattcccggcccactctgcagaagagcacggctcgaaatcgcgcgaaaatccacagcgcccgcgcgggcggcggcgcacgaacggcggcgagccggcgaccagatgcccctccgatgagcgaggcgatcccgtccacccgcccggcgctgcgccactgcgtcgcgctcctccgcctccacctcgccgcgccatccctcgccgccgccaagcagatccacgcgcgggcgctccgggccggggtgcccacctcccacccgctcctcgccaagcacctcctcttccacctcgccgccctccgcgcgccgccgctccgctacgccgtcgcggtactctcccgcctcctcccgcacgggccactagacccgttccccctcaacaccgtgctccgcatcgccgcgggctcgccccgcccgcgcgtcgcgctcgagctccaccgccgccgcctcgcgctgcccgacacgcacacctacccgccgctgatccaggcgtgcgcgcgcctcctcgcactccgtgaaggggagtgcctccatgctgaggccgccaagaacggcttcgtcacgctcgtcttcgtccagaactcgctcgtccacctttatggcgcgtgcggcctgttcgagagcgcgcataaggtgttcgacgaaatgccggtgcgtgggcggaaccttgtctcgtggaattcgatgcttaacagctttgcggccaacgggcgacctaacgaggttctcactgtcttctgggagatgttgggcgttgactttgcgccagatggattcaccatagtcagtgttctaaccgcttgtgcggagtttggggcgcttgctcttgggaggagggttcatgtgtatgtggaaaaggttgggttggttgaaaattcgcatgtgagcaatgccctgattgatctgtatgccaagtgtggtagtgtcaacgatgcaaggaggatatttgaggagatggggttggggaggaccgtcgtctcttggacgtcgttgatcgtagggctggcagcgaatgggtttgggaaggaggcacttgagcttttcagtctaatggagagggagaagttagtgccaactgaaattactatggtaggagttttgtatgcatgtagccactgtggattggttgatgatggatttaggtatttcgataggatgaaggaggattatggcatttcaccgaggattgagcatcttggatgtatggtggacctgttggggagagcaggaagagttgaggaggcttacgattatatcatcacaatgccattggagccaaatgctgtggtatggaggaccttgctgggttcttgtgctatgcacaagaagctggaactagggaaggttgcttgggaacggttggttgagcttgaccctgggcacagtggagactatgtgctcctctccaacctttatgctgctgttgggatgtgggcagatgttcatgtgcttaggaagacaatggtaaaagatagagtgaggaaaaaccctgggcatagtctcgttgagctccgaaactctgtatatgaatttgttatgggagacaggtcacatcctgagagtgagcagatatatgaaatgctggctgagatagctgagagattgaggcgagaaggttacatccctcgcacaagtaacgtattggcagatatagaggaggaagagaaagagaccgccttaaactaccatagtgagaggctagccattgcatttgccttgctgaagtctcttccaggcattcctatcaggataataaagaacttgaggatgtgtggggactgtcatgttgcatttaatctaatatcaaaagtttatgatcgtgaaatcattgtcagggatcgaagtaggttccatcatttccaagggggggcatgttcgtgcaaagattattggtagttgattcatgtaaagattgacagtgataaaagcgtggtttatgaggttccatgccaatcagataactggtgctgagttcttgttgcataacatgttctgtagcatcatcatatattgatagtacaaccttgacgatggacactgaacactacctgatggtacaagtgagaaaactacaaagatatgaggcatgttatgcagacgacccagcaattattttgttgatatgcttataaggtaccagtacaagcgagaaaactacagagacatgaggcatgttatgcggacgacccccaattattgtgttgatatgcttataaggtaccaaactgtggcttttgtctgggatccatttctttccttttaattatcataccgaattttcaaaactgttttgattctgaatacatacatctttgaaataagccttataaaattgcctgagttttatcaaactttattctgggtgttccacttatatcggacctgatcctttttttaaagaacatatcaggcatgattctagttacaaatttaattccatacaaagcactactgtagtttattgcttggcttccctttatgtatattggtaagcaataaatgtttccactcattggctaccgatatgctatagaactggatgctgaaaagttgcactgcattaaactataagatctttcttttcgtttctttcatacaacatcaaactgtctaaagcttccagagcaaagttaagatacaactttcatcatgaaaacactaaagtttttatcttaatattatgcattggtgttaaccttttaatggatgttgcattgttccatatgtttctactttctactcatggggattactgttgacatttgtgtgcaccacttccatttatcctctttttggaaactgtttccagcaccatcccaaattcactatgtaaaatgtcttactagtgcgttttgttgcattctgtacgtatgccatttcagttttgataagttattttacttaacctagtttttttaatggaatcagcacaagattgtgctatttcattgaacaaggggtaaaaaagtacaggccctaggggcactggacctagttttttcaagatctgattttctttatcaggttctctcctgtattgaacccttgtcccaggttaaaacatgcagcattctccatgtaatcttcaggaaacctcttcattaggcttcactctttacaaagtgaatcaaggttcttcccttaatcctcaaggaaagcttttctcattaagccccgacatatgctaccatgaaacaacaaagaaaagaaattagaacatgcacttggcccctttcaatcttatggaatctattgcctaagtttctttttgttcttttagaaataatgtccatgcttgcacatcttgaaggcaaaaggaatctcatggtttcctggccttcaagtcattctcatccatattattctattatgttcataaaggtccctgcattggttgcacaatccaagaaccagcagctgctggtataatcatttataacatgttctgctccaggcattacaataactgcaacataaattaatagacgatcggcatggcgattctcatcatggtaaagctcactcatttatcaattcaatgacagcatataaaacgtcggtagggtctgcagatattacaattttgtaagaggaattatggtaaagtcatgtttgtgtagattcgaaccaaattagtcaaatggtgaccatatggccataggaactgggcgggtggctctctgatagctacaagatgcatttctctctgtacattggaaatatgggatctttgtgccacttttcaagccatctcctccctgctatggccataaatatgcaccacggtggggacttcttttagttcgtgtcttgcttgcttagtaattcgagtgaaaccctgaccctttcccatgaacaagacaagctttcctgttgatacagctgcccttcgttcagacactcaatatattccctaggccctcacattgaggagagagtggtagatagacaaagagggagagagctgagtgaaaagcagtgactgctttcagttcggtttcaaccatgaagagaaagcagttgatcatgcacagccttttgattctgggatggttcataggtgggtaactgcactgctcttgttctttgcccgtgtcttctccacaaatatttctcatactaagtatttgaatgagcttgctttgatctgttagtagtaccactgcaaactttatatgcataatctcagaactagctgtatctatgaacagactgttttgtttgttcacgtttagctgtaaatgttcagtcaatccgatcatcacaatgttctcactgactgttttgtttgttcacgtttagctgtaaatgttcagtcaatccgatcatcacaatgttctcactctgtcatttcctctgtgatcagtctcaacagcaggcgcacgcgtcgcgccacaggagaaggcggagtccgcgacgccgatcccgacgctgtcgccaccggaggggaacatgacgttcgtggacggcgtgacgtggtgcgtggcgcgcccgggggtgtcacaggaggacctccagaacgcgctggactgggcgtgcggccagggcggcgcggactgcaccccgctgcaacccggtggtcggtgctaccagccggacaccctcctctcccacgcctcctacgccttcaacatcttctaccagcagaacggcaactccgacatcgcctgcaacttcggtggcgccggaaccatcatcaagagaaatccaagtaacacaacaacagacagtttgtttacatttttacaattcagcattgttcagtgacatctgtaattgtaatttacatctgttctttgtgttcttgataggttttggatcatgcaagttcctggcatccgagtaagttcagtccataattgtttcagatgttcttctttctccttattacatatgactggtaaattaattaaattttgctggattggtgcaggacatctgctgcatcagcactgactcgaggaagcatgtggatgatcttcgcagctgcgtctatgatgtttcttcatctgagagttttccaatccgtgtgaattgggtcgatgctaccaaagtaattagtacctgtggtggtttggttctctttgtagtatattacttatgtaagaagcaaggaacagtgctagttttttcgtgtaaaattgtgaagattatatattactacctccatcccaaaatgtttgacgccgttgacttttttttaaaatgtttgactgttcgtcttattcaaaaaatttaagtaattgttaattctttttctatcatttgatttattgttaaatatacttttatgtatacatatagttttacacatatcacaaaagtttttgaataaaacgaacggtcaaacatgtttaaaaaagtcaacggtgtcaaacatttagggaaggagggagtatgatttaggtcgtgtttttcactctgtaataataatgaagtaaatagttagcaagagtttgtggagggttaatgcatggttaattctttgaattttgtttcagaaagctctcgcttgcatagccgcagaggtggagtaggtcacaagcgtacacaaacacaatagccaattacgagccatatggcccaatatggtgaggcccacaaggcccaaggtgacaaagccccgcatagtcagatccgatccgtaggttgaaatctggacggtcggcacgtcacgcacggacgcgcgcgcttattttagtaccacctcgagaattcgatcggagaagcaccagcttatatacccgcccgcgctagcctggtcatctcttcggagacatccgataaaattggaacgatacagagaagattagcatggcccctgcgcaaggatgacacgcacaaatcgagaaatggtccaaatttttttgagaattctgcccaggtccctggagcttatactttttatcgcagttatgccctcggttctttctttctgccccttctgctgaatctttttcttccgttctcgtccttcgtgtatgaaggcatagttaagttgtctgcacttcagcccctgaagattttttatcttataaatagaccctcatctgtttccttctttagtgctgcccattgttttcttagcagttatgccctcggctctttctttttgccccttccaagttttttcttgcgctatcgtcgtccatggcttcatcgatggaggctcatacttaagttgtctgcacttcacttcagcccctgagattgttttctcttacaaacaagttgctgtatatttcttctctgcttcactttttaataccaatcaggtcctattatatattgtgcattgctgataataatttgtttagtgcacctctttttttgttaggcaccctgtaatctactagtagtactttggagccataaggccaatcttataacagctcatatcaacatcacgtcctctcttttaactatttctttggctccaacaaacgccaatcatatcgtccacaaccacaagcatacgcagtgacgaaccaataacaaaagctaccaacattctatacatattaattatctaattattggttaatatattaattattaacatgatataaattagctggaactaaataatctacccggggtccgtgaccccgagatagtgaacgtagccacgtctgtacgccactaagcatatgctaaaactcagttcaagattttttaattaattaacaataagaatgcatttaaatgcaattaagaatctttcacccttgtattttcaccaattagacctcacatacgcggcataacttttttacattcctattttaaactgaattaatgccactagttatgcttaaaacatacatgtttttttaaggaaagctttttagtgccttttttatggcacttttttaatctacgatccttctacctaataacaatcaagcatatcatcacaatttaggatctccagagagctcgagacaggacgctgttcgctctagcgtccgcgcctggacgttagtcctagtagcgtccttactattttcataatttgcactagtacctctcacttactaaatatttaatttcaggataattaattattataggattaaaaacccggtatattcttagataaaaagaaataaaattcagcttactctattttagatccaactttcaaattatgcaactgcatgtcgcgtgaatattaattcctggtggcgatgacggacacattcagccccttttttcttgttcggagttttgatccaactcatacctacgttgaggactttgtgtcacacacgaaccagggatgacgagcgtattaacagattctgaacacatcacgacgtgataataatgggcatacgacttagcattatagggtagggttagaagaagaagtgtttggggcgtgtttcgggcttagagggatgactgggacgatagcagatt

SEQ ID NO: 34692 - DNA, 20922 bp, Oryza sativa
aatcgaagaggtcacctgtgggattgtcagagaggagtataaggcttgtttggttgataccctgataggggcgggccgaaaagctcgaggctcgttagctcgctcgactcggctcgtttcattttcctaacgagccgagctggcattttagctcgttagagataacgagccagctcgcgagctgcttgtgagccttaacgagccctcagcaatctgccaggccacaaagcccataggcccatttatttagaaggcccaatagacaatagtgagcactaaaagtgaaaaccctaggtcattcccttatcccttcccttccctgttccctttggctggcggctgagttctgtaggatcgaaacgcaagaactaagccaaccagaggggggggggagggtgaatggttggtatgcccaaaaacaaaaacttttagcagaaataaaagttaccctcaaattcacgagattggtctgaccgaagatgattcgctggtctgaccgccctgatgctgtcggtctgaccggtgtagatcgatcggtccgaccgctcgtcgccggtctgaccgcccttatgccgccggtctgaccgccactcgtcgccggtctgaccgccggtgtattgccggttggaccgccgaaacccggtgaaatacaaatcgaagaactcttaaagtggatgataactttattacttctctctgtgtttacaaagtgcaacaacaacactccttacaaaaatcttgagaaaactcgaaaccctaactcaactatcaacttaattactctccaaagcgataccgggaagcctcacgctccctctctatttatacccaaggtaggcagcctaaagccacgaaccaaactcatactagaagtcctaatcaccctaggaaaccttctcgtacaagaaacaaactttacaaaaccaattccaccaaatttggactccttccaaattcgactccgcatcccatacgcacacaatacctccatcctaagccatatggaaccttcaccttccatgtgtgaaagtgcatctaggcccctaacgattttggtgattaattacaatgcgattagagaggactaacatttttctttaagcaaaggtgaaggttgctatgtcctcaatgagttagcgtaatgcatttcccgctgaatatgttaatgagatgtgatgcggcaaatgagcaaatggtatattgtatcttttctttttgtttgagtcaataggaatgccgcactattaagagggatgatgcattgacatatgaggagtgatcaaagtgctcaacatcaatttttaaaagtgtttctcctcagtttgatgtgttctggaaatttttggagttttccgaaagtcattttcggactttctgaaaatgcacagaaccaattttcgcttctggaaattttcggatatgtccgaaagacattttcggattttccgaaaatgactgagaaggcaaatgtggttctgtttattttcggacttttccgaaattgattttcggagtttccgaaaaactttagcaaagccaaaaacgcttctgtgttttttcggacttgtccaaaagcgattttcggacttttccgaaaacatccataaccgtgtttttggttctggaaattttcggacttgtccgaaaagttttcggaatgtccgaaaaatctctcgttgactttgctgttggtgctgagctggaattttcggacatgtccaaaaaacttcgggaacatctttgtgagcttcatctttggtgactttacttcctccctctccactagcttagctttcttgagccgctataggtatagttgctgtttgtgctagcatattcttgttgtaggcaactagatctaggatttactttgctacttgtgctgactccgaaaattttcagatatatccaaaaatttcggaaatatccgaaaattactgcttccgcttttaattggatttttgaattagcctattcacccccctctaggcctaattgacactttcaattggtatcagagcctaatctcctaattaggcttaaccgcttaaagagatcatgtcgggccaaacgggggaaggcaaagatggtgataagggagctatatttccttatgactatccacctatatctacatcttatgtgagtacctatagcggcaaagctccgtacttcaatggtacggactatgccgcttggaagcataagatgaatatgcatttgaagtctattaacccatttatttggagaatagtcgaaaaaggctatgtgttgcagaatcccgaagatcccaccaaggaggacgacgagaacaagcacaagaacgctcaagccgctaatgcaatacttagcgccttgagtggaagtgagttcaaccgtgtggatggcattgagagtgccaaagtgatttgggacatgcttcggaacttgcatgaaggcacggatagtgttcgtgagtccaaggtggagatcctcaaggggcaatttgagagatttgtgatgttggatggtgagagcccaagtgacatgtacgaccggttgagcaagatcgtcaatgagatcaagggacttggctccaaggacatgaccgatgaggttgtggtcaagaagatggttcgagcaatcactccaaggaactctaccttggtgaccatcattcgtgaccgtccggactacaagactctcacacctcatgatttgctcggacgtattcttgcccatgacatgctcgtgcaagagtccaaggatgtcatccaatacatcaaccaaagctcaaccacaagcatcaagaaggaagacttggcattgaaggcgaaggaagaagaagaagagaatcgcaagagcaagagcaaggcggagatcgatgatgaagagatggctctcttcgtcaagaagttcggcaagttcatgaggcgaagcggcttcttcaagggaggttcttccaagcactactccaacaagtcaagtggaagacactccgcaagagtgtgctacgtgtgaaaagagcccggacacttcattgcggattgcccacacctcaaggatggttcccacatcaaggaagataagaagaagggtgagaagaaggatgagaagaaggagaagtacaagcatagcaagcgggaacattatggccaagctcaccttgggatgatcttcggctccaactccgagtcaagctcaagtgatgaagaaggagtcgcaacgttcgccgtcaagccttcatcaccaccgagactcttcgactactcaagtgatgaggatgctcccatttgcctcatggcaaaggagcctaagttaccttctcctctcaagtcatttaatgttgatcttgttagtgatgaggaggatgaggttgaggatgaagttatggatgacgaattgttcaagtccataactaaggaatccctaccacacttgagtgagttgcttgggagaattgaggaccaatatgcaactcttgagaggcaaaaggctttgctcattcgtgagaaagagcggtctcatgaactcaagagtgagcttgctaaggagagagaaaaaaatgaggctttggtacggctttacaagtaaaccaaagagtctcatgctaatcttgaggtggcgaacgctcaacttcaagatagagtggatggcttggacaaagcctacctctctcttgaagagaagttcgaaaccttaaaaaatagtgtctcttttcctagtgagccatcttgttccaaaattgtcccaagtaatgaaccatgtgtgagatgcaaagatattgatattgaagcttatgctactaactctatctctttgagtgccttgcaaaagcaaaatgagaagcttatgggactccttcacaatggcctacttaagtgccatatgggtagtaaggccctaaaggagtacctaggctatcaaagggacaacttcaaccatgagggtcttaggtatgttcctccaccaaaaggaaaggtggacaagagtgtgatgatcaagaggccccaaggtcttagcaattttgttaaggccaaaagtatccttcctaatgattatgcttcacattgttcttttgatgcatcttatgttcttagaaagaatgttagtggtcgtgttgttgctaagtatgtaggcccgaggggcaagaatatttctatcaagagagtactttgggtgcctaaggcacttgtcactaacatgagaggacccaagcaagtatgggtacctaaaactagaaattgatctcttgtaggaatatatctccggtggaagaagttgggtgattgatagtggatgcaccaatcacatgaccggagaagaatcaatgttttcaacacttgatccaaatggcacttcacaagataacatagtctttggggacgatggaaagggaaatgttatgggattgggtaagattgcaatctctaatgatctctccattgccaacgttctcttggtaaaatctctaaactataatcttttatccgtttctcaattatgttctatgggttacaattgtctctttaccgatgttgatgtgaccgtctatagaaggaatgattcatccgtggtctttgagggtgttctcaagggaaagctttaccttgtggatttttccccaagtaaagccaaacatgagacatgcttagtggctaagtccaacacggggtggctttggcatcggaggctagcccatgttggtaagaggaatcttcacaagcttctaaagcacgatcacatccttggactaacaaatgttcaatttgagaaagatagggtgtgtagcgcatatcaagccggcaaacaaattggagcacatcaccccgtcaagaatgtgatgaccactacaagaccattggagcttctccatatggaccttttcggaccaattgcttatctaagcattggaggtaacaaatatggtcttgttattgttgatgagttttcacgcttcacatgggtgttctttttgcatgacaagagtgagacacaagccatcttcaagaagtttgcaagaagagcacaaaacgagttcgacctcaagttcaagaacattcgaagcgacaacggcaaggagttcaacaacacgtgcatcgagagtttccttgatgaagaaggcatcaagcacgagttcttagctccatattcacctcaacaaaatggagtagccgagaggaagaatagaactctcattgagatggcgaggaccatgttggatgagtacaagacatcggaccggttttgggccgaagccgtcaacaccgcatgccacgccatcaaccgcctttatcttcaccgccttcttaagaagactccttgtgagcttcttacctgtaacaaacctaatgtctcttactttcgtgttttcggtagtaagtgttacattctaaataagaaggctagatcatctaagttcgctcctaaagtggatgagggattcttgcttgggtatggatcaaatgaatgcgcatactgcgttttcaacaaaacctccgatattgttgagatcgcgcgtgatgtgacatttgacgaaactaatggctctcaagtagagtaagttgactcacatgtgttaggtgaagaggaggacccgagcgaagcaatcaaaaggttggctcttggggacgtacgtcctagggagccacaacaaggggtgtcttcctcaacacaagtggagccacctacatcaacccaagccgacgatccctctacctcaagcttggatcaaagtgaagaatgcgagcaagtgccaccctcaccgatcaacttagctcgcccaaggatccaacaaagtatccaaagagatcatcccaccgacaacatcttaggagacatcaacaagggagtatccactcgttctcgtattgcaaatttttgtgagcattactcgtttgtgtcttctcttgtacctctaagggtggaagaagcccttaatgattcggattgggtgatggcgatgcaagaggagttgaacaatttcacccggaataaagtgtggattttggtgtagcgacctcggcaaaatgtaattggcacaaagtggatcttccgcaacaagcaagacgaggccggggtcgtaataaggaacaaggcgaggttagtggcgcaagggttcacccaaatcgaaggattagattttggtgaaacttttgcgccggtagctagacttgagtcgattcgcatattccttacttttgctactaacctcaattttaagctatatcaaatggatatcaaaagcgcctttctcaacgggcctattaacgagttggtatacgtggagcaaccaccgggcttcgaggatccgaagtatcccaatcacttgtacaagctccacaaggcactctacgggcttaagcaagcccctagagcttggtatgagtgtctccgaaattttcttgtgaaaaacggctttgaaatcgggaaagccgattcaactctttttactaaaagacatgataatgatatttttgtgtgccaaatatatatcgatgacattatatttggttctactaacaagtcttttagtgaagagtttagtaggttgatgaccaaacgttttgagatgtccatgatgggtgaattgaagttcttcctcggccttcaaatcaaacaactcaaggaatgaaccttcatttgccaaacaaagtatttgaaggacatgctcaagaagtttgggatggagaatgtcaagccaatccacactcccatgccatcaaatggccacctcgacctcaacgagcaaggtaaagacgtcgatcaaaaggtatactgttctatcattggctcacttctttacctttgtgcatctaggcccgatattatgcttagtgtgtgcatgtgtgcaagatttcaagccggtctgaaggagtgtcaccttgtggccatgaagagaattcttagatatttagtgcacactcctaaccttggtctttggtatcctaagggagctaggtttgatctcattggctatgccgatgcggattatgccgggtgcaaagtggataggaaaaacacatcgggtacttgccaattcttgggtaggtcccttgtttcttggtcttccaagaagcaaaactccgtcgccctatccaccgccgaagcggaatatgtttcggcggggagttgttgtgctcaacttctttggatgaagcaaaccttgagagattatggcctcaatgtatccaaaatcccactcctatgtgacaatgagagcgccattaagatagccaacaaccccgtccaacactcccgaaccaaacatatagatattcgccatcatttcttgagagatcattccacaagaggcgacatagacattcaacatgtgagaaccaacaaacaattggaggatatctttaccaagcctctagatgaagctaggttttgtgagttgaggagtgaactaaatattttggattctcggaatgtggattgatctattgtatgcatgtttgcttggtataataggttttgcatagcaccttgtgacaaaatggtcattcaactcatggatgggcactggtcacttttgtggagaacttgaatctatgtgtatggggatctcatttttcaatgaattttggtcctagcacaacttgaaatagattcacacattccctatctcgagggtgaattatcttgtctcatggtaattccctctcttttgatccctcggatcatccatttgacttgtggctattgttttgtgtgattgattgtgtgctagtcacaagttcaattggagcctatagtgctcgaccatccctccattcctaaatcctatccaaatctttgcgaaatgtgtttttgtcaaaaatttcccggagctagtcccctgcaaaattcctttaaaaagtttggaaaactgtttcttcaaaattccccttgcaaaactgtgttttccagaaattttccgactttctgaaaattttttggatttttcgaaaatttttcggaccttccgaaaatttcctgtcctatcgctcttcaatcaaagcaatcccaggatttttcggacattccgaaaattttttggatatatccgaaaaatctataaaagcgtgcacaaccttctggatcttttcggacttatccgaaaattttcggaaatatccgaaaatttcggggtctttttatgtcacctcgtggactcccttctctctcctttccactctttttccccacgggaatgactccctcctccctccccaccggagaccacctcctctctggtgacctcccgcggttcccctcctctccaacctcgtgggagcgcgtttggggcactccttgggacctacattgtcgatctccaccacgttcttcaagtgttctttgcgttcttgaggtattcgccctaaaatcaaatcctttgattcctcaagttttatcttgcgatttcctttggtggagatgttcccctagtgccataggacctgcagattcattttcacaagtttttgttggcggatttgtgcggcatctgagtaatagggttcggccggaatttttcggacttttccgaaaattttcggatttgtccgaaaatccttggccgacccctatcactttggatttgcacgattcttgccctcactcacttgtttcttgcttccttggcttccattcactgatcccttgtatctcttgtgtttgaaggatgcctccccgcaagcaaacctcccataagtccaagcgcccgagggaccgctctcccactccatcctctcatgatgattcagacggtgattggtccggtggagaggatgcggttcctcaggttgcgcggggggctcggggcggcaatcttccttctcggcggtctactcaagctcttggtggtggtggtgatggtgagggctcctctcgtcaaccgcaaacgccgccgcaccaacccaatgttcccattggccctctccgcattcatacccccgagagggatccggcggtgattcgtcacgtgtatgattggaggcgcaagtctgaggttgttgctcctcgccgcgatgaggatccacgctcccttcgccgcactgccacggatccgcggttttggactctttttcagcaagacttttatgagtctgtgatcaagtccaaagctcatcccactgttcccatgcaatggatcaattgggaggagttgcaggcgcacaatgattcggtgataaattctgtgattacaaattgtgatctcatgggtattcgctctttcatgactttgcagcaaaattggtgcaacgagatcattgctcagttttatgccaccgtctactttgatcattatcgtgccatgcactggatgactcagggatcctggtattctgtttcctatcagcagttggctgaaatttggggttttcgtcttcgctccttacttaaccttgatgacctgcataatcttcaaattcctgccaacactgagttactccctctttactctccaaatgatcctaatgtggtgttgggcaaggtcgatggtctcaagccgtactttgcctacttgaaccggatgtttcgccggtcctttgtgcctaaggatggtgatgctagcagcattaaccacctctctcggaccgtgcttcttaggtttgatccccctcctcatcgctttcatgtttatcactttgtgtgggaggaaatccgcatggcttccattcagtacaagaaggggttggtctatgcccctcacattatgcggatgatcgagactgtcactcagcttcagtttcgccatgatgtgactcattctcagcttcacttgcgcctagataaggccccccgctcctcagctgctcgggacatcccttcctcttccactcaggcacctcctgctcctgagcgccctgcccctgtggctcgtcgtgagccgtctcccttattccgcattttgcggagtctttttggtctttgctccgcggaggccaaaaagaaccgccggcggaattcggcgaagaaaacggctcacgacgtcaagttcctcaaggcaaggtattatgaggaccaccacattgatgtccctccttctcctccgggtttcgaggccgagcccgatgagccagaggaggaagcgattgaggatccatttgctgggttgcctcctaacttcgacttcttcggttatggccatggctatggctatcttcctccaccacctccagaggatcctcctcaggcgcccttcgcttgagtcgtcgtcgcatcgtcctctctttttttggtgtcttgatgccaaagggggagattttctctctatctatcatgtctttatggtcgagcacatttggtttttatttgtatgagactatgtgtggttgctaagttaagtttaatgctttgtaagactttattgtttaattatggatgcttgagatgtaatggatcttattatgtttaatgtggtgcaatgccttatcctatttatatggtgcttgtgatgagatgtaattattcttatgcatatgatgtgttggatgtgatgagcatatgtgatatatttgttctcttgtgagcttcaatgtggatgcaaagatttagggggagctctctacttgcttttatgcacactctcacggggagctttcgctaaacctttgcaccaaaaccttaaattatattcattttctcttatgttctaatcgtattgtcatcaatcaccaaaaagggggagattaaaagtgcatctaggcccctaacgattttggtgattaattacaatgcgattagagaggactaacatttttctttaagcaaaggtgaaggttgctatgtcctcaatgagttagagtaatgcatttcccgccgaatacgttgatgagatgtgatgcggcaaatgagcaaatggtatattgtatcttttctttttgtttgagtcaataggtatgctgcactattaagagggatgatgcattgacatatgaggagtgatcaaagtgctcaaaatcaatttttaaaagtgtttctccttagtttgatgtgttgtggaaattttcggagttttccgaaagtcattttcggactttccgaaaatgcacagaaccaattttcgcttatggaaattttcggatatgttcgaaagacattttcggattttccgaaaatgactgagaaggcaaatgtggttctgtttattttcggacttttccgaaatcgattttcggagtttccaaaaaacttcagcaaagccaaaaacgcttctgtgttttttcggacttgtccgaaagcgattttcggacttttccgaaaacatccaaaaccgtgtttttggttagaaccgtgtttttggttctgaaaattttcggacttgtccgaaaagtttcggaatgtccgaaaaatctctcgttgactttgctgttggtgctgagctggaattttcggacatgtccgaaaatctcaattattgtgcataacgggcagaatttggtctgtggctataaatagccccctcccctcacttgtgagggctgctggttctattgcaattatttgtgcccttggcttgctctctctctaacacttttgagccttgctttcttgtttcccctctcacccgtgttcgattcggatttggtgtgtgtgtgagagttgtggattcgagtttgtgtgagtgcttgttgttgacttcgtgaagatttgtgagcacttgcatcatctccgggagttctttgcttcatttgttactcttggaggttgaggactccaaggtggctaggtgtcgcccccgagccaccgatctacttgtggttggccgggagaagtttgtgaaggtcggatctcacctccgaaagggaagagatacccttagtggaaggaggagtgcttagtgcaacctctagaggaaaagggttagctaagacccggctcttagtgagctcctcaacggagtgtagaatcccctcaaggattcaaactttgggaacatcttcgtgagcttcatctttggtgactttacttcctccctctccactagcttagcttgcttgagccgctataggtatagttgctgtttgtgctagcatattcttgttgtaggcaactagatctatgatttactttgctacttgtgctgactccgaaaatttttggatatatccgaaaatttcggaaatatctgaaaattactgcttccgcttttaattgaatttttgaattagcctattcaccccccctctaggcctaattgacactttcaatgtgtattgaactctagccttagtatcccgcatgatctctgaccaccctggacgttgtcttatctccaagccgactcccggtccatcaccgcaaatactctcccggtatcaattcacctacacatgaaacaaacaaagaaaccatattctgagaccaagctatccccaacttgactcattgttagcaaacaacagtattacatacggatagtatccatctagaagtcatattcatgagataaactcagatatccaaacaaacaatccgaaaacgaaaccgacatagtgtcggccggtcagaccgcgggctggccggtctgaccacgcgtataccaccggtctgaccggcaaccactacccggtctgaccggtcacataaaataacaacacctgtaatttacctgcaaatccaatcatctccaaaaccacttcgagaataatattccaaatatcaaaaccaataatctccaatgccaattgttcatcacaaaataataatcaaaaacacctttgattttacaagttcgtggcgccgctgccacccaccccagcacccgacgtcgctgctctcccccagcgcccgacgcagcgtcgccaccacccacccccagtgcccgacgtcgctgctctcccccagcgttcgaccacaacgctcgacgccaccgcccgccaacaaccccagcccgccacctaccgacccacctatggcgccgcccagcagtgagcatgagctcctccccatggtgctggtgagctcaagctcgtttcctccgccgtcaagctcctcctcgtggttgcagtactggcgtggtcgagcttgttccatccaccgtcgagctcctccggttctccccgtgttcaccggtgagctcatccccatggtcgcctcccttcttgcttgcccccatagctcgtgagcctaacaagccagctcgagctttcaaacaagctgagccgagctaggtttctagctcgttaggataacgagccgagccgagctagctcgttatccattatcctaatgagctagaccaggccgagacgagccgagctagctcgctatctacccctatgccctgagcaagatgcttgagagaaatatatgcctgtgtggaaggaaatatatgatgacgcttaactaatcaggcacacccctcgtcttgttgtttggttggagtcctatacctaagataaaacatgtccactttagattgtgacaactattatcaaagagagattgaatggagtaaagccagacacgcatgttccttagtctggcgagcaactttggtggccctggcctgagcgtgggtggtcctcagggtagtaataaacaaacaagcaactaagaattctcaggtaggctttaggctaggcaactcctctctagggcaagcagcaaccaaacacatccccataggttctgtttggagaagtagccaagagttatttgaagatttaatttttagcacaagaaatagccccccaataaaatagcccttgagttgtttagatccaagagctatttggcctttaatgcactttcccaatcatgcgaggagtgggggcggcagtgctggtgggggccggcggtgcggcgggtgaacggccgcacctcctgcgaggagtggaggtggcggcgctggtgggggccggcggcgaggcgggcaacggccgccgcgccgacgaggagtggaggcggcggcggcggcggtgaaatatgaggcgcgtgcgcgtggataaggcagaaagaaggccatgcggagagagaggaaagccaccttttttagtgggttctacccgaaatatcttcaatgagcacctcttggataggatagtttttttatgggttatttccaaatagccctcaaatagctcacccatttagatttgttgggctatttgagactaaaaaatatcccataatctaaacagggccgtagtctctcacctaacttcactttcgagtttgctagatctgtatgtggagcgagaagacgacagaactgatgagacgagatggaaagaaagaaaaacaatgtgggctgggttagctacggatgcacgtgtgcagccactactacttaaaaaaaataaggatctttcatgacccttaagatttattttcactagcggccataaaaaacctcgcttgtaaaataaaaacagacctgaaaacttggtcccaccaataaaaatggatttccacaagcagagtcttaagagcactacttgaaaaaaataaccccacatatgaaaatccatttttactagcggagtctaagggttaccaccaacaaaaagatcataggagaagggcgtgtggatcaagtcgtccttatcccatccctcaactatctctttttcttttccatcagccacttcctcaaccacttcctagatatcccctccctcatccatttcctctcctctccctctcttgcttcgatggcttgatggcggcgacggcggcaagaaaagccatggctgggctcggtggtggcagcatagggaggagacttcatggtggaggaaggaccaacaacggccaggctcggcagtggaaaggggaaccgtggcgggctcagcggtggcaaggagaaggtagtgatggtggaggagcaggacacctgatccggtgatgacaagttcgtctatggcggtgaaggggagtgctgcctccaccatcaatccctactcgaggagagctcaaccacaacgacgaaggggagggcggtagtagtagaggaaggggagtcctagcttgtggatccagtggtggtaggcatcgagagctctagttctagtggtggcggtctttgggagctctggatctgctggtggctacaggttagcgataataaggacaatggcttagcgaaatcgaccaagacctccttcctcatctttcccgaccagatctgagctcgcctgacctcctttctttgaaccggcagcggtgatctcggcggctcccgaaagggcgtcttccacccatttggcgacaccgccatcgacgacgtcgactttttcatcgaccaagacgtgtggatttggggattgggaatttgagacagtgatagtggatcctgatttttaatattttttctcctaaaaacattctcgatggtgggtctctctagctaccatcagcgaaaatcactttttcatatgcgacctttttaccttagccacttgtcaaagttgattttcgctggcggccggctgctcatcagcaaaagtttattattttcactaatcttaggtcgttggcggcgccgctgactgcccaaaaaaacctgttttggctgtgagaaaaagttgttattgcagtagtgaccgaaagaaaaattttagaattataccgttgaaattcatttttcttagaaatatacgagattcgaaagaatttacactaattgacgaaagcgcgacaaaatcgcaaaaccaacgcgctattgtgcggtctcgcagggcgactgtgcgagatcgctctgacatggggcctcggtctcgcatattggccaagcgagatggctggaaatgacgctaatgacttaattaatcttcctaattagtggcaaattaattactaataataataactagttaaacaaaaataactaattaattgctaatgacactaattaatctattaaagacgtgagttcgcgcgccaccagcgcgggagacagcggggtcgcgcactctttatgcgagactgcggtctcgcacttttccttccgcgacagtaccacaatggtatataccatttctgtaattttcttctaaacgtgtatatttctataaaatcagaggaaaaaggttttttttttcgtgatcgaaacgcgtttgcgtgggtctagaccgtattatattactgctcatgtattagctgttctgtacgcctgcttcattctgcataccactgcgcactgccgccgcttaattagtggatatccctaagcctaatttcacaagataatccgttggaaacacattggaattttaactaaactagtgttatacatgtgcattgcaatcgaatttggagtaatacttaatggcgctgtgctttcagtggtaggcgatgtacccgtcgacagtgagacgcctatagtgacttcgtcaatctctccaggatttgccggcccagtcttcgaggtaaggtttgcgtgcgtgtgtttatagggatgagtgcgcgtgcgttgtgagtgtgtgttgtactgtgtaattcttaaaaaaaaaatttggagtaatactggtgggaggggtgggtcggtttgtttttttcttgggattttctcagatagggagggtgggtctgtttggcttttatgggattttcccacgtagtcaggagaggtgggctggtttggttttttacatgattttggctcttttgagattctaattttttttcttcaaacttctaactttttcgtaacatcaaacttacctacacatataaacttctaacttttctgtcatatcgttccaatttcttcaaacttctaattttgacgtagaactgaacacagcctttctcgcgctgcgagcggtaggggatgatgaccgtgtatttaaaataatagagataatgtatagactagaaatatttataaccgggttaaggtcgagttcggcactcacctttcccaacctatactccatcatttttcacgcgcacgcttcccaaattactaaacattatgtttttttaaaaaaaatatacaagaaatttgtttaaaaatcatattaatctatttttaaagcttattttagttaatgcttaattaatcatttgctaatagatcgctttgctttgtgtgcggagaggtggagttcccaacctccaccttcaaacacagcctaaacaagttattgtgaacaaagtggagtaaactgcaggagccatatatatccaattgaattttcacagtgaatttcaccttaactaaatcgtttcttaactaattaaaatattcgtatttttcctttcgtcacctcgtccgtgcgatggtttttcatccgtcccacccctcctccaaaaaaaaatcccaatcggaattccatcatcacacaaacagaatcccacaatgagcacaccttctctccaaatctcaaatcatcacattccaaatcaaaaacaaaatcctagtccaaatctaaatcggaatcatcaaaaaacatccagaatattaacacgagatgacgagaggagagggaggggcgagccagaggccgccacgcgctgctccttgccacctcaccttcggccgaatctggtaaggagtggggcggcgaccactgcccgatgaggagagaaggagccgacgccggatctggcaaggagccaccaccaccgccgctcgtggtgggggagggcgccgccacagccactcgccgcgagggaggctgccgcgtccgccgcttgcgggagggcaaggcattgctgccgccgtcgccgatgctcgcaggaggaagggcgctgccgttgctcgggggagaaggttgccgtcaccactgccgctgctcggtggggaaggctgctaccgtcgccatccgttgggcaccgccggtggggaggggcacgaaaaggtgcgccggtggggagagaggcggcctgcgtggaggggaggaaggggaaaactggaattaggattagggcttatttggtccgggggttttgatggattaggagccgatctgagccgtccatcaaaatgaacggcttcagatcgctcccgcgtcgggccagcatccatcatcgggccgcatcactgctagaccgtgctcgcttcatgagccgcatgtaggtcggtgtcacgccccgaactagtcccgaccggaactagcccgtgacgctccaaattaacctgttaatcgataccagtcccaggaaacagtgctggtatcataggaagacagaatatcacagcaacagaggtctctttaatatagagaaggagtacagtcatgttgggctgcggacagatcccgagctcacaactgcattacaaaagggaagcggaagccaagacttggaccaaacaacacaggcgcgacttgggaactaggccgaaaccctaaaactcaacgtagccggcttgctcctagaagaactcctcgtcagtgggatccgcttcatcttcttcagcaactggggggagttatttatatagagcaagggtgagtacgggagtactcagcaagccatgggaaataagtgtttaatgcaggcttcaaggaaaggctgttgtttttgcaattgattttatttgaactcttttctgaaaataactaagtgagtgcttctcaaacgacacggatgagacagtgcgtctcgtccggtcggagtatgtgcaaatgtatcagtctttagaattgatcaagattggcacccggccaacaactttcaaacgaccacccaggccaacaactttcaaacggccacccgggcctagctgatcccatcagctgcagattttccaaacatcgatcccctttccacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaattccaaggaaacggtccttaggtgcaagagcgggaaaccgtacacccggtacgttccccggtccgcgattttggaaattcatttagttcgcaagcaccgacccaggtgtcgggttttccaagtcttttgtaaaacccaagttttacccaagatgtttttttcagattttaagtttgaaggcggccgtcgatactcgtgcagagtgcacgatttccgaggcgcaactgggtggttacaagggaacatggtataacaattaacaaaggaaggatcaaatgcaacaaattaggtaggtccgtcaatctgccttgcagacgggacaagcagattaagtgcgatcctatcaatgcataataatctttcaagcaacataattaagttcaaatataggctcaagatattcaaaggtggcttgccttgctcgagatctggagcttgatcctcgaaatcctcgcactgcgggtcttcgggctccgaaactatacgcaaaacgggacaactcaacaaacggcgaaaataaagccctattaatgacctctaagcgtgccattagatagatctcgagatttgaggaattttggaagttgaacggagtcaaacggacttacggttgggaagatattgaatttataagattattggatttttggtctaaaggaaaaggatttacttaaatcctttttttgaaaaagaaaagaaaagaaaagaaggagggggaaaattagacttccctcgggaggctagggcgcggcccgagagaaaaggggcggctcggccgagctaaatgggccggccggcccaacaaggcggcccagagcgcgcgcgcgggcggggaggagagagggagccggtggaccgggctcacctcgcgtggtcccgagtgggacccgcttgttggtgacacggttcaccgtgcggaacgcgcacgcggcgcccgctagggtttgggggagggacgcggtgcacgcgcgcggttcgcggaggacgcggatgcggcgggcccacgcgcagcctcacggctcgcggtggaccgcgcccgcgagtggggccgaggggagcggctgaccggggtcggctcgacccggtcttggccgagctggcgccgacgtggctgccacacgggccggcgggaggtagacgacgacgccggccggaacggacggcggacgacagcggcgagcggcggagcgaaccacggcgatacaggcgaaaacgagcacaccgggtggttgcacgggacgagaggagtcgagccaacggctcggattcgccggagggagctcgacggcggcggattgcggcggcggcaaccggcggagagaaaaggggaaaacggcgacgaggtcacgaggggccgattcctggcggcgagagcttctacgcggctacgggaatccgtcccttgcgccggattaggaggaaacgcatcgagggaggccggcgacgagaggcgcttccgagcttgggcggcgacggcggcgagcacacggcgagcggcggcaacggtcggggcggcgccggctagctacggggaggctactcgtgctactacccgagtctaaggggaggaggtggaacgaggaggaagaacggagggaggcactaccgtgcgggtgggcgcagtgaccagagccgacggcacgaaacgtgatcgtttcggcctctggccgaggaagaggagggggagggcgtgcccggagtccccttccgcgtccttgctcgtgccggctcctttgacacgcgcaacgacgaacggggacggcaaacagagcacgggaggcggtgacaatggcgtg

SEQ ID NO: 34693 - DNA, 5037 bp, Oryza sativa
cggcacgcgcgcgcggaaagcaacgtgcgacgcggcggtttgagcggcgcggctcggcacgcgtgttgactcgcggggccgagcggctgcgcggctccaggtgcggcagggcagcgggcccgggcggcgcagacggcgcaggcgcggcacgggcggcgaccacgcgggcgcgcgcacgcgagcatcggcgcgcgggggccgattttggggcggggagctctctagggatggcggtggggagagggagagcgagggggggcgctcggtgcggcttacgcgcacgcgcgcgcggcgcgcgggcagagcgagggagagagggagagagagagagagagaggggaagatgggccgagagagattcggcccatcgaacccgagggaggcaaaatagacttttgcggaggaattgatttgggaaggatttggattcgggattgaactcgacgattgatctgggatttaagatctgagaaagcacggacactagacaacaagcaaagaaacagatttcgcaaataggatttttaagagataatttttcccgctaggcgccacgacggaacgggcgctacagtcggctcggttgcgggctgaagaacaaaatgggctgaaaaaggcccaaatagaaaggaagatttttatttaaataaatgttgaaatgatgtttgtattattaaaattagcaattaagttcggaaattccaataaaattccaaagagcgtaattaatcgtggggaatttaataaaattaattccaaccatatcattttatttttcacacttactttacttgtaagctagtaatttaattattatacacctagctacttaaaaaatacccagatatcttaggaaatttgtatttcaattaattacataatgtaaatctttcttaacttttccttaattttctggtctttatatttcccgttgcaacgcacggatacttttactagtaacaataataaaattaaaatagttttcacctattgcaatgtacggatatttttttttgccattgatacatgagagccataaactatcttgcttgtgttggaggcttgaagctgtaacggataataataataagaagaagaagaagaaaaaaaaaaagagaaaggtggggcccgcaaggtaggggaaggggcccatgggccaggccagaagaggtcgggttcggagatccccattaccactagtcctactgtacttcggttacggaggagattttttttctaacaaataaactaataattattataaagggaacagatccccggtggggcgaagaccgaaaccctagccgccgcctccgccgtcgccgtcgccgtcgaaaccctagccgccgcctcctcccgatccgaccgtgtcgccatggccatgcgctctctcctcaccaagctgcggatcccggcggccgcttcccgccggactctcccgccgtttcgctcttcatccaccgcccctcaggttcgcttcgttcccctcgctattaacctaatcaatcccttctttctgatgatgtgcgatgataattggcccgttcaatcaccaccttctcttgtatctcgcggtttgcacgcacatgttctagcgattcacctctccgattagattagtgttattacccctaatgaacctttggacccttaatttcgttcattcaaattatcctatagtaccttgtgtgttttgttgtctctgtgttggttgacctaatttaactcaaaatcttttatttcccctgagatgaacaaaccccgatctctgttttttttccccttcgagatgaacagatcgagctgttttttatcagtattatctaccaataacaagtactagcatttactgtcctcatatgatactcgccgcgctgggcttattttcttcagctctattatgatcaaaccagtgactctaacttatgttagatgcaaacctcagttatttacctgtacctgtatatagtctcttccatctgagtttattaattattcgtagtaattggtttgtgtttgacattgcaccaccatctgactctctctgtctctcttgccttatatatataggctaagggtaagcttagcagcactgctactgcccaagatggcactccagttcctggagagggcaggtatggcgctgattcatggttctagttcagcattaatatctaataatcatttttctccttttaatttgccaacatgcatgtttaactctagagcttgcgtctcatggcttttttttttcattttccctctgcctgcaaggcgcatacttgaacagattatggaagaaggggacaagcgccaggggaagctgatgtggtatgaaatcattggcaacttcatcgcgttcaatgctacactctatactgtctaccttctataatatgaataggttcaggaacaactttattcaaatactgtgatgccatttggagacatttcaatgatgttcgttccaccatttcgaggagaattcacaaatctattacttcaacctcatcatgaaactaccactaccgcagcagctgagcatcagcttcacggcgtttaggttttttaaaattacatcgacatcttagtactgatgtttgaatattttaccatcgctagcacaggtgactgcattgcaacggaaaagctaaaattacaatgaaatcattatctaaatctcctatgaaaacacattcttcacggaatatagcaatatgtagaccaaatcgatcggtttattttaatgttgctcttgatccattacagatactcggtgtcaccactcaccaccagcgcgcaatgtagaacaagacttgctcgtattgatggttgtctttgacaattgacatgctaggtcaaggcatctaaaagagaatcagtttgcacctacaacaatttctttaggcaaaacctggcttagtaccattaattgcactcgagtattgttagtactgatgtactataacacaaagtagaaaaattaaggctgtgtttagattcagggtgcaaaattttggcgtgtcacatcggatacacggacacacatttgaagtattaaatgtagactaataacaaaacaaattacaaattccgcctgtaaactgggagacgaatttattaagcctaattaatccgtaattagcaaatgtttactgtagcaccgcatggtcaaatcatgtagcaattaggcttaaaagattcgtctcgtaaatttacacgcaatttgtgtaattaattttttttctatatttaatacttcatgcatgtgtccaaacattcgatgtgacatggtaaaaagtttttgcgtgggaactacacacaggggtgtgcctacgttatactaccggtgtcacaggacaccgggtagattattcaaatcctatataaattacactatattaattaatatattagtcaataattagatagttagtatgtattggacccccggtaatttttgttctgggttcgccactgactacacaggcctaagttttctcgtgaagcaacaaatcctgaattcctgtattacttaatccaagagatctccacgtaaatatgtctatcttttttaactcaccatgttgatcagccgccattcttgatctatcaagaaccttgtcatcaggatgtcctacttggagctcttgacgattgtttgccataccaccttagtacagtacaggtccttgaggtgtctttgtactgaacattacccagtacagatgcatgatcttcctagctacacggaccctgcagcctgtatcccggtcatgtcgtcgatcttgtatttgctttcaaaaaactgtatatacatacatgcatgcacagacttacattgtgaatatactgggcatgatcttgtatctttgtattggagaagactgccataccatgcacaggattgattgattagcttggttttttttttcctagcttaattgccattgcaattaattcaaccatatattgcaattaattcgatctcctgaccatctcaacctgcgaggaagaactactactactactactactactactactactactactcgatcatctctccggcgctgtgtgtgtctctctcagaactaacgaatcgatctgcttgctatagctatatatatagacacacgggcgatcgcttgttttgcttcgcgggagtcattccacgatggcgcaaccagccgggcgaacgaacgaactgaaggaagcggacgttggaagcagatttcgacatgcatgactcgatcagtctgccgcgggatgactgaacagaagctaagataatttgattgggatgaagtactttaccagcctcaaaagaaggttttgtcctaaaataaaacaatggtacgaaaagtagcataaaagaaaataatgcttatgatagaatgaataattcatttgccaaatgaaacatggtatataagcaaaccttgcaacatcacacaggcaggcaatctcaggaatacccatgagtacatttccttccaccaaatcaccatggcctgccagatttgagtgcaatcaactttcagacatcttccaacatcttcacgctttggccagttcaacaaggtatggttcaagttcaatcagataaagcacccaagacacaaaatacacttcaagattaactaactattcactaagtagaaaatccatcgttgatgtcgcagtcatgcgatggctgctgctgcacccacagcttcacagcatctcccacggccagaagtgaggtcttgaagaacacctccagataactcagattcttgtagatggcttcagctggcgttgccccttcgaacctcacagccacaaaggtgcatacaagcacctgcatgcctgcaaagccaagtgatatagtcgactgtcgacgcctagtcttttcgaggtaacttgcgagcattttcccaataaggattctgtgattaaaaaaggaggagagttaggcctggtttacggtgtgtttagttcacatcaaaattggaaatttgattgaaattagaacgatgtgacagaaaagttgaa

SEQ ID NO: 34694 - DNA, 5130 bp, Oryza sativa
tgcacacacaaacttccaacttttccatcacattgttccaatttcaatcaaacttccaattgtagcgttaactaaacacacccgtacacaaagcatagcaacagattaaattcctaaaagattggacaggacacgagcaactgcagtcatacacaaaccacaacaaatgggcaaacagatcctcagcttcggatgatgatttgtattaaaagcagacgattttcagcacggtaaacataaattcagaggttcaaattttgctcatatctccctggctcgcacttgaaaagaattcttatctcctagcaagacctagaaccaagcataaattaaagcaaaaggtacagaatgtcgagcacacgttctgggataaacaaaataagcccttgtttagttctagctttttcgtcacatcaaacgtttctacacacacaaacttataacttttccggcacatcattccaatttttttgaactttcaattttagcgtggaactaaacatagcctaactatttatgtgaataaaacagaaagaaacgcaagaatttataggcctggtttagttcttactcctgctgaatgaagaggactttcattgccttgatgatatcgttgtctgcgtacacacccaggtctccagctccatccttcacagccttgctggccttcacagtgagcacgcgagggcgaagaagaagatgaaggcgcctccacgacggacatgtcggcggcggtggccacccgcggcatggtggaaccatcgccccggtagatccttgccaggcgagccaaagcgatgtgggccctttgggatcccaccatgacgcgttgaagcgccacggccaccccgacgatcttggcgcgcacggcggcgaggacggtcgacttgccggtggcggtggcgaggcccctgctgcagacggcagcgagggcggtcgacttggcggcggtggcggaggcggcggtggcgaggcccctgctgcagacggcggcgagggcggtcgacttggggccggtggcggcggcggcggtggcgaggccccagctgcagcctgccgcggccgatggagagcgcagggtgggggtgttgccgggcaacagcggcagcttgggcgctgcaggtccggccttgctgcagctaccggcgacggtggtggcccagatgcagcctgccgcggccgagggagcgttcttggtctgccggtcgacgagttggtggtggatgctcctcttggtggcggcaactgcagggcctggacggaggacggtgagcagggtcgagggccgcctcaacctgccggcgatgaacccgagcatggcggcggggtggattcccggcggcgccccgggatggagacgggaaccctagcgcgcggcttcgagtgacgacacgagacgagaggaagggtagctttgctgtgcgtgcttgctgtcaaactcgccacacgcgctaatcacaattaccacccatcattgtcttaaacattttttttctaatattagattactcctactgtactaaatagtactccccccgtcccaaaatataagggattttgagttttttgttgcactattttgactactcgtcttattcaaaaaatttatgcaaatataaaaaacgaaaaattgtgcttaaagtattttagataataaagtaagtcaaaaataataataattttaaatttttttaaataagacgagtgttcaaatagtgcaagcaaaaactcaaaatcccttatattattgctattaaacctttgatgtttgacaacataggaatataaaatatacagtaatgtaatttcatgccacaacaaacccttcctatagaaaatgaatccacgtgatttttccaaaaaaggaaaaatgtttggtagttccataggaaaaggataggcattgcgagtcacacggaaagaaaaaacatgagatcgatctaaaggagccatgttagttgccctccaaaatttcattggaataagccatttcataggttatcctagtcttcctttgttccaatgagccattctggaatattttctagcgcattcataattcctattctttttgttggttctaaaggagcccttgactccttgaggcaagtgtgtagtgacacacgagtaagtaaggacattaaattcatatattagagaataccttcaagtgatgttatattaatgttataagtataattaatggaaggtgagaaattggtcaaagtacaacaaacaaagatcgtacgtaaactaatacacttgatatatttttgggacgggacggagggaagatgtgctattgtcgtatcgatcgaattcctgctttatatttcaaaccttaatctttttcttctttctgttagtactattttctttaaaaaaaatatttatttttattattatatatatagatgtatccatgtttgtaaaaataccaagggtgaatttaggagccacacccacaaaactgggtggctcgttggcgcataattaatttagtattctttccgttccaaaatgttaaaacctattaggataagttccatttgaatttggatggaagaagtattatctgtaaagaaaacttaaaaataggttggtgtgatttttttaaaatcaaattttatgtaaatattttgttgaaagaaaaatgtaccgttttgtttaaaactaacgtgggaggtataaaagtgaggtgagggtagaagttgagtgtatcccttctttagatcttaaaaaattttaggcaaaaacgtcacatcaaatgtttggacacatgcatagggtattaaatgtggaaaaaaaaaactaattgcacagtttgtatgtgtaaattgagagacgaatcttttaagcctaatcacaccatgatttgataatatgatgctctagtaaacatttactaatgacagattaattaggcttaataaattcatctcgcagtttacaacgtggaatctgtaattgtaatttgttttattattagtctacgtgttcgtatactttaaaaacttacaaaggttctataggctggctgccaggcccctttccaaacaccactttaagatctttcaccatagcaaacactgttttaccgctgcgatgttttggcttcgtacggtggtccgccgtatgttcaaagtgcttgcctttcttccgtactgggtggtttgctgcaaggaatcgatgatgacccatgtacacaaccttccgacagtgcttaagatacgtactttttgtttcatccatacagtgtgtgcaagccttgtaccccttgttggactgcccggataggttgctaagtgcaggccaatcgttgatggttacgaacagcagcgctcgtacgttaaactcctcctgtttgtcctcgtcccacacggggacaccttccttctttccacaacagtttaagatcttcgaccagtggtcttaggtatacgtcgatgtcgataccaggttgcttggggccttgaataataatcggcattatttatgtacctcctcttcatgcatagccaaggggggaggttgtagatacacatcataacgggccaagtgctatggccgctgctcatctttccaaaggattcatgtcatccgcacttaaaccaaaccgtatgtttcgtacgtcctttccaaagtctttaaattttctgtcgatgtttcaccactgcgaaccatcggcggggtgtctcagcatcccgtcctgttgacgttcttcagcgtgccaacgcatcattctagcattccccttgtttctgaacaaacgccttagccgtggtattatagggaaataccacatcaccttagcaggaattctcttcttcgttagctgcccgtcaaccttacctggatcatcttgtctaatcttgtatcgtagtgctttacaaatagggcatgcttctaggctctcgtactcctcaccgcgatataggatacaatcattcggacatgcgtgaatcttctgaacttccagtcctagagggcagactatcttcttagcctcgtacgttgtcccgggtaatttgttttcctccggaagaatgttcttgacgagtttcaataaatcgccaaatgccttgtcactaacaccatcttttgccttctattgtaagaacttcagagtggtatccaactttttgtgcccctgctcgcaacctgggtacaacgacgttctgtggtcctctaacatccgctccaatttatgggaccccttttcactttcacagtcctcctttgcgtcctgcaacatctgaccaagatcatctgcagcgtcattatcgccagcatccctgtccacctcgtccgtttgattttcttcaaatccagcgtactgagcccagtcgggaatgttctcgtcctccgcttcaccttcttccatttcaacctcttgctcactgtgggatgtccaacaattatagcttggcatgaaccccaactcaaacaagtggaaatgaatagtcctggatgcagaatattccttctggttcttacacttattgcatggacaacaaataaaaccgttacgcttgttagcttcggccactctcaaaaaataatgcacgccctcgataaactctttggaccgccggtcaacgtacatccattgccgatccatctacatgaaatgaaaaaaaattgtacataaataaattttcgtacaataatgacagtcaaacagtaatgataaaataattaaaaactctttcgacaagcaattcttattaacaatttttgaagttctaaactaatattaatgttgtacttctcttaattttcaatttagtttgttttctattttttaagtaattttcatcatattttaaactatgagaataaaatttctatatattcttcttccccacacaaattttctctctcatcaacttacaacaaagttttggagaaaaaaaatgtgtgaaacatagctccaaaagtaatataacaacaaaaaaaaatcttggatgatgaagttactaaccttttagacacctccgatttgtatataatcactaaaagaatttcacaacatattttggcatgacctcccctctttctttgagaaattttgaagcttgctctcgggctggaggaggaagaaggcatatataaagggggggatctctc

SEQ ID NO: 34695 - DNA, 14912 bp, Oryza sativa
aactgggactaaagatgatctataccaactgggactaaagatcacatatgaccgttgtagccaccaatcaggactaaagatccggttttaaatggatccgggattattgtggatttcggccgaccgaccaaagatggtttctccaccagtgcttgctccgtctccacccaccctttcctctttcgctctccgcctactccgcttagggcagtagcaatgcaaagccatccttctgtgtcttctgttattccctactatcgccgtgtttagatgctgtaaaaatttggctaattttcttttatgtacacagacacatattttaagtattaaacgtagactaataacaaaacaaattactgatttcgactgtaaactgtgagatgaatcttttgagcgtaattgatccgtcattagcacatgtatgttactgtagcacttatggttaatcacgatgtaattagacttaaaagattcgtctcacgatttatagttggactgtgcaattaatttttctttttgttcacatttgatgctccatacatgtgtccaaacatttgatgtgatgaaaaagttggaatctaaacacagcttatacacagtgggcgttatctgttttggcacaatgcaagttaccaaggttagcattgatatcccaggccaaggaatatgttccccaactacccctttgttctcctcgacgcatcgcctccccacccacttcatctcccaatcccccgctttttcccccagttcgtgatgatgctgctccgacggagacggcggcggcagcggcggcggtgatggtggtgaaggtgtgcgaccacgacggggcccaaggaacggttctttcgacggccgccggcacggcggccgcacacgcctcaggcgagtcctgcaactgccgctacgtcggctgcctcgccacgtcctcgccgccctgccattgcttctcgtcgcggtctgcggtctgcccctgggacttctccagcagagacagcgaggcgggagcgaggtcacacatggagccgaactagcgtgagaggaatagaggaatacctctctctttttctttcttatctcatgtcctagctctcccctcctcctagatccagttctcccctctccctcaacatcttcttcctctttcaattcgacgggaggggtagcggccgcggcaaggggagcccgtgggcagagtttctcccacagttggcggtagcagagctcgggtcgtgggcggcggatgatgtgctattttttggtcgtgtggatgtgtgccgatggaggtgaaccaatgcgatgcaattcgctgagatgccggctggtgcggctgtgcaagccgctcatatattctcccttcgtctcataatgtaaggtattttgactttttgtttatactgtttgaccattcgtcttattaaaaaaaatttagaattattgtttattttatttgtgacttatttattatccaaagtattttaagcacaactttttattttttatatttgcataatttggtcaaacagtgcaagaaaaaaaattaaaatttcttatattataggacggatggagtatgtcaggggacgtcgatcaaagtccgaccccgtgcaaacagctagtagtagatgatctcgtgcatgtgcaccgtgcacgcgtacggggtggcggcggttattttgttgaattgaatcgccccttgccgagctgaccgacgtctctgccatagtgccatccgcgacgatatatcgatcggcggcaaggccgtctccagatatttggggccaccgaacgaaatgctaattggatcctaaattttgaaaattttatataactaatataaacaaagcatactttcaatcaactatataactttaatatgtgttattttatacaaatattaatgctaaaagagaaaaggtagtactactgatctcatgttgtactgaaaagtgaaaagcatcatccttctagtgtttcttggaatgaaatcttaaattatatcttcataattaatatcgagattgagctgctgcatctagcctgtctcttcctacgtttttcagcacctgaatcatactttctgtttctagaagtgatgaagtgatgaggaattaaagcaattgaggaaataaaagccttcctgagttcctgttttataaacaaaataaagaaaaagacatatgtcgtatacatacatacatacatacatacatacatacagtatacacacttgattagagaatcagagatgactagataagatgagatcagatgaaagtctagttcgttcgtcaaattacttgatgatcaaactccctttgattcatagaattggaaaaggattttcataggattcaaatttctatggatcttttttctacatgtccctttgatttatagaaaagaaaggaaactacaatcctatgctttccatttcataggaaaaatagcaagagatgtgacctctttgtgaacttttctttatttttcctatagcactatcaaagactcctattgtttttcttgtgttcgctaattcctataggatttgagaaacctactactttaattcttgtgtttttttttattcctgtgttttttctatcctgcgaatcaaagggccctcagtctggttgccaggggcgccctcgccggctcgcgcttgctggttgccggcttgccgcgcgcgaccgcatgccggagttagccacgccgccgctgccgctcgatcggcgctcgcccgctcgattggccggcgattgttgtgctgtctgcctgcgcgtgcgctgcagcctcgcgtcctccctgcctcggctgctcagtccattgtccacgcctccatggccatccaacagaccaacacagcaacttaacactaaacgctcgcgagttggagtcggtgaatcgcggcgacgcctcgactaacgcatgcatgctgcgagcgatcaccaatcaccgcgcgcttgagatgaaaacaaggcaactacgctcgcgagacgcgacgcgacgcctcggactgcaaacttccgccgttctcgcacacccccatcgacggccctgatcggcggtcgatctggtggctgtggtgcacggcgatccagcgacgccgcgcgactcgggtctccagcctccaactgccactacccgaccgacaaaacctcggactcgtctcctgcgaaaagctaattaatccctcggtaaaaaaaaaattggatgtgacatattcttgtatatacaatgaatatggataaatgactagtttagtttccaacttttatttttaaactttcaactttttcatcacatcaaaactttcctacacacaaacttccaactttccgtcacatcattctaatttcaatcaaactttcaattttgtcgtgaactaaacactctcgtatattggttttttatactaaatccgtcctaaaatgtaaacatttttagctataaatttaaacatttacattttggaacggagggagtaacatatgatcttgagcatcaagcacgtaggagtactggagtagtaagctggcgaagaaccaccgatcgaggatctgcttgagttcacgcccgcatgcagtcaccgtctagcttgacgtagggtttaccagaccttacgaaattttttttttaaaaaaagtaaatcggacttaccaagccaaatatcacttggtttaatttgcgattatgctttaaaaatcaaattgaattttaatttgtcgataattaaattagttttttttcccatgcacgcactgtcctgcgttaggttaatattatactgtcgctcggcgtcgttcaggaattaattcgttgtcctctcgaacgaataatttctttacgtctgatgcaacgacatacaatattaatgagagagatgcctgcatataattacttatactgaccggaggatctggtctctgtttttcactagtaaaagagattatcatggacaaccttttttttcgtaggtgccaggcggggctaaaaatttttttttggttcccagtaatataaagaccaattatgaaaattctttttctcaggtgaacctattaagaggcccgcctagctgcaaggtcaacctctcgtcctctcttccctctcaatatttttaaaagttaataagtcacccatacttatatcctcagctcctctctctctcctgctcacaaactcatcacctgctctttctcgcatggtagtttgaataacatgctaatgaaaactatggtaaaatatatatcttagttagaaactaacaggggcctaagtattgggtgcatggagactataaatataactatctcatttgaaacaaatagaaaaaaaatgcttaagacttttagatggagaaagtactgacatagcacctactcttatttgctatagtaatttggtttagcacacattaattaaggcctagttaaaatgcatgatctatactcctttaaaatcagtaatttgtggtgggagcgaatctgccattccacctaatttcattgcaaattttacaactcacctcttcaactttttaatactaagaatcaatcaaatctaaatgggacatataaaatcgaattgaagtaatcattcccaataggaaaaagatgtgtaacccacactattatcgtaaattttcttttatccatatcaaaacaccgaaaacacacagagttgaagtactagcatgagtgtgtttcatcaactctacaatattaattaaaaacacagaaaaaacgagaagaggtgccttggttgcatcactgacaaattgaattagaagaaagttttcataagggtttaatctcttgcttatttttctatgaatttgagtaggaacacgatccaataaaaaattttctgtcatgcatgttttctatgaatcttaggtgtatctagaaaaaagaccagaaaatttaaatctactcaaaatcctttggctgtgtttagttacacatcaaaattgaaagtttaaagaaattgaaatgatgtgacggaaaagttagaagtttgtgtgcgtagaaagttcgatgtgatgaaaaaaataaaagtttgaagaaaaaaaagttgaaatcaggacctttgccaaatctttcatttcaaatgctcacagtagcaataaaatattgcatgaatgttcatgtcaagtttatactcatcacacgcacagtaatctagtcagacatgcataccttgagcagctgccccctgccctgcatggtgactggagtaatagaggggtgtttagattaggggtggaaagttttggagtatcacatcagatatacgggcacatatttaaagtattaaacgtagtctaataataaaacaaattacataatctgtctgtaaattgtgagatgaatatattaagcctaattaattcgttattagcaaatgtttactgtagcaccatattatcaaatcatgaaacaattaggcttaaaagattcgtctcgtaaattagtcgcaatttatgtaattagttattttttagcctatatttaatattttatgcgagtattcaaacattccatgtgatagggtaaaaaaatttgagagggatttaaacagggcctagatgatgatgagtgtggcagacaagagtggatctgatatgggtgccacagtggctataagctcccttgggagttgttgcttgcttgcttcggtcggatgattgatttacaccatgccctagccctgcccaagcatatgcctattgctagtcactctactccgagagcgagcaagcaacaattcgtgtaaaaatctatcgcgctagtgaggccttgtttatataaaaaaaaatttctcaaaaacatcacatcaaatatttagacatatacataggataataaatgtgagaaaaaatcaattgcacagtttacatgtaaattacgagacgaatcttttgagcctaattagtaattacgcaatgatttgataatgtaatgctacagtaaacatttgctaataacggattaactaggcttaataaatttgtctcacagtttacaggcgaatctgtaatttgtattattagtctacgtttaataatttaaatatgtgtccatatatctaaaaactttaagccgaataaaagtgaacacacccttactccttagagtctactctactatgtggctcgccatgctccaatgcgtcatgactataggaactagcaatagatttcgtacgaaattacgaatactagtagcgaagctcgttctagctgttccttaatttggatttggaggatttctcatgaaaactttagattattggagttcacaaggattttatacttgcatgcacgctcttttggactagaagaataatgccctgttctttctatatatttcgtcggattatattttatccacagttctagaaatatgttttcttagaaaaaaaaactttctctaccgtatcgttgggattaatttttctatactatacaaatttatttacaaaaatatataatttatctctattatcaaatagataatccgatgtaataattcggtaaataatatgggcctaagcttgataaagcttatgaaatagtttaatttcctaccctttcatttcaaaggaaaacaaagtttatttcgtgcgaaccatccagcgtcattacctcaaatattcttgtgtttcaaaaatcatgtgggcttctgatcgttttgcctgtgactcaaattgcagaaaaacagcatgtacacaattaaaaaaaattgcagggtaaattttgtaaatcaactaaaaatatcgagttttaaaatttaaattttagccacggctgataagtactcccttcatcccaaaatattataatttgtagcccttaaggtttgtcctaaatataataaattattcacaatattctcttcccaccaaatcacaacctatttttcacctacctcctcttctcatacatttataacattttcctatttaattttacgtactttcttaataccatatccaactctaaaaatctttatattctggaataagcagcagaaagcaaaacaacgaggacattggtattcaaaaaagcatggcatttaattcctgcatttttctattcatttttttaataatggaatgagtcagcctttgctcaagagctacagccaactattacagaattcacacaaaagaaactcacacctaaagttcacaattgcaaaaacaaaacaaatggcaagcacaaactagtagacaccaacacaagataaagatcctataactatagaattttattagagaacctccatccaaagttggcaaaaagttacatgatcgtcgtctcaaatttacgacttacatcatttataaaaaaaaattacattttcctattcatgttcctgtgaatcatgcattacaaagaagctctcaaacatgtacattatctattacggagtgtttagattttaggcgaagtctcttctctaaataaattatcctaacaaaaagaataaaaaaatacatgaaataaacttatagtcactcataaaaactttaaaaatacatgaaaagagaatttcaataaaataaaaccatatataatagataaattgtaacttaaaagaaccgaagctagctagcccgcccatgaaatctagcaattccctaggatatttttattttaaaaaaatcggtgttccatgttcacgctgggctctagggttgaaaaaaaaaacaggaatagataaaacatacgaatatggtaagattgtggatgtaaagcggtcactactacagaaagggacatataattaagtcggcactataggtgatggaaatggtataaccttcgtcctaaacatgtgcccgcaaggacaccaatggcaagaatcagcacctaagagcccacaaggacaccaatagcaagaaccggcacctttgtatataaataggtgccggtttttaattggaactgacacatattttttgtcagagaaagatgctggttccagctaaaaaccgacacatatatgactgtcagtcataggtgttgttccgagctgataaatcgacacttttatgcggattgagccaatcttatccaatcgaatcaaacgaaccttttttttcgccacccttactttttttgtctcccttatctcctccttttcttcacccacacatctttgtcttttcgcctctctttttctccgccttctctctctccaccggcatggaggcggcggctgctccccctacccggtgttgcggcagcggctgctgctgctccccctccctggcgtggcggtggctggtgctgcttcctccctccccctccccccagcgtggcgatggcagctgctactgctctcccttcccggcggtgctgctcccccccttccctgacatggagccgacggtggttctcaccagcatggcaacaatttgatttgtgaatattttgtggggattttatgatttgggatgttgattcagtaaccactgaaggaaaggaattgcttcctatgatttgcctatggccaattcctgcatccaaaggcatgaacagtaaaacatcctatgggatttgcaatcctatcttgttccatcaaaaaaggaccttggttgaaaatggcatcttaattctccattctctggctctatatttgtgaagtcacgtattcacgaaaatgtcatcaggggctccttttgaacaatgggaaactaaggaattttggagaactagattcctatggaaaaatttcgtatgtgctcctttggaacaaaagaatatgtcttccaaatcatttaaagtccctatgaaatgggccatttcatatgtaggaatttcgaaagaaaactagcattatcatattttcttattcctatggcacaaagttaactttgtaacttttttcgctgtgtcatccaaacaacagtttcgaagcattcctatatatattattaatgtccataagaattcaattagcataacactttttccccgtgtcttttatctttctttgtttttagaataccgtgttctaaatgagccctacatgtctaaaactagcttgtaggaggcatatccttataatcattaaacatggtgaatcgttaaatgacttaaaaatgctacaaaatgaatcaaaaagagaaaaaacatatactaaaattatgtttttaaagtttaagttttagctattgagcaatcgtctagcgtggctggcctcggccagaaacaagctgccatacatagtctgctcctcgtactctagggctacctaggggaggacaggaggagtacgtggtgggatcctctgtgcagttgagtcacttacatgtggaccatagtaaaatgggacccacatatcagtgactcaactgcatatgcagtaagtcagaagatctgctttcggaggagtactagcagcagctataggccacctccccccacccatccaaaaaaataaaaataaaatcggccgtatctacaggtactgctagtctactactactccaactagttccatgcatatacagactagtatccatactctaccagcttgttagtagtagtatgttctctctcttttttttttcttttttcccaattagtttcatacccttaactttagtctagatttacaaattaattagtatttcctccgtttcatattataagactttctagcattgtccatattctatagatgttaattaatctagacataacatctatatgaatatggacaatgctagaaagttctagacataacatctatatgaatatggacaatgctagaaagtcttataatataaaacggagggagtactgcttaattaattgcacatgcatagaatttcccgttcctctacttgaatcttcgtgtacctccccaaacggagacaaccattattattattattattactaggtgattccccgtgctttactgcaggaattactaaccatttctcaatatattttttcaacaatcaagctagaagtaaaaaggaaaaaaataaatattagggtttttccatacatatcatgaaacaaacaaatgatacccgttctttaatgtgaagcatattgataattatatgttaaatattatagaaataaaaaataaatttgttaaaatattgtgcaaatgatatgaggggtgatgattggatatacttgcatgttaatttgtagaattgaataaattgtagatgatgttgtatgcttgcatgaggttaaatatgtaattattgctagtagatgatgatgtggcatggttgcatgttgagctttagagatgattgggtatgcttgcatgttgatttgtagaattgaataaattgtagatgatgtatgtttgcatgaggttaaatatgtaattattgctagtgggttatgatgtggcatggttgcatgttaagctttggacttagcgggctatagctttatagaaagtgttataaaaccagccccgaaattaacatcggtagctaaacgtggaagaagcgccataggagatccaaacacaatgacgacaccgaggcacgatatttggtaatggagttcaaccaaggcctacatctctggggcactggttacgagcgctcctccccgatcagcatatacaacgtatcagagttacaatgactcacggctggacgctgccagcagccgctccctctcgctatactaagtcgccatgcggttacaataggcacccctctctatttaagagagaccctaggagagagtccgactcttactctagtcctaatacctattacaactccaagtcctaaactgtagctgactttgtacacatattcgacacaaactctaacaaactccaccttggcgaatatgccatgccaacctgaatttgttccttgcgcgaacctccgtgtacccggacttgagtcgatcctttttcgccactcacgcatttctaccccgacaagcctctaccaggctcaccgtaaacaagagacttcactatccttgcgatttcttccttttgactccacctgcaacagtgctccaccttctctcgtatcaccacagttgtcttgccaagcgaaattgaattccttcctagctttcacatcatagacttcttaaagaccatgttcaactccatctaccgtcttaaatttgacttgatctaatccatggccagataacccacgtcaccaccaaatagataaatcaaactcaccagacttgaagagaaccctttcttccttgtcgtcttatgaaccgagctaataaatctaacatccatgctttcccgcatccgtagactgaattcctaataatctgggaaaatcaccgttgctttgaatcatccgaagaaattaccaccatagcgctcactcttcctcttcagcgacgcatatttcatatatccccatcatgcaaaccccacagatcctggatatatcctgtactgccaaacagtccgttgatacccttaacgttttcacccgttgttgtccaggatttttccttcacacacctttgccacactcctgccccaccacagccttgccttcgaatcataatgcagaagccctgatgcacagttatttttgttgtcaatccatgatctcaatctagccctagacgaaatgtccatgtgagtgatcaactcggcttggtgaacgagtcccattgaaatacgtgtccaatcccagccacctagcctccgtgctgatctccacgtccatcacgactccaagttgagaagcaactccgcaaccgaatcgacctccaacagctacacaaactgtacatcatccgcgaccctgattcgatccgataccaagaacttgctgctccatgcatggacctaagcacaatgggcctccctgccgcgcgcatgcacctatggatcattacatgcatttaactaatgtaccagcatgcatgcatgcaaaattagttaaccatgcatcgctaatcatgcatgacagcatatcaccgtgccatccaattgtgcttctggcctcctctgtgtgctgctcctttgcgtgccgtcgccgcctccgctgaccggagccggcccgcgccgaatactgtcagcacctacacaacaaccacaccatgccgtgttcctgctgtccggatttcgtcaccaataaatccgctctgacctccgattgaccaccgtcaatctagttgcaagcggaagccgacaaatcgcatgtcgtctttccagtcgccgaatgacccgagcgttacgtctagccgtctccctgtcgaacacaactcatcgaaagacccgggccagccctcccggagtgttcgattccaccgaccgagaacgtcgattgcctccagcttcaatcaaccccgagcgtgtggccacatgtctccctgttgagagtagctcaccggaaagttcgagccacccgcccgaagtgtccgacccacagattggttcaccaatcgcttccgccgccatcaacccgagcaccacatctggtcgtctccttgttgaaagcaaccatcaaactgttcagactgccgtctgaagtatccgattccatcgatcaaattccgttgatcgccaccatgttccacctagcgtccatgtccgtttcttgacaccctgtgtagttgtcgcagcatggagcacctcactcgtacctctaccatggatctcccgcatgctttgataccacttgttataaaaccaaccccgaaattgacatcagtagctaaacgcagaagaaatgccataggagatccaaacacaatgacgacaccaagacacgatatttggcacggagttcagctgaggcctacatctccggggcactgattacgggcgctcctccctgattagcatatataacatatcagagttacaacgactcacggccagacgccgccggcagccgctccctctcgctatgttaagtcgccatgcggttataacaggcacacctctgtatttaagagagagatcctaggatagagtccgactcatactttagtcctaatacctattacaactccaagtcctaaattgtaaccgactttatacatataaccgacacaaactcttacagaaagtatagattgcgtggtgatagattcaggcatctctccaaatttactatggtaggtttatatctcatcctaagcttaggttgatttattttgaaaccgagagagagtagactatatatatatgcatggaaattaaaaagaaatgccatgtgtacttagaacaagtacattcaattttctccctcgttcgaccgccatgttttcaaacatggatctcacaacctaaatcggaatttctaacctgcataaagatgacgcaaattccagtaaccctcccgatcgaaataaaataaaatacagggtttgacaatatttatcacacctcgcttcaattgtagatatatatttgatgtttacgataagacttgttcaaatttttggagcttaattttaccattacttttatattagaaaaagttccgtattacccttagactttctttctctactccttggtctgctcttttttcttggtgtcagtagttgttatgcaattcttttttctcgatgatgtgatttttgttctgtcagatagtttttgtatgaaataacattggttaatttgagggaggaggatgaagatagatacactgtgtcactgctgaatatcattccaattctgactcgtcccaaaatttgcacttcatctctttttgcagctcttgtttattatcttgttatatttcgtggaattttgcatgctgttctcctctttcatttcttctttggtgatttccaaactaacaacttgaatcgatactaaactgacgcccagtcatgaggatccgtgcatgcagtgtctagggacactgctgaatgtcgttccaattctgactcctcccaaaatttgtttatttcagtatcttgttgatttatttcgtggaatcatgcatgttgtcctcctctttcctttcatctttgctgattaatctttcagtatccaaattaatcaggatttgctcagcagaaagaaaccaattagctcttgcctcttgaagcctatgtgaaagctcatgtaattttgcagttgcaaaaatgtacaactttcaggtgacaaaaaatggcatagggatgtacaaaataaacattaagaggaaaaggtttcgtgtttagaactttaaaaccaagcaatcaaaaacattttcttcctcgaagatccaacaacaaagctctgcatcaagaaacattccattggttgacagaaacaaaattaagctagataagcactgattccacgcacaatttacatgatcattacatcgtccatcacacaggcactcatgcatcgattacacataggagtattgattcgtgtgactagcttaatgaatttgattagccgatgatctggtccaggacgccgatgttcttgaggccgaggacgacgccgacgcccatgatgtggccgacggcgccgcaggccagcgtgtcggcgagcgtgaacccggcggggtcgccggtctgcaggccggagtcgcgcgcctccagcttcagccccgccgtcgacttcctgttcgccgacggcgccagcccgaacctccccgcgaacagcatcagcgtcgtcgtcgtcaccatgatctgcatcgcccccccaaataaattgcccatcacattccattcacatcaagcctaatcacgtcgttgaattcagctaattaaccacactgataaattaattcagtgtgtgtgttcttacaacgttggtggctgagccgatgtagtcgcaccggatgccctgggacctcttcttgctcatcctcaacgatggcagcgtcacctgtgattaatcaagaaccagggacaattaggaatgtgtaattgtatgcatctctagttatacttttcg

SEQ ID NO: 34696 - DNA, 3667 bp, Oryza sativa
aaggggagcttgtggactgcagtggccactcatggataggttacagatccttgctgctgatgtggcatctcctggttagagcctgccaatgtggataagatgctcacctctgcatgcaatgttcttggatgcagctgcaaatgttgttggtggtgacttgatgcatgttctgtcaaaaaaattgacaggcatatatagtgagcaagagaatgggaaagaggaattatgtggagcagtaaaaaaaaatggaaatcttggtattttttcaaccgcagaaaaatgagtaaatgaacctggatttactgtccctgtaggctggaataagtgcaagagaatgggaaataggaattatgtggagcagtaagaaaaatggaaatcttggtatttttcaaccacagaaaaatgagtaaatgaacctggatttactgttcctgtaggctggaatgagttgcttgcatcgacactgaagtggatgtgccactttaccagttgctcctttgctggtgctatgccgagtcatgaactgaaataatcaagaacttgaagcccattgcttgcaattgcagaaatggattttgcaatgtgaaacaacgtggcgacgcatcttactgctgtaagcctacaccacgatgagattacctcacaacgcgcaaagaattaaaatagaatggacacttcaataaccatcactcgtacatatttccatttcgaattttgtatatgaaaccaacgatgacgagccaaaaaaaacagaaaatcttcccaatcaatcatatagcctaatatgagaattgcatacacaacttgtatattaatgcaacaccatatcaccaaccctccctttcctatgtacatttcatgagtatggaaaaccagggtcagaagagcaacccgctcctgatttgagaaaaagaaaaactttaacacactcaaccacacccatacacaaaagctgccacgctccaaatcctataaatattacacatcctccaaactaaacaacttgaatcgatactgaacaaccttttctaatcggtttcatactgtaagttatatcaggttggcaactcgatcttcatgcttctatcttgaggagtgagttgagagatgtgctgttgaacttttgagcaagacctctaatcaccagaatgatgacgtctcgcatgtgccgagtttgcaccatcaagtcaacttcgctctcaccatcaacaacaatcttgaagcggtgctgatcgttgcgatatagctcaacctgaaagattcaatgaacagttagctttagttataaatttgcgtaggacagggattatacattctaaaatgaacattttattttccaagttcatgcaagaatttacatggaagggtggaacatatgttcctcgcacttctgtagttgggaatgatgccttggatccaggctttacaactttgatcctcttcctattcacttctaaaattcttcgctccaaatgtcccatcacttgtgcctgttaaattgtttgtttttccaaaaaaagaaaagaaaagaatgtaacttgtagattgcaacgcttattatcctggtgaattgtgatttaaaaaatatattacatgtaggaggaaataccttttttggtgttctgtccttgtcacacaaaacctgttcaatgcaaattttatgcacttgttactaaacaaagtattaattgttgcaatgataacaataaaaaaaacattactgtgaaggtagcccatttctttagataataaagatagcccaagtagaaatgtaattatgcttgagacagttactattgactgaaataatcactctgctgcagaattgctcagcactcaaatttggaaacattagctgtgcaaataggaaacaagtatgctctccatagtttgacgaataagaggcccagctatccatgacagtgagacagtccagtagtctaatactaccaaaaaggaactaacatcagtattgaaatgaatattacctcaaacttgacagatccatcatcaagcttctgcttcacctccttgtaaatttcaggctctgcataagaaaaaaccaagcagttaatagaccaggctgacaaccttaagtaatgctctgaagattaaacttaatagtgaataaatataactatcgcagaaagtaaactgaggctagaagaaactgtttagctaaccgctgccggatcaccaaaaggataaaaaactgagatgatgataataataaatgttagtaggcgacaagataggtgaatggactataccaactgcaattggctccgttgaagcagagataggttgtccctcaactccatcctctctcacaggtgtataaatgataacaagtctataacctacatcatcaacattggcttcatatgttcttccaatttcgcctgcacaagaagttaattgcaatataagaatataagtaccaagaattgaagcaaaaataagtgggcatcatcttgtgcccattaggatttaaaagtggtaaatattatatcatttaaaaaaaatgtagaattcaaataatcataccaggtatagagataagatctgggcttccaaccatagacctgagccattggattttgctcttgccttctttgcctccagaataggtaccccgaacagcatacaggttagtgtggaaacctcttccttcaatctccagtttttcaattttaggttttcctgttaaaatcaaacatcacgcttcagtggtattgcaaattttaatgatttgcatgaggatggatatcagtacggtcatcaagcaaacttggcaatagagattaatccaactagccaagcctcttttagtagtatatacacaagaagttcaatgaagatgacagaagtacacacttatgcaccaattgaactaatacaacatgatgcatccaaaccccaactgcaaagagggagtcaagatgcagaagtgcaagcctatggactgatcctctacaggcctatccattttgaaataaataatgaatattttgctcaactaaaatatccatcagtttcacaaagttacaatacgcatgctgatttaatcaataagacataagcggtagacaaccaacctggtaagatcggagcagtcacaatggatatcaattcgctggatcgtccaaatacatcagagactgagcattcacatttcaggcatcggccaatatcttcgaaacgtactttgtatgagcgagagcactggttagccagtggctcaaaagtctgatccacttcagatccactggaagcaaacctgcatccagagatccacagcaagtgttatatgccatattgaacaatgtgacaaagtcatgactcacgacatacacctctttgcattaccattgatatgttatctctttcttgtagtaactccatagatgttgttgaactgcagtgcttggaatttgttcaagaacagtcagtgtctctctctcaacctgatttcccttgaaagagagtgcttcgattttaagtcgttctggaaagaaaaggagaattaatacatgtagttgcatggaaaatgtgaacatagaacagtatgtaataggttcagatattaaaattaccagggagaattatatcagatggctcagagagcctttcttctccaatgatcccatcagaacgaacgggaatg

SEQ ID NO: 34697 - DNA, 629 bp, Oryza sativa
agccatccgccgcggcggccgacgcctccggcctccttgagaggctcatctccgcgctgttttctaagatcaccgccaatccggagacgcccgtcgccgcgggggcagtcgggacgccgaaccgctcgtcgtcgtcgtgctcgtcgtcgccggacacgctcgggttcggccggtcgtcgtccaccaagacgcccgagtcgatgaagccgtgcttcgccagggagtggtggttcgacgacatgacgtcgctgtgcccgcagaccatcgagaaggcgatgagggtgctcggctgctacggcatcgagaacaagaacctgatcctgacgcggttcctgctgcactacctccgagccgccacgcgcaggccggcgctgtgcagggagggcggcggcggactcgccggactcggcgacacggccgtgcacggcgtggcgctcgtcggcggcaccgcgttctcgtgccggggcctcttctgggtgctccggatcgtgtcgtccgtggggctgagcaaggagtgcaggcacaaactggagaggctcatggggctgatgctggaccaggccacgctcgacgacctcctcgtctccggcgacgacggtggcgtgtacgacgtgaacctggtcatgcgg

SEQ ID NO: 34698 - DNA, 1224 bp, Oryza sativa
  unsure (1)..(1224): unsure at all n locations
cgcgtgtttccggggagtaaagagttgtcgtctgggccccacatgtcagtagtactggttgtccgctacgaggggatgacatgtggggtcactgatgagtttcacttgggttcagtttgctagtgccacgtgccaaggataggggcttttccgtcgggatccgcttctatcggcgagtgtcacccccgtctcttgatcgtcttcccgtcaacgtagcactagctcgcggttaaatttggcaaatcaaccgcttgatgatagatacgagcccggaatttgacgaccaaatgcccaaaatttcacgaaacatcgtcacacggacacgtacgtagtgcaaaatcacatggcaaccaaaaaattaccctggcaaaaatgggtgaaaatttttagcgtgtcacatcagatatactgacacatatttaaagtattaaacgtagtctaataacaaaataaattacataatccacatgtaaactgcgagatgaatttattaagcctaattaatatatcattagcaaatatttactgtaacaccacattgttaaatcatggaacaatttggtttaaaagattcgtctcgcaatttatacacaaactgtgtaattagtttttttcgtctaatatttaatacttcgtacatgccttaaaaaaaatttatcggtggatctaaacaccccccccccccctttccccaatcaaacaggccatggctggtggtgctgatatatcgacagaaacatgccatgccatgacaatgcggaatgcatcagcctctgcctgcaccagacatttctgctctgtgactctgtccgagtgaagaagacgacgacgacgctaaaaagcaagtgccacatctgctggctagatgccgctacattttactgttgcgtttggtgttggtgcccgtggtgggccccatcttcttggcgatattccggagcacgtacttctggatcttcccggtggacgtcttcggtaactcgtcgcggaagatcaccgtctttgggaccatgtaccgcggcatgcgctcccggatacacgcgaccacgtncgtcgccgtnaccgcgccgccgccctgcttgaggctgacgaacgcgcacggggtctccccccagaactcgttcggcggcgccaccaccgccgcctcgttcaccgccgggtggccgtacagcacggactccacctccacgctgctgatgttctccccgccgctgatgatcacgt

SEQ ID NO: 34699 - DNA, 517 bp, Oryza sativa
tgcgcgcgtcgagccgcgtgttgatgctgtccagcacggcgccgctcatcggcacggcgaagtgcatctcgtacatcgccggcacgttcggcaggagcacggacacctgactcaatccagcttagcttagcaacacgaggaaggtgttcgacgaaatgaccgtggaaggaaaaaggatcgatggatgctcacgacgtcgccgcgggagatgccgagggaggagacgagcgcggaggcgaggcggaggcagcgccggtgggtctgcgaccacgtgaagacggtgtcgtggtagacgacggacgggcagtcgccgaacacggtggcggcgcgctccaggaagcccagcggcgtgagcgcgcacgagttggccgggttggcgccgagcttgtccatggccgccgcgtcgatcgccggagcacgagctgtcgcctgtgtgaacgccggtgactccagctatcgcggggtggttggagtggaggcgaggaaagagcgagtgaggaggctgcggtgatataaa

SEQ ID NO: 34700 - DNA, 281 bp, Oryza sativa
gcgcagaggaagaactcggccttggcctgatactgcttcagcgtgtcggcgtagccggcggcgctgccgccctgctcgaagaggaccttggagaggaggacctggaggccggcgtacttgttgtcccaagagaactcggtgacggcccaaccggtgccgccgaacgccttcgtgttctgggacacgtagcggaagtactgctcgtcgccggtcgccttgtacagccacgccgtcggccacagcagctcgttctggtagccggacgccgacgggtagaactt

SEQ ID NO: 34701 - DNA, 682 bp, Oryza sativa
tggacgccacggcatcacctgccggtgttgctcacgagtgcaagagagaccaaagatgattaagaaatgccgtactcacttaacggccaccgttcttcctctcatcgccatcaattcagttagtgaagagaacctaattgcagaggttaattgctactacctacttctaatttttttggatgcttgactagagggagaaagacttacgttgttcacagttgacgatctagtagaacgtatctgaactttgtacacaatctgtggttggttctgaaccgaagcgcggagcgccacatttttatcagcttttctctccctgcatgttgaagaatgttcagtccaaaaatccaatggcgtgagcatttgaaaaagatgaatgatcaagtaaatgtacgggagaaagccaaaagccgccatgaatgggaaggtgaaacgagcaaaggagttcacctccacgactccttccttccattcttcatctcttgctttcaccttgtcaaatctcaaatataccaatgaacatgcgtgcagcctgtacatacacagtatgtgggttgttgtctgcaaatcctcaactgttccggcgaggcagtttcgctgtgttgagttgagtgactcgaaagtcaacatgaggggagctaatctgcatgtcacaatattctcgagcagatcataggatcga

SEQ ID NO: 34702 - DNA, 186 bp, Oryza sativa
atgcctcttccaatggttatgtgcccctccaataattgctgaaatgctaaaatcatctgcactcttcttgatgcagacacatgccactgttagaccttcagtggtggaactactactcgaaatagccaaatactgggatttgtatctgatggaaactgtacttgatgataagagtgaggtatgaat

SEQ ID NO: 34703 - DNA, 349 bp, Oryza sativa
accaatatagagtaacaggacaagtttttaatgaatacacttctccacctagacatatgctcttggttgatccactcaaaccaaacaaatcaaataaactatttgtccaatctaattattctgacaaagaaaaacatagcaaagcttatatcagcttaaaaaaactcaccggttcagacacctcgactgcagcattcgagacaacctccgatgacatcaccactccatcctaaccaccatctctgccttgaatccactcaacaatccgctcctcccctacaacatagagcagatggacagtgtgttacctaactaacatgttcccaacctcggactgatcaacatgttc

SEQ ID NO: 34704 - DNA, 459 bp, Oryza sativa
tggttacagtcgttagagtagtactttaaagtcctgagtttaaatctttatagaagtaaattttagattgtgttgtccacgggacaaagttctctattgcaatggccgtgtatatccagttggatgtaaaaggcaaggccgggtaaatgctcgatcgggttgagtaatgcggcgcgaattgaatcgaaggatggatgaatttgcaggtggatttggtgggcgggtactacgactccggcgaccacgtgaagttcgggctcccgatggcgtacgcggtgacgatgctgtcgtggggggtggtcgagttcgagaaggagatggtcgacggcaacaagctccaccgcgttctcgacgccatccgctggggcaccaactacttcgtcaaggcccacacccagcacaacgccctctgggtccaggtacgcacgcactcaaggcccatctcaccaagagcccaac

SEQ ID NO: 34705 - DNA, 559 bp, Oryza sativa
gtgtgtttctacccagtcatgatcaatcattcacgaagtcagaagctcagagcagaacaagtaaacctcaaaatccagctaagggggtacagagaaatacaggattcacgtcgaattttccaaaatgtaaaatctggatgcttactagacgaccaaaatgccgtcttgttccatgcacaacggtaaactttaccttggcaggcaaagaatttaaccactggtcctactaatcgaagactagactggtactattttttttgccaggacgtacaaaggatgaccggccaatttcattaagatagaagaaaagactagcctggtactgcccctataattagccactcaatagcatcagcctttttgaacagcctagcaatcatgttcccaatcatgaattcaaacagaggtagtacggtcctattattcataaacaggtattactattaggacggaattaacatatattttgttcactgagccaaacactaccaccgaaaataacatttttttttgctgacaaatatgaaatatagagttcatagaaggtgatctctttaat

SEQ ID NO: 34706 - DNA, 716 bp, Oryza sativa
cccactgaggaaggtggagggggtgggtgaaaagtgtccagacctgtgatgacatcagacagcctctgagctactgcagagaccccctatacctatggaccacttgatttggtgacattttcaaaatatatccaaaatctgactatttctcaccacccccagcactgccatgtgccccaggccaccacctcctctccccacagggctccccgctgctgctgtggcccctcccaggctattctccacatggtagccaaagtgaacttctatgaacttctacaaacagatcatgcaactcctcccccagaaacccccaagccttctcttcccactctgtgaaatggccaaagcctttaccacatggatgaagtcctctaagacctgggcctcgccgacttcactgacctcaccttgcaccactcccattgcctggaagcccctcaaagacacagagcacactcccttccgtgggatttgcacttgaagttccctctgcctggaacttgcctgtcttcctcctttgcttccttcaggtctctgctcacatgtcatgctattatcaaggacgtccctgacaccctgtatgacagcactgtcctgcagaaccatctatgatatggaaatgcgtcataacctgagcttccaatacagtagccactggctacacgtggctactgagcacttaaaatgcagctagtgtgctggggaactgaatt

SEQ ID NO: 34707 - DNA, 26273 bp, Oryza sativa
gtaggtgggattgggtcggtactcttgtctatggctaggatgggttggaaactatgtcacgtcttctgtctgtataccgtggtggtatgtggcacgtggttacacgtgaggaatatgtgtcttgtgggtaaagatgtacacctctgatcagagtataatttattcgaatagccgcgccctcggttatgggcaagccgagcaatgtacccaagttagtgttttaattcttaaaacctgcttaacaactaaaatgtggaatggttagcctgggttggcttgggacgagctgggacccagggtcgggttgccagttcggtctgaatcatcgtaggccttgggttaaggcaggttcgtgtgggttcacggccttgataaataatattgtttagttctagaatcgtgtttaccaaatagctttgagcaactaaagatctttaaatgctgtttactgtaaccctaatcctttatagtgtaactcctttgtgggtgtgtcttgttgagtacggtggttgtactcagtcttgctcaatttttcccaaacctagaagaggagcccctagaagatgaaggctttggtgtctagctcgtgcctgccgtcaagcgcctgtggtcgtcgccctagtcttccgctgtttctcggttgtctttgtgtgtgctgggccttcgctgcccatgtaataaattaactatttacgcttccgcttgttaaactctgaattgtatcaacttctggtgtaccttgcctcctgggacaaggaataatacacgcacgtaaggaacgcccgttgggttatttccggtcgtgacaagttggtatcagagccacccttaaccctaggacgagccgtaggtcccaagccttagcaatattttcgaaataaaaatcctttgtatttgtgaaaatcctctagtctctctctgtcttgctgcttcgtttatcgccaaaatctgacctttaaaatgttgcttttctttttgtttttgtttgtagatggccggcagcgtcagccgtcgtggtctggacatgactggtttcgtcttggagctgcggggcatgtgcgttgtcctggggtatccgcatggagtggactaccagggcaggccgcttccggagcaggagggtgacgatgcagagccccacgctgcttgggaggttactgcagtgatcctcactggctctcccgagcggacttcgctggcagtcaccgcgggtggagattctttctccgccgcttgccagagcgccgctctcctcgccatctgcactcttcaccagcgctacccggacgagttgcagcactcgccctaccgctaccaccctcgccgcggaggagcccgcgactacgccaccttccgggatgctagctcggaggatgacgctaccatcatgcacctggcgcgcatggtggaggcgtacgacgcggctcgtatcgacttccatcagatggtgcgccgtgggatggtcgagaacaatctgaagatcctggagctgcgtcaagagaacctgcagctcaagaaagacctagacgcagtggaggcgcagctgcatcagctcaagatcgcccagggagaggtctgccgccccaagcgtcgccgcgtctgccgcagccagaagatcaccgcccgcaagagcacctccaggcccgagcttgttcgtcagtccctggcatggacttgcttcgtcgagaaccctcgtgccgagcccgcgtgtcacgcccggaaattcactagtaatttccgaactaatttgtgcataaaatcctcgtccaggaatcagccgaggtacacaaactgacaatttaatatacaaatccatcttaataataacgttacatacttacaaaagaaaagaaaacagcagcggaattaacggtctagcgatggcttcagctccactcccacaggcagctcaactggggtataagccaaacgtcttctccttctggatcctttttcttcaactgaggttgattgattattgcaagaatgagtatatgacatactcaacaagccacacagcaaatatgcaagtgcacaaggattccaaaggaatggcataatataggctcatttgcaaaagcagcatttagcaaagagttaagataagtaaaacagtagagtaattaatcatcaattttaatcaacactgaacaacacacccatgctgtacaggcccaaccatcctgaacaaccatacccggctgtacagatctaactccaaaccaggagctaagcaaattattaccaattataacatccataattattgtgaaaggtgtgagactaatcacgaaaaacattgctcaacccgcccataaccgcgggcacggctattcgaatagttttactctggccagaggtgtaccactgtacccacaagacacaaccccacatcatgtcaccatgtgcctcagtaccaccacggtacctcggaaaggagttgtgacaataccccttgcacaacataacccattatagcgcacctttcctggatcataatcacccccttataaacaaggcatggactccccagcgacccccgtggacttctcgccacttctcagtctggcgcactataatgaatcacgctatacaaaagataaagccgttgcccacgctggcttgtggttggcacgataaatgtctcacaacagtagctcgcgaaccggtccttaattgccatgagcacgaccttcaaaaccatgtgctcacaacccaccactaatcatattttaattaccaattaattatcataacacgattaaccatcgtgagctaccattaaatataaccataaataataatgtagtataaatgattcatcccattagtgagctaatgtctctaagcattgctaagcaattatatatataacattcagctgaaccaaaccaatacataaggttcaagctaatcaatttattacccaaggtatcaaggaatagggcattcaatgcaaattggccataacaaaggaataggttcacaccacccggtgacattcgaaaataaatgcacagttgaaataaatagagaatttaaatataggatcaacatgctcaaaggattgtgtttagaatctgtgtgacttgccttgcaacaatcgatcttcaattaatcttcttgatcacttccgacgcactcacgaaccttcgcaacgacggaaacgacaagctaacacgcaaaacgaagaaaaagactaataaaaaccaaataaacaatacatataaaataaacaaacatgtagatcataattttagatgaattatgagacttgaacagccttattctgacttcaaaagaatttattatgaattttacaagattaaatctaattaaagcccatttaaaaagaattaaataaatttaattcaatttatggacaattttaatatgtagatctttattttagaaaaatttagcaacttgaaccacctgaaacggatctacggttatttagatatgattttccgaagatttaatctattaaaagaaattggaaaaggagaagatgatgacgtcagcatgacgtcacccacggaggccggctagggttggcgacctcgccggagctaggatggtcggccgcggctttggaggacatgtacacgtagaggacgacgagacgaacccaacggtactcaccctcgaaccaaacgacgaacgacgacggccggcgacgagatgaacggcggcggcggctcagacctcgccggagatggagctccggtggccggcgacgaaaggggacgggtggccgagcttcctcactcctcggcgcacctcttggcggcggcggcaacggcagcgacggcaggggcggcggcgcgacctcgccgaagctcggccggcggcggcggcgagttggacgacgcggcgacgaggctacggggcactagagagctcgggaaaaggggcaaacgaaagaggagtactagagggtcctatttatagccttggattgaagagatcggactcctcccgcaagaaatcgatccgagaaatcaaaaactcggttttggagataaactcgaaaacgagtttgattcggataaaatacccaacgatttgctccgattcttgaggggaaagatagaggagaacgagaggataaaatcccctcaaacaatcggaagaaaagaggccggattgggtgcggatttgagaggagaaaggagcggctcgggctcggcatctcgcccggcttgggcgaggccggaggttgaagaaacctctgacatgtgggccccacatgtcggcggctagagggagagggggcgggcggcgtcggctgggccggcttgggccggttcggccgcgcgcggggagaaagaatgttgggccgaattcagcccaacgacttaagggagggtttttaaaactttttcaattaaaataattcatgaaatgatgtttcatttattaaaaatacttcccttgctcaaacaattcccagaaaattctagaaaatagaggaacaagcaaagtatttaataaaattttatctagctcaattttatattgagatttagcaaattaaaattagatcttctcttttaagcttttaaaatcatttctaataattccttttaaacaacaatttataacttaaggattttaaacaagaaaagcacttaacaattataattagatcattattgatcaaataattactgaactgttctttgtatcatttaggaattgagctccgaaaaatccgagaaaattccagagagtataattaaccatggagaattaaaaaaaattaaatccatccatgctttatatttaggagattttatttcccacaattaacttcacttgtaaattaatgaacatttaatataaattctattattaatttattaaataatttataaatcctgaaacgaaaatcaggatgtgacaccgcgcccgtggttccccaggagggggaagcctccggcgttggcagcacggaagatgcgctgttgctcaccttccgtcctggcccgtcgcagcggtagacgagcagttagtaggcttgcgcgtgtgttctttctcgtttgtcttcttgttggagttgtgtggggcatggttatgccggtgtgtggcataactgtgtcggagcctgcctttattttatttgcctaagcaacttgaactttaatgaaccaatttaatagcagtaataaattcaagaattatggtagtcgtgggtggttagctttaattgtcagctctctctgtttgttggttctgtgtggggttttcagatggtgatgaccaggagaagtgctagtaccggtgatggcaaccaacctgaaggcagcaaccacaaccaccagggcaggccaccttcaccttcttctccgcctccaccaccaccaccagataccaacgccattctcacccaaatcctcgcccagcaggccaacatgatgattgctttcctccaccacctccaaaatccgccacaacataatgctccaccaccacccccacaacactctaaactcgccgagttcctccgcatccgtccacccaccttctttagctccaacaaccccgtggatgcgttggattggttgcatgccgtggggaaaaagctagacactgtgcagtgcagcgatgaggagaaagtcatcttcgccgcccaccagctgcaggggcccgcatctctatggtgggaccatttccaggctacgcagccagaggggcagcctattacttgggctcgcttcactgccgctttccggagaacccatgtgcccgccggagtcgtggcccttaagaaaagggaattccgagagttgaagcaaggcaaccgctccgtgatggagtatttgcatgagttcaacaacctggcccgttacgccccggaggatgtgcggagatgaggagaagcaagagaagttcttggcaggaatggaccctgagctgtccgtccgtctagtttccggggactatccggatttccaacgtctggtggacaagagcatccgcttggaagccaagcacaaggaactggagtcgcacaagcgccgcttggcgaatttccgcaatcaacagggtgctaaccaaagggtccgctacaccaatccctatccagggggatcgtcctcgcagcagcaacctcgctccgcgccccgacctcaattcgtggtgcgcgtcccacagccgcagcaacagcagagtcagcaagggactcgtgcgccccgtcctcctacaccaactgtgcagcctggtcaaggccgcagggacgctcaaggtccgcagcgtctgtgcttcaactgcttcgagcctgggcactttgcggataaatgcccgaagccgaggcgccagcaaggccaagcgcctccccgctccaacaacggtggtaaggatgtcattcggggtcgtgtgaaccacgtgacggccgaggacgtgctgacaactccagacgtcatcgttggtacgttcctcattcattccatccctgctaccattttgttcgactctggagcatcccactcgttcatatctgtgccattcgtggggagaaatcagttgggggtagaaaggcttaggaaccctctgctcatcaccacccctggaggggttatgacagcaaagtattatagtcctgccgtccctatagaaattcaggggattccttttccctcggatctgattcttctagacaccaagaacttggatgtgatccttgggatgaattggttggctcaattccaaggagtagtggattgcgcgagacgcactgttactctgtaccgagggccggaacaaccggttgttttctttgcacccccaacctctgtcagaagttcagaacttcatcagatagtactgtcagaaatccccatcgtcagggagttcggagatgtgtttccggaagaactacccggtatgccgcccaagcgagagattgagttccggatagatcttgctccaggaaccactcctctgtacaagcgaccctaccgtatggcagcaaatgaactggccgaatttaagaaacagttggaagagttaaaagaaaaggggtatatacgtccgagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcgattagcttaaaagtgccacggtattctccaagatcgatcttcgttccggaaatcaccagttgcgcattagggaagaagatattccgaagaccgcattcaccacgcgatacggactgtatgaattcacggtgatgtcattcggtctaaccaatgctcctgccttcttcatgaacttaatgaacaaagtgttcatggaatacttggataagtttgttgtggtgttcattgatgacattctgatatactcacaatcagaggaagaccatcagcaccatctccgtctggtgttgggaaagttgcgggaacatcaattgtatgccaaacttagcaagtgtgagttctggttgtccgaagtcaaattcttagggcacgtgatatctgctaaaggagttgctatggaccccgaaacagtgaccgccgtcactgattggaagcaacccaagacagtcactcaagtccgcagtttcttaggtttggcgggatactaccggaggttcatcgagaacttctccaaaatcgctcgacccatgacacagttgttgaagaaagaagagaaatttgtgtggagcccgcaatgcgagaaggcgtttcaaactctcaaagaaaagctggtttcctcgctagtgttagtcttgccagatactcgcaaggatttcatggtgtattgtgacgcttcgcgccaaggattggggtgcgtgctcatgcaggacggtcatgtggtggcctatgcctcacgccagctacggcctcatgaaggcaactaccctacccatgatttggagttagccgcggtggttcatgctctaaaaatctggcggcactatctcattgggaatcgctgtgaaatatatactgatcataagagtttgaaatacatcttcacccagtcggatctgaatcttcggcaaaggagatggttagaactcatcaaggattatgatgtgggaattcactatcatcctggtaaggccaacgtggtcgccgacgctctaagtcgaaagagccattgcaacactcttaacgtccgtggcattccacccgaacttaaccaacagatggaagccctgaatctgagcatagtgggtcgtggattcttggctacgctggaagccaagcccaccttgctcgatcaaatccgcgaggctcagaagaacgacccggacatgcgtggactcctcaaaaatatgaaacagggtaaagccgcgggtttcacagaggatgaacacggagccctatggaacggaaatcgggtatgcgttccggatgtcagagaactcaaacagctgatacttcaggaagctcacgaaagtccttattccatccaccctggcagtacgaagatgtacttagacttgaaggagaaatactggtgggttagtatgaagcgggaaattgcagagttcgtggtcctttgtgatgtgtgccagcgtgtcaaggcagagcaccaacgaccggccggacttctccaacctctccaagtaccagaatggaaatgggatgaaattgggatggacttcatcaccggacttccaaaaacccaaggtggatatgattctatatgggtagttgtggaccggttaaccaaggtagctcgatttattcctgtgaagaccacctatggagggaacaaactagccgagctctacttcgctaggatcgtgagtctccatggcgttcccaagaaaatcgtatctgataggggaagccaattcacctctcacttttggaagaagctccaagaagagctgggtacccgattaaatttcagcaccgcgtatcacccgcagacagatggacagaccgagcgtctaaatcagatcctagaagatatgcttcgcgcatgtgtcctagatttcgggaagacctgggataagagtctcccctatgccgagttctcctacaataacagctaccaagccagcatacaaatggcaccttatgaagcgttgtatgggcgcaaatgccggacaccgctcttgtgggaccaagttggggaaagtcaagtgttcgggactgatatcctgagagaagctgaagcgaaggtcagaaccattcgggataatttaaaggtggcacagccacggcagaaaagttatgcagataaccgtcgccgtaacctggaattcgcggtggacgattttgtgtaccttcgaatcacgccattgcggggtgtacacaggtttcggacaaaagggaagctcgcacctcggttcgtgggtcctttccgtatcattgctcggcgcggagaagtcgcttaccagttggagctgcccgcctccttgggcaacgtgcatgatgtgttccatgtgtcgcaactcaagaaatgtctccgagtgccatccgagcaggccgactcagagcaaattgaagttcgcgaagacttgacctacgtggagaggccagtgaaaatcctggacaccatggagcgcaggaccaggaaccgggtaatccgtttttgcaaggtccagtggagcaaccacgccgaagaagaagctacctgggagcgtgaagacgagctgaaggcagcccatcccgatctctcgccagttctttcgaatctcggggtcgagattccgtttaaggggggtaggtttgtcgcgtcccaaaacgactctaaaatacatcctcgaaattatgcatataataagtaaaatccatgtgaaagcctccaacaattaaaatgtgctaagttaaaagtcaaataaggcttggaggatttttgtatatttcctaaaagcctaaaatgcgtaaataaattttagtggaattttcagagcacaaatattaattaagaagaaaaaaacaaagttaaaatggttttgtaaaaagaaaaaccctaaaagtcttttccccccctctccccctcttgggccggctcggcctcctccccgcgcgcgtgccgctgacggacgggcccgcccgccaccctcgctgacgggtggggcccacccgtcatccccttcctcccgccgctcctgccgcctcgcccgtgccctagcgccgccgccgccgcgaatcccgccgctcccgtccgccccgcgcgcaatcaagaggggggaaacactccccgtgattccctccctctttccccccacttttctctctctctccctcggatttgttcggaaacgtttccccctaaacctcgccggcgcatcaatggcggccggatcttccgcggccgattccccctcatccggccgctctctccccctcccaaccctatataaacactccccgtgcctccctccaccgtttccgccactcgccgctctctctctccgccggaatcgagctcgcgccgtcgctctctctctccgccgtcaccgccgagctccagtccgccgtcgtcgtcgccccggaccttctcccgcttcggcgtcgccttctccgggttcgccgcaacctcgccgacctcgtccacccctctgtttcacccgccgaccgccggaacgccgccgtccccgtcgacccgagccgcgccgccgccttcctccgctccggtcgccgttcccgtcgtcgctgtcgacccggggtgagccgtggaccgccgtttcgcttcccccttccctcatctctctcgggcgccgctccgccgcgctggtggtcgccggcggcgaccatcggggcgcgggtgcgccacctcccgtcggctgtgccggcgtggccgccttcgggcgcgccccgcggctgccatgtggggcccggtcgtcagccgcccgcgccctcgggtgcggctgacgcgtgggacccacggcgccggccggtgtgagccgggtgcacccggtccaccgtggaccgtgaggctgccgcgtaggccccactcccgtggacccggtccgcgcgctcctcccctcggctgacgcaataaatccgattttaaattaaaatttaaataaagaaattcgcaaatatccatttaaagagcatataaacttcaaatggccataacttgaccatttgaactcggaattggaccgttcaagtctctaatttctccttaagaagtcaagaacccatttttgtgctttgtttctgcttgttatatggagtttattagagtataagccttttcttttccgttggtcgtgtagacgctgcagcttcggaagatccgctcttcgtggaggttgaagccgacgtttgggaaagcgagcaaggcaagtcacatcatccttgaacatattgaatcccagtttataaaattatgttgatttaaattattgcattatcgctttatttaaattcccgcgttatcactgttttatctagccatgcctatttacctttgttatgaccttattattgtattgttattattaccttgttcaccctagaataaacaaaaccccaactagtggacactctactcatggtatcactagtatgattttagttagatgcttcgctttttaattaggtaacattaggtggtttttcaactctagactttgggaatatttatatcacccggatactatggaatggtttggttattgtggaattggcttcacaccgctccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggaagaagtcgggggtcgatggacatctccagggcaaatgaaggctacacgagctgcggcccagtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttctgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttagcctgggttggcttgggacgagctgggacccagggtcgggttgccagttcggtctgaatcatcgtaggccttgggttaaggcaggttcgtgtgggttcacggccttgataaataatattgtttagttctagaatcgtgtttaccaaatagctttgagcaactaaagatctttaaatgctgtttactgcaaccctaaccctttatagtgtaactcctttgtactcccttgcatttattctgcacttgtgggtgtgtcttgttgagtacggtggttgtactcagtcttgctcaatttttcccaaacccagaagaggagcccctagaagatgaaggctttggtgtctagctcgtgcctgccgtcaagcgcctgtggtcgtcgccctagtcttccgctgtttctcgattgtctttgtgtgtgctgggccttcgctgcccatgtaataaattaactatttacgctaccgcttgttaaactctgaattgtatcaacttctggtgtaccttgcctcctgggacaaggaataatacacgcacgtaaggaacgcccgttgggttatttccggtcgtgacagcatctaaatcagatcctagaagatatgctccgtgcctgtgttctagatttcgggaagacctgggataagagtctcccctatgccgagttctcctacaataacagctaccaagccagcctacaaatggcaccctatgaagcgttgtatggccgcaaatgccggacaccgctattgtgggaccaagttggggaaagccaagtgttcgggactgatatcctgagagaagctgaagctaaagtcaaaaccattcgggataatctaaaggtggcacagtctcggcagaaaagttatgcagacaaccgacgccgtaacctagaatttgcagtggatgattttgtgtaccttcgggtcacgccattgcggggcgtacacaggtttcagacgaaagggaagctcgcacctcggtttgtgggtcctttccgtatcgttgctcgacgcggagaagtcgcttaccagttggagctgcccgcatccttgggcaacgtgcatgatgtgttccatgtgtcgcaactcaagaaatgtcttcgagtgccatccgagcaggccgattcagagcaaattgacgttcgcgaagacttgacctatgtagagagaccagtaaaaatcctggacaccatggagcgcaggaccaagaaccgggtaatccgtttttgcaaggtctaatggagcaaccacgctgaggaagaaggtacttgggaacgtgaagacgagctgaaggcagcccatcccgatctcttcgccagttcttccgaatcctggggtcaagattccgtttaaggggggtaggtttgtcacgtcccaaaatgaccctaaaatatatcctttaaattatgcctagaataattaaaatccatgtgaaagcctccaaaaattaaaatgtgcaaagtaaaagtcaaacaaggcttagaggatttttgtatatttcctaaaagcctaaaatgtgtaaataaattttagtggaattttcagagcacaaataataattaagaagaaataaacaaagttaaaatgattttataaaaagaaaaaccttaaaatttcccccctccccctcttgggccggctcggcccatctccccccctctctctctcctctcccccgcggcccattcggcccctccccgcgctcacgccgctgacgggcgggcccgcccaccaccctcgctgacgggtggggcccacccgtcatccccgacctcccgccgctcccgccgtctcgcccgcgcctagccccgccgccgccgcgaatcccgccgcctcccgtcgtccccgcgtgcaataaagtggggggaatcattccccgtgatcccctctccctttccccccatttttccctctctctctcgcgttcaaacgggcggatttgcccccgcaaatctcgccggcaccattgatggcggccggacctcccgtgccggtttccttcccctctggccgctctctcccccttccaaccctatttaaaccctccccgcacttcatccgaccgttttcgcctctcgccgcccttccttctcgccggattcgagctcgcgacgtcgctctctctctccgccgtcgccgccgagctctggtccgccgccgtcgtcgccccggaccgcctcccacctcggcgccgcctcctttggcttcaccgcatcctcgccgacctcgtccacctctccgtttcggtcgccaaccgccggagcgccgtcgtccccgtcgacccgatccgcgccaccgcctccctccgctccggccgcctcccccgtcgccgccgtcgccccgggatgagctgtggaccgtcgcctcctttccccttcccttccctctctcggccgccgctccgccgcgccggtggtcgccggctccgaccatcggagcgtgggcgcgccgcctcccgccgaccgcgcaagcatggccgccctcgggcgtgccgagtggctaccgcgtggggcctggctgtcagccgcccgcgcccttgggtgcggctgacgtgtggggcccacagcgccgaccggtgtgagcccgggtccttaagaagtcaagaacccatttttgtgctttgttcctgcttgttatatggagtttattagagtaaaagcctttttcttgtttccattggtcgtgtagacgctgcagcttcggaagatccgctcttcgtggaggttgaagccgacgtttgggaaagcgagcaaggacatattgaacatattgaatcccattttataaaattattttgatttaaattattgcattatcgctttatttaaattcccgcgttatcactgttttattcagccatgcctatttacctttgttatgaccttattattatggctattgttattattattaccttgttcaccctagactaaacaaaaccccaactagtgggcactccactcatggtgctactagtatgaatttaggtagatgcttcgctggttaattaggcaacattaggtggttttacaactttagactttgggaatattcatatcacctggacattatggaatggttggattattgcggaattggattcacacctccccctctattcaaaaccctcaaaatggttttaggctgggctcggggtgcatggttttgatggtagcacctcggccatatatggaccggtcttcgggcctctgttgcaaagcactaccgtacttccacatgtctagtgggtaaggcttagtttctggctcagtctggttataaacaaaagtacacggatggggatggacgaagtcgggagtcgatggacatctctagggcaaatgaaggctacacgagctgcggcccggtagtcgagatgtcatggcacagggctggtgtcctgctgctaggggctcagtcctgcccacctgtcccgaaggttccggccgtaggtggggttgggtcggtactcttgtctatggctaggatgggttggaaactatgtcacgtctttcgtccgtatgccgtggtggtatgtggcacgtggttacacgtgaggaagatgtgtcttgtgggtaaagatgtacacctttgatcagagtataatctattcgaatagccgcgccctcggttatgggcaagccgagcaatgtacccaagttaatattttaatccttataacctgcttaacaactaaaatgtggaatggttggcctgggttggcttgggacgagctgggacccagggtcgggttgccagtttggtttgaatcatcgtaggccttgggttaaggcaggttcgtgtgggttcacggccttgattaataatcttgtatagctctaggatcgtatttacaaaatagctttgagcaactaagtgtcttttaatgctgtttactgcaaaccctaaccccttatatgataacccgcttgtactcccttacatttattctgcacttgtgggtgtgtcttgttgagtacggtggttgtactcagtcttgctcaatttttcccaaacccagaagaggagttcctagaagatgaaggctttagtgtttagcttgtgcctgccgtcaagcgcctgtggtcgtcgccctagtcttccgctgtttcacatttgtctttgtgtgtgctgggccttcgacgcccatgtaataaattaattatttacgcttctgcttgttaaactctgaattgtatcgacttttggtgtgccttgcctcctgggacaaggaataatgcacgcacgtaaggaacgcccgttgggttatttctggtcgtgacactgctgatcggcaagagcagaagcctctacaacaagcatgcaatgcaaactcaattccaccgtgcaacagatcaactcctatctaccggtgtcttttctttctaatattaaatttttccggcgagattcagttatcagtttgaagcggccggggtcgacgtggactcggactccaaaccaaaaccattaagcaactgctcgtcatcaagcgatcaaggaggaatagatggaataatttactgtagtcatgtatgctcttgatggtgcataacttggcctacagctgtatattacatgtttccagtcacgaagctatctaccggccaaacagttttttatttttctacaaagcgcaagcattcatcaaggcacacagcttggtgtcgaggttatcaagattgcgatctggctattccaagtcgatttatatttttcgccaaaattccggctattagacctttgaaacaagagcttctggatcacaaaccactaccaggtttatcgttttaaattttcttgcataaattagattaattcgcagatcactaattgtaatttgatctattattttatgcatgtgctgccggccgccttcgtataccgccgactggtgttctcgcctgcacggctggcgtattatgccgtcgttgttgggcatctacgtcttcaccaccggccgcctcgattgccgccgactggtgtttctgcctacacggttggatgatcacaccaccgttgttgggcgtctacaacttcaccaaccggccgcctccttcgctgccgactggtgttttcgcctgcacggctggcctattatgccgccgttgttgggtgtctacgtcttcaccgaccggccgcctcgtcgatccgccgccgattggtgtctccgcctacacggttcgatggtcacaccaccgttgttgggcgtctacgtcttcaccgaccggctgcctcgtttgctgccgactagtgtttttgcctgtacggctggcctattatgccgccgttgttaggcgtctacgtcttcaccaaccgaccgccttgtcgatccgccgccgattggtgtctccgcctacacggttggatggtcacaccaccgttgtggggcgtctacgtcttcaccgaccgaacgcctcgtcgatccgccgccgactggtgtttccgccttccggctgcctcgtccgccgccgactggcgtttttgcctgcacggctggcctattatgccgttgttgttgggcgtctacgtcttcaccgaccggccgcctcgtccgccgccaactggtgtttttgcctgcacagctggcctattatgccgccgttgttgggcgtctacgtcttcaccgaccggccgcctcgtctgctgccgactggtgtttttgcctgcacggctagcctattatgccgccgttgttgggtgtctacgtcttcaccgaccgatcgcctcattgatctgccgccgactagtgtctccgcctacacggttggatggtcacaccaccgttgttgggcgtctacgtcttcatcgaccggctttccttcgccaccaccgattggtgtttccacctatacggttagttggtcacaccactattcatgggcgtccatgtcttcaccgaccggcttgccttcgccgccgccgactggtgtccccgccttcatggctgacctattatgccgtcgtcgttgggcgtctacgacttcaccgaccggcttgccttcgccgccgccgactggtgtccccaccttcatggctgacctaatatgccgccatcgttgggcgtctacgacttcaccgccggcctgccttcgccgccgccgactggtgtccccgccttcacggctgacctattatgccgccgtcgttgggcgtctacgacttcaccgccggcctgcctccgtcgccgctgactggtgtcctcgcctatgcggttggcgggctcctccaccgttgatgggcctcgttatctacatcaccggcttgcttccactgtcaccgactggtgtcttccttgttattgatggacgactttgttcctacattggttacctctgccattaccaaggggaatattacaaagctaaatcatcattaattttcttctttatatgatatttttctttttctctaagtcactacatcaattggttcgccattgactagtgagtcgggggctatagatgttatgtcatattttttgaacaattttcataatatttatattgattgctcacgacataatctgagtataaaagtgcctatcgagttatggagttctatcttcctatgcttcccgtttgatttgtcgatggacagttgcctttgggccgattcctaccacccgggggctcactggatggaccgagtaacgcaagatgctaagtgttattcggaataaatcaaaagcatagagataagataaatttattttctgctctttacaattgcaaaagtacccgagtagtaaattctgattcgtgaaactttgttccattaatgacgaactcatatcactcatatgcatgtttgggaagtgcctaggccgactcccgatgtttgggggctatgactagtcggacagagtgtttaaacgtacggagtcatctgctcggggaaatcaaaattgacaagaggagaaatacatatttataaatattttaaaatacttgaatttttctcgagtattatatttacatcagatactactcatcctatatgtttgttctgtaggatccatatccagatatgcataaaagggattcatggctttaagcttatctcctacgcttcaggaatggatcagtcagaacatcaccaccggcttgccttcgccgccgccgactggtgtctccgcctgcacggctggtctattatgccgctgttgtcgggcgtctacgtcttcaccgtcggcttgccttcgccgcagccgattggtgtctccgcttgcacggctggtctattatgccgctgttgtcgggcgtctacgtcttcaccgatcggcttgccttcgccactgccgactggtgtcttcgcctacacggctggcttattatgccgccgttgttgggcgtctacgtcttctccgaccggccacctcgtatgacaccaactggtgctatcgtcttcacggctggccacgtcgccgccaccgcaaataggcgtcattaccttcaacgcaagctgtctacgtctgctgccgactggtttcttcacttcgatggctgcatgattctgccagtgttaattggtcttatcgtctttaccgccggtcatctcgtctgctgttgactagtgccctcgcctctacggctggtttatactgctaccactactgatggacatcatcgttttcattgctggccgccttgtctgacgccgactggcttgttcacctccacggctgcgcgccttcgtcatcattgactggcgtcatcgtcatcatcagtttgccttcgccgccgcccatggtgtcttcgttttcatggttagtctattttgccgccgttcaaggacgtcttcattttcgtcatcattctacttcttccgtcgccgactggttatgccgccgtcgactgggtggagcaacttcatcttaattatcttcggaacaggcaagctctattgcctcaacttcgcaagttttgctacttcaccaaccacaacgtccacaagatcttcgacatctcagcatgcacttccagattcgacaccgcgctattccactacaacaagtggttcttcaattttcaagaattctagtcggacattttcaacatgtatcttcactcaagcaatgactactcgacgacaagaagctataattctcgactctatgttcagatgtttcccaactaaccaaagagtcgggggctacacaaatacaggactctcaaaattcgacaagctgaagcaatcaattaatcagccaacgagtcaactccaggagtcatcagttttgtcttcgcttcagagctggcgttctacttgagcaactccaattatttcactggaaattttggcttctccacgctgccacaatttactccaaaattttcaagtatcaagtttgagattttatctatatgtctgggcgtttggagttatcaaccaattaacacagattcaacgagttggacaacatcatctactttccttcaagtgaagcatctacaacagctacaattccaagttctactgccatctttacagatcaaggggtgttgcatcaatcttcgttatgcacacatcaaaaaaattacttgagcttcgatatcttctcaacagtttgatggattattgtcattgacttcatcaccagcacctctacttcatcggccctgacatctctgccgttgctaatggatgactatgtcttcgcctccggttgcttccgtcattgccgacttgttatttcgccttcacggttgacctactatgaaaacgctgatgagcgtcttcgtcattatcatcggttgctacactgctattgactggatcaccgacatcgtcatcttcatcaatatcctgtcaagcctcttcaacatagcatattctactgctgtttgatgggtaacttcgtcatcataatcgatcatctatgattgctgcttatcatcattactgtcggttgcgtttgtcgtcgccgactatttttttcatcttcatgattggtggatttcgtcatcgcctttgatgcgtgtctacatcttcaccgtcggcttgctttcgtcaccaccgactggtatcctcaccttcacggatggctaattatgtcgccgctaatgggcattttcatcttcttcaccagctgcctcgtctgtcatcgactgattatttcgctaccatggctacacaactttatcgctgggcaccttcatcttcattgctggttgacctgactgctgccgactggattcttcgcctccacggttgtgcaacttcatcacttttgattggtatcactatcttcactaccaccaatatttttgccacctctggtgagcaatattatctctatattggtcgccttgtttctatgccaactgcatcagctaccatcaatggaccattgcgactacggcagaaggacaagctatatgatcaggggcttactagctcaaacacaagtatcataccttcaatttggacttgttccggatacatgcaacatgaattcatgatcatgagtctattttctatgctcaaagactggactatttattattccccgtaagggttatcaatcgaatacttgcgcaagtcaggattcaattattatatctattttggagtatcccataagggataatcactctgatcagaagctattcatataagctacacttggtctatatcacccggaagatttattactcgggagcatgttacatgcgtcatcctttaaagggtgtcgaaggcatattttttagcctaggcctaatatgtctgcagcctatattttcaggtgtagcctgtcacgttcttttagggacttagatactttttgcttaggccaaagtgcacgtgatcaagtgcccaataccttaaaatccttttataccgcagttactcaactttttaggagttggtacaatgcatcttaaaaggtgtcaaacagtaaagctttatatagctgccccgctgacttttttatataagtgaaggtgctgtttgggtttttaagcaattgattgaatacaatattgttgctttttgccacgtaagtgtgcatttttatttgaccaatattatggcttaggctgattatatatcttggtcattttccaagcggttggtaaatcctttatgagtttatttactcggattttgcaccatatatgccgtatatttccgggtgtggtgaaaccatgtgtcttttagagagttaagtacatctgttaaagcagtgtgcgcatggcgtatgcccaatactttcaaaatttctttattcacagcattcaagttttttttatagctgttttgctatgtgaattttcaatgatgtagtcaactttaggttgctcacatcaatttttaccaagcagtcggtatatcacttggatcatgttatttgggggattcacaccgcatatgctatatattgatatcaagtcacttggttgattacaattatcaaaaccactcggttggttggattatttattcgttgactatatgcttagtttgttcagctaaccacgtagtcgggggtacacctattaggtgcatctagtcgatgcacctgactttatttttcagccctccacagtcttcatatttggtaaaagtactcgggagaccatggcaaaaatgattgaagaacttggctttggagtaatctggttcgagagaagattatctttttgactgtgaaggtctcaggggctactgtgcagattatgggtaccccatacccacacggcatggttatccgactagttataggggataacttatatctatggaatatgtaacagatcatgacttgggtattacgtttccttgtatattacggaatggcctaaagtcctggtttggtaatattgtaaagtagatttaggaaaccgataccgtattggttaaggtttctatcttgtaatcctgccccacgtcttatataaggtgggcaggaggccctctagggggcatgagcacatatgatcatcagatccgcctcagggaagccaccgacgccgccgttgggagggtgtagtcgccgagagggagggacaactgtcaaggtcgacggggagtggaagaagaagaggcggagggacggtcgtcactgccgttgggagggcgctgtcgccgagaaagagggatagccgtcaaggccgacggggagagatagatggagagggagagggggagggacggccgttgccgcgtcgtgccggcgagacggaagggagagggggagatggagagggagcagtgccactggaggggagagggtagaggaggggaagcgatgccgctggaggggagaggggataggaggggaagcggcgccgctagaggggagaggggagagacggcgcctgtggagggaggaggacggggagaggcggtgtcgggcagggggagggggctggtggtgggagaggggaggaggggtgaattaatctagggttagggttttgattgatttggaactaattcgaaccatccataaaatcaaaacgaatggctcagattgatagagcgtcgagctggcctgcatcaccgaaccgcaccacttaatctcacacgggccggcgacccaacacattttcggttacggcccacacgataagtaagatgaggagcatggggatgttaattaaactttggtcgcttacggcgtgagaaaagtgggccggctcagttgtaggctaaagaagaaaatgggctaaaaaatagcccatatagaaatgaggatttttatttaaataaatactgaaatgatgtttgtattatcaaaattagcaattaagcactataaattccagaaaattttgaagagtataattaatatggagaatttaatacaaattaaattcaaccatatcattttatttctcacacttactttactagtaaattaatttaattatatacctacctacttagaaaatacccaaatatttcaaaaaattcgtatttcacttaattagaatttaacatgttttaattcaattttctcgttttttctttgcaactttccgttgcaatgcacggagtctagaaaatacccaaatatttcaaaaaattcgtatttcacttaattagaatttaacatgttttaattcaattttctcgttttttctttccgttgcaatgcacggactattttgctagtaatgaaataatccactagcaaataaccacattttaaaaatgtctttcctcaaaaattcacttcaatggtgtccaccaactataatcacaaaatttgtcgccctagagttatcagtaatgtttgtacaatgtttgatacgtcataagcgaacatgtcataagtgaaactagtcatagccatttctacttggctgacagatgttgaatcctagccacccaaattccaaatcatccacgaggctccatcagaaaaaacggtgcatacgcatttcaggctttcaacagtgtcatatttaccctaacatccagaaacgaatctcactatacacgatagacagcgtacctataattatttctgaggccgagaacgaaaacaccgcacatccctatactgaacaagcaaaacaaaaggtaaagaaacaatggagaattaattgggtagcgaccaacagaaactgctacgctttgtgcctccctcagattcagagggaaagatgcacctctcgagctcaactgcctcctcacctttacaaatgactagtcaccagcaaaaaagattaaaaaaaaaaaagaatgtgcaatgaattaacttgtctcaagtcagtcaatcgtcaatatcctgcacccattgcagacctgcaacaggacaaattaaaggtgtcaagcactcataaaataaagttcaacaatatgggtgccataatctcgctaaagtatgcgagaaaaaaaatgccagattgaaaaatgacgagaacaatttttcaaagtaaagaaaaatacgtgggtaaaccttcagcccagtataagaatattgaatttctcatagtataaggttctaaaagatactaacaatttctacagagatggtgctgttttccagtgttgttcgcgcacagacacaagacagttcacactagaaatatggaggacataataaagctgctaggagctatgtgagggtggaactgaccttctaatactgattccacagctgaatttggaatcataagtccaacaatccgctcattatcatttgtctccaagcgagcgacacgtatcctcttgtgaatttgtcgaacctgtttgatcatgtcagcaaaaaaagaaaataccaaagagagaagctcagataaaacatggacgacatgtacaagcagcgaacctgcttagctagggccttttctactatgccccagacaggaagtattagaccacccaaaatattgatttcctgtaaccttctgcctactgtacaatagcttccaagtttgcatttgggtccatgcatacactgaaacaagtcacaggacacgatttaatgaagtaactggctgaagtacagaaataggcaattaattaatcatgtatgttctcgaaacaaaattgttgtgctcagataaaagtcacaaagtaaatcatgatcctgcaactataaattacttgcacaaaataaggggatgatagttgaagagtaaacagataattcagtgttggattactaaaacatatttcatacaccttacaataacttttggaaatttgtcgttcaaagagagatccttttgataatagaggaaaacaagttcctcaaccttttgactcagtttatttttcatccctcaactccaaaatcaggtaacctatccctcaactcttaaaaccggagagaattagtctattcaactgtttggcaattgtttcacgcacataagcacattgcacacaggatctgagggggtcaaaacctatttttagcaggatgagaatggaaccatgctaagagttgagggatgagagtgagactttttgtacagataatgatacaacagctttaaaaagagcaaactcatactggc

SEQ ID NO: 34708 - DNA, 830 bp, Oryza sativa
aatgcatagatgaaatcagtttgttagtccaattacatgaaagatatgctcacacatatacatctccctgcaaaaaaggctcaacagatggaggccaggaataaattcataaacttcacaacattcctgttgaagcacacctctgtgtgagtgaacgtgaacaccaggatttaaaccctagtgggtcaagtcttgcagtcacaactcaaccaacacacaaaaggtgcttccctagacgaaggtagtaactattactgaagttgagattctacagaaaatgctatctgaatttaccttcggtgattctttcattttaacactttttgctttgatgtcaacaataccggaatcaagctgtccttcacttcgtgcattctgaatgactatgtcaagtatacttgtgaaaagatcaaatagcctgataaatgaagtacacattaataaggtatcaactgaacaggtataaatataacaaaataaatttgttctaaaaaaaaacttgcctgttctgaatgtctggagccaagcctagaatgcgattgaggaaacggcctatgtcatgcagatcagaatcaaaaatcctaccagtaagctttcctccattttttccattgcctatgtgcacaataaacaaataataagatttgaattctacacttgaaactacatatagtagagcatcttgttctgcaagcatgacctgctgcatgcattttgcaaacatagttttcattcctaaaacattaatcagcacttcctttatcaaaaaaaaaaattgatcagcaataaatggataactgtatacaaaaagatgcataactctattactt

SEQ ID NO: 34709 - DNA, 14937 bp, Oryza sativa
aggaacaaacaaattttaaaactatgtcaatattgtttctttggaacatgaaaataagaagattgcaatgaatttagtcaattcctcacctaaaagtgtttgagcatagtctgaaccctcggagggatcaaatagtggtccagcaccgagtgcgtaagacagagaatcatctaattcaccaaggtagtaaaacaccttggaaacaaccaatgctgccaactgcctctggtcgaattcctcatcttcatataagctctcactgtaacaagtatataacattataaaataagtaaccagaaacacttcatgcttaatagagaagtccttgaaaatattaagttctaccaagttattaagtgacaatgaataaagaacataatttccagaaactataataccaaattgcaactgccaaaacatttaatggacatgcctcttccaatgtatctagctcccattaaatcccatgaacaaatcataaacaagaaacgagacgacacatgtcttagctcaatgtttttacttgacaggacaagcgctaaagatcaaacaaaatgttcctgcgtatagtcttgcaattcagacacttcaaagtcaaggattatgcatattcctcaaaccaaccataataaacagaaaaaaagaagtctcaacctaggctccacctgctcgttttcagattaaaattatgcttcattagaacccttcaaacaaaagccttggcaatccgagcctaaacgcaaattatttttaaaaaattaatattttttctcgaccacagcaactcctcgaagaataatacatgaatgaaccacaacagttagggaagtttgagttatctataatccatacacaaagcctaggttttctagtaccagtgaaactaaccgcccattataatcccctcccgaaatctccagcctaacagatcaaaccaacctagggttcatccaaaaaaatcgccagatcgaatctaaccaggccaaacgacactaatcgcatgaatcctccctccacacggcaccttcctagccgaaccccacctctcatccaaatcatcatcatcacatacatagagcaccaaaccccaaccccccactccacgaatcgaaccgaatcgcgcgaaacgccgcatcgggcgcagcgggccggcggggagggaaaactacagctgaaggtgggtgggggtggagcaactcacatggcggggacgctggtggagatctcgggccagaagacgtggacgagggagttgaggttggcgagcgcgtgcagcttgagctccgccgccggctcctgcagcatcgccagcagcccgctcgccgagctcaccatcaccgccgccgccgccatctcccgcctccgccgccgctggattcgacgatttggatgctcgtctcgtcggcgctgcttcggctttttttgccttttgcttggaggaggggaagaagaagagctctcgccttcgatgggaggggcggagatgtaaatatagcaggttttggaggggctcaatggtgaaatccgagtagggcgtatttctccgatttttttttggatcgggaaaaccaatgattgaattggcacccggatacgtatacggatacgatgcactccgtatttggtggagtactgttcgtactcaggcctcggcccattgtccagagcaaaaccaaaggcccaatgccctaccgttttcacccgtgcatttaggcgcagaataagttcactttgactccctcaaaagtgacccgaatctaattcatggccctgaaccccaaaaccagatatcttaaccccctaaactgttaaaaccggtgcaatttgactccctcaacggttttggaggacgattttgctgctgtggcgcctaagtggcgacattgaccgagtattcgtttcacgtggtgttgacgtggcattagaattaaaaaatatgcgtgggacccattagtcattcacacaaagaaatgtgggcccactgacatgcgggcccacatgtcagtcctccgtgtctccttccttcctcctccttctctcccttctctctctccccttccaagccggacatgcgcaagggcgtggcggctcaccaggatccttgccgccgcgaccacatcgttctgccggcgccgccctgatgtcgcccaccctgctcctcgcagtgagccgcgccgaccacctcctcccccgctcgctacttgatgccgacgtcggcctgctcctgcccgccgccatccccattgacgcatcagtcgggaccaaatgcgtgagacaggagacaaagaaaggcagtggcgcagtgccctgatggttcggagaactcaatggtatcgtgagctaccgctactgcctttggctgagaagaggatgaggaatcagcaatcatagacgatgcctccagcagattttgtgcagatgttgcttgccccttctctacacacctgaagtggaagaagcaagctcaatgagtagaagaacaatttatatgaggagatgcacaatccatattaccaccgtgaggtgtaagttagctcacgaatgtgattaagcgttacatgatatagcggtataatttgcaaaagagatggatatcacagccgaacaagtaacatacagattaacaaacaagtaaaactagtacaggccaaaaatttatctgtaacttgcaacatgaatccaactgaaatacatagggaactatacttgaggcttctgttcccaaccacccaaaaatcatagatagccccatcgacaatcacttggaacatagcgagcgtagcatggagatggcggagagtaagaagcgcgggattagggattggattggtgactcccagcggaagcggaaccgcaagccaggccgactgttcttcctcctcccgctctcctcccgccctccgcggcttcgccttcgcggccgtgaaaccgacggaggcttcgggatgcggccgcggcggcgagaaatgaactccggcgaggggaaaaactcgaagcacttatcggtcagatccccgcaatgcgcgcaaggttgttgcggttcgccaggatccccccgccacaaccacatcgctctgccggcaccaccctgatgtcgcccaccctgctcctcgcggtgagccgcgccacccacctccttccccactcgctgcttgatgccgccgcttcctctaccaccgccgccaccggccgaagagaaagaagaaggggaaagagagagagagaagggagacatggaggaagaaggaatgagacagggaggactaacatgtgagccccacatggcagtgggcccacatttctttttgtgtgaatgactaatggatcccacgcataatttttaattctaatgccacgtaagtgccacgtcaacgccacatggaacgaagactcggtcaatatcgccacgtaggcgccacgtcagcaaaaccgttgagggagtcaaattgcaccggttttaacagtttaggggtcaagatatctggttttgcagttcagggtcatgaattagatttgggtcacttttaagggagtcaaagtgaacttattcctttaggcgctctttgtttagacttataagccaatttataagtcgaaaagtctaaagccaacgtggaggattactaggacgggattcagggctatcaccacctgccgcctacatttgacaaatctatgggatacacaacaaacaaatgtagtctctaacctaggcaccacgtctaagttattaattattactctaatacttgcgcaggaacttccttctttattcagagtcctagtcctatagcacttagtacgaaatactaaataatgaacccacaaagatggaaatctatcttactcagactaagtaattaaataatggatatcatgttttatttcattatatgcaggtattgacggtcaaatattatgatttaaggaccgtcaagagtactccgttttcagccccggttggacgaccataacaggttgttgtaaagaactcggcaacccggagtggtctttcgaagtaccaggaggacactattagggggtattggccacacgattgtatactagtatatgtaaattaggaattgagtgcatactagaagtatatgaattaattgctttctatttcttctcccacttagttataaaattaattatcatgaatgatttgaatgggaaaaacgataacctatcatgataattagaggaaagggcagagccaatttcatttgtcatgataatggcattttaattaaaaatcctcatttcgttatttgtgcgtgcaacatgcgtgggaggcgcgcacggagtccaggcatgagatggcaacgtgtggttcatcggacgaccagaaaatttggctgagataatttttttttcagccggctgttatctagtcccttgttgataaatttaccttcggaaatttaacaaatataattataatacaatcataatataattattttataacttgcacgtaactacaacttgttgtaacttttcaaaaatctcaatgcaacatgctattttcataaaaagagatcatgggactccaggtaaaaaaaaaagtcataggaccgaatcctctctcatgtacatgtgctgtgattttttttcttcctcacttgtaaaaattttaaaacaaatctaactactgtgattggtacgcggggagcacgtccgataatatttgaatgcaggatgcgaggcgataaacaagataaacaaaaacaactatttttcgtgtttaaattaaattaaacaagagataaatacatgatgattaagaggataagctaaggatgttggagccattcagaacacgggcaccaccaagtgtatgaacacggcgaggatggcagccatgacgccggcgaccctaactgttgccgccatggcgacgccgttggcggtgggcgcaatctcgatgatgaagcggcatgacccggcagaggggtcgacagtggtggtggtggcgatgcccttgaagtcgcaggcacggtcgtcctggtcgttcacctggtagtagctgttgaacgcgtacgacacgttccccttggcgtcgaggccgccgcacgacgtcttgtacccgaggcttgtgcagtcggcgagcccgcacgcgtagctcacgccgtcgccgaccttctggtcgacgaggctcgccgacggcttcatcacgcaccaccgccgctgcaggtaggtcacacccttcgccggcatcagcgtgctgccattgccattgccgttgccgccgccgcgaaggctgagagggtacttgggctggccgtcgtagtagaagacgccccagtggcgctcgaagttgcccggctcgatgctcttctggtcctcgtcgatgaggctgaagaggtaggcgtcgacggggccaggccggagtggcgtgccctggccggaggcgatgtgggtgaggaacccctggttgaactgtcgtgcgtactgcgggttcgcgttggcgtcgccgtcggtcggccacccgacctcgccgacgatgatggacacgttcgggtacccgttccgccgcagcgccgccaccagcgtgtcgtggttggcgtcgaacgtgttctggtacgtcacgccaccatccaccaccggcgccgacgagccctgaatcaaagtagggatgaaaacggttcagaaatggtcggaaacggtaccatttttctattagttcttaaaagaactatatcaaatttctattagttttttcttgaaaatgataagaataattactatatttatgaatttaactatttagtgtatcaacgtcaaatcgatactgaaaaaactatattttaagaatgctaacgttagtacgatcgaaaaattttcatactattttcacccctacctgaaagaaggcgtagtcgagcgggaagttggggtccttgtagaggctgatgaacgggtacacgttggcgacgaacggcgcgccggtgtcggcgaggaactggacgatggtgagcatcaggccgtggatgtcggcgcggaagtcgccgtcggagggcttccccgtcggcgactggtacacgtcggcgttgagcggcaccgtcaccttcaccttgtcggcgagcccggccttcttcagcgctgcctgcacgctctgcatcgccgggaacgtcgtgttcaggtacgtcccgttgaacgtctccaggaacggctcgttcccgacggctacgtacctgccaaccacaatccgtcaggaaaattaaaaaaaaagcatcattttttcatcgagtaaattctctctatatatggccctattcttttctccaacaaaacttagattaaattttggatactcgtgaaacgcttttcaaactgctaaacggtgcgttttgtgcaaaaactacatgaaagttgttctaaaatatcatattaatccatttttcaaatttgtaataattaaaactcaattaatcacacgttattacaacctcgttttgcgtgaaacacttaatctttattttcatcttcatctttaggacatccaaacactaccgtaagtacttaaaattctactcttacgaacaagatctcaagcgttgaatttaattagctggtagctataaaagttcaatttttttaaagattctagtaaagctttttactagtatcgtattcattttcatcaaacaaaaaaaacattattacagcagaatattttcagagaattttttttgaaggtaattgatagaaatccggtttctatatctattcatggatatacacagttaaattttcagagaactaaaagagattttaagatgaagaggtggaagattatttgaggcaaggatcacttcagcacggttagacatctgcatcagacagggaagcatgaccatgctgcgaagaactgaaaatctccatataccatatgaatgcctctgtgccaggcattttccactgaaattcatgacgctagaacgagaaaaattgtggcatggtcccaagttcttgtgaccatcacaattaattatagccccacaataattttgttaaatcttcaaacaaattggctctagtaataaagttgaatgattgaaacatatcaggttttaataacctatgaaattcttttgttggaattggtcagaatttagaggcttctaggttccaagcaacccaaaatttcagggctataaaatatatttttttaaagataaggtgaaaagagattactttcagtaataagaaacagtgtggatgaaatttcaagacaagattaatgcagatgtggctactggcagcagctgcatgatctttctggatggctggacaagatggtctagaaaggcacaagagagattgtgatttgtgagagactattcctaaaccaaaacgtgtcaaaacctctcaaaatagttgctgtgtccttcggtttcttgagctttagcctttttcccctgaatctgatttcatcactgcccatacatgtcccaatcacagaagtggcaaatcatgaacaccagagataatggttttctcaaagctatgtgtgatgtgtgtgtgcagtagcactgagcaaaagagaaagagcaaaaaggaaaaaaaaaacaaaaaaaggcatgcatccctgactttgattttgatatgccatgcaggattattgcaattgaactgttggaacaacagaaagaattttcagttgcttgtggctatggtcttgccaataaagagaagggaaccttaactttttgtgactgctagatgtcctgtgaagcttctacaccagtgatgtcaaagaagacatgctcattttggttttggtttcaggaactctacagtgtgacagtaacactttgctagttgctattgcaggcttgcagtgtcttgagagtgaagtaaagtactaatgccttagcctaaatgtgatgttaaagtttttatttgtagtgttcagtttctcaaattagttaacctttgtttttttaacttctacaacaaacaccaagattccaccaaaaatatgtttgcaccacaatatatatgatactcttagaaaatatgttgtctaaaaaaatgataatctctccttccaaaaaaatacaaagatttatgtagttctacttgggtattaaaaaaataggttaaactaaataaaagttcgttatgattggttaaaatgagaaaatatgtatggtgttattggttcagataagtgagtttatagggaaattgttatatttcgagatagattttgaacgctataggttgctatattttcggatacaaactaggccgagttatttcccccactttcccaactcacatcgcacgtttttcaagctgctaaatggtccgtttttttgcaaaaattttctatacaaaagttgcttaaaaattaaattaatctattttttaaaaaaaatattaatacttaattaatcacacgctaatgaactgctccgtttttcgtgaggaggagttgggttcccaacccgaaggaacacagcctaagagcctatctttactgttcgtagaagccatctggagcgtccgtttccaatccaacggccaagcgtttcatcgaaacaccttgcaattggcatcacgaaaacgagatatatatatatatatatttttttggcgagctggggtactgatcgagtgtctgacctgatgtcgacgccgttgttgacgtggttggagacgttcgtggcgacccagtcgtcggcggccttggcgccggcggcgaggtcggcgagcatgtcgttggggatgccgaccatcacctgtatgcccgaccccttgagcgccgccaggatgccgtcctcggcgtcgaacagcttcaccctgtcgaacccgttgtccttgagcagctgcaccaccgtgctcgccggcagcgggtggctcagctgcgtgccccagttcacgccgatcccctccgaccaccgcgccatgcacgccgccgccaccaccaccaccagcaccagcctgccgccggcgagcggcgccggcgccattttgcttctgcagagtgtagttctgatcaagaaatgaggtgtttcttgggatacttttggggattttgtggattgtgtgtggtgttaatcttggatcaggaatcggtcagaaaaggctgggagagtgggtatgtttgattcttggagatgatcatcaacagcctcaaaccttgtgacacaccaaaaggttagaggaaagattgatcgatcaagaaagaacttatatatatgtggaatctgatttgttcttggtacacagccaagtgccaagtgtaccaagaacagctgaaatggaacaagagaagtgaggaaaatacacagcaatcagcaggcaaattcagagacctcaaactaactgaaattcagagaaaatttccttgtgccaaaaaaaaacaggaatcaaacaccagcaatcaggaaacaaaaagggagctcagaaatgagaccacaaaatggtggccgatctcttctttgaggaagcttgtggggggtagcagaagaagctgtctgcactgatcacagcctcacaggaacaagagcatgacatgacagggacaggaggaggaggaggcattaataggtcaccacaagtggaggttgtgctgcaagcaagaatcctcaaaaaagggggaaaccaggtgactactagtattaaaaattgcagagatgaacagcaggggtgtacttacatgccctaggttgagatcaggtgagtgccaggttagtaggtagtagtaacctacaggaagatcacagcaataagtaatggacagttgactcatcaccagcatttccaggaggagaggcttgccaggtgtaggagaaacaaaacaaaaaaaaaaggctatggaagtatggatagcttaagagcaaggctaataatacaaccgacctgttggtaaggttattagtagccttctcttagagcacccgcaatggtaaagtaaggtgctatctataaaacatgtacatctcagcaatagactcgattaatagtaaaccaccttaatagtatgtctacattggtatctatagctctctcatgcattgcctcgtttttctctatagactatctctaagttagtagatagctttgctctctctcttcatttaatacattccaagtaggaaaatatgctgacatggatctcttgtagagagcctatagataaccattgtgggtgcccttaggctacccatataatagttagctctttacaattaatacatggtccacttgtctctctcacagagcttcttggttcttgtgtccaagccgactgtaagtttacagccggcttctcctctctctcctttcttctctcctccacctcagtatttagccggcttatagcctactattatacttgctctaagaggagatgaagttgtatccacagtggagcaacgtgtggcagagccgcagagatcacacaatcatacaaaggagtttggcatgatatctctactatggtaaaagctcagtcgcctccttccatctcctcctcccatcgcgtgatgatccaatgctttatcttcaatcaccctctagctcatccctaattgtaatgtgggtctgttactagtataaaactatatatatgaaaaggaaaaagaaaggatgaagccttaggctgtgtttgcaagagcaagttcccaacactcccctctcgtttttcgcgcgcacgttttttaaactgttaaacgatgcttttttttacaaaaagtttctatatgaaagttgcttaaaaaaattatattgatccatttttgaaaaaaaattaactaatccttaattaatcacgcactaatggactgttccgttttccacacgcactaacgcgcactgttccggatggtaaccaccagcaaccaacacagctttagtgctgcatatgtgcaacctcctcagattttcagctgtgtttcatgtaagcccttttgaaagggaaaaacaattgctcaaaataggggtaaggttgtagggttttttttgggggtgactgaagggtatggcaataatttcagtgtcaaaacaccatagaacatttgatcatataaattagcaaggtgtgtattgattattgaagggcagatttttactttggagttatttgactggggatgttaaatcatgagttcaatttgaatggccatcgatcagttaacatcagaaaacgaggcagcccttctgaaattcttgaatttgtgtagtgatgatgagcatataaagcatatgagcaggaaaaggcagccagcaatatcaaataaatatagtatgaacaaaagtgaagtttgttgtgcctttttttttccttatctgtttcttacctttctctcatcaggtaaaataaaatagaaaaacaaaaagagaagagggcaggagatatgagcagagcaaccggctttgcttcttccacttctactttatcctgttttcttagcattagtgcattgttcaccttcatcgccatttgacaacagcgcttagttttttttttaaaaaaaaagaaactgacaataactctccagtacattacttaactcatcgacaataggaaaaaaaaagaaatgtatatggtgattaatcaaacactcaaaatcacaattatattttcttctagctaggagaagctcagatatatttgtttcataacaaaggtgaggttgtcaagatgataggtgacaacagggagtgatttgtatgaggaaaagggatctggttctggagtggcaagggagcttagtatctgtctaacttttttcaaaactatatatatactaaacaaattagaaagcaaagagagcatctccaatctgtccatgaaattcttgccttgaacaagggagaggagcatcaaggtgtttggggcagtgcggggagtaggatctaatggctcgactagcagctgtcttaaatctggaaagtgtgtggttatatattgtgtttaaaagcactactactatgtactacctccgtcctaaaatataaaaatctaaaatttgatatgttaagatacgttgtactaggaaatgtctcatccaattctaggtttttatattttaggacggagggagcagtagtattagtaactattcgcatgtgaaatcttctgtactcctcttttccaaattacctgttgttccagttttgtcctaagtcagtatttgtatctttgatcattagttttccgagaagagttcgtataatttaacatcataaggtttgtaattttaaatttaccatgagaaatacttataagtttatatgttgttaaaatatatgaatttatagaaattaatggataaagatattatttgacttacaagaaagctaaaaataaaaggtatgatgaaaaaaataattttgtttttgggcatttgcaggtaatgcctcttaagctgtgtttgatatagctgttgttcttagctaattagtggcacgaaaaacgagacgatccattagttcaagattaattaagtactaaatattataaactttaaaaatatatttgttgatttataaagaaatttcaatatagtaagtttttctataagatgtaccatctaatagtttattaagtatgctcatcccagcactaccttagtgcagtctcaatcctctacctcagttagtttccatagtattaaaatactaccatataagaaaaaaaaaagccaaggtagtaagagagttaacgaggagagaggggaaaaaaatatgaagaaacagctctacgcaaaaattaaaaatgaaaatgaggagatatgtggatgaaagaagagagaagacatgtgatagaagataatttattgtgaaaaaaatcatccattgaatatatagtttctatatataatgtctatatgacatggtgaatatgaaaactattttatagcttctatattgcgattgcccttggaatgcatacttagttatatactgtgcatatcttacggaaaatataaagtaaatcaattttacctgaggtaaaatatcgtagatgtagagcatgctatatcaagtgtgcatgcaaaaacgtatttatgcaccgtgaaaaacttgttcctttaaaataaaagagagtgaattgcactttgggccggctattattgcatgagttatattttagactaggttatttctaatgttatcactttggtccaggatttcttaccctctattgtacattgaaccactttttttgtctgccactccttgatttcattagcaatcttatcagcaacacaataaaccaatcaatatttcatctaaccttgatttctttactccttgatttagctgcttgacttctagtttttcccttaaaaaatcatgtgagcttagaacaaatcactctattgagcttgcattcggcagctacaacagccagcgatcatgaggcttggtttttgttggctcctcaagctcgggaagacgggaacagagcagagagagaagggatcccagtgctatgcttgatcatctattcatccttcagatccatggcgcaggtgcttaatagaaaaaaaaggaggaaagagaagagatggagaagaagggtggtccaatttaaaactattgtaaatttatatagtccaaaatgataagataactttaccccttgtccaaagtaaaattttggtaaaattttatagcctaaagtgcaattaactcaaaaaaaatatatagatcaggtatgacgatcacaattcatgttgaagaataaacaaaaagtaaacaagaagataaatatgaaatcaacagtaaaggcttatctttgttatcaaactagatgatgccccgcgctttgctgcgggatgtatgttacatattggagaaatgatgaaatgatttggattgaaatattatgaaaataatttgagaatgatgatttagcatgtgtatgcatgtttagttttagaatgaaataaattgcagatataattactatatacttgtatgttgagttttgtgtgtttaatgggttggtgtggcatgcttgcatgtaggttttagacatgctaataaatactatgcttgcatgttgagctttaggtatttagtgggcagtagctttatagaaaaaagggattaaatcattcactctagctacaaatcatatgattctccatggagggagtaatttcacataacattgtttcttttgttttgcactcacctttagctagtgaaaatgatagtatttaagaaagggagaaatattttttccaggaagaggaatcacattttttttttgacgagaggaatcactgatttagtccctcaagttccttgcagcaaaatttttccacctgggaccctaaattttttgttttgcttccatattgttgattctttcttttacatagttccatattgtcaattcacattaaagaaaaggaggaaaaaggagaaagggtgcacattgagtttcatatgtaggggacccactgctacctaagagcatctccagcaataggctttattttaaagcccctaaaagttaaatgagggctacccccatcttccaaggatccaaaaaatacctctaactctagcaatagcccctatttcttagtccctactcatgtttctcttttattttaacatgcaatccttgtttacacaatgtttaacaccacaataattaaacataaatatttctaacgcgtataattgaaccatagttaaatttacaatttcaaacgccacaattcaaatccaaaatcaaaattttcaaacatgtaaatatggtgtgggcagaatgccatatacaacaacatgcaaccaaaatttatagttcaccaatgaaaacgaaaattgctcaccaacatgtcattgtctgtctccatatcaccacaataggctatgtgaacccagtgatgcattatttttttttgcggagatgcactatataatttaaaaataacacaccctacaagaatgaat

SEQ ID NO: 34710 - DNA, 8169 bp, Oryza sativa
aataagcgcttgtgctcttggctctccttagtttccttccatctctcttctttcactttagcttctttctctttggcgtcgagcaaatctttcatcgcctccttgtatggtccatcttctccattcttcatcttctcctttgcttgcttcctacccattggtctttttttagcacttggctgtaataaatcaggagttgtactcttcctagcatcatctccttcttcatcttcttcaccagcactcttaattggggtggaagacttcctagaccttggcctcttgtgggattctagagtttgaaactttggagaattcctcaacttgagccaacaatgattaaattaaatgccctattcttcgatgcattggatgagtacaatgcctcagcttcaagaacctgaagcaaaattcaagtgttagttcacatacatacaagattgttattaataataatgaataaacaatttaacttacaagctcttgatgtggtatgccacttggatgtcgacgctcaatttgctcgtagcagccttgaaacttgcttacttccttctgaatgttaccccaaagtgctcaagagagtttgcattcctatcagactcaaaatcacagttagcatggtagtgctctgcaatcctttgccaatatgccttccctggttgctcattgccaataataggatccgagctaatgctttgccatgaaatgcacagttgaatgtcctccttacgattaaagttgcttgatcttttggctcttccttttgcaccatttgttgaagtatgaaggtcttcattttgcattggcaaggaatatgcctcaacatgggtctcttcggacatcatgcacataaaggaatcacattcatttgccatcacaatctagtcactgcaataagtagataaattgacaacttctccaatcaatctcaggaaaaatggcagatgctagctaatatatgttggtagaatgcataatggtagcaaatttttccaatcattagaatttagaacaggttatgctagagctctacaaaattgaattaaaaagaaaaccatatagcaccccaaagcagcttattttttttctcttttttaacagtctactcgaagaacctgcatataactaacatcggtacaaataaaattgtgtagctcaggaaattaagcagcactacacccataccctctagaatacgatcacaagatttcaactggcacagtgtctcaaagtcatgcatattgaaaatcacactgaaaaccatatagcactatccaaaacttacaattcccaaaaccatattagcttgatccaatttatctttccccctgctaatttcagttacagtttttttttgtgttgaccttattactaatgcaattgtttaactacttgaaatcaatcatcattacatgagctcacctgaccatattatacatggattcagattttcatttgtcaatgaaggagttactatccaaactatgtttcctatacgcgtatgcatggctatttttcatatttctgaaactacaagattaggaacctactttcaataaattagattattcaggaaaaaatcaatcagatcattccaaagaaagtataattacatatggattatgagattaattattgtattaattaacagtcaaacatttgaggaaaacaaaatcacataataaaacaacaaaaccatctcatcgtggaaggttagttcctacccatttcttctccaaatatacattttcgtactgacaacttttctctcaaacacgctaggtgctaccatataactcaatccacaaatccactagaaaaatgaaaacatgataccttcaactagcgcaactagcaccagggagaagggcgtcaggatccaggaggatattgccaggtgggcaggtggccggccaggaaggagggcaccagggaggacgcctgcaggggaggagggtgccgccgcgccagccaggaggaggatgttgggaaggaggaggcctaccggggaggagtgtgacgggcagggaggagggcgccaccccggatgagggcgtatgcaggggaggagggcgccaaccaagaggagcggcgtatatccgtggaggcgcagctagcgggatatttcacgtgaaaaaagaagtgcccgcgtgtctctgccgcggatgggggctgcggagaaagccccctggactgggggcctgaagggataatttggaggccttcctattttaggggctttagtaggggccttattggacctgattttttagtctcaactctcaaaattagtataggggctgtgtttagaacctctactggagatgctctaagggaaaatatatggaatggagcctctgcaaccctaattagtggggatccatcttatatatattgtcatcacataatatttcatgataggaaaaactataagctatagaactttaacaccgctgaggtcgataacatagcacacctcaaagtttaggtggatcaaacacgttagccacttgccactaggtcatggctgatcagtgacagtacatggtggattggtgccgccctgatgcttagaccattgctaagattttcagcccgtgtcaaaagacaaaaaaagaggtttctatttaacaaatactaaataaacagagtacattttacttcaatctatataaatatagaaaaattgcatgaatttcatgtgatcaacgtcaactagagctataccaaaggaacttactaactgacaacgatggtgatgatcatgactaagtaggaactaagaagaattatcatatcataaagcagtgattcagttctccttactaagcgaacaaatatagtggaacctttactgcctggaatgcacattcacatcatcatcatgagctttagttctttgaggtagctgtagccgagaaaaaacaagcttgttctagctaaataagtgaaagagaaaaagagactttaaaaaatagaacaagaagatcttaaaattatattaaaagtgcatttggctttgactggattataaaataagaggttattttttgaagggaagatgttgggttctggacagcaaagttgggtcacgtgttccactatgtcatataggacgctccgtctttggttgaggtagtgcactatgattaaatttacaatttttgtaacctgttattgaatttaggtttcgtagaactcccatccggttaatgaaatggtcgacaattttgtcgacaagagtttttttctttaagaattttgtgtaacacaatatataatatatgttttgagataggagatacagtaggtagcaaggccctcgtagcgatgtcgcaaacttacaatagaaggtcaggccaaagttataaaatttgataatttgattgtattaacacttgtggcaatgaccacgtgggaccttctcgagtctacgacggtaagtcaggatgtcaaataatcaaagtactccctccgtctcaaaaaaagtaaacctaggaggggatgtgacattttctggtacaacaaatctagataaagggctgtccagatttattgtattaggagatgtcacatatttgcttgagtttttttttttgacggagtacagtttatataggatgttaaaaaaagaagagagagagagagaaagatatctctgggccaaaggtagggtcggacaaatgggcccaacagccaatacggtactagttacgtagcccagcaacatggcgccatccgtggaacggaacgggcgtccccttcccgtgtcttatccactcccaacgttccattctgtggatgcttccgccaccgccaccgcccaacgaccagcagcaagcagctcagccaaggggctccccatcgtatcgatccccattcgcgccgtcctcttcttcttcttcttcttctcgattcataggtgtggtttccatttcttgctgtggttgctggttgaactagcttttgctttgcttggattgtgttttgattgaggggtttgttagtgttagcaatctaacccaagatatctttgcaattatatgctccagttaatccgtcaggcttttgttgcttgctgctgctgctgcggtggcgggtggggaggaaggatgctgattgcggctgatttcccgggagattcgacggtgtcccgatgcgcattccccggtttgttctgagtgatgatgcggtctccgtttcgtgatctttgattgatgagccgttccgcggtaagctctgaaggcggcattgcgctccggctcttcgtggactggaggatccggcgccggagggtctgcgcatgcaagatgttcgacactggttcccaaaggggtagggtgaagcagctggtggcttttgccaagaagaggaggcggcccaagaagcagccgtcgcggcggccatggtggaaggcgtggttctcggactggaacgacgaggaggagagcttgtctggctggagggaggatgaggagctgctcgaggaggttggcggcgaggaagggctgtcggacgacgagaagtttgagacgtggaagaggaaggccgaggctattgtcgagctgcgggaggcgcggcaggatgccatgaacgcggaagggcgctcgtgggaggattggattggcgggggcagtagcacagcgggggatggcggcggtgactggggtggggatttggatgtgtcagacctgataacggatgatcctacagagatagtgagggataaaggtttgattgaaactttcagagactctgtagatgaagattacaatgacatgctgtttgaagaccgggtttttctgtatgcttcaacgaattcggtgagctctttacctatcttgttttctgtcaccaaatgttataacccactgtccagtgataaccatgagatacttgtaatgctttttgaatatgatgaactacttcctccgtttcatattttaagtcgttttgacttttttcttcatcaaacttctttaaatttgaccaaatttgtagaaaaaattagcaacacctatcacaccaaattagtttcattaaatatagcattgaatatattttgatagtacgtttgttttatgttggaaatgttaccatatttttctataaacttggtcaaactaaaaaaagtttgactggtaaaaaagccaaaacgacgtataatatgaaatagaggtagtactatataatattggagtgcataatatagcaacaaactttaatctttacaccttacaatattatcgaacgctgagggtccattttgatggtaatgattttgcatctggtggctggtgtattttgaccattttgatgattaaaaattaaaaatgttaaaaagtgtagcagcattatattgttatattaagaccctagcaaattggatctaacaaaagaaagtttgcactttcaggccaaatttctagcattattgattgtgattccatgggtgttggattttctggttcatgactatgttctgatgccatttttggaaaggtaaatcctctcacagtgttccatttttactttcttaactttttcccctcacttcttaatgtaagaaaatgcattccatgtacacccaatctgatgtttaggaatttataaggtgaagtttcaagcactgatgatattctcagtttctcactctctgtgcttctgaaattacatgcgatcaataatcatctatgctaaatgcagaattgattacatggaacattacacaataacaggtacgtccagaaggtaccacttgctgctgagctgcttgatgtaaggcgcagccagaaactcctgatggtaaaggacataaatactgagaaagcaagatatcgttttgaagtagagattggtaaatctcctccactttctgatgatgagctctggtcagagttacgggaaaaagcgtgagaaacactctaactattatactttcttgccttgttgtaacttctgttgatgcactagcattgtctgacatgagcaatggaccttctatcctgcaatttcatatgttcaatcttaacagatctgctctgctacttgatcaggatagagttgagagatgaatggagattagaaaaccgaaaagcgtttgcaaatatctggtctgacatggtttatggaatttccctattccttcttatgtacttcaaccagagtaaagtatgttttatcagataagcagctttgttttttttttccatctttgattgtgttccaataaatttttcagctttctgagtgtgcatgtgagctaagtgattggttataaataaacaccccacaagttgacaaatttctgcactattaggcctctctcagagttatccgatttctgctgttaatacatagtacatgatgattttgtgccaaaagaactgcagtgatgaactgaccagagtattcccccattctatttgtacctggttatacatcatacttttctgacctagtgcagtagtaagaccacctcagtttctgcaatatgtttgattgttagtatcatttagtaacacatactggaagtccatgatttatgtacaatgaattcatcaatctatcttatccatcatcgtagcctatttttctctcccattgaatgcttagtgttatcctgcgtacaacttattcttattgcctgctaagctttcaggttgcgatgctgaaattcacaggatataagttactaaataatatttcagacagtgggaaagcattccttataattctagtttcagacatccttctagggtgagttacaattcatttttcttgagttcatatatacatgtggttttagtgtgaacctagtttgtaacaaagcatacactaaacaattgtgctatttcttttgctggataatggatgtcagcaacctaactaaaggcaaataacatgagttctaacctacctctctcatgtgttacctgcttatctaaaaaatcatacatttaaataagtaattcttgttaaaagaagattcgtccaaaatgttcaaagaagttaaagaggaggccagagctccctccaggggagagtgccttttcttttcagaaactaatatcagggggatactcagcagcatgttttagaaagcaattcattatatcttgtcatcatgattcatgagcgattttttaaatattctctcataagtatggataagtttgtaaaaatgcatggaagaaatattatagctattttttttgtcaggaatgaggcagatggttctgtgtttcttcttcgttcgcacttcaaatatgatcttaatatttcttcatttttctctctcttcaaagatgtttgtagcattcgtgtggcagaatcttatttatcatctagttagaaacttagaatagtgaacctaagtggtacagtatcccgttagaagttaattcacacaaatgcatatgaactgctttgcgaataatggaattcttcctgttcatgcttatgttatacatcatgacatcttttctgtttcaaacaaactatggatagtttgtaattttgtttcggctttttttcttgttttcatgtaaacgtaacacaaggttaacattgttttggtttgtctgtgatcttgttgactatattaacatcatttagctgcattttcacaggtaccattcagagtcaggttggcattctttggtagaagtcattctcgagcactacggccttgaagccgatcaagctgcaatcaccttctttgtttgtctggttcctgttgccttggatgtatttataaaattttgggtcagtccacttcttgccttcacacaatcaagctaatagggctatgaacatttattttattctttaaaaaacatttatttcattttatctttttttaaaaaagaatataagtgtttgttaaggcctcataatttatgactagtttcacccaaagttgataacattatagattcacgtttggctactcagcgctaacatttcagataatattaactgaaagttttatagtctttctacaaagtgatttgaactttattgctgggccgacagttattaggaagacaaccttttgtagatacaatttcatttcctgacactgctcttaaatcaattgttcaccttgcatgtgctagaacccattgcattttttaataactggaaatacatgttctcttgata

SEQ ID NO: 34711 - DNA, 18274 bp, Oryza sativa
  unsure (1)..(18274): unsure at all n locations
atcagaaacaaagattgatcattgatcggttgttatagtctgaggaatcccagatcggtagataatatactccttgacaaactgtattgcatccccagaatcgactttcttcaaaggaattgctttcacccacttggtaaaatagtcggttgccaccaatataaacttatgccccttgcttgaaggtggattgatctgaccgatcatatcaattccccaacctctgaacggccatggcttgattataggattcatagccgatgctagtgctctctgaattgctccaaacttttgacaatcttgacattctttgtaatatcggaagcaatcctctaacattgtacgccaaaaataccttgtacgccgaagcaaccacttcatcttgtgagctgattggtgagtaccgcaaataccttcatgtacttcgcccatcacaaccttagcttgatcggcactcaaacatttaagcaatacctcatcaatcgtctgataatacagctcatcatccaataaggtatatttcaaagccttatagcgcaattttcgtgaagccgactgagatgaattctgcaaatactgataaacatcatacctccaatcatcggctgtgattgcagctacctccacctcaatatccttcatcatcggcttgtatcctaacgctccatgagccaagtcattagcttcaacgttctgctcccgagagacatgcttcaaagtcaccagacgaaaataattcattagttctcggcacttctcgttgtagatcatcaaaacatcatttttgcattcatattctcttgccaattgattgatcactaacaaagaatctcccatgatctccacagcatcggcttcaacctccttgagcaattgcaaccccttgagatctgcttcatactcagcctggttgttggtcgcataaggtttgatagtataagcaaattcaaaacttgccccccgaggagaaattataaccaagtcgataccacaaccaggagtgcaaagtgacccatcaaaaaataaagtccagggcacaatctcaaccgagccgattgaatcatcaggatgttccacaataaaatcggctatagcttgccccttgattgccttgggtgattcatatctgaggtcaaattctgttaaagcatatatccacttcccaactctccctttgaggaccagagccgacagcatatatttgatcacatcagctttgcataccacagtgcattcattggataacaaataatgcctcaactttgtgcaggagaagtacaaacacaagcataatttttccatcggagaataccttgtttctgcatccaagagccttcgacttaaataaaaaatagctctctccttgccttctagctcctgaatcaaaaccgagttgattgacttctcatcggccgatagatacaacctaaaaggcactcccttttgtggaggaattaaaactggaggggaactcaaatatgccttaatattgtccaaagccttctgctgctctgccccccaagtgaattcttgatcggctttcaaccttaacaaaggtctaaaaggttccaatctcccagataggttagatataaaccttcgaacaaaattaatcttgccgatcaatgattgtagttgtgtcttatcttctggaggttgaattttcttgatttcatttatgctcctttgagatacttcaatccctctctcatgaataagaaaacccaagaactgtccagctgatacaccaaaagcacacgtcgtgggattcatcattaggccatattttctggttctctcaaaaaccttcctcaaatcggctatgtggtcctctacctgttttgatttaacaaccacatcatcaatatagacctcaaccaacaagccgatcagatcatggaatatgtagttcatggccttctgatatgtagctccagcactcttcaagccgaaagtcatcacaacccactcaaataagctgattgcaccaggacatctaaaagcagtcttatgaatgtcttcttttgccataaaaatctgattgtaaccagcattgccatccataaaacttataattttgtgacctgaagtagcatcaatcaattgatcggcaatcggcattgggtactcatccttaggggtagccttatttaagtctcgaaaatcaatgcacaccctaagtttgccttttttttcttgatcattggaactatattggaaactcactcgacatatcggcacggttgaataaaaccagcatcatataatcgagtaatcttagccttgatagcatcatacatttgggccttacatctccttagaggctgctgatgtggtttatatcctagcttaataggaagccgatgttcgacaatcgatcggctgaatcctggcatctcataatattctcaagcaaagcaatttctatattctttcaatagctctattaacttggctctgaattctgcatataaattcttactgataaatgtcggccttggtctatccctggaccaatgtcaacttcttccaaatcatcggccgacatgaaaccctgtccttgcttgtcatcgagatcatctactgtgtccttagtgtagaaatagaaatttgaaccctccacgatgctgttaacgccaaaatttggtaagcccgaagtcatcatcggcctagagtcagtatcggcttcagagtcttagaatcggccgatgggagttgtcaagtcgccaccagttgtgttcttgatggaatcggatcaattaaagaaaatttatctagaagagtccgaattcaaggaggatgcggcatgtcaagttatctattaattaggaatagttttttttgccgccggagcagagctcttgcctgcgcaagaccaccaagacaaaccccatcttctcctctacaaccgtgttgacgtataacacgaggcctgggagatctgcttaactccagtgcaagtccaaaactcgccttccggtatgctagcatgccagttgatttgatcttgcaatcaacaagaaataaagacaaagaaaccgtggttaaatccataaatgatagccgatcggctaagtgccgatgatatatcatttatcttcgagccgatgtcatatgtaaatcgatcggcagttataaatagataataaagaactaaatctattcgatcggctgtagatattaaaaatatataatcctggtgtcgatatatacttaaatcaagtgattgggatagatcggtcaccgtgctgagacagtataaatcacttagatcgaaatatatattaacaacaaaactatatatgttcatagcatagccgatcaaatagatctagcatgtatcggctaatactccgatacaactctatgttaagatattaaaacaagcagaatataccagacagaaacttaatatacttagatgcaataagatcttaatataaaaggcagatttaacatgtcaacgaagcatatagagcaaatataattaaaccagataagatcggctgacactccgatgctaccctaatcagcaaccagaaggcaggctagagattgatattctaagcacgacttaatagatcaaactcaactgatgcaacattaagtatgaaaagaagagcaatatctagacaatcaagtcgctggaagtttcacagggtggtagatatcttatataatctaaatcaacaccgatgtctaacctaatcggctgccctctaccgatagatattagccgattgtaggttagatagcgatattgccagagattatgtaagatatataataactcgacgaattacataaacaagattagagtatcataaagatggaagcactaatcccgagaacgcaagccgtcataacaagttttacctcttgttgaagatcgaaaccgatgcagctcaacccgaaagcaagaactcgtcgaaataaaactaaagcaaaagggtggcgatgcgccgaaattgtattgaacatgtgtgttaattgattacatggggttcaggatctatttatacccgaaaattataagctatgtccataccggacacgactattatctctaacaaactctaagatatcataagtctttgcggcagacttttaccctaagcatatctctaaggaaattacataaaatatcctaattaatagatacaattgacttctcaggactctatccatacgtggcaatcatcttgaagcatatcaactcaactcgatgtcgtacataagtcatattgccggaatcggctgtatcacttaacccagtctgactcggacttagccgatccaatcgtagccgatccggactccagccgattcctactctgtttctgcaacaatcttcatctttgattctacttcgatcttatcctcatctccgatactgatataaccaaatttggttgttaacaaaccgacttgattcaccgcctctcactgcctataaaaggacgacgaggtcgcccttttcttccatatccatccgagctctctctctctttcttcttcatgtccagctatggccggccgtctgccgatctcccttaccggagcgttgtcggccaagtcctcgcgccactagcttcgtctcatcgaggcgaatccatttcacccctttcccctttcccttcctgaaacaagccaccacaacctcctcttttgctgccagagcagagctcttgcctgcaccgttccagcctcctctctcactttctctgccgactgtcaccctccccgggtgcgcgtcgctcgagaacatgttttaccaccgacgttgcagcctctcaaccaccggagtaccggcgcccctcctctcccttctctctgtttgttcatggagaaagagagaagaagcaggaggaaggaggaagaagaagaagaagaaaaagagagaaaaacaaaaagaaaaagaaaaagtctgacaggtgggcccctgcacagtactactttatattttctagatttaacttgaatcctattctttagaagcccatatctcctaaaccgtagatccgattccagttaaacttggacctaaattcatctaaattcaaaccctaccttttgataccaaatttgctatttaaatattttatttgaatttccttgatttatttaaatgtcatttgcttttcaaatatctccttttactccaaaataccctttagccactaaaagtcgccggttagaactttacgccttccatggagacgttcgtgtggtatattggccccgacgtcgaaccgttggttgtaaagcccggcaaaacccaaacccaaggtcaaagtgctgctctaggtaccccacgcctcgatgcgtacaacggtcggagcttcactattccctcgacctccacagcacgtcgcacaattagctctcgggctctgtgtgatcttagccgctccacaaccactcacggttgtcggagtaacacttccgccccactaaattaacctgcacccaccccctattcctccagccgatatgttgtctgctgacaccggctagagaagacaccaaatctagtcgttatgctgttcaacactagcatcgactagcacacaatcaaaccctagctgataccttgctagataaatcctagccgtcatccaaattccacacccaccagtatcgcctatccaccctactctcagtcacctactctccaaacaaccaagacccacacatgaaatataagtgacatttgttgcttgatcccctttctatcttagcctccaaccctttagaacccatacatgaaatattagccaataatccctataccttataaaggagatatttataccccaaacccaacatttcttgcccttcatcgctttcttgttattttctgacttttattgaatttggttctttctcttctttagtagagtctattttggatggcagcctgtgatatttcgaggatcggataatcaggttgcctatcttggatatatttgcattggagcaaggcaagttattattccttccctttgagcataaatgccctatattctatattctattctatgccctagccatacatgattttgaatgcataatctgaacatatagcgaactagttatatgctagcttttgcttagccctgcctagttagactgcataaaatataatgaacttagattggaacagtacgtaagatttggttgattttcgggtggctagtactgttttggtcgatataagtttaccaagtacttatgtcaaatgaacgagtacgaccgcagcttctagaatggggacagacctagatattatgttaattaacaatgtggtacctctgtatagtggttcttatgtaagtcctcgcgaaggaggcaaacttacgccgagcagggtgattgtaatatttaccgaggcgcaggtaaatatttgagataaattgtaatatcacgaactctgtgtgtattgtgaaaacctggttgagatgacgggagtctctcaaccagttctctccaaaaaccccgggaacgccagaactcctttcgctgctgataacgttacgttcagagcacatggggactcaagttcatggaacaggtaccacaattgttgataacctaatactgggccgtgactaagctaatgaatattggcaagtcgtggattgcgagtaaagcgtacatttactgcagtaaagtataaatgaatctattcgaatagttgtgctcatggatttgagtattgggactcatatggtatttggttagaaacttaattccgaaacttaaatactgttgcatttaaaacattctaggctttcttactctatattctttgctttctgcaagtaaacctagctctactcaaatattaccatttcatgcattcattattgaatataatagcttgctgagtacgttgtactcgcccttgcttcaacccgctttttcagagtcaatttgatgttcttaccgaagccgggagttcaatcatataagttagttccattctaacttaattctcaagtatagactagataaatggtttaagtctatatcaaaacattagagttgagtcattctatagcttctgctgtaatagttagccacaaacttgtaaataccctaatattattctgtaataatatctcctttgaaaccttgaccaaatatatgcaatgaagaaccaaattgttgaacctgtatcaatctactaatccagggcttgatacagtctaaccatgtcggtttccgaatcattagttttgggacccgacatgtccgcagccgatgttatggtttgagcctaagtgatgagcaactagccgatctcgccttccaaggattgtcagcagctatcagagagagattcttttgccacgagtttgacaaccatgctcatctaatgcaaatagtatcagctcatgaaagccgattacaagaagcaaaggaatattagttttggggttatcaagatcagaaagaagataattttgaagcatgagttctcatactccaaaactggggggcatgtgttaacgttaaaatttggtaagcccgaagtcatcatcggcctagagttattatcggcttcagagtcttagaatcggccgatgggagttgtcaagtcgccagcagttgtgttcttgatagagtcggatcaattaaaggaaatttatctaaggattactggtgtggtggccctgttctctttttttttttgagcttcttttcgttaaattcatttttctctcttagatgtgacatgactaaatacagcgctgctgtaaataaaaaataaacatcttctgttttcattgttttaataggtaaatataaagatttttaagtaatatttaaaaatagtgctgatcaacgacattgtcactttattaaaagttttagtttgttttttctccttttgagtttgggcatataccaatattgagataggtaggctaaagttaattatgttctatttttaatggattgggtttgtaatatcttgcatgcactcatatttgtatgttttgccttgtgagagaaatctatacagtttttgtgtgcgtggatgctgggaatgactagaaattcatagcggaaggtttcaatgaaatgaaagaaaaaaaagcagtgtaggaaacaacgcggaaggcatggacttctagttgtagattgggtctttgtgaataaacctggactcctaacctgctctggacggacctggactccagatggacatgggcacaatgaaggaatgtacatgtaaatttttttcctattaaagagctccgattatgaaaattaaatcaaactgataattttctgttcgtcacatcggtatttcatccgtaaatccaatccagcgatgccctagcctccgttctcgtacgcactttgtccctaccattggtgattgctttccctgcggaaaagaaaaacgcatccgcacggtgcaggattgaattcctgatcgactaggatcgggactgaatggatcgtgttagctcctcaccgtcaccggtgtgcctcgcgtcgttctgcatagagatggccactttgcatagcgatggcctccctggtgggccagcttgttcgtcgggagcacctccgcgacgccgcacgccaagccttgagtgtcgtggccttgagctggggatgaccctggacaggcaaatagccccgtgacactcatctcggcggcctgcactgacgccatgttggcggggtcgacatgcttggatccgcggaaaggttgccgatggttgtagtggtaacttatcaacgttgagatacatagcaaatgcaaattcgttgagctacaccctccaaaattatcaccatagatgggctcatcagtaatgctccatatcaacacgacaatatggaattcacacgatttacacaactcatatgtataaaatttggagatatttgcgaggtatatacaaattcaatgtttttatgcacatgtgttataagtacacaagcaatcttatctatcaatatttatattcacccggtgcaatgcacgggtatatttgctagtacagtaataataattcttgttgtagtagtaatcctgggaaaaatatataggaggatttcccatctagaatatccaaaacgaccaaacccatctagaatcccagatttcccattttacccccgggcgcaaaccctcgccgcgtctacccgatggccggcggcggcggcggcggcggctccccctcgccggtagccgcctcggcgggccccgtgcaggtgcgctgcgccggatgccgcggcgttctcgccgtggcccccggcatgaccgaattcatctgccccaagtgccgcatggcgcagcgcctcccccccgagctcatgcccccttccccgcccaaggcctcccctactccgccgcctcagccacagcctcatcctcagcttcagccgccgcctcttcctgctcctctccctcccccttcccgccgttccgcgccgcgagcgcagggcgtggaccccacgaagatccagctgccgtgcgcgcgctgcaaggccatcctcaatgtgccccatggcctcgctcgcttccgctgcccccagtgcgacgtcgacctcgccgtagacctctccaaactccgcaatttcctcgccacggccggtccaggcttcgcccctccgcttccgcttccgccgccgccaccaccgccgatgccgcccatcccgctgccgcacatgcccttcctcccgatgatgccacatgttccggtgccgatgccgccgatggcatcgcccgctgaattgcccgaggagattaatgaggtgagcaaccagcattgtactggttacagatttacagttgtggtggaatgtgtgtgttatttcaggccgaaatattacagttatggtcctactgctagctgactgaatttatgtctgaaggcttaccgttttctcagaatctgtcatgtatggatgcccatgctcatgttatgcttaggagagctttggctcactggaacccttttagagtttttttttaattttgctgtcaaatcacctctacattcgtggttacccgatacccatggggaaccgcattatagtacatgtgttcttttaccaggaatcctataaaagatggtattgttgcctcatgctcatcatctatttccccccagttggtaataataggagagcagtgaacccataagttgggtaggctatggcctatgggacacaacttctaggcttgtgatttccagaaacgaaacttcatggaatgaaaagctataacttgcaccattgcatggacatgggcttgatttatttttcttgtttgcttctggacaaacaactcggtatgatgactgtgacttgttacgtcatgcttgttttggggttgggagtgtcggatggtatcttttatgatcctatcaataaaggaattttgagattggcaccagaaacctgtttctacccttgattctataaaatataagtgtggcttctcacaattccatgtgattctataaaatataagtgtggcttctcacgattccatgtgaatggtgaacctgtttttaccctttgatactgttgtttgggcactgcccatacagtttggcccacacccagtttctatacgctttccatactgaagacaatgggctgaattattatttaggtatttgtctcatcattttcaatttttttttgtctatatgcaagcatgaaaaaataaaccttatatttttgtttggagggagtatcattggtgcacgtgaagtcttgagtattccataacattctgtcataaacattcagttgttttagcgcattttcactcaagaaccaatgccactgccttcttgctattatactggggttctaactgtagctatcttcaagcaggttgcagttgatgttgagcgtgaggaagatgaaggtggtactgtcggggaaacttttatggattacgtaagattttaggtttttgactgcttttatagaaaatggagggtagttccttcaagtccaagatctgtttctgactttctgttttattttttatgagctctaattttttgccatatttgttttctatttccagaggcctcccaagctatctcttggtcttcctcatccagaccctgtggtagaaacttcatctttgtctgcagtgcaacctcctgaacctacatatgacttgactattatggatgaattggatgagaccaaggtgttatcttgcttacaaattgaaacgatagtgtatgcttctcaggttagttatcttcttgctgttgacacgtccttatttttaaatttatgtatgtattgcatctgttgtaagtctagattcttgtatgcagaggcacctttatcatctgcctactggtgctagagcaggtttctttattggcgatggagctggtgttggtaaaggccgaacgattgctggattgatctgggaaaattggaaacagggaaggcataaggcattgtaagaacatatgaaacaaaaagaattcagtaacttatctgacaaaagcacctaactatttgttttggctgtactcatgttgtttctgcccttatgcttctgacgatgaattaattatccaggtggatttccattggttcagatctgaaatatgatgctcgcagagatttggatgatgttggtgcaaaatatgtggaaggtatgattctacgcatgcatcttacaacagttatctagcaaaaacaaaaaaagagttgtaactcacttggattgatgctactgtatgcaaatacaatattggagaacagacacagcaatgtggtcgtgtttgaatcttctatccaaacatataagctggcatgcaatgttatttataggccctgcttgggggagcttttggcagctgcagcttctgccagaatctcaagctcccccaaacagtccagattcttactcagattgtgagaatctgtacttttagaatccataaaatggattagaagccagaagctaggaaactcaccttctccagattctcaccagcagattctcagaattttaagctctcccaaacaggggccgtattaacatattagatcataacagagaacaggtgacttgaaaataaaaatgcaataaaccagagaaattatcaaatccatttgtggacatttgcctgcataactaaaacaggaaagggtctaagaaagtaaactcgaattcattttcatgtatatgtcaatgcttagcaagtttacattgggcataaatttctgagagtaccaaaacacaactctgtgcatccaaattggtggttagcttcatggttgttaaggcattgctgtggtgtcgacaaagcggtaagcaggtgcaggggctaaggcgttggctctgctttttaggaaaaccagaggagcaaggaaaaaaggacttaagctcatcatggaaccctagttggcggtgtttctgtcccgcctcagatctgtgctaccatcctccactctgcctcacggtcaatgtcctccctgtcccgtcgttgagaaaattgatagaattccattcttcaaagtgggctttgataagatgatatccccttacattgcactctttaaaatgccagaaattatctcttctatatatttttttcatttaggagattttaagtctgctttagttcttttccatagcctggacatgtggcttagtcaggacctgactgagccgcacccatctgtctagagcacatgtccccgttcctcccacgcaggtggccgcaactgcaagactagcaagagttcttcctcccccgggacttttggctctctcctaacctcacgctgcagccgctgctacgtatctgatcttgcaccaccctgagctgttgctgtcgcattggatgctggatgggatgtagaccagtgccacgaactccagtggaatgggcatgagggcatggcggttgttgccgcgggtggttcggttgtcacttgcttgttgaagaagcctcaagtcatgccttcggagaaaaagggacatgcgagataaatgtgtcttctcaagtacccagaatttggaatagaaattaaaatagacttagccaaagatggcaaaatatacaagaggcaaggtagagtggcattttaaaccatgcactttgaggagtggcctttatgaatcctctcctggcatgggtggagagagaacctgtttggctggagttaagtgcaacgtactatagtgtggtggctggctggatgtaattctgtgccatatnctttctcatttttttttattgtgcaaggcatgngctcgcgtatgctgtctgtaaggcagggtcagggtcgccttacaaccattggtagtgctgtcaataaactggcctctgcttcagctcaatacaaaacttagtgttctagggatcctagtgcatgcttcgtggaggcaggctctgagcccagatcaaggtttgagcaggctggtgcttatattaaggaagcttgataacaaatgcggatccaagttctttatctttagttattgggaccaatgaagtataatcaacactagactcatcaagattttgagaccaaaagagaatggattcataccaaatgcctatatcatgtaaaacatgggcatcacgacatgtctagaacttgtaaattcacagcaactgagctctgatagacaaagctcacgattctgggcagctctagctaggatcatctggagctctagcctagtttgaatcaagctcagagtgggcggagttcaagcaggttgtaattaataagaattatctatttcttaaataattaatcaatatagtagtctagggattagtgaactggtatcctatctgttagtttagaaggctattggtttgttcaagatgttagagatatgatttttgttagttaggcaagtattctattcttgtaggtcaagtactgtacacatcagcagtacccatggctgccatatccgcataaaagtgctcacgtatgcaagtatcaatcaactagccttagggcctctgttccatatcaggaagaagcctagctggcgaccagatgagggtgtctttggacacctaccaatccaattcatataaacaaatcttggtaaatcttttcatggatttttctaaactggacttttaagaatgtctttgtaaaactgcatgtgccctacagaaactatcactaaacagcacttttaacccattctccattctatccaatggcttctccccatctagaatggggagaggataaatctgtagccacatggatggacattgcatatcagcatctgacctattactctctttaactgacatcgtgaatgtgacggcatgctggcgcatgagttgtgccctttgactacttcctattacaagaagggtagacactgtcgtatgtcacatgtgggtcctggccaaattaaattatacactttagtggtagttttgaagtgatggaatgccaaatactcagcaataattatatatatatatatatatatatatatatatatatatatatatatatatatatatatatatatatatatatatatatatatatagaaaatcatgagctgcagttaccaatctgatcatctcaagttagcatgtaagtttttttaacatatttcttatatggtttcctctatatcaccaaaagtgaacgatcttaaaaactgactcaaatatggatatgtatttccaaaagcaaacgaacttaaaaaccaatttatacacggatgacgtatcaaatatcgacaaaaacatctttaatttttataatagtagagattaaatataatcttatcgtattttcaatcggtacttgtatgcagcttgtgtggttatagccatttatctcaaagcttgatatagccggttcaactcttggcacctcaatttatgcttcttttttttttattttttttggtgtgttgcgcgagctgcttggtgacgcctgtcatcacgtcgtcttctagcgcatggctcgacgtttatctcaccatgttgcacgagctgtttggtgatgctttgttttcacgtcatattctagcacaacctgacccggcccatggttatgacgctggcattctggcaatcacatcgtcctcctacgtgacgccatcacacaacttcttgggctccatgacgtcagcgagcggctagaggcaagccaaggtgagcatgcagccgcacttgcaattaaaatgcacacaggagtttatgcgttgttggctggttgtctaggaactcgttggagttgatgcactgttggagacgaaagcattcgagtgtatgcaagggtatagaagtccaaagtaatcattcaaatgccaaaacatcaagaattctcatgcaaaggacccaagcgtcaaacatcaagaaatatagtacctagggagtagatttttttgacagtatggtggtgtttgaaaatcctgaagataaagattaagtgtttcacgcaaaacgagatggtagtagcgtgtgattaattgagttttaattattagaaacttgaaaaatggattaatctggtattttagagcaactttcatatagaaagtttttacgggaaacacactgtttagcagtttgaaatgcgtgtcacgagaatctaaaatttcattcaacaattgttggacattcgaacgcagcctatggcttttcataacacgttgattatttgatcaagctgaaataagaacactcaattacatagtcactttcattttgcggtcaagcacggattggaataagcgccggtttgacatgaagttcttgaaaacacagggcatcgagataaaataaaaatttatatgcttgttattcatacatctggttaggttagagggtcaacctagattttcacgagcataagcagatcctagattgcacatcaagggtgctagccacatcctcgcgcgagagagagagagatcgaggtgctagcgcatagtgtaaccatcaccatgcgcaccttgcatctcagcacaatgaaatgtgtaacctatcttttatccaaaatcaatcatttcatttcgtttaattcgtagcacaccagagataaccatttctcaaattcctctttcttatatcgattaatgtgtatagctgttcttttcaatgcatctttcctttggcacaaatgcagtaagcaagcttatttcgttaaatagtagcttccgcactctttctacttactaaaattaatgtgaatgatcagggccctttagaggttctaatcatggagcacaaagctaccaaaaatgcatagtttccttcaaaaataactactcccattatatgtagtggctatctctcttaacttatcttacatgtattggtatctctcataactccttatcattctttcttttacttaaatgttaatttgcactaatatttttctcataatcaaatacataatcaactgctttttcctagttctccactacggtgagcactggaaaatacagtgtaagattcaaaaattatagtataaatatatggaatttaaagtataagatatagcatagtataagatttaacctttttccttgaaaaatatgacaacagaaatatagctagccattattaaatattggttatccatgcaagcatactaccatcgaaaataatcagtcaaatctgccattcacaaatatagacatttcttcttgctacgcatgtagagaaatacttccttcatttcatattataagttgtttgactttttttaagttaaaattctttagttttgaccaaatttatagaaaaagcaataacatctatgacaccatattagtgtcattaaattttacattgaatatattttgataatatttttgttttatatttaaaatattaatatatttttctataaatttaatcaagcataaagaaggttaactaagaaaaaaaatgcgtaacaagacttatcgaagtgcgtaacaggatggaggtagtaatcactaggcactcaaacgctgaagcaactacgtcagtttttgactcgagtagttagagataagtactattagtactatgtttgtgcttataagaagaatgtaatgaagcacgtcaccagcattttgttcagcttaaaagcatcccattagaaccaagtaattttccagatttgtgcagaaaattgaactagctcttgtgaaaatatttccaatttctcataaaattcatgtggtcgaaagtaggaggatcagatcttttcaggaagtcaggaatgttcagatcgacttctgcaaacaggccttcaacctgtacccaccttttctgttcatcagacaaaattcctgctacatattgcagcatgcaattaaaccaggcacaaagatattttttttaaaaaaaaatccaacgcatagatcgaattcaccgcttgtaaaaaagggagcaatttctgattgaagcataggtatttcctcacatgcatgaattgaataatttcctgcaggaacaagaaaatagtctcatcccgcacaccaaattggacctaaattattttcttagactggcctaaattccttgataacattacaaatgccacaaggaactacaatggagaaaaaagggggaaaggcaaattcctactgcagcctctgctgtttgtatacatatacatagttgtttcgaatttcacataacaaaaagatgaaaacgcagaaggttcgatatgtgagcatcctgggacaaaatcgctcattatcggtgaataccgcatcaacctgaatattcctggatgatatgtgtaatcagcacattttttttatgtggagagtatatatactacagaatgttatgtatgccttttgtagggtaagcactggttagggcgacctccgaaattgcaatccatggcaactatgttggcatttcatcaatcagacactagccccgagtgagccctgcagcagagtagctttcttcagaaactcagattcaaatttgctttctcaatgaacgattaactgctcacagcaatatgtaactagttcttttgtcaatcagacatgtttatctctgtttcattcacagtctggttcaaaagaaagaaagaaagaaagaaagaaagccaatatttcaacaatttaagaaagaatcaagaagcacctcgcaaacaccatcacaaaaagttgctaatgaacctttgataacaacacaatacaagccaaaggtatataacaccgaatacatacctggaaggatggtctttccttcaaattcttaatggaatgaattaagcagatcaaattcctgat

SEQ ID NO: 34712 - DNA, 2985 bp, Oryza sativa
tatatatttaggaaagtatttcagattttaatgctttatctgtcttgtactttcaataattgagtggagatgaaggaacatagttacttgtttgaacaaatatactgtgtttattaggcaaatacatctattggttccatgttaattgctaatatttgtaactgataccgatatatttgttctgcagtgcatgctttaaataagctaccatattctaagatagactctaaggccgttggaatcacaactggagttatttttgtaacttatagcagcttgatagcatcctctgagaaaggccgttcccgtttgcagcaattgatagagtggtgtgggtctgagttcgatggtcttctggtgtttgatgaggtaaagaagactctggtataaatattaatcgattgtgctaggcatcttctagttagcatgcaattttctattcaatccgctgcaaattaatctggtatgcttaaatgatgtgtttcttgcagtgccacaaagcaaaaaatctgattcctgaggcagggagccagcccactcgaactggtaaagcagttcttgagatccaggtgtgtgactatatatatattttgggttgattagatacgtgccattaaaaaattgtggaaatatgccattactatttgcgtatttgtaacgatgccactgctacttgttgataatcttagtggtgccactgagatacatattttgcttgtattggacgaaatgcccttatcttctacctctctcttccctcatcttctacctctctctcttccctcatcctttcccatctctctgacccgaatcgacgcctcaccgctacttctcgactaggttggcccgtcaacgtcacgtcaggtgccgaggtggcagagagcaccggacaggtccccacggctcttcacgaaggcgatcctcgccgcgtcaggtgccgaggtggtcggcggcggggaggtggagagcgtcaggcggctgctcgctcctcggtcctcgtttcttcgtcgcctagggactcttcgtggtgaggagaggtgaccggatttgggactcattggcctccctcttttccgactccgccttgccagccgcgtagagggataaagggagggaggagatatgccatcggcgccggtgaccgtgagccttgcagtgacatcgtcgtcgtcagtgtggagctctacaggagatggtcggcggtggcgcgaggtggagggagacataggtgtcgtggatgaagagcgccagaaagggaggcggcggcgactgcggtggtcatgtccattgacagctgtgcttgtggtcgccgctgtcaagccatcgctgtctcaggttgtcgaagagaagagggggaaaggggaggaaggaagaagaagggcaattttgtccaatctttttttgtacatgcatccaaggggtaaatagtggcatgtctcaaatatgtctaaaattataatggcacggttccaaatacttgaatactagtggcaaatttcaaaaccagcatatttttaatggcatggatctaattaaccctttttttcttgctctggtctccctatgatcaacagaacattactagtatacatttattgcggtcatcttatgtagccgactttttgaatataaattctttggccctggaaagcaaacactttcctagagtgatagcatatacttcctctgtccatgaatataaagcacttttggaacagtgctaagtaatttttttttaacttttgtctatcatcaatagcacaaaaattataacaattgactacataagaataatgtttctagatctatcgtgaaacaaaatatcataatatgcacctctttgtatttaaaatagtttatttttatagatgttattagtcaaagtagcatatcgaagaccgtgttgatgcccaaaagtgcttatatttgtggatggagggagtatttttcaaatatcaaaccagaagtcaatgaccttatgttgtatgttgtgatgttatagtattattcctcattcctcaatttgatagattatgtggtatctgggatgggatgattctttcaaagaaattctactgatgatctgttcttaattattgtcaccaaacattgcaggaaatgttacctgaagctcgggtggtttactgctcagcaactggtgcatcagagcctcgaaatctgggttatatggttcgccttggtctctggggagatggaacatcatttcagaattttcagaaatttctaggtttatttttgttcctttatacttatattttatttttttatatacctttccatttgtgtttgcatgttatcgtaattcatacaaaaatttcaaataattatttccaatgccgaccagctaccatcataataacaatttcaatatataagggcatgagcagtagtagactagtagttgtctcttatcaaagcatagcagtagttgtccactttccctgcaaaatgcgaatcagaagcaggtcaataggctaagagacgaaatgagcagatctttttgctgcattatttcctttttcaacagatagtaaagtactatccgctgtctgtgttcggtaaagttatcttgaaaggctaagtgatcaccactgtcgagcactttttttttttctttgggagaaaaaatatataccaagagctgtttacaactagcactggtattagtggaagaagaatttcctccattcactattgatggacctggcaattttgcccacaagttacccatagtacaacatatcctttatgttattttttgtgcttaaataactatgatgagaaacggcacttgtgaaatccaatagaaaattaagacaaagttcactttcaactctgaattttcattttttggccttggttcattttccccctgaactgcacaggtcaccaccctttagccgatcttaattttctattggatttcacaagtgccatttctcatcatagttctaaagcataaaa

SEQ ID NO: 34713 - DNA, 3918 bp, Oryza sativa
ttcacccttgatccaatccactcttgtgagccatgtgtaagttttgagtgtggatgtcgaggcaatgaaatgactttgacaaattaaacttcaaaatgttgcttacacgggaggcccacatgtaagtggaaataagcttctttgttatctattagcttcctttctaaccttctctcctctccccacttcaatgagtctcccctgtacaaactgtttgccgggcacttgtgttggacgcactagatcagccagtggtccagcctgggagactttgtcatgctgtaggcatacctctagtcgaaacacacttttcagaacctcaaaaaggatctcaacttcttgattcaattttggttcttggaattagtatctgctgagatgcaactcgtgatgagcattttttttttgtttttttctttgggctctcctttttgttcagtattcgaaaattttagttttctaacagtgcaaaccaaaattcatgtcgaggaaataaaccacactaaaaatacaaattggttcagtttgcggttaaaaccatatattgatgttagcaattcatcagttctgcaaagaaatgagaagaggatgaggagagatggggtgaggatgacatgtccatggggatccaataatttttttcattctgttttctgagtatttgccattccaacaaaaccactgataagtcataaaagatcaccataatttgtctggggggaaaatgcacagttttaatagtaaaaaggttgtgtagtagacattttaagttaagttttgataaatgaacttattcacagtttaataataatgtttgccatcctttacaagctatggtaacctttctcaggtgctcttgagaaaggtggtgtgggtgctcttgaacttgttgctatggacatgaaagccaggttagctcttcctggaacttctcggtggttcggttctaccttttacacacatcgtagttgacatgaagagcccttatgcattgggtgtatatacaaattgctctttctgtacataggtaagccaattacctcgttgatacatttcctcttctaataatgattggtatacctcttgttcaacttgtcccaggggtatgtatgtttgcagaacgctaagttataagggtgctgcttttgctaccgtggaagctcctctagaggaaagaatgatggtaagattgatgctccttattttctgcttttattttggtggtatgattagtttactttgaaccattttaaaaatctttatagtttacaatgtgatttcacataacattaaaaaccaatgttatgtttagccttttctaatcattttttgtgtagtgctggtgttgatttttatttcacattttgttatctcatgatgcagaatatgtataggaaagcagctgaattttgggccgagttgcgtgttgaactcctttcagcaattgaatattatgcagaagacaagggcaattcatctcagatttggcggttatactgggccagccatcaggtggttctctttcattttacgtaacaatatgtttataaccataacaccctagccaattatgagattatggttccccagaaatcatattgcttccttttggtataatatatgatctttgattggggattaaattctgattcagtggatttgaacatggcaatttgtttgaccttctgaaaaactactacatatgattaataactaaataacagtatgctatgtatatatatttttgcagcgtttctttaggcatatgtgtatgtcggctaaagtacctgctgttgtgagattagtgaaagaagccttagcagaagaaaaatgtgtggtgattggtcttcaaagcactggagaagctcgaacagaggaagctatcagtaaatatgtgtgtttttcatgcatagcactttcatcctgtatacctaaagagtgaacttcacaatactacaacttttttttttttgtcaaaaccatctcttcgctgcaactttagccagacatttcacaaaactgcaatcatagcacaatattttgtcagaaaatcaccactgtcccttgtgtgtatttaacatgagtgtccaacttgtagaagtgagtctgactagtgggcctgacctatcggacaggccctttctgacgaagttgcagttattttttggttaaatcatcagttgacttttctgttttctgaaatgttcaacaaaaattgcagcaaaccgatggttttgatgaccaaaatagttgcaattcagtgaaatttactctattctaaaacctattttggtgaattgattcttggaattattttcctgtttactgaatgaatgtggtagggtgttgaaatggaagactttgtttctggtccaagggagttgcttcttaagctggtagatgacaattatcctttgcctccgaaacctgattgctttcaacaaggtttgcatctagacaaactttgtagatggatcaaaatgctaatattttggtgtttgggaagctggcctccaatctaaacaaacatagcatgtatttgtcatgtagaacttgtgtttgattggctggtaattaaagcatttctaattttttgttgtttcttatttatgcatgctgtagtaggtgatgaaaaagttgcagaggttcagcgtaagcggcactatggacctgatgtatgctttaaaggacaagctaggaaactcgcaaaaatggaagatgaaagtgatgatggaactgatgaatattctctacgtaggtttcttgagaacttttgttaatgcttgctaaatgcatgatatttatgtggcaaaagcagttatatttcccaatcttttaataactacttggaggttggaatcatcttttcgggttccatgacatcaaaagtcttagtgggattggtgaagattacctagccatctagaacccatagtatagcacaactagctggcatttagtgggtgatctcaacaaaattttgacataaatcagtgaaaatttcagagtttgtaaatatgccattattattcacctatttttaaccatgtcatcacaatttcataagtattggagatatgccactacgtaccccttcacaacattttctaaccttttttaggaccaaattacccctttcttctaccttcatccccttcttccttcccctctctactattttctagctccaactaacgagttctcgcgactgcaccaacagcgaggactgcaacgcagcctaatctcccagtacacagtcgcaactcacaagcagcatcgcatcggtgcgctccattcacaaagctaccaaaaatgcatagttaccttcaaaaataactactcccattatatgtagtggctatctctcttaacttatcttacatgtattggtatctctcataactccttatcattctttcttttacttaaatgttaatttgcactaatatttttctcataatcaaatacataatcaactgctttttcctagttctccactacggtgagcactggaaaatacagtgtaagattcaaaaattatagtataaatatatggaatttaaagtataagatatagcatagtataagatttaacctttttccttgaaaaatatgacaacagaaatatagctagccattattaaatattggttatccatgcaagcatactaccatcgaaaatatcagtcaaatctgccattcacaaatatagacatttcttcttgctacgcatgtagagaaatacttccttcatttcatattataagttgtttgactttttttaagttaaaattctttagttttgaccaaatttatagaaaaagcaataacatctatgacaccatattagtgtcattacattttacattgaatatattttgataatatttttgttttatatttaaaatattaatatat

SEQ ID NO: 34714 - DNA, 3473 bp, Oryza sativa
tgcagctgctgatgtattggacgccatggctgacatgcacaacgacatcggaagctcctagcggaatgtgttgttgctgctacagattgagtccgccgtcattgttcacatttgtggacaccctcgccacatcaatggacttgagtagggacaacgcttcatccaccgtgattctgtttagtgtggtgtgccacggctccagcgcatcgtcctgccttaccctggtgagcttgggtttgatccggtggatgcgcatgcatggcggtgtcggcgaactactgatgatcatgttcgggggacgggggaggggtgatgagatgaacacgagtgaaggaaacggagaaagaaagggtaatttggtccaaattttctaataaatgcagtgaagggatatgtactttgtagtggcatatctcgaatttctgtagaattgtaatgacatggtttgaaatagttgaatagtaatggtatatttcaaaatcataaaatttataatggcatagatccaattaaccatatatatatagctatcttctcattctcccatgtcagggatggttatcattcgagaaattctcttctagtattcacattttgatgcaatggggtttacctatcactagcatgagtatggtgagtaaaaataaaacattttttgtgttttcacatttaaaatgttaacataatcttatacactgaccaatggaacctggtttgattttgcattctaaggttgcatctgatcatttaatttgaataaggctggatcattttgcgtattcttgaggtttatgtacacacacattctttattacttgaaagctatacaacgccagtgaaatcacagagagaaagtgagtcaaaatggcccttatgcctaatgcacctctaatttgtcaatactagtgtgtatcccggtaatattttgtggtttcttaagtagtagttagttatggttgcatggcttgcagcagatgagctatggtatttcttactaattcctgaagtacttattgatatctcctgtaaaatgtcacagcagagtcagaccatgaatcaacagagtctgaagaggaattcaatatgtgtcagatctgcaacactgaggaggtgatttgcaatgttccaataaatgcttcattgttttaaccttattgtgatgtgtttattttgactggaaattgtgtggtttaaattgggcctgacatttttacctgccatttttttactaaatcccaacacattataagaaataaaagcattaacattttattccttgttttgcttttgttgtctcaatgtcatcctccttttttttagacatggctgaatgatttaccttcataaattcattgttgtacttggggatagagtgctagaaacctacaggcctacacaacctacaaaaagattcttaccttttcatatgcacggatgcaccacagctactcctttcgcaactctttttgctggtttttataatacttcagttgaatgccattttaggagaagacgatgttgctccattgtactggttgcgccgcacatgttcaccctggttgtctgattcctccttggactggtatgctagcagatgattggtcatgttattcatgcaaggagaaagtagagagttacttcaaagagagagatgcttacataactgaactctccaagaggtgcctaatatatcaataaccatttactaactaatagttatgctcatatggccgagttaatattcatttaccctggtaaattaatgcaggtatgacactgcagtggaaagaaagtcgaatattttgcagattattcgttccttggatttgcctaacaatcctctagatgatatcattgatcaggtaactgatttgtttctaatttggatttaggagtggtgaattcacttgttacaaattttttattgaacttataagagctagcctcagaataggcattattttaaagttgttacctggagcttgcagctggtatatcttaatttgtgcattattcaaaattctaacagagtactttcaagtttcaaacacatataactatatttcatccccactaagtgtatttagagccatgtctctcctctcttatcgagctacatcgcttcaattatttttagcccttggatgcttaatctacggtctgaattgtgtctcttctttttcttctgatgaagtcacattaccttagtttttacctttggacaatcattctatatttgatctaaattgtcataaagcacatcatcttaattgtttatggcttattttgatgattgatcacagatgcaaattatataacgttgcgtcatttagctacaaaacaaatgcgtcatttagctacaaacaaattcatctcatactttatttctaccttcttcatataatattcctgtagcaacatgttgggtttcatctagttaatttagagcagtcccttttattcaatatcagcaatagtttacccgatctagttagcgtctagtatatggcacatgatattatggacaaaggtgccaaactgctatacaccatcgtcatgttgaatacaacagatagtataacttaaatattttactttcttcagttcttggtaggcttgtttattcagttcttatgtatcattgcattaagaagagaaatatacgtacacgaagtcttactgcattaccaacgcaaatcttttgatagtgggatgggaatcacaatataagccatggaaatatggaacaagcgattgtgtaaatcaagatggattgcccactttccctcaagaaaagatggattgcctaccccactggaaggtggaactgtattataaatttataactgtaaaataatttgagggatttaaaagatttcggtatcttttaatttgttgtctaattcatccagtttttactgaacggccaagcttgcaagttttatttttttgtgatatgataaaatcaatcttttaatttgtcccatctagaactgccaggatagcataaacagaaacagtttcgctaaaggtattagctgattattttaagcatcaatgccttgagccattctgtctgttttatatttgtagctaggtggtccttacaatgttgcagaaataactggacgtcgtggtatgctagtaagagcatcagatggaaaaggtgttgtttatcaaacacggaacaagtaagagatttttccccttaagagtaaatttcaaagaaccaaatgttttatggttatatttgcatgaaaccctaggttccttggccagtggcacttaacccttgtttattgtcattatgtttcacaaaaccccaggcttaactaaatctcgactcgttagccttggaatgaattgctggagatctgtcaaagatagcaaagactgcttgaagcaggaatagattttgttatatggggttgtttagtgaaacctaggaccataaaaacctgggcttaactgat

SEQ ID NO: 34715 - DNA, 744 bp, Oryza sativa
cagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcggccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtattcccattcaccagctcctacatttaattaacaagagaactattgtatttatctaacacctggattatctccacctttcatttgatccctatttatagattacgctgcgttgctaacgggccgcacctcctatttc

SEQ ID NO: 34716 - DNA, 6939 bp, Oryza sativa
agaaggtccggggcgactacgccgccggaccggagctcggcggtgacgccgaagagagagagcgacggcgcgagctcgattccgccggagagagagagcggcgagtggcggaaacggtggaggaaggcacggggagtgtttatatagggttgggagggggagagagcggccggatgagggggaatcggccgcggaagatccggccgccattgatgcgccggcgaggtttagggggaaacgtttccgaacgaatccgagggagagagagagagaaaagtggggggaaagagggagggaatcacggggagtgtttcccccctcttgattgcgcgcggggcggacgggagcggcgggattcgcggcggcggcggcgctagggcacgggcgaggcggcgggagcggcgggaggaaggggatgacgggtgggccccacccgtcagcgagggtggcgggcgggcccgcccgtcagcggcacgcgcgcgagaaggaggccgaatgggccgcgggggagaggagagagaggaagggaggtgggccgagccggcccaagagggggagaggggggggaaaaagacttttagggtttttctttttacaaaaccattttaactttgtttttttcttcttaattaatatttgtgctctgaaaattccactaaaatttatttacgcattttaggcttttatgaaatatacaaaaatcctccaagccttatttgacttttaacttagcacattttaattgttggaggctttcacatggattttacttattctatgcataatttcgaggatgtattttagagtcgttttgggacgcgacagatgctcggtctgtccatctgtctgcgggtgatacgcggtgctgaaatttaatcgggtacccaactcttcttggagcttcttccagaagtgagacgtgaattggcttcccctatcagatataattttcttaggaacgccatggagactcacgatcctagcgaagtagagttcggctagtttgttccctccataggtggtcttcacaggaataaaccgagctaccttggttagtcgatccacgactacccatatagaatcatacccgccctggatttttggaagtccggtgatgaaatcgatcccaatttcatcccatttccattctggtacttgtagaggttggagaagtccgaccggtcgttggtgctcttccttgacacgctggcacacatcacaaagggccacgaactctgcaatttcccacttcatactaacccaccagtatttctctttcaagtccaagtacatcttcgtgctgccaggatggatggaatagggactttcgtgagcttcctgaagtatcaactgtttaagttccctgtcgtctggaacgcatacccgattttcgttccgtagggttccgtgttcatcctctgtgaaacaagcggctttaccctgtttcatattcttgaggatcccatgcatatctggatcattcttctgagcctcgcggatttgatcgagcaaggtaggcttggcttctagagtagccaagaatccatggctaacgatgcttaggttcagggcttccatctgttgattaagttccggtggaatgccacggacgccaagagtgttgcaacagctttttcgactcagcacgtctgcgaccacgttggccttaccagggtgatagtggattcccacatcataatccttgatgagctctaaccatcttctctgccgaagattcagatccgactgagtgaagatgtatttcaaactcttatgatcagtatatatttcacagcgattctcaatgagatagtgccgccagatctttagagcatgaaccacagcggctaactccaaatcatgggtagggtagttgccttcatgaggccgaagctggcgggaggcataggctaccacgtggccttcctgcgtgagcacgcaccccaatccttggcgcgaagcgtcacagtacactaggaagtccttgcgagtatccggtaagattaacactggcgaggaaaccagcttttctttgagagtttggaatgtcttctcgcattgcggtgtccacacaaatttttcctccttcttcagcaactgtgtcatgggttgagcgattttggagaagttctcgatgaatcttcggtagtatcctgccaaacccaaaaatctgcggacttgagtgactgtcttgggttgcttccagtcagtgacggcggtcactatttcagggtccacagcaactcctttagcggatatcacgtgccctaagaatttgacttcggacaaccagaactcacacttgctaagcttggcatacaattgatgttcccgcaactttcccaacaccagacggagatgctgctgatggtctttctctgattgtgagtataccaggatgtcgtcaatgaaaaccacaacaaacttatccaagtattccatgaacacttggctgatcccctcctcctgagatagatttcagtggttggttctggctctcccagagctccaattgaacaaggaggcatttgcttgcacacacatgcacccagttgcatcagactcgcatgaccaggaggcagaggaagccagaacaaggctcatgctcatcatgcacgcagaagccatttctctcatgctttcagctgccaagcttcacccagcacggcttgcggttcgctcctcccgtgcgtgcacagctcaagtgaaaccgcctcatcacttccatgtgatcatcctcctcctcagctcccagaatcctaggggcataaataatctagccgtggcatctccattcgatcaccctcatcgatcgatccgcccgatttggtctggccagctttcgtcttctgatagatggttgcttttatacacctgaaactaaggcaattaaagcttaagtgtaagtacaatgcccctctttgttttcctacattttagcatctgtttatgaccatgatgatgatgcattgctgcttttaaggttaaggtgcacatcgaaaagatttgctacttgcttgtagacaagaatcgcataaaatgtaacaatggtttcagaaaggaaatgctcatactaacgaaagtttcatgacacaatatttcagatctttcaaggaggaataagaatcaacctgtcaagtaaaaagttttaatatttgtatgatcagaaagggcatacaccaacctaaatttgctgtgtaagaaagtagctagctgtgccaaatcattgtcacctcagtcagatctgccacaagcacgtacacatatatgtgaaaccgactagctttcttgcagctggaaaaactccaacgtacaacagtaaatgatataatctcaatatctagatataaaatatcctttttggaaacttctacaacgataatatatatcggtttgtcctaaaaactctttttttgttccaacaggtaagacttacaagtagcagaatagtttctacaatatgtggaagctcaagattgccgagggaggaccatggctaaagagtggaaacagtcatgttggaagagaaacatgggaatttgacccaaattttggaacaagtgaagagcgggaggcggttgaggctgcacggatagagttccagaagaataggttcagaacaagacacacctccgatgttttggctcgcatgcaggtataatgaaaacttaagttcaactattgcaaagagcttgattcgtacctcaaatcagaccgcagcagcatctgtatagctctataagaaactcacgccagtccttgtaacacctgacattagccacaagcatatgcatttatagatgtgtaaacaagcatgaaactaatcctgaaaaacaaaactaaacagcaaagggaacagcacaatatgatgtttagtatccatctggaattttcatttttgcagttagctaaggcgaacaacttcagtattgatctacagaaagaaaaagatggaaaccccataaatattgacacagctacagtatcagatatactgaagaaggcactcagttatttctcagccatacaggcatatgatgggcactggccaggggatttcccaggcccactgtttaccactgcaaccatggtaagatagtaacatacacaatcaacttcatgtctcctgggattaccatcatatcatacatcaagtttccagcatcaattcaatttgacagggatccttatgtttgtttgttccaactgcagatcatagttctatatgtcacagagtcattaactattacactgtcatcggaacatcacaaggagatctgtcgatatctgtacaatcgtcaggtaacactcaatagttaacaggaagttaatggctactttttaagtaaatacacctaaaagattaattatatttcatataagatgtgaacaagacttaactcaaagtttgtgaaccagaacatcgatggaggatggggactacatgcagaaggtgaaagttccatgcttagcacagctctcaattatactgctctgagactacttggggagaatgttgatgatggaccagatatatccatgcataaagcaagaaaatggatacatgaccatggaggtgcaacaatgataccgatcttgggaaaagtgtggctctcggtaacaatactttcagctgtatcctagttctatactcaaatacgttttcagctagtaattttactaaggtggcttgggatctcaagtttccacaagttagtttaatttatcaaatataataattacctcacctgaattaaagatctttccacctacagaaatcaaatggttaatactagtcaatgagaacatcaaaatgatttggaaaagcaaggttatcaaaagtatcaagtattgttttagtagtatgttagttatgcaaatttcatttgattatgggagtggatcttccactatctacattcccctattgtaaactgtatatttaatattacaggtgcttggagtttttgactggtcaggtgtaaatcctattcccccagaattatttcttcttccatctttcgttcctatccaaccaggtaaaattttcttccttgctatatgttcaattatattagcacagatcttatcaccagactttgaaatgaaacatgctagttagaacatatagattatgctttagttcctgaggtcaagtcgtcttctgcaattactgagcaagaagtccacaataaagcccctatttagagagatatgttgacaggaaaattacaggtgatcaccatcatcaatgatgaagtgaacttcattagcataaaaagcattatcaattcactcattaaatgttgataattttgtattattcgattactttatcttacagttgttccatctgtagaaatagagtagctatgtaaaatagaacaaatcaaatatcattatgggtgcaattttgtttttgtatgcaggacgattatggagtcacttccgaatggcttttattcccatgtcttatttgtatggaaaaaagtttgtcggtcctataacaagattggttatatcattaagggaagagctacatattcatccctataaaaagattgactggaaggaggcacgcaaattatgtgcaaaggtcagttcactaaacttaacacatttctgcctcgcacgagaaatttagcgaggtactcagcaacaggtgctcgctaggccacctcaggaatatttagatataatgccaactaatattatggtctatgtatagacatctagatatgtcaggaattactaacatcatattatcagctactatgaaatagagctaagatgtgctccaatgcttgcaatattcgcatgcttgttgtagttaaatatcagattgtttatcagaagattcaaagtccgtatagcttgaatcaactgcagtaattttctttcattgtgaattcaaatgtaggaagatgcctataatccacatatgtggctacaagagtgcctatctgactgcctttatagttttggtgagccgtttcttacacgttggccaatttcctacatgagaaaaagagctctataccaaattgctgagttcttgaagtatgaagatgaaaattctcagtatatctgcattggtgctgcacagaaggtaggagttcttccttgtcaaaatgagactcatacttaccctagaaatctcagaagaaaaaaaagcagtaatagcttcttattctcagtttccttttaacagattgagaagctgaattaccaactagtatttttgtccaaaagtttctcatgagcctgcaaatcctgcatcaactgcattcatttgctttacaagcatccccatgaaacaagaagtacatagtacagagaacttggttgaaagttaaaactgcatatctttaaaaaaaaggtcgagactgaatatgcatgtgcagagcgcagacaaatgcaaaacaaaataagactttgatatttaaaattaatcaattttcatggagatgcaaaatcttacacagattgttaaatcgaatacacatttagcatatatataaggtttagctaaatgtttattctcagaaagtgcttaaaggtaaatttcaggcttccttatacatgcatagtgaaagacactatgttcagcagacttgtttttacagaatgagtgcacttctgaaaatgcgtggtaaaattctagcatcatttacttctgaaaatacatggtaaaactctagcaccaattttaccatgtattttcattaattgaacactgcacagtgcactcattccataataatgagcctgctgaacataatttctttttctatgcatttcttttgacctgaattttaagctctagcatgtgagtgaacattattttgaacaggcattattcatgttgtgctggtggattgaaaatcccaattcagatgcattcaagcgtcatttggctagagtagctgattttctatg

SEQ ID NO: 34717 - DNA, 2814 bp, Oryza sativa
catggtttaataaaaacttcccaggtatttttggccagaattgaaattatattagtatctttctcacaacttactgcttaacactactaacttaatttttaagattatggacaatccttctggtgacttcagcagaaagtaccgtcacatatctaaagaaggatgggccttccaggttgcagatcaggggtggcaggtttcagattgcacagcagaagctcttaaggtgcagatcaaaatttaaatattaagtgaagaacaaattagcgctacctgatgcagacatgggtcaagcagggttgattttccatttctattcatctgtctaggtttaattgattctgattgattattctcgaaagtaaaatgaaaactgaaaacaagaaaaaggcatgggttgatttttccatttctattcatctgtctgggtttaattgattctgatcgattatgctcgaaagtaaaacgaaaactgaaaacaagaaaaaggcatgggttgattttccaagtctatattcatctgtctaggtttaattgattctgactgatagctcgaaagtaaaaccaaaactgaaaacaagaaaatggagcatggcacatatgcacctaaattccccccaaatctggtgttaatgtctttaagtttacgataccatctgatatcattataccatacatggaagatggagcacacaaatctacaacaaagtaatacagtttattgtttcaggctttgctactgctgtcaaagtgtttgtcagatggtgcagattatcaaatggaaacctactgctactttgacgcggtgaatgtattactctcgttacaggtgattattctgcagcgcagacagtaccacatactatagcatatgatttggacagagttcaccttaaaaaaaaatctactgcccaaataattctctagttccctagaacattaatcatttattttgctatcctatctgttactccctctgtcccaaaaaaaaagtagctatttttggttatgaagccagaaatagctacatttttaggcacagggagtagctaggaaagtaagggccctattcttgaggtcaagtactattcatgtcatcacgtgaacggtgaacagcacccatgggtactgtagaagtccaagttatcatataaaagggaccatgaaactccattgtaattaaagcaatgaatagacaagagaaaggatagatgtagagtaataaagatttgactgaattctatgcagaacccaaatggtgggtatggagcatgggagctagctcgcacatatccatggatggaggtaaatctgctcagcacctcaacctaataactgtatcaatgcactaaatagtgtaactgtaatggcctacgtatgctactatcctctttctttattatcctattatttgatttaagaattatatgattaacgccactgcattctgttattgtacacatatctagaatatactgtcagctcagagttccaaacatagaaaagaagtgagaaaatattaatgtgttattcacagtcacaaggcatacttcagagcattaggactatcaaaggtgaaggagagtatgctatgacttgcagaattcacatttaggatacataaataagagaatataatggaagcaaactagctgaataagttaaatacttagatggcacataatatcaaggatttaaggaaattaacgttagaggagcatggcagtaacaaattatatacatctgaagcactaaataatgagaatttgaattacgttttgcagattttcaacatgacagagatatatgcagacatcattgtggagcatcagtgagaattttacaatctttctttctcaaattctcctattgcagaatgctataacatgcacacatactgcaggtacgtagagtgtacctcatcagtcatccaagcattggcattgttccgggagaagtaccctgggcatcggaaagatgaaatagatcaatgcatcaggaaagcaacagaattcatcgagaagttacagaatgatgatggatcatggtcagcactccttaaaaaaaatactatagaaaattgaagtactaattaaatctatcaattaacataatcctagttacataggagaatgatggcattgctggcacactgcctctgtttagagtgctcttgccaaaatctaagagacagtatgcctaatccggtgaaactaaatgattcaccaaatcgccaaacagaatgggctagatcatcacgttctgagttgcaacacatatttcggattgacaatgtacttatgtacagataagaaaacaatgaaaattgagataatatacagtagcaaagcatattaagagaatcagttgccgatagcattactagtaaagacttttgtataacagaaaaaaatagactggatcgaggttaaataaattcaatggtacatattagattttaaaacactgctacaagtaaatgtaatactgatagctggttgagagattggtaatttggattaatatttttttttctacaggtttggatcatggggtatttgcttcacgtatggaacatggtttgcaatagagggtctgtcagccgtggggcagtgttatgatgacagcacctgcattctgaaagcctgtgagtttctgctatcaaagcaactaacacatggcggatggggggagagtcatctttgatacacaaccaaggttacactgccggaatgctttattgtgtcaatcaactttaatttttgacagcttagattaagcatcgggtttaggaaaacttctatctttctttgt

SEQ ID NO: 34718 - DNA, 17263 bp, Oryza sativa
  unsure (1)..(17263): unsure at all n locations
actatcagacctctagcatcaagcaaacaaatatagctccatctgctggcaatgctgctctgaagaattcagcaagtacaacagcgccaacttgatttcttggcagaatcaagcaaacagtccagtgtattgtaggtcatgtgaaagagtacaaaactctaaatctagaatctgctgtattgttttggtcgattttatgagatccttatgaattttttgtacattctttagatctgtgcaagaacatgtacatcacatttcacatttaggtactttgaaaaaggataacaaactttgccccaacttcctggtccataaacctaattcataaactgttatagtgatgatactgttaacataaactttggtactaaatgtatgctaacacacctctttttgctccaacagcagaaaggcagcacagaatttaacagaaacccacaaactattctagtaataccaaaaatatgtgttcaatacaatgcatgaaagtgaattctgaacgtgaaaaaacacataaaatgtgttgggcgtggcctgtggggttagaagaaaagccaaaaaggagtggcgcactccataatacatctcgcgttgctatggtgtagagggatcagggccagaccgtggcctctgacatggaaagtggagttgggggcccaaaccataacagaaaccagacttctccggtgcatttaaagttttaaacagaaacaatttagggaaaattaaactcagatgcaattataacagaaactcatcatagatggcaaaataaatctctagcaggaatatagcttgacagtcacagatagacttttccttcggtgactaatcacacatttctgagaaatgaatgaaacttcattacaaggcaacaaatacaggtttaagataaatcaagaaatggacaggtaagtaaaacatttcccatctataatgaaatacgtaactaagtaattcaacttactgaagaacattctggatgtgatggagtaattttccgatatgttttcttgtcaattgttatttggggaacatgggaaatgagatggaagtcttcccctgatttaacagcacatcttctgctcaactcaggacagccattgatcacaattttcttgagagaagtgaaactttgaatgaaatctggcagtttcattaatccattgcaatttccaataccaaaatattgaagagaggtagcagcagaaataaagctccctggaaaacagactagcttcggaagcccaacaagctggagcacatcaaggcaagccaggccacccatggcttctgaaggttccaacaaatccagctcatggcaattattaatcgataatgtttgaagtgtggagagttgattcatggtcgagggtagagtagccaactttggacagttgaagatgtagagctttcggagggaagttagactaccaaatccatttgtcaatgatgataactcagcacatgaatttaagaacagaaatgtcagtgaagtcaaactacaaaatccatcatgttctgataaatacttattcttcagtgtgaggcacaagaatctaaggcttataagtctatgcacgtcctttggcatcttctctaattggtcgcaccgactaagttgcagtgtttgcaagttcaccaacttacatagggaattcggtaagaacttaattttcccattccattgtagatccaggtaccttaagtgcttaagatttccaattgaactcggtagctcatcaaaatcaacgtcagaaaaaataagaacacgcaggagtgtaaaggttgacaagaagttgtcaagaaaagctttagtcatggtcccattgttatcaatgcttgcaaatgtccttgccttgtttgcctttctcaggtgcttaggaaattcaatctctgttgagaagtccttgcgatcccacacaaggtgcctaaccttttcagataaatctttactttcacaattaacaatagcatgctccttatggcacacaaacatcgcaagattatgaacaagatcatgcattttacaactttgaattgagccattataaataacataatggtcttggaaaagagatctttgatccagttcattaaagtattgtcctccaatagtttctatttcatctccttctctggttttatgcaataaccctagtgccatccagaacataattaaaagctctctcaaaatcacgtagtcttttggaaaaacagataggcaagagaagcatgccttaagatgaggtggaagtgcatcataactcaattttaaggctggcaatatatcgcatttattttgctcaatattccacagatttgcatccttaatacgcaaccactccttaacatcctgtttaccaaacagtacagaccccaatgtcttagctgccaagggaacaccgtggcatttctccacaatacatttgccaatttctaacaagagtgtgtcctttttttcctcatctctgaatgcatagcgaataaatacctgcatacattcatcaaatgaaagctctggcacatagtatggctccaacgtcttcaccaccgacgcaacattcatattacgtgtggtaactacaacaacacttcctcttccaccactagataggaggtttttaagttgttcccagtcattaacattatcactccatatgtcatcgagaactagtaaatatttgttttcctgtaaaaacccacgaagcttgttttgtagcgtttgcaggctcagttgtttgttgctttcacctgtatctgactggattatgtcatccagtatcttctttagatcaaatacattagatacgcaagcccataagttcttctcaaacattttctttatcctcatatcattgtacactagtttggccagtgcagttttccctatgcctcctaaaccaacaataggaagcacagaaaaagcatatgcatccgcagcactcagtatgatttcaacaatcttgtttttcgcttcgtctctaccaacaatgtctaactcattgatgaaggaatgtgtttccctggtattgctactgaaaaattgcgtatctatgatctcctctgttaatgcaaactcccttctgttagctgctatctcatcaagcttttgacgaactactgtatcttatggctcaattcgaatgggtaaacaagctgccgactgaccccagcatagaaaccattatgaaccttttgctccaaatctttggtggccacatcatccagaacatcatcaatgtcgtagacgacatcctttaaatcttccagccacactttaagagcacaagaagtagactgcttgcgctctgcatctttaagaacaccacagatggacttcagagatctttccaacttcctcacttctttcttgaaattccacgctgatttaatctcgctggcagcacaaaaggccgcttttccaagaacggagattgcaaaactcgatagatgcacctcagccatattttgcttggcaactgcacgatagcaagagcatcaaaacaaacatccatgagaggaaatctgatgtcataatactattacttttttttaattaaaaagaaaagaaccccacattacaatacattaatcagtaaaacctagcatgatttaagatttaagatcctggtaaaatcagactcacggaactaatcacataaatggatgccagatgaagacggctgcaagccctacattgcaatcaatccaatccacctgtggggattggagtggatctaagctcaaaattaaccttaacaaacaagcaaagtccaggacacgcaccaaaacccaccgcttcctttgcccccctcccgttcaagacggacgcgtcagatcaccgagcaccgccgcgtggcaggaagacgacgagaggggcggcctgcagtgacgccctcgggtttttggctccgcacagcttcttcggcctcacgcggtgggtggggggtgcggtgggcggtgagcggcggcgacgtcagctaggtcaaaccgcagcggccagcggcggttttttttcctttcccctttggcttcgctggcgtagagcaccggcgtccggctggtcgccggcgaggttgccaatgccggtattcgtcttctccgagtgtgggtggtagcaaaatgggcaagattaactttgtttttcactttaaatatcttggttgagctacagttgaaagcttgaattattttaagaaaataaatagaacaaccaaaaataatttatagatgctgtaatttaaaaatccaaaattaacctaatacatttttgtttttgcaagacttagtttaaatttaatatttagactttggttgtggctaacaagccaacttatatagtaatcggagataaacctattgtacgagagggatatgagtgatggtctgagagtatgagccaagtagatttttttttctcccatcggatagcctattaagccaaagaaaaagccaaattttgaattttcaaaattaagattgattttaagatatttttttaacgtagtttctttttcagcattggcttttatatcaccgagaacacatatataaaagttttacctacaaattcatttttattttctaataaattgttttggcttattagaaaaaagccaaacaatggggccctttgtgaatggaagaaagaagagagatcgtttgacttaaatttggagttgattcttgctttaaaatttatttagttatttttttagggtgagtttagtttatttagcaccttactaatttgggcaataattttctcttgataatgtatgacctcgattagtaatgtatgaaacatcttcgtatgtccccacaaatagggcaacaaaattcatctaagtctttcaagctaaaatcttagtcatcttagacattattttttatttactaacaaggtataagaaacaaataaatacaaatgatgaaggtataaatacaaatgatgaaggtgaaaacaactgtaaaatatatatatatatatatataattttattattggagtatgtatcaaatatgttttcctttccagtaactcattgcatcaattgcttatatgtatatagccacattattgtaaaatgtacaacaactcttaaatatattatcggatgtgaactaggttttataaactcaaaaatataaaccatatagacataaaagtcttatatttgttgaatgtaaaaaaaattcctacataacgtgttaacataaaagtcgatgtagcattgtcattaaacttacatcaactagcacgtgaaaccaaacccgtcggtctcttcctcctcttattcctcagtcatcactatttgaagtcggcatttcgattctcatcctcagtctctccggtcatcatcatcggccgcacagcaaaaccaccgtatcatgaccttgcaggcgccatgtccaaccggtcagaagagagagggggttctcttccatcatagccgatatgggagacgattttgttcagattcttcaaggcatcctcgaacgcttcgcggatctcgtgttcgcttcctactcttctccgacgagctaccgattgtgctgggcttctttgccgatcatgatcgacactgctgctacaaaaattcaaaaaggtaaaattccattttctaaaaaaaatagtagatgaacacctattcttttatgagcattagctacaacttacacctatcacaaaacaactcgttgcaaaaaggggagagaccaaaacttgattgctcaatgcaagagggaaggattgcaatgctcccatttgtacgtaatcctattaaaataagaaaacacaagaaaggaaattttcaagttctccttttctttttctttggagcaatataattctctctctctctctctctttttttggcaccgctttctacctcctctactcctcttctttttagcgaagcaaaccctcacctcttctctactctctctctctctctctctctcaagctcggcggaggcggaggcaagcaaagctttttcccttggcttcacctagcaatccaccttgggcggcccgtccgtcgagctgagcgcgtcggcgccctccttactcctccctccccacgtgcggccccgtcggagcacggcggcgacgaagaaccaggggggtgggggggcgaggaggagggcatcattccaccggctgattcattcttcttggctcgagtcgaattggagaggtatatcggctcttctctcgtaccgccgcgccactggagatggatggatgggcgctttgcatggctcggattagggatccgttcggacatggcttcatttctttcccaaattgacccgtccagttaattccgtcccggtttccttcttttttttttctttttttctttttttgatgtgtgggtggtgggtgcagcagtggtagctgtttttgtttccaaaaggtgattttttttttgggtggggggtgttgttcagatgaacacccaaatgccccgcgtttgggcgagcgagttgtagtgcttgttggaaccaaatctgtgatctttgcggtttatgctggtactatgtttggtgtgatctcagaaaatcgaattttatttgggttgcttttatggttggtaccgatgattttggcgaagaatcgtggtgtgattgtaggaatgggaagctttgatccgttcggtttgctgtaggagcatgcatgcttatgatctctcttggggttcctcctttgcaggtaattgcttgccttctgaggaactgcgggagggagcgaggagtcgtggagcgactcttgaaggatggcggaaggtgccaaattccatgggatcgttggcgctgttggcgcgcatgatgttggcgggaacttctgtgacatggggtactaccagaagctaggggagggctccaacatgtcgatcgatagccttaacagcatgcagacaagcatatacggtggttcggttgcaatgtcagtggacaacagtagtgttgcatctagtgactctcgtaccgggatgcttaagcatcctggcctcaggggtccagtcattgtgtctagctattctgtcgggaacagcattttccgtccagggcgtgtgtcgcatgccttgagtgatgatgcattggcacaggctttgatggactctaggttccccactgagacactcaaggattacgaggagtggaccattgatttgggtaagctgcacatagggatgccatttgcacaaggtgcctttgggaagctctataggggaacctacaatggaggcgatgtcgcaattaagcttttggagaggccagaggctgaccctgagaaagctcagttgttggagcagcaatttgtgcaagaagtcatgatgctcgcaacgttgaggcactcaaatattgtcaagtttgttggtgcatgcaggaagccaatggtttggtgtattgtgactgagtatgcgaagggcggatccgttaggaattttttgaatagaaggcagaataggtctgtcccactgaagcttgcagtgaaacaggcattggatgttgcacgtggcatggcatatgttcatggccttggatttattcacagagatcttaagtcagacaacctattgatttctggagacaaatctatcaagattgctgactttggagtggctaggattgaagtgaagactgagggaatgacacctgaaacaggaacttaccgctggatggctccgtaagttggcatacatgctctttatcttgcttattttaatcagtaattatctcaaattcgtattaagacaatgctgttttatttttcttcactcggcattacccaaggccacagtatttctcaaatggtaaatgcaacacatttgcagtccttgtatgataaaatgcagtaacctattcatgtgaattagtagctaggtatgcacatgtgttctaattacatgcaatggcactgtgccagtcctgttatccataatttatccttttttttttgctaaggctggttattatcttgaatgattcatgcatcgaatacttgagttatgtgaaaatgcatggtcatttgcatgtaaaacttttctactggtgctgcccataactgtaatattttactttttttgttctctgtttttcttattctcctctgaaatctagtttggcagatcaaattttataatatgtgaaacaagcatatgctgtgacaggagatgtcttgtaaattcttgtgtgtagcttcatgggttgaaatatatgaatgctatttagacatagtccaagagatctcattctaaaattttcattacatacctatatacgcttataattggttcgtgggtgctaatatttaataaattattgctgtttaaggtattggattgcattaaccgtgccctatgaaagcatttatgcactaaaccctcattctttgctgatagatgcacaaggtgttcatcttaagagcattgaaattgcagcttgaatcttctagtttagatgcttgttcaagatatatttgttgctaattctcggctacaaagaaaagatggcagcatcggttaactcaggcctatccttggcattaggcacaccaactatttattaggtgaagatggatcaattatgaataggattatttggatagggtttctggatttaacagacaatcaatactcattcaatgttgactaaccgggtagtctggatatcagtgccacataaggataatttggacaaaaactattaaccgtacaacctagtaacgcaaaaaccctagcccttagaaataatatgtctcctggcttccgtagctaacctaaccttaggtaaggcatgctaccagctagaatgttgaagacctgttttgccgataaagggtgatttcatgggtaatgaaagcatctgcacccccaagagagccttgtgtaggtaggaaagctttagagcaagagcagcatgtcaacatgatacactccatgcgattatccacaatcatcaattcccgtccatgggatctatgagtaatcctatcaaagatcttgcccctgccagccagatgacctgcgttggtcagccattggtatgatttgactggaaaaattgaaatgtgctccatgattgtaccatcacgatctgtgctgcttggataattaactattttcagtttaaggacccctttggtttgtaggaataacatagcctaggaaagcttttgaaacaaaggattaagttctatcatcttcctatagaaattgaaccatgttgcttgattcctgtgttattagtttctgcgttccataggggggctgagtcctctgctgacccatcacagcaaagcccttggcagtttccacgttctctaggtcatgatgctgtccagtagctttgccttctttcttgttcctaatagaattgtttatgttctaagacaagattaactaaaaagttgtgtttgaagtgtttgcgcaaaacaaacttgtgctttaccctttttaagggtaagcaactgcacaaatagtttcacctctcttaactatagcttaaatgcacaagtgtgttcctagctaagctaaggtgcaaaagatcaaaatgttcatgtataatgtaatgttgcttaaacagtaaggtaattgcatgcatgtaactacctggcaaaatgtgttatttgaagcaaaaaagttcctatgatgaactttctgctgtgcatgatgcatgaatagcgagtgttttgtgttacaatattagcaaattagcacaaagtggtgggttttatttaaaactttgcagagaggaaaagtatgctatttggttcttggtgcaaaatgctgtttatatctggcagatttactaactacaattataactagcacttcaaaaaagtcaagcttgagcttttattcactagtcttggcctgttatggagcattttctctcatagaaatagagcatcaagtttattcctttcttatccattagattggaccagcatattttcttataaagtatgaattagtgtttgggattatagtgcctatcctggaacctggataggtggataaattattggatctctatgatgttcatgttcaaatatagtgcagtatgctagaattggatcaattattgctcattgtgtttttttttcattggttctagtcatgataactttttattttgacttgcagtgaggtgatccagcacagaccatatgaccaaaaagtcgatgtctacagttttggcatcgtcctgtgggagctagtaactgggaaccttccttttgcaaacatgacagcagtgcaagctgcatttgcggtggtgaacaagggtgtccgcccagccataccccatgactgcctccctgccctcgcagagatcatgaccaggtgctgggatgcaaatcctgatgcccgtcccccgttcaccgaggtggtcaggatgctggagcaagtggagatggaggtcgttaacactgtccggagggcccgcttccggtgttgcatctcccagccaatgaccctagactgagtcacagccaggatccagggtggaaaaaggcaacctggagaaaagttaagtcctgtgtacctatcatattaataggcctgttctgcagagaagatgaaagcccaagctgagtgtacttggcgtcgcgcgttctcttcgtttaccctagacaatacctagtatctatcgtcagactggaatgtattagcggtagctttttatctttgacaacaaaaaaacaccatgcagggctcttgttgcaacaaccgcatgttcctgctgtatgttatctgttgtaatcatcctgcttggaacatgtgcaaggctgcaaggcttgatgcctaatagtatatatagcatatgtataattacctggcatgtgtcatacctgtttttatagttctggcatgtgttttttaacctgcttccatagttctgaacttcttattgatgcagctttcatggttaatgttatataccatgtactattaactagcatgtgtttttccctgttcccatagttctgaatgatacacctacatgcttaatggtatatatagcatgtacagttatctggcatgtgtgtttcatagtttagaatgatgccaagtaaatctgtcatggcatcacgccaatttcctccttgtgggttcttgagcatatcatggtatatcctgtgatgtgttcactagtttgattgctataataaccgtaccaaatgctttcaggtttgttcagtggatcagctgggttttcagttctgaatgcttcccaattaggttccccttgtatcacaagttgaatatttcagtcatgaagtaccgcgtgaccaaaggagctttgctacagaattgtgctacatgagagcttaagaagctccaagttcacaagaaaagaatggcgctctgcaaatatacaaaggatggaaccagagagacatgagactggaaagctaccggcagcataattatgcagcttcttatggctaaacaccaccactcacattgaacagcattcatgacgcaacacaagtaaaagcgaaagggaacacattgagacaggaaagaagattgacagcaagaatttcggaactatgaaattggaattataacctaaagggaggtgaaacaaagcctataatgttgtacaactgaagcagcagcaacacctgacataaccaacctgctcttttaacccttctcacctccataagagcatcatatgatccaactgctgctccaaattagtaaatgatatgggggagaaaatcgactgctttactccacagggctagcgttcgtgctcgccgttccatcttcagccttggtggnnnnnnnnnnnnnnnnnnnnnnnnaagaaacaccctcaactgcaggcttgctttcgccattctcagtttcttttagctggacagtctgaccaaatgtgtctgagatgtgggccataagttctcctagggccttattctctgctggtttctgcagctctgggctggcaggctgctgctgacgtctattctcctgcaaggctttctcccgctgctcatagaagtcaaagtcttcaagaatgttcgtctccgattcatggttcttgaagatagttaacatctgcagaccatgttccagcttcacctgcatgttttgtctctcaagttagccattttcagaaaaagctacattcactagatgtttcagaaaagcagagatctctacggaaagattaggattaaatcaacagaagctggcaaaaagacagcttttttacctcctgggtgtccctgctattagttacaggtttgttgtcattgttctcaagaatgatgtgccgcagcaggttgttcgggacatccttaataatgtgccacttcacagggaactggccactccacttgtcctgctgccaataatcgacacttttgtcaaaatcgacgggtccaatcatctcagctacaccacagaactgaccactgccattaacctgcaaaaaacgaggttatggatcaatttaaataaaatctttaaaaaatcaggacatagatcaaaagtagtcttatagaaaatcagctttttgttacttgctttttcccgtagtacagagaataaaataataaaaaaagaggggcttgtcttaccgagaaaaatagaaaaatagggcaatagtcttctttttctttggccaagcgataagcagaatccagctttctattcccactagctgtactggcccaaacattgtacttaatgctcctatgtacatggtcctcagtgtaggactttattacaaaaaattttgcatccttgtattcagtgacaaaatcagggcgattatacagttcactatcaaccagaggaacatttttctcatttttgtcatctattgaagagttctctgtgtcttgtttctttggttttgtagcacgtggcccacggttttgctcattcaggaactcaagagcaccattctgaataccaaatggcatgctccctttctgttgattggcgcttaagtcaaaagtaccaaatctgcgaccagaactccaacttggagtagtgcctccaaacttaccaccttgttggcgtggcttataggatccaggggcatacattgacccatgatgctgcaaaaacatacaccgtcagtgctggacaatgaagagcacaataaacattaggactgacaattttagttcaaccagtatttgccaaagcccaattgcaagaaagcataccattccaaaagccagcggtgtgttcccttgaccaaacaaaccaggagtgctgcttggttgggtggatgctgcaaaagaaattcatgatatgttaagcattggcctaatcaattattacaacagaaataacttgcaatcatcaaaagttcgacttgaagaacagcaaagattgaaaaggagaaatattacctctgtcaaaagacccgaatggttgatgataacctggtgttggcgagtagagaaggccgtcaggaaggaagtactcctgctgcagcataggatctccttgagacattccagtggcggaattagagtatcccatgctaggagaggctggtggctggtagtaaggacttgagaagggaaagtgcaatgggaggtatggctggccatctccaacgccaggagaataagctccatacatcatttgagggttgtttgcatatccaggagataacatgattgactggttgtcgttgtaaattcccttcagcaaaacaagattaagaaaactaaactatgaaaaatggaaaataacttcagtagtcatagtacttacaggtgatacagaatggagtccttccatattgacataatgggggtattcttcccattggcccaaatggttcaggtatcctacaggggaaaaaaaagcaaagaatattaaataataacacttccaaaggagttaccttgttaaagaacaagatacgcagattgaataatatgttcgcctctctctctcaagatttcaatagaggcagttaaacaatagtgagatcaaaatagtaaggactgatgaacacttaaaactgatagcaacaatcaatcatgttagtacagagaaaaccaaatttagagttaaatatctgaaactttatcttctaataccatggttgtgtacatttggggattaaattgtccaacagagttcaatcgtcaataataacacataaaaatgaatgtaacctaacctccagaatagattgtttgtggctgaggtgcgtacacattgggttggtagaaaggttgttctccacctttacccaaaaaactagccttctcctgtgcaccctttggtgattttgaggagctagcaccctggggaacactagtagtcattttctcatttgtactagaaagaatctgatgcagagaaaatcaaccattagtaaatagcgcgacacctattgtagggaaaaaaaactgataagacaattacctgctctttagcagcactcttggatgcgttgttctcacctacaatttctgattgtggtggaatcatgcaatctacataacaagcagagttacaaagattgtaacatcctcatagcggttatcaaaacttaaaaaatgagcgaagtaactccacagatatataaatatatatagaaagtaactatatcctacaaaccataaatgcatattatggtttttactccaccaaaactatcaactcgttctacatgagcaagcatttaataaacgctttacaattgcacatgtcctttcatcaacactgcaaatcagccttttgcatacacagcgcataaccaacatgctcaaatcaacactgcagcagcagcagcagcgacctattcaaatacctcctccgattacccagagtcgagaggacgctttagtcctttttaaccgcactagaattagtgaattaccacctacccgctcgtactcctaccggcgtaaatttccaaactacggaattattacttaattctcccaacttttcccccctcgatagcaaactgtcctgtacgcgttagctcccaggggcggggaggggaggatcaaacatgtgacaatattagtaccaaatttaacgcaaactaagagagaaaaaaaaaccttcccagatctagaacagaagctagggttcacgcgaattcgaggggagaaaaacagaaagagcgcgtgggtagagagagagatgaggaagaggacgatggaagcttaccggcggaagcagccgggcggacggcggcgcctcgccggatggagatcggcgcaggcggcgggcgaactcgcgcgaggagacggagtttgggggggagtcgacgccgaggggaacgggaagactttggtttttgacaatctagccccttttagaaaacttattttgtaatagaccctcctaaaagctcgttttcgtggataaggtctttcagcggtctatctatacattaagctttttctaaaagggccagattgtcaaaaatccaggaacagctatagaccatgtgggccgcccggcacggcacggcccaggcccggccgtgcctgggccgaggcttgtcgggccggcacggcccgaccgacgcaccgggccgtccgtgccagcccacgtgccgcactcacggcccaggcacggcccaacacgcctcgggccgtgccgggccggcccgaaggcacgatgggccgtcgtgcttttcctcagaataagtctaaatttactccctcctattgggctgtgacatatgtacagctacaaaaagtctattttttctccctcttctttgggctggggtatataaatagctaaaataagtctatttaaggtccctattctttagacagttacatttatatgtctatttttagtcccccatactttatgtaccgggcctggcctgccggcccatcgtgccgggccggcccgaccgtgccgggccagcccagcgtgccggtggggaggcccaggcacggcccgacggtcgggccgggccagcacgggcccgacccaagtcgggccgtgccgtgcttgggccgggccaaaaaggcgtgccgtgggccgggccttcgggcctcgggccttatggccaactataggaacagcggaacgtggacgggagatacttgaccagtttgaccaggctaaacaatgattttggatacaattatgcttattactccgttcggttttttaattttctaacgtttgaggatgatcttactcctacttttctattttatctatactagcaaaagacccgtgcgttacaacgggaagtgtaaagatcagaaaatcaaggaaaagttaaaaaagacttatattatgtaattagttgaagtacaaatttccttaaaaatttggatattatttaagttggcaggtgtataattaaattaatttacaagtaaaataagtgtgaaaaaagttatatggttggatttaatttttcaaaattcttcataattaattacactctttgaaattttattgaaattttcaaaacttaattgctaattttgataatataaacataatttcagcatttattcttcaacccgcgaattgaaatttcccgttcgttctcttctgggtaaccgaaggtggagtgttatttgatgcggactctggatgatttgttgtgtgttggacttgggatattgcaggacaaaaattggttgaggacggacggaaatttcactggaaacctacattagattagagatagagaatatataaacgatgaaatcggatagaaattggaccttttttccggacttttttctgccctttttatatacaatcggacttttttcactctttttttcattttagacgaacaacggaaacattttcaaattttttaagtagtagagataaagattagccattttcgttttcttagggagtgctgtcacgaaaaacgtgttttttaaaacaacttttgtatagatattttttgcgaaaaaatgcatcgtttagtagtattagaaggaaagaactcaaccttaagggacctaaactgaacttattccatgcccatgaggcggactgggaaccgcggcctgatgtgggagaagccgcagccgtccgatctgatcgacggtctagattgatccggatctatataaaagttcagcatcccaaccctaaccctgaaatcttttcccctccccctcactctctttttaaatgacggcgccaacggtgcctttccccctccgccatggcggcggcgccattccccctccccttcccccaccgccacgacgctgctcccctccccctcccaaggtggcggg

SEQ ID NO: 34719 - DNA, 902 bp, Oryza sativa
agtgacctcccaagcagcgtggggctctgcatcgtcaccctcctgctccgggagctgcttgccttggtagtccactccatgcggataccccaggacaacgcacatgccccgcagctccaaaacgaagccagtcaggtccaggccacgacggttgatgctaccggccatctacaaacaaaaacaaaagagaaaagcaacattttacagatcagattttgacgataaatgaagcagcaggacagagagagactagaggattttaacaaataaggaaggatttttatttcgaaaatattgctaagacttgggatctaaagctcatcctagggtcaaggaggctctgataccaacttgtcacgaccggaaataacccaacgggagttccttacgtgcgtgtattattccttgtcccaggaggcaaggtacaccaaaagttgatacatttcagagtttatcaagcggaagcgtaaatagttaatttattacatgggcggcaaaggcctagcacacaagaagacaaaagaaaaacagcggaagactagggcgacgaccacaggcgcttgacggcaggcacgagctagacaccaaagccttcatctttcaggaactcctcttctgggtttgggaaaaattgagcaagactgagtacaaccacccgtctcaataagacacacccataagtgcagaataaatgcaagggagtacaagggagccataatataggggttagggtttgcagtaacagcattaaaagacactaagttgctcaaagctattttgtaaatacgaccctagagctatacaatattattaatcaaggccgtgaacccacacgaacctgccttaacccaaggcctacgatgaatcagaccgaactggcaacctgaccctgggtcccagct

SEQ ID NO: 34720 - DNA, 13021 bp, Oryza sativa
ccactaaaatttatttacacattttaggcttttaggaaatatacaaaaatcctctaagccttgtttgacttttactttgcacattttaatttttggaggctttcacacggattttaattattctaggcataatttaaaggatatattttagggtcgttttgggacgtgacataacccctatgtattgcaacgaaaatcacgtcgttgcccaaaatttcgtggcattagcccgaaaaccttgtagtgaagcaacaagaggaccggcgcagcatgactggtctgaccggggaccatgatcggtctgaccggcctagtgtggccggtctgacccgatctcagcaaagagctggggggcatgagatgtttgatttagaggccgatatgactgtaaattcagacatttgtgcccaggagttggaaaaaggattggataatccgtttaatagaatattcgaaagatcctagtcttagggttgatcgggaaattcagcggcaagcatttaaatatactttgcttgatggggagttatatcaccgaaatatagatggggtattactgaaatgcttagataatgatcggtccaagtttcccataagatgaattggttgcttaagagagtggggttttattggccgaaaatgattaatgattattttaggcattatacgggatgtgaagcttgtcaccagttcgttaatgttcaattggtgcccgccgcagtgttcaatcctattattaaaccatcgccgttccgaagttgggctttagatttcataggtcaaatttatccttcgtcatccaaaatgcatcagttcgtgccagttgtaatggattatttcaccaaatgggccaaactcatgctgctatgacttacacggaggtaattgactttattttaaaagcatattgctcataaatttggcattcctcaaacttttatgtctaaggaggtaagaagtttttccaaattttatggtattaaattgttaagttcatctctttactacgctcaggctaatggacaagccgagttgagtaataagatgtcgttgaaattagtcaagaaaaagatcgaagaacatccaaagaggtggcatgaggtgctttcggaagcattatgggatgataggatatctgaacatggtgctactaaagttactccttaattttgagtaggcttatggacaagaagccgttttaccgatagaggtgaatcatggctctcttagatacataaagcaagatgacttattggttgaagaatagaaaacatttatgggagacaatctttatgatgtgaccgataagtgtttgaaggctttggaagtgatagagaaggagaaaaggagagtagctaaatcctacaataaaagagtgaaagaaaaatctttcaagcaggagacttggtatggaagacgattttgcctttgggttctcgatttatggagttccgtaagtggtcacatagttgggaatgtccttattggatatgtggaatcgtttcagggaatgcatattttattttcttgagacgttacaagcagaacgatttcaaagagcaattaatgggaaatacttgaagaaatacttcccgagtgtttggcaagttcccaagtctttaggttcacgatgttcaccaaaaaggcagggggcatgtgtttacatccaaattttgcacctagtgtcgatttccttcacgaagccggtctgaccgttatatgttggtcggtcataacgttgcttgtggaccggccggtcaaaccggcagaattcgatcctgagtatgtgtttcagaaaagtttcagaaagtatgtgtttttgtttttgtctttgttatatttttataattttggtacatattaatcagtttatcgcatatttaggtcatatcctaaccactggaaatcgttcttaatgccgctatttactttccataaaaatatatcaattctaccgtctatgtttttgttagaaacagtcttatagcaaataatacttataagatgcaattagtttagtcaaaatgaggatagatggggagttttgtcaggaattaatatattttgatgttagcatatagcactccaattgtagctctccatcagcctctttgttagttaatgtcccaaaactaacaagaatagttgtaactgttttatttatcaaaatccaggtttcaagctagcaatatcgttggatgatatctttttctcaaggtaattttgatctatgttgtactattacaatctcataaactcctgaaccaactgtagtggatgtttttttttttggcgtgtatgtgtgatgttaagaaggatggatgtgtcaattttagcacaactgactttacctacaattttgtatttcttacagcacaaatgttttgttattctcaaacggtttgctttttgaagcattggtcaaaaaagacatcactgagtgatcttaagtggcggagtagatagcaccagtatagtttctgatccccttgctctaccaaagtaggggaaacatggaagaacactctagctcttaatatgtatctgctctgaaatgctaattattatagttgcttctccgatatatatatatatatatatatatatatatatgtgtgtgtgcgcgcgcgcgcgcgcgcgcgcgtgtgtattgggtttgcgtactaatctgaaatgctgatgagtgttaagtaaataattgtggcttgatccttgaatgctgcaaatgcttggtagtacacacatatggccttctcttttcttcactttgttttctttatttctttccttatgtggcactgagcaacttcaattcaagtctgtcatgtggcactgagcaacctcaattcaagtctgggtgggttacgcagggacatgtagcaaacttgatattacgtgtcatggcttgtttgatttgtgacacatacatgttgtcttacgaatgcatgaatgagtgtgtctcttcttttaggacaggtttcacatgcattttcaagctcgtttgtttcatggccctttttaacggacaaaatacaaatggactggtgatacaattcgacatagaggaagcacgtgatgcgagtgaggcgcgcgcaccgcgtgcacgaggggaggcggctgatcctgacatgtgtacaatcctacagttacaaatcctgctgtaaacgcaataaaaaaaatcagccggctgtcacattgacagtcccaattctaaaataaacaaatcttatactatacgtgacatattataaaacaaagggagtaaacttgcattccatactggtttgtttatctctactattataaaaactagaaaaaaaataccagtgcgttacaacaggtgaaggctattttaatcttattattattatacgtttcagttaaggtgaaatctaatgtggtaaacgatgtacccatcgacaacaaggcgcctatggtgacttcgtcaatctcaaagatttgctagcccagtcttcgaatatgctcatatatatagatatatatatgtatatgtatgtatgtatacatatacatacatacatatatgtgtatatatatatatatatatatatatatatatatatatatatatatatatatatattctgagctgcaattaagagtctaatcgtctcaagttagtatgtgaatttttttaaagagatttcttatacaattctgtctgtatttccaaaagcgaacgaacttaaagaccgactgaaatacggatatgtatttcaaaaaacgaacaaacttaaaaaccgactcatgtacagatgacataccaaagtaccgacaaaaatatcctcaattttataaatagtagagaattgaagatgtttttgccggtattttgatatgtcatccatgtttgagtcggttttatgttcgctcgcttttgaaaatacagatccgtgtataagtcggatattaagttcgtttgcttttagaaaaacaaaatgagtcgtagaagaaatctcttaaagaaaactcacatagtaactttgagataaaagtcgaactcctaatttgcagctcatgattttctaagaaaaatgtatccaagcgaatttacgcagctaattttatcctagctaaatcgtataacaaattataataaccttaacccgttgtaacgtacatacatctttttctagtttggagacaaaaggagtaattcttttactctcacgaagtaagagcagatgcaatcccgtgtatgcacctgaaaagcggaaaatacggtagaggagggtgacgtgtaaaacgaaaaatacgaatatgggcatgtacaaaattagagtctaatatgagctctctatattaattactttctatattaattaatgtcactatagactatcctcctaccatagtagagaaataagatttctaaactattaatacactagataattttttattatagttctttccttttcccgtcctcatgcaacttttccttttcctgtcctcatgcaactttttattatagttttttccttttccccatcctcatacaacaaatttttagataatatagttctttccttttccccatcctcatgcaacaaatttttagataattttttactgtacttcttttcttttctccgtcctcatgcaacaaattttctggtaataaatttcttttctccatcctcatgtaatctggtaataaactatttttctaagagaccgttattagccaccattgtacatgtctaaggggagcgctggaaaacacgtttattaacactacgtaaaatttaaaaccatgactcaaatatatgtttagagaaaatatcgctgtccaaaacataaaaccgtaggaagcatcatttgattgagtcgtgatggctcttgttaagaacgggagataagcactaaatcgcatccatatctaaattcataaataaagtggatttccctctaaacggccgtcaaatgccaccgggagtgcaaaaccacgttacatgtggcgatccgaatgcaaattttgtcgttcatttcgagcaaaatagtgaaaaaaaaatgggcttcctagagtccctactggccggaaaggtccggtcacagtaatgaaatcataagaatttaaaatatcttaagtaccaacagttgagaaataacatatggaacattcttgtaagttgtaacaaccaataatttagcaaatcctggaataacttcttgcatgggattttaacattcagtagactattaggatcagcatgtgatcataaaatggtcggcccagtaacaagggagcaaaagatacatacttttagctggaaacttgggatataaggaaatattcaaacaatacattcgcacagcctccagtagcaccatttattcctcctcctcggcctcctccagccatttaacaaaaggttccagtgctttgacgaaagattgcctgacattaaaatgcaaatattatagcagtttcaaacataactgaaactctacaacatctacatgaaacaaatattatccactagtgattgcaatctaaagttcgcattggtagttagtttctacttaacatgaagattgaagttagggcacggaaaacaagaaaaacaagaaagccattagcgtatgactaatcaagttataattattattataaacttgaaaaatggatttttctgatattttaaagcaacttttatatagaaagtttccacataaaatgcgttgtttaacagcttgaaatcgtattaacaaaaacctaggtaaaatcagtatcttgtacaaaagtggacctacgtaaggcaattacctgccctttgggtttgaacccttgcggaaccaaaggaggatggtatcttcagctaggacatcttggtcatacagcgttctgattatttcaggaaatagcttcatcagcttagcatcctcatagcactgtgtctgaactttgtatatgagttcgagttcaagcctgccacttgtgcagaatgcattcaaaaggccagcccatgctttcacctgtaaagggaatatttttagatataataaatgatacccatcataacaaagagaacctagaaagatcaaaatggtctttagaggttaatcctaatctccacaagcataactaatagaaggtgcttcttcctatttgggatctagacaacgcagcatctagagttttccctttcagcaaactgcaaaattaataatacacttattcatggatatcttcaagtaatttgtccaaaatagacccattccaaagtagagttaaagctcttaaattggatacctaatagacgatccatcattgggaaatgtgacacttccacaactttagtgaacatacataatgaaagcagccctcatttaccaatttatttgaatgcatcccaaactattagaggtgacagatgtcaaatactcacacatcacctaagcagttaaaaggtaatcttcccatcaagaggatatactgtccagtgtagtaatagttggaattcgtacaaccaaggaccaccaagtggttaattgacatgcaaataattgatcaggattatactgataatctggtagtcatattaatacatatatatacatttgattatgatctcctttttcttttgtgaggatagttgagaaattttagggtgcgttcggcaccccaagttcccaacccctctccctcgtttttcgcgcacatgcttttcaaactgctaaacggtgcgttttttgtaaaaagtttctatgcgaaagttgcttaaaaaaatcaaattaatccatttttgaaaaaaaaatttagctaatacttaattaatcacgtgctaatggaccgcttcgttttccgtgcacactgtttgggttgggatccggctggagtgaacacagccttaatctattttagaggcaacttaagacattatattgtcatttcataaaaatacttgcaatattccccgggtttataccacagtagtttcgaagcatgtaatatcacatggtcgtagattagactctaaacttaactgtgactacgcaactgacacaaggacatgagtggcactataacttgttatctactggtactattgggcaggttgacggtgcactcaatgtggtagtagtaattgaaggagtaatcaggtaagaggaaatggccaaccaaatgtccaacatggtagatttggtgtttgcactcacaacagatctgattcactgatttgtgaaagttcgttcgccgcttacgactggccgtccaattatgtggcctgtgcaggcaactattaccaccctaatgccatctataacacggtaagtgacgctgactttaacctaatactgctctcatgtcacagataactgacattttgcatcaatcgccaaaattcaactgcaaaaaaatattactgcaatttttgtgaatacctcaagaaaatcctacccatatcatgtacatatcaatccaactatccaaatatgtattgacaaatgaagttgcaaagtttgttgcatttatttcaaagttaacaggcttcttgtccctaaattagaaagtggaaatgccatcaaatgccccatcttacaaacaagcaaccactcataatcattgctttaacctgcctttccattaaactgtagcttttgacaggcgatatcaatgttcattttccctcagtaattgatagcttttgcatatcatgggttaacataggccagttaaccccatgatatgcaaattcgtatacatttagctcctactatccataccagcaaacatcgttctactgttctatggatagaattttatttcttttgcctcccgagaaatgattggtcaagagaaagttctccagaggttacactgaggtagttttctatttaggtggagggcagacgatccactttactatgagaaaaataaggaacgagaggtataacaaaatagaaatatgatacaccacaaaacaatgttgtacacttgctgactatcctcacctatgctagtaggcaaaagtagaatttcagaagctgaactaagatatacacattccaagtatcccacaactgctttaaaatcaatgccaaaataaaaagatttacctgccgaagtgctgaattagaattttgttgctggttcttcccagaccactgaacagcctccatcagcacatcccatagcatgcgaacaacctctatatcaggaaatttagcatctttcacctgttgcttgacagcttctgtgacttcagatatttcagcctcttcattgatcattgttgtcagtgttaactttatctccttaagtttaacctcaaacatcttcttttcattgtactcaacaagacttgtcagaccttctttactgaagagagcataatgaaacactagaactcagaatatcatttaactacttctgttcagcaaaaaatcatgataacaacttacgtgaaatgttcagataaagcctcggaggttctttttgccgatgggaaaaattccagcaaattgtcctccattttgcctttcttcaaaagtgcaataagatcatctaaagtgttctccttcagatattctttgaaaaactcagtaatgaacgaaagcactatccctttggaaacaagattatccttgagcagtggctggaagacagtttcaggtggaagacctgataacttctgagaaaaggcaagtgctgtgaaaatggcaagtttcttcctctcattttcttcgaagaactccagtgactgaaggaatttgcgcataacattttcaagattctttatcaagaaaggcctcctgcgcaatgttttctgaatgtagagaacagaaggcaaaattgcttcacgctgcgctgcacaatcaagtacagaataggggtgacgctctccttcttcctcaggttttattgtgccaggctgagtgcgccctccaatgaatacaacctgcagtttttcaaatatttacatttaagtgttcgttgacaacaagggttattcaaggaaattgaaactccagtacttaattcattttgcacatctttcaaaggcacaatactatttgtagttttacttttgttcaaaataaacacaaaagaattaaatcacaaatagctcaaaaataactgtgtatctatactcttttaatcaggtagtggtggtggcacctactcccattttaaatgtttgcatgttacctcttcttgaacttcttaatattaaaaaggatcaaaactaaatggatagccacataaaaaaatagttcaagatgaatattccgtaacacattaatacattttgtttaatccattgcaaagcaccggcatttagctaatagtataaaaatagcttgacaaatggcagtttggtgccacagagtacagcatccaagcaagcaagcaagctaaaactccaaactaattacaatataagctagaagagaactgtaataatatcttagttaactataaatatagatgtagactattaaaggtcataaccacaaatgcaacatccaagagaattctacatacatataattctatggaaatacctcaaaaaaggtgtcaccgtaacgtgagaagttgagatccgaggactcgatacttttggcaacaagttcctgtcagtgaaaggtctttataagaattgattgcacaggataaaatacaagtaaaacatatgtatgtgaaggtcggcaagatagttttacatataaatataatgttagcttgtatgtcgatattctagcactccaaataatgttcaacatgattacaagaataaaaaaattaaaatttactatgaagtcataattgttgtatagcatgtaatgctttggattgaatacactaagagatgaaaatgataacattattcactaaatatgttgagtacggggctgaaatggcaatacatatctgtgaaataaattgatttatcagtgtaatgcgtaggttttatttttgttcaactgacctcttaaaaaaaagtactagcaaagaatgataggcagactgctaagaatattttcaagaataattgcatgtcccttatgagcaaaaagtatagacaccaataaatattttatcagaacacccaactgaagattaatgagacgaaagttaggtgacatgtcaaggatgtttacaagggctacccaggtctccagcattatccagataaatctggacaattgcatcagagaatgatgcagggtccaaaggagcagcaatattccgtttgcgggtcttaatccgctggcctctgcagtatagcataacaaaaaaaatcattaagatagccttactatatgatagttgcaaagaaagctgaaaacttcacacaatactatgaattgacacaacaaaccacatgacagctcattcccttactgtatgatcacacagtgcgtagttaaggtaataatgagaaaagacaagataaatatatcttaaaagcaagaacatcatgcaaaagaaacatgcaacattatctctactattgctaggtcagataagacagattacaaacacaatcataaggactaagtaagcaacacggactaacaaaatttaaagcacagcacttgaacaagtttgcgcctcatagatacttaaacaaggaaagctctatcaaaatgaaatcaaagttgaaattatgcccatacattttgtgagcttaagttgcagtacaagggcatttaggaaaagcatgtctatatgttactacttgcaatacgaacaaaacagaaaagttctacatatgactcaatcaaaatatctgtatgtgcagttgtgcatattgatctagcatacacaaatttataggagtaacatcagtgatagctctagctgtgcagattcattcgtaatgttgcattccaatatagtgcttaaatgatatgaacacccagtacaacagcaccagaagaaagtaaacaagaaatatctaaaagaactagctaatacccatgctttgctacggataaaaatgaattatatgtgggctaataatatttggaacaagttaattataaggtttttgggacaatttcatccctgattcgctgtagatgtatttgcgtgataaacctaaattctagagaaaaagtacaacagagttagtggctggcagattcactggcaccaccattgcgagaccaagagccttacccaagagtgggcttctccttcgagctgcagacaaaaaataggtaaaagagaaattggatcagacaacaagaaagcatcatctccaatttggatgaaattcaagtgatcatggcataaggcgtataaaatgttaaacaacaaagcagggactgctaataattcaataacccgttacccctgcatacttaaaatggatcaagtgtccctatgtgtctaaaacataagtcacctatcaaaagaaaattgaacttaaataggacaaaaggtaaaataatggtatgcactaaatggccaaaaaaaaatcaaatgttttattgccattgttgcagaaatcacgaaaggtttttgtacgaggctccccatgctttatggtcctaacacattcataaaaccccttccttaaccagatgttattttattggcactggaaaaggccatcgggacattccaaaacatgtcaaaaaaaatgtgtaagggtagtaaaaaaaatgtgtaaagaatgtgtaagtaaaaaagaacttggttatgatggagtatccagactctggccgagaaacctttatgcagctacagtcataaaacataacatactgatatgtggttttgtgaaactttctaaaaatatcgacggagaattccagaatcttcataaataacaacggacaactcaagaatcttcatgctcatctcagggtaaaattcacagaacttactaatcaagaaaaactcaaacatctgacaaccgccaaatctgtgaggaatcaaggaacctaactgactaaaagcagaaaaggcagctccatcaaacccatcaaatcattgaagatttaagaaaagactatcaaattacccaaacaacgaaaatattgacacgataaacgtctggataaacatagctaattccttataccatttcaatgagacgaacaaatcggacaaatctaccagtacgcaacgaatttgatagacctacaacgcaggaatcaaaccaaggcacatcaaagggaacctcgcttactcacagctaccagatccgatcatactgagcgctcggaatccccaagcttcaaccatcaaaactcgccggaaaatcgcacatccaagattacccaaatcaagagcgcgtcaccaagaatcaccaaacgaaaatccagcttccaaacaagaaagcagcaaacagcagctcgaaccccctcccactccgatccagcacccctacaaccgacagcccacagatccgccgccatacaggcaacaaagggaaggaagaaagcgagatctaaggctaccgcagaagcgggacgacggcaagtacctcataaacacaacgatctggcgcggagggggaggggggttgagtggatccggggcttcagggaaagttgcgcgcggccgccgacgcgagggagagtgaggagggtaaaaaacctagctcttctcagggtaggggttggtgcggcggtggcgatcggggaaagagggggtgataaagcgtgtgtgcggggcttcgggcggaaacggggaggcggcggcggagaacgagtggttgggatcgaccagaggtcccgtgtgggctgagtgatgggtcggccgaagttcgggcatgggctcaataagctggcgtctatctgtgggccgatacgtggccattggctgaaggaataagattcactttgactccctcgactgaccagctaatctaaatcgtattcctcaaccgcaataccagaaatcttaacccccgagctgttaaaaccggtacaaatttgactcccttggtgattttggatgacgattttgctgatgtggcgcacacgcagcagtgttgacttggtcttcgtcccacgtggcattgacaagacgact

SEQ ID NO: 34721 - DNA, 6452 bp, Oryza sativa
cggcggctggagaccactcctcgctttgcgtcgccgcctcgaggccgagactcgcccaccgccgccgcaaaatcggaggcggcgcgcagcatccgctctgcatccgcaagaaggagctgcttccgcgggagttaaattgggcccacatgtcagtgggcccacatttttttgtgtgtgtggatgacaaatggcccagcatatattttttaattttaatgccacataagcgccacttcaatgccacgtggaacgaagatcaagtcaacactgtcatgtgtgcaccaccacgtcagcgaaaccgtcctccaaaaccaccaagagagttaaattgtaccggtttagatagttcgggggttaagatttctagtattgtggttgagggatatgatttatattcggcggtcagttgagggagtcaaagtgatcttattccttggctgaattagtttttactagtagaagcagagagcaaggttaatagtacagctcgctagtggctataaaaataacacatcatcctgtttatagcttgtttcaaaagctaataaatacagtaatgatctctacatatttctcatgcacagcattttattttttttaatctcaaatagtatcctttgattgactgctaataaatgatgcacaaagttacacacatgcagggaaaaaaaactgggcctacagcacggggagccgcgtgcagcctggctgcaaaatagtagcccgcgtctctctctcctacccttctctctctttcaaccaggcaaaaatctgctatatgaaacattatagcatgctgatttagacttattgtacctgttctaagagatccatcggctgcctaaaaaataagctaaagcaaaatttaaattttaaaacaattttaacatattttcaacatagttttttttcagtgttaacttttaagtcactaaaaacacatatataaaagttttgcacacaaactattttttgtttaagttggcaacttttctagcaagaagacaatcacgatcaggacacctaaatgcgtggtggtgatttagagtcgccaaccacctcaacctagcaaaagctagatcaagatggttttgatatattaaaccgactagcagagccgatttagatggaacaagcgataaacacccgtcttgtgggtgaacggaaggtttacgggacaaacctacagagggatttcgcactctcgcgacgaaagtggatgatttacagtgcaaatcgataaagactgacaaactaagctagaactaggcgacaatactcttgactctacctgcaacaatgctctaccttctctcatatcaccagtcatcttgccaagtgaaaataatttttttcctagctgtcacatcatagactccccaagaccatattcacctccatcttttgtcttaaatttgatttaatctaatccatgaccagataactgatgtcatcaccaaatagataaaacaaactcaccagacatgaagaactaaatattttcttccttgtcgtcttatgaaccaagctaataaatctaacatccacgctttcccgtatccgtagactgaattcctgataatttgaaaaaattcaccattgccttgaatccccgaagaaattatcactacagtgctcgctctacttcttcagtgacgcagattccgtatacctctatcgtgcaaaccctgcatatcttggatatatcatgtactgccaaacagacccgttgacgtccttttgctcgggtccatatcccgccaactccaccgcagctccacgctctagaagccgtctgtggagattatggataccccatacctacacgacatgtatagtccgactgggtatggggtgccatgtatagatagaatatttttaaagggactcgggttaaattccaaactcgtatgtcaaggaaatacccgagatcctagtcggttacgattgtatcttatcagtaactacctattccgttagggatatggattgtgctttgtaatacggacccctttccctatataaggaggggttcgggtgcctctaggggcacgattttctcccagatcaaacgatcaataatacactcggcggatcaatccccggacaggagtagggtattacttcttgattaagaaggcctgaacctgtataaaattccttgtctttcaacccatccacttttccagcttgatagccacccccttttagtattgccgaaatcttgtttcgacagttgccgcgccaggtaggggtagcatcaagttcttcgccgactagtgcgatgggtttcgtctccggcattgacgacttcgtcttcccacctgggcaggcgtttcggtttggcagcctcgacttcatcaccaacgacttcggcaagatttctctcctcgactcggattcgaaccagtcgggaagaggccaggtccccgccccgttcggtatcccgaaatcggccgggatctaccccaagatcatctcagccgagttggccccaaaccactcggacgagatccaatctactccaacacgacccgatcaagatgatggagcctatccgctaatcctgatgaaactccgcgatgacttggctgccgtcttcaccaaaagggcgtcctctccccgtaggtctaggcgggatccggccccgtccccgatccagtctagttccagggaagtcggcgtcatactccagcctctcggcacggtctcgacggaacaattggacggctacctcagctctcccagtgtcgactcacgactgacggagatcgtagagtacgacgacttcggctaccgctacgactaccgcaacctcgacgacttcgacgaaggctatgaagataactacacgcccctttacttcggcattttcatggccaacaacgagacggaagaacagtgtcaagcccgacaagcagaagaacagcgcgtgcgacaagaagccgaacgtcgccgactggaggaggagcgccaagcacaagagtgagaaaggctgcagcgtgagcaacaggagcgcgagcgggctgcaaaggaggctgaggaccggtgacagcgcgccttggaggctgggcgacgagcacgagaactcatcgggcagcaagatgtcgaggggacggcggtttttcacatccctttacagaacgcggttgcagcgatcaccctcctcgacaccctccttaagggagacgcactcaatcaggccaatcacgtcgtcaacatcttgaacaagaccaagaccatgatcgcagcttcggtcccggttaattccgcaagcgtccgcacgccgactggcagccgagttcctcctcttcgatctcaagactatcaccatccaagcctcagcatcgtcggcgctgggtcaagtcgcaagagcagggatcacggcaaacgatctgtctactcgcctcctcaccggcaaagggagcgtcgagctaaacgtccccactccccacatcataggcgtcccatcgatcttcgcgagaccattaaccagcgcgcgcggcgagaggctacattccccaccattcaccagatcgctacgacgacgacgtggatggagttgctgccttcacaagtgacctgcgtcgagtggattggccagccagcttcaagctgactggaatcgagaagtatgactgctccaccaaccctgagtcttagctcaccgtctacagtctcgcaattcgcgcaccaggaggagacagcaaagctatggcaaattatctgcccgtggccctagcggattctgcccggtcctagcttcacgggctaccccgtggcacaatcgaatcttgggcggaacttcgcgaccacttcatcgctaatttctagggtacctttgaacgccctagcacccagtttgatctttacaacgttgtccagaagtccggagaatcccttcgagattagatctgacgtttttccgagcaacgcaacaagatctccgacatcatcgacgacgtcatcatcaccgccttcaccaagggcattcgccacgatctcttagtcggcaagtttggacgcaagcctcccaggatagtcaagcagatgttcgaaaaagccaatgagtacgccaaagccgaagatgccgtcaccgcatccaagcagtcgggcaccacttggaagccgaagaaagatacgccgactacagggggagtggaagtaccaatcacaaggatcgcaagcgtaagcccgaagaacttgtggcaaccactacaccatgctcccgacaacgttcacgcgtcaacacttttgacaagatcatgaactcccaatgttcgcatcatccaaattccaatcacgcagccaaagattgcttcgtctacaaacagttcgtagagcaatacgctaagaactcacgcaagacgactaacggagatcaaagcacgtcaaagaagaaggatgacgaagatgatgccccgactggttttcaagaccatcgcaaggaactcaaccacatctttggcggacccctagcttatgaatccaagcgaaagcaaaagctgattgaacgggagatcaatgctgttcagcccgacacaccccaatatcttcggtggtcagagacagctatcaagtttgaccactcggatcatcctgaccgagtggtctacccgggacggtaccccctggtactagacccagtggttcgcaacgtcaagctccgaagatccctcatcgatggtggtagcgcactcaacatccttttcgccaagatgctggacgacatgcagatccctcgcacggaattgaagccgagtaatgcgccctttcacggagtcatccccgggctgtcttctactccactcagccagatcactctgccggttgctttcggcactcgggagaattttcgcacagagaatatttgcttcgaagttgttgatttcgagacagcgtaccatgccatactcggacgaccggcattagccaagttcatggctgtcccgtactacacctacatgatgatgaagatgccaggtccccgaggagtcatatccctgcggagcgatattaagcaagccgtcacttgcgacaaggaaagctgcgagatggctcagacccgcgagatcacgctcgcccgagaagaaatccgactagctgcgtccacagcaaccgaaggagaagtgcctgcgaccaagatgacaaagagcggagaaagcaacgccaagaccaagaaaattcctctagatccttccgatcctactaagactgttgtaataggcgctgagttagtgtaacatcctaaaaattcctgacaataaaaatcactaaaatttcgaactttttaaaacttttgcatcatgctggttgttatgattgctattgcttgccaaaccataaatgatcacaaagaaagtaaagaaaagatcgacatttaagcaatagatataatttacgagaatatattattgttaaccctaccaatatttatgcacaagatagtaaagtcaaatattaatttctattataaattaaaaatcagatattaaatattcgaaccatgagtgatagcttgatgtcacaattagctaaagaaatagtaagattaaatctaatttatttggatctactctcatatgaaatataagtacacatgaaataatgaacacatcaatggccccatctataatagagtatctcactagaatatataattaatatttgaaacaccttatcaagctcctcataacatgaaaatcactcatataaaataatggtcatataaataaattaagctttatatataaataagattatgtgagttttaattaaacaattagattaatattgtaccgagtctcaatttactatttatagaataaatggattaaacctatctgtgtaaaatatattgctatacaaataaactcgaccaatctaccattgtattattaaggacacatcgttatattaaatataatattacccccaaagtcttcaaaaatatataagttcactttagggccaataatttaaattaatctaaaaagaatttatttgtgtgataaataaataaatatgggtggtaataattttggataaattttcatgaggagttagtgcttaaatttagttaacatttaactaagtaaaattagggcttataggattaaaattgtataggagataggctaagaaatgaataataggaaaggacagtgttcattgcccctaagtgctcgaccttgtcccaccgcggcacctagccttcccgtgccgctgccttgcgccttgtccccccgcacgccatggtgtcgccgtcgcggtcgtttaaacgcgcctcgcccggtcgtttcgctttgggcacgcagctgtcgtgccccctcgggtcccatcgtcccacgcgcggtcccggtggcgtcgcaataacaataccggtcgcgctgccacgcagtagagccccgcgccctgtcgctgccgcgccgctcgaccgtcgccgtcggcct

SEQ ID NO: 34722 - DNA, 18005 bp, Oryza sativa
ctcaccacctcccctccctttcccctctctttcccatccccggagtcgccgcctctttggaagctgccgccgccgttgagttgacgcgccccgccgccgcgctgtgccttgtcgccgcaccgtgccccgccgtcgaccccaccaccggtccggtgagcctcagcctccccctcccccaccgcttgtcgtcgcgccgcgctgtccgccggttccagccgagccacgagagagaggaagcagagaggtagcagagagagagaagagaatagagaagagaggttagagtgggccccacgtgattagtaaatagtaatccgctttttaatctttattagttaagtatattacataggtccaggtggttagaaatctgattatggaaggtttatagtttcgagtctatgacatgtgggccccacttgtcattagctcatcctatttccctttagaaaattaattcggtggaaaataaagtaaaggtttgaccccacgtgtcagcagctgttagtgttaagaacaaacttcggattaaaaataaatcatttatgaacagtagcttttcacaatttctcggattaattcaaatttgaatctttacactagcataacttattcattttaactcggatttgagtgaaacttgaacctaaattcatctaaattcataagctttccaatgatatataattcactatttaataaaatatatttataattataaattaattaatatcaaatgattagataattgttaacctaaatagtgtgccaataaataaaaatggatattgtacagtagcataattatctttaatatgtcttgtcactgtagcaaccacataaattagttataatcaatccttcaaattaatgggtgtataggaaaatattagtgccatttactagtctatgtccaaatataactaaatccatgacttataaattatttacaaaaagtttagcctcatattttgtaactaaaatataaacacacatagatgaatatttaacttgtttaggagagtaatcacagagctagttgtatttggaccacttaaaaattagtcgatacaatgtcatgtgaagtagaatatatatatatagtcggttgatatccattagttaaccaaacagagccatcttaaaatcaacatgtattgtatagcttacagtaaaaagcaactactcaaatatatgatccaataataagatattgttgcttacacatatactatacatcccattatagttgtacggtatagtattaatttgcgtgttgcatatattaaattagagggagtatatgacaaacatgtatattagataaatactagttataaatcttgacctcatataattataattatagttcaactgtaaattaggattattcattgtaaaattatgtgatgggataatctgtaaccataatatgattaacctaaacaactctaacatacaaagcatggataattattaaccttttataatttattgtgacaagtaaaatatgttcataattaaagtaaagcctccatcaattaaataataataaatccatctaacaacagaacctctggtatgtaaccgtgctatttagatagatgcatatatagtcataatccttccatagccatttgatagactaaaccaccgattagccaaatatatatgtataccataaatgccatgttggttaactcctaaatagaccacgatgacaatagaaagattaagaaactttagcccttagcatgattggaatccattagcaaacacgaatagtatattttgttgcgcatatttgattgttgtttgaatattggtttttctcgcgtattatagaccttgtgtatcggttagtcgtgaggcaacgtctgcaatttccaggaggtgaaggttgatcaagattatatcaataataaggattattctgagcaggcaagtcatcactattccttgaacatgttgatcccaattgcgaaattatttttatttacaaataagattgcatgcaatgatgaacatcctatttttgaatatgccatgccttgattattgtttacccttattcccttgtaaccatgattacgtatgagtccctagtcaactatgacaaatgcttagaaatgctactctagaatcatgcatactcatatttatcaaatgctatatgcttgggcaattacctttgggaaggtattgagatgcggcatgtggagacatgagcgccacattgccatgatgttgatgatatgatttgtgaaaggagaaataaaattaaacaattgttttcgactggggcagacggaggatttgggtggtatccggaaaaggctagtaccgtccctggtcaattaaggaccgagccatgaagttaagcatgaaacgacccccgtacaaccgcacttctcgtatgggtatagacctagcggagtagatagctgagcggaggcagtatccatgcatagtggtttcttgatgtgtgaggcaggggctctacggtggggcatccattggtagaaccgcgaggcgggtatctacagtggtgtcgccatcggtaggactgccatgtgagaatttaaacataattataacttaatgcatgtatgagtctttccttcccgggtgcgccagaactcctctcactgctagaaaccgtgtacgcctatagtgcatgaggatataaagttcatggagcgggtactgccaatgcgaggttatcgaaaagctttgccgtaatgcgtctcatgtgtagggacgaggctcatgtgttgggcagtcgcggagcgcgggtaaagtgtacatccactgcagtgtgagtaaaccaaatctattcgaatagccgtgctcgcggttattgagcaccgggacgtgtattacacttggctagactcaaaattcttaacttgtgtgggatgggataatgcatgatgatttttatgctgttggacccacttcctgagaggcgggaaggtggacgtcctcagaaaaccatgactactcaatggcgggaagctatccttgggatcacaatggatggtggacagaaccgtcgttgtttaatgtgaacactggtattaaaatttgatcagtctatgctaggtcttagacttgtgaaaagatttgcaaaacttgctttgcgcaaaggaacctgaagccattccttgacataccctctatcatatgcatcgttactgtggtggcttgctgagtacggttggtactcacccttgctatttatatatcttttaggcgagtgttgaagagaagcccttgtcgatacgcttgcgtatccaacaagatgatcggagtgcggtcttgttctaggtctcgttccccagtcgactgcctgtggcatgttaaccgggcccttatattattttgtcttccgcagttgttctctgatagttgttggcctacctagccctaatgtaagtatttaactcttttagcttgaattcattcatgatatgttgtgattcaactatgtatgtgtgtaccaactactgatccagggattggtacgaataaacacagatgatttccgatttccaaaatcgggggtctacagttagattgtaaataggaaagcatgctcatcacctttcttcaaaataataaagatatctttgcgtggaaaccatctaatattttcacgcccagaaattcacgaaccagaatttctaagctgaatgtgtattagacccctatccaggactagccagggtacacaaacgacaattgttgacatacagatccacgtcttacaaaaatagaaaagattacaaatgctgcagaaaagataaaagcgagctaagcctaaagacttgactcctgcagcgagcgattccattccacaggcatccttgacagcagcgacgaaaccaacttcttcgagacatctccaactgagaaggacttcaactctggtgttgggggaaaagagagcaagactgagtactacccactgtactcagcaagtcatactggaagagaaggtatgatgcagggtataaccaaaggaggctagaggttcatttgcacaaagcaggcatttaaaagcagtagttaaaagcagtaaaacaattgtagtaatagatcaatattaaccaatcactgtccaacgctacaccacgttgcaacaggcccaaccaaccacctgaactacaccagttcaatagctaactaggggtgagactaatcacggtgaatctggtcgaccgcccataaccgcgggcacggctattcgaatagttttactctgatcagaggtgtacaactgtacccacaagacacagccccatgacacgtttccgtgcaccgacatgccaccacaacataccggaaagaggccgtgacaggacccttcgcataaccccctctaaccgatcgcaccacacctcagggttcgcccccgttcccagcaggcaacgggcagcccctctctcgtgccgcggtgaatccggaagccgatcaaccggacaccccggccgacccaactccatcacacccaccctcgcctgggtacgtcggccacaggaaagctacactacaagcccagccgttgcccacgctggcttgtggtaagtacgataagttcttccagggcattccgcgaaccggtccttaatcgccatgggcatgactagcaaaaccatgcacccacagtccactaggtagtgtattttaattaactaacaccattgcggtggcactaatctaaagctatgccaataatcaatgtctatgctttaatgtgatcccgctttgtggtctagtagaactaagcatggctaagcatttcctaaaccatctagtcattttaatacccaagttaaacaatatatggctgagtagtaggacccatcaaacatgatattgtaaaagaatgcaacatttaatagaaatgcgggacatttgtaaattgggtacaatatgatcaattgtaatgcatgacttgccttgctcttgcactagtgagaccacaacgacgtcttcgagaaaccgcggatcgacggaacggtcgaaatctacgcgacaaacaaagcacacaagcaaaacatgctataagtctactgaaacaggaaacaaaaccatttttaatggattctatacatttttatgaatttactgagacttgaatggacttaaacggagctcggatgaattagatatgaattttagaagattatctgtgtttctactattaaagaaaagtcttattgatttattgcgcaataaagcatcccaggctgacgtcacccaaggggggggtggcgccgacatgcgggacccacgggtcagtgacacaagaggaggaggaggtgacctggcgggtgggtcccaccaggcagcggtccaagggaggggaggtggcgcctggctcggctcggctcggctccaaaccggcaggccatggaggggcggcggcgcgcgcagagctggcggcggcatgcggttgccggcgacggcgaccgtcggcgggaggcagcggcggccggcacgaaggcggcggcgcggcaaaaagagagagagagggagggaaagggagggagaccgatcctcaccgaggggctcggccggcgcgggggaggagcgacggtgaacgatgacgatgagtgacgggaggacgaccacgatgggcggacgtgctccgggaccacctaggggacaaaatgggagggattagagggagaagggtggtctacggcgagcggattcgcccggcgaaggcggcggccatggtggtgctcaccggcacgcgaggagaacggagctatggcgacgatttgcgtcaaccgagtgttggacggggtagccctcgcaacggcgaagctagtgccggtggttgcgcggcgtggcgacaatgctagcggtgccggcgcgcggccggagagtgcggcagcggcggcgctaggggagagcggcgcggcggcgatagaggcctcgggagagagcggcgacaaaaggaaaaagatagaggggggtgcggaggacctttataggggctcggtaggagcggacgtggccggggggcacccgattttcgccggcaacgtgggaggcggagagagagagagagtagggggattcaaaccgaatctcgccctttttgggtgcacggcgcgggcgggaaggcgaggccgtgggcggcgacgtggcgtggggtggggcgcggggtggagcgccagaggagcggcgaaagcggcgatgtgggcggcggttttggcggcggttgccgccgggctggaggtaggggaaaggactgacaggtgagccccacctgtcagagcccgggggagtgaggggaggcggcctggactttgggagggagcggtagagataggccggcggcccatgatgaaaggagagggagggaaaaaaaaggagaaaaagaaggggaaaaggaaaaaggggattttctggggattctttaatgcttgtgctcctttttaattggttaaaattatttcttgggctctgaaaattccactaaagatcctgttagcatattctgacatgtagaatccaagaaaaattcaacaagccaattccgattattatttgcatttattaatttagggattcaactctaggttaaattaaacaatttcttcggacgatttattttatgaactttaaagcaaggaggagaatttcagagcgtgacagatatgcctggcattcctagagaggtgattgaacactctttacatgttaaggaagatgctaaacctatcaagcaatgactccaccattttgcacaagataggaaggacgcgatcaaggaggaattgaccaagctgttagcagcaggcttcatcaaggaagtccttcatcttgactggctggccaacccagtcctagttcggaagaagacgggacaatggcgcatgtgtgttgattacaccgacctcaacaaatcttgtcccaaggatcccttcgggttacctcgtattgaccaggtagttgactcaacggccggctgcgagctactcagttttttggattgctactcaggatatcatcagatccgactaaaggagtccgactgcttaaagacttcatttattacacccttcggggcctattgctacatcaccatcccttttggattaaagaatgcaggggcaacttatcaacacatgatccagagatgcttttcaacttagataggtcgtaacgttgaagcttatgttgatgatgtagtcgtcaagaccaagcagaaggatgatttgattacggatctagaagagacctttgcgagcatccgcgccttcaggatgaaattaaaccctgaaaagtgcactttcggagtaccgtcagggaagttgcttggctttatggtatcccatatgggcatgcaagccaacccggagaaaatcaacgccatcctcaacatgaaaccgccgagctcccagaaagacgttcaaaagttaactggttgcatggcggcgctcagccagttcgtctcacgactcggcgagcgggggttgccctttttcaagctgctaaagaaaaccgacaatttccagtggggacccgaagcacaaaaagcctttgaagacttcaagaaacttctcaccactccaccggtcttagcttcgccacattcgcaagagccgctgttgttatacgtgtcggcaacttcccaggttgtgagcacggttctggttgttgagcgtgaggaggaaggccacgttcaaaaagtccaacgaccaatttatttcgttagcgaagttttggccgactccaagacaagatatcctcaggttcaaaagctgttgtatggcgttttgattactgttaggaaattatctcagtattttcaaggtcactcggttacggtggttacatcgtttccactcagggatatacttcacaatcgcaaagcaaatgggtggatcgcaaagtgggccttagagttgatgtctttagatctatccttcaagccgcgaactttgatcaagtcccaagctttagcagacttcgtcgccgagtggaccgagtgccaagaagacatgcctgtggagaagatggagtattggactatgcattttgacgggtcaaagaggctttcaggcaccagagcgggggttgttctaatttccctgactggagaaaggctgagctacgtattgtggatacatttttctacgtctcacaacgtggcagaatatgagacgcttcttcacggattaaggattgcgatctccttgggaattcggcgtctgatagttcgtggagattcttagttggttgttaatcaagtcatgaaagagtggtcctgccttgatgataacatgaccgcctatcggcagtaggtacgcaagttagaagataaattcgatggccttgagctaacccacgttcttcgacataataatgaggtagccgacagactggctaattttggttcaaaacgagaggcaactccttccgacatgttcgttgaacatctttatgagccaaccgtaccaaggaaaaaaataatcgaggccacggacactcaagaagtaagcatgattgaagccgactggagagagcccctcatgagatttttgaccaaacaagaactccctcaagataaaaacgaagtcgagcggatctccaggcgcagcaaactttatgtcatacatgagaccgagctgtacaagaaaaatccatcagggatcctgcaacgctatgtgtctttggaggaaggaagacaattgctaagggatatatattcaggcatatgtggcaatcatgctatcgcacgaaccattgttgacaaggcctatcggcagggttttttctggcccacagctgtatccgatgctgacaaaatcgtgcgaacatgtgagggttgccaatttttcgcccgacagactcatctaccagctcaagagttgcaaaccatcccgttatcttggccgttcacggtttgggggctcgacatggtcggcccgtttaaaaaggctatcagtggttatactcatgtctttgtagctgttgacaaattttccaagtggatcgaagccaaaccggtcgtcacaatcacgacagacaaggctagagattttttcatcaacattgtgcaccggtttggggtacccaatcggatcatcactgataacggcactcaattcactggcggagtatttaaagatttttgtgaagacttcggcatcaaaatttgttatgcccccgtagcgcatcccatgagtaatggacaagttgaacgcgccaatggtatggtacttcaaggaataaaagcacgagtttttgaccgattgcgtccctatgctggcaaatgggtagaacaattgccatctgtcctttggtccctgcgcaccacacccagtcgggctacgggacagtcaccgttctttctagtctatggtgcagaagcaatgctgccaagtgaagtagaattcgaatctttgcgatttcgtaacttcagcgaggagcgctatggagaagaccgagtagatgatctcaaccgactggaagaagcccgtgaagcaaccttaattcagtcggctcggtatttacaagggatgcgccgttatcacaatcgcaatgttcgatcacgagctttcttagtcggcgacctggttctgaggaaaattcaaactacacgagatcggcacaagttatctcccttgtgggaaggactgttcatagtttctgaagttactcggccaggttcttattgactcaaacgtgaagacggtactcatatcgacaactcttggaatatcgaacatcttcgtcgtttttatgcttaggcattattttttgtatcttcttctttgactgttaacatcaagttcttacttgagttatcagtcgggggctactataataataatggagtgtgatttttatcaattcaatttgcttacttgatttatcattgccttgtttgattttttggcttagttaatgaggactgaaagtttttaacagcttttgcgggttctaggctcagtaaggtttgacaaaaacttttaagaaatcaggagctgagtttaaatcatcaagcacaacataaattcatcagtattgtacaaattgtgcctccatcatcatcatcattgtcagaatacaatatcaatcagtttcagtcttttcatcgtcagagttattagatctagtcggccagaggtcgttgtcctggaatctctcaacaacatcagcagctatcttgtcggcagctttctgcgtgtcattgatgaggtcaagagtggcttcttcgcttgtcccgtctgcaaagccatcaatggcatcaatatcaatcttcgggtacaaggacttggtcattgccaacgccaggcctgctcccatacttccagcttccttgatattcttaaaatatgtatccggagcaattctcagcttgtcgaagatttcggcagcaacaaatgagctcggaccattgttgttataaaaaacatggcttggacgagtggtgtagcggcgttggcgacctcatctctagctccctcaagcctcttgattttgttaagcaagacgtcgaactgagcttgggatttgattttgcgatctgcacaagtagattcacatcaacgagtgggcatgaagataagagtggttttttgatgttccagctacaagtatcttcgacatcttttagagctgagtccctctgcttcgttagttcgcccttatttttttctagagccttgattcgcctttccagctcggatatcttggcagcttgcactgtattgcttctcattggttagttgcacatggatagcggtacgaaacaagtcagataaggatgagatttaccttttaatgaaccgctcagctcaaagttggagtcttgaagctcggcagtccgatctctgaggtcatgctcagtcttcctggcaagctctttggcttcacgcagctggtctctggttgcttcaagggttccaaggtggggaactaatttttcgagggttgcggtcttcgcctcattcctaagatggattctctgcaccgcaaatttatctttgttcaagtaaagtggccgacaggatgattgaggctgcgtatagggagagttacatttacaagatgagtagattggccgagtgtctttttcagcagacatacttcctcgtcttccttttgtttatttatcacgattccctgtggttgcatttcatcatcccaccacttgactaatatgggtgggcgagaatcttcacctgatcgtatctggaggacctcttcttcattaccgatcattggcccttatatattcatgaataatggtgaagcaattgaagaaagtttgtcggatcaagacagatttggaggacttgtttacccattataatttccggtcggggacgagcaggtccttgcaccctaacaggagagttagttccagggtcagcagcagcgtccgtcttgggagggctgttggcttgagcttccacttctgggatatctctattttgttctgtacccaactggtttccagtcgggggctcttgatcagcaccgacttcagcttcggctgactggtttccagtcgggggctcgttgctagtatctatattgccggttgccggttgattattacctgggcggtcttcagcagttggcccagtttctgctgaaggactagtctctgtgccagtcggcatggggtcttttccagagggatctatgtcagatggtttcctacaaatttgagacatgctatcagctttgcttcaatagtgagtgactagcgaaacaggggaaattgctagatgacacatacctggatgacttccttatttttggcatgggacgactggacgttttcttcttcggattggcttgctttggctgtttcccaatcacccctttgttgtccgtcttttccgcgtcatcaccttcatcgtcacttgaaaccaacttcctcttacgagaatctgactggttagttgacctcgaggtgttgggttggacgtccgactggatcttcggccctccactggcttggccagtgtgccggcgaggtgagcggcgttgagcaattggagtatcggatttcatcaaagcgaattcctgtgcatggtattccaagttttcagtcgaccttacagaagataaaagcatgctttgagaaaggctaaggtgtataatacataccggtggaggagggttgaacgtattgtatggcacgactagcaataagtgtgaatagctgaccacaatggcattcgagaagattttgtacattctctcctacataattttgaactcaagagactctgggttctctcggttggggtcatgcttgccatcaaactcaaaagctgtgcgggatctctccttgattggcgccagccggctcttgataaagtgccgggtgatttgctctccttgcagaccctgttctttaagcttcagcatgcgatccaataagtcaagcgcttgggcagcctcttctcccatagaaagtgagttccaggtatcgcgatatactggaggcagacaggagtatccgggaagcgctggcttggggttttgcacatagaaccagttcgcgtgccaacctttgttcgaggtcttgaagggcatggagaagtatttttggctcaaggtccccctcagttgaaatccggctcccccaactacgcacggtttgctcttatttggctggggcttgaggaagaagatgcggcgaaatagagcaaaatgtggcctaatccccagaaaagcctcgcaagcgtggatgaaattggcgatgtggactatggagttggggtttaggtgatgcaaactgatcccatagaaatccaaaatcgcccgaaagaaacttgaggttggaacagaaaacccgccgtagaagaaatgggagaacagcaccacctcgtgtgtgtcgggggtcggaaatgtttcaccgcatgctggacgccacccgatgatctcctttgccggaagaacgccgtgcgccaccatctccttcaggttttcctccgttacatcggagggcgcccactgactctcaaagctttctctctcttccgccatggatgcgaactggatgatgtgatttggttcgaaatgtggctgggaatggatgggagattgatgcggtggttgcgtgggagattcttgtggagttttggaggatggattggagcgaatctgtgaaccctagcttcgcgggcgcggtttcacaccgtagcagagaattgggaaagtggcaagagtttcggcggggaagacgaaccgacgctttgctttcggtgttatttcattagggtatcgggagtactaatgggcctaggcctaaacagtacttcagcccaattttgctatctcgtcgtgtctaagttgtgatccttagggacttaggcattttgcttcggcaacacttgctcacaacagtatagcccaatgctgttaaaatcctttttgacgtagttagataattctttggaattactacgatgcaaataaaaaggtgcccaacggaaaagtgttatactaattttgtaagcctttttaggctgcaaaagctgttcgggttttgttgagatgactggtttttgaatggtcattctcttggcatgttatatgcttattttgatatggtgtgagtcatagcttaggcaatttagattcacctattgtcatgatttataccacatttgatggatctttttcgagagtttttactaggattcttatcatatgtgttgatttataaacctttagagtgtttctcactcgggactttttatatctccttttctggtgtatcaaagctaaagcagtcggctggatgttttattaaacgtcgcatatgcttggctgtgtgataccatggatgatccggttgtaaaaccactcggttggatgttatttgcaccttggctatatgcttagtttttaactaatcacatagtcggaggctacacctaattaggtgcatctaattgatgcacctgattgtttctatttctagcccttcacagtctttgatcttagtactcgggaggccaaagcagaagaagttggagcactcgcattatccttttggattacgagagaagactatttcatcgactgtaaaggtctcaggggctactatggagattatggataccccatacctacacggcatgtatagtccgactaggtatggggtgccatgtgtagatagaatatctttaaagggactcgggttaaattccaaacttgtacgtcaaggaaatgcgcgtgatcctagtcggttacgattgtatcttatctgtaactacctattccgttagggatatggattgtgttttgtaatacggaccacttcccctatataaggaggggtccgggtgcctctaggggcacgattttctcccagatcatacgatcaataatatactcggcggatcaatccccggacaggagtagggtattacttcttgattaagaaggcctgaacctgtataaaattccttgtctttcaacccatcaacttttctagcttgatagccacccccttttagtattgctgaaatcttgtttcgacaccgtcgttgccgtgccggaagatccagccacccgaatgagaggtatgctagccgtcaccgccctcttcttccctttcatctccatgtggccaccgcttccctctcctttacgctctccattccgctcggtgaggtgcggcgatggtctaggcctccccaccgatggatccgactgccctcgctctgggctccagcgtcgaggatgtcctgcctagcacgcgttcgtgcccacgctccctcggcttctccatacacccgttgatctcgtgcctaccctaacgactagatgacgagttggcatctccttggtcttcattgcgtcccttgcatgcgattctgcagccaaacggtgggctcgacactagcaaggtcgtgctcgtgccgtcacttcctctggtacctccaatctctcctctagctcttacctcctctcttatgccaaaggcttcctcccgattgacaacccttctttcgcagaggcaacaaggatgccccgtatggttctttgctcgcagttggggctttcgttcattatatcaagcttaggatacctttgaaatgtatgcaatgattctctttggttgctaaggtaaagttctttttgggctgattcagttcatattatgtacacaagaaacataatagtgctgatctagctcaaagccttttagaccatactataaatgtcctactgttcgttgtttatttatcagtgcttattaagcttctctaaatgcaagtatccctcccagtgcatatgaagtggaacatgtctatgtaagttctgttttgcctcgatacgaatcaattacgttgtttgaacatcatatgaagtcattgtaacctatttagaactggaattttaacaaagattgtcatatgaggtgcatgataaagtctttgtcccctaatttggttcctcttcttagctagaggtatactaagaaatactagctaggttctctctttacgagcactaatgcatttttgggaagtatgatatctcatctgaggtgtgtgaattcaggcaataaagaaaaacatatactactgttatagtttttgtttacaattgaaatagttattgataacagaaatatgcttaacatgctacaagcatagtcatattgctaaaatgtgacatttcatattgaagactatggccctgtttagatcccaccccaaaatttttcaccctgtcacatcgaacgtttaaacacctgtatgaagcattaaatataggctaaaaaaataactaattgcacagattgcgactaatttgcgagacgaatcttttaagcttgattgctcattatttgacaatgtggtgctaaagtaaacatttgctaatgacgcattaattaggcttaatatatttgtttcgtggtttgctgacggattctgtaattagtttttttgctagtgcccgaacaccccatgcgacaccctatataatacgcaatgtgatatgccaaaactttacaccctggatctaaacactccctatatattatttgagcaactacctgtgtccaaaactatcaaatatttcatttcaaatggtcaggtaggctttcagttatttacagctagttgggatagtaggatattggatgaggtagttcttataatgtaggaactacaatccattgataatgtttggaacttactgacaatgatagtggacatactgatatttgaatagtgtcccatgtgttttattgctaatttttgtttacacaaatcattcataatagttgggaaatactgctagcccaatgcgttatggggaacaaaagcaattgttgctttctcatgaaaatgatgtaattatttggaaccaatgtggaatatttattctccttcaagttttgtctgaatatacaacagatggatataaagttgaaaccactttctatgcatgaaacacttatttttcttctttttaggcaagtttatggaggaagctacactttgtcgtgaagatcagagtttagtttatttgcttatttccactgcgtttgtaagaattatttattatttttgtatgatgtggatctctgtatcaatttgtcgtttgtgtactctggctggtcctggacagagattttaatacacattctgcttgaaattcgggttagcgaatttctaggcgtgacactgaccgggcccaccagggttcggccgaactaggacagcgcccaatcgcccccaaaatttgaacactcgatctgcctactctgtcaacagtagaaactgaatcattcgtgcggtagctcgttggatcgacccagttcattaaaatctctctcttgttcatctccctgtccactccaccttatccattcaagccactactctctttagctcgaatccataagtccagtccatacccaagatcttcaatggctgggaaatccttgattccgtatggtgctacatgctgaaacgcatttgatctcaatggagagccctctccggcgaatcaattggtttcgggagaaaactgggcgatggaagaggcaaatgcgatcttcatagaccccctggacaccatcgcggtggactccatgagtatgcggccgatcggcgctgctcctagtttagccgaacctaggtcggccgaaccctggtcggcctcgatcaaccccctgtttggccgctcgcccagtctcgccacgctacaaaactccgactaaagtacggggtgtttcccaagcgcagaggccgacgacaggagaattgggtctactaaagcgagcacgatgactttttgaagacaaggagaaggccacatctcccgccagcgagcattatgtgggatctcttgatgtgactgtcacaccccgaagttctcctcccaagccaaaaatttaatttataagcgaccctaagaaaaaaaccggtgcaaagcaagagtaaacccttttaaatcaatgcaaataataatcgaatctgacatgtggaattttttcttgagttctacatgtcgaaattcactaacaggatttttagtggaattttcagagccctagaaataattttaaccaattaaaattgggcaagcaatattctaattccaggaaaatccttttctcctttttctttttctttgtccctccctttttcggatgggccgccggcccattctctccttttctctccctcctccctactgggccgaccgcaggccgagacccagccaagccgccccttcctttttccccgggacgccgacaggtgggcccccactgtcggacccgtccccttccttcaaccgcgcccgcaaccgccgcaaacgcctcccgcttctccgggccacgtcagccacgtccgcgcgtgcgccgcatctcccacgcccactcccctctctctcccgcccgcgcccgcgcccgagatggccgggattcgattttcgaatcccgcctctctctccttcctcactccccacgttggccggcgaaatcc

SEQ ID NO: 34723 - DNA, 491 bp, Oryza sativa
aatctcatcccactgaggaaggtggagggggtgggtgaaaagtgtccagacctgtgatgacatcagacagcctctgagctactgcagagaccccctatacctatggaccacttgatttggtgacattttcaaaatatatccaaaatctgactatttctcaccacccccagcactgacatgtgccccaggccaccaccttctatccccacagggctccccgctgctgctgaggcccctcccaggctattcttcacatggtatccaaagtgaacttctatgaacttctacaaacagatcatgcaactcctcccccagaaacccccaagccttctcttcccactctgtgaaatggccaaagcctttaccacatggatgaagtcctctaagacctgggccttggcgacttaactgaccttaccttgcaccactcccattgcctggaagcccctcaaagacacagagcacactccctttcgtgggatttgcacttg

SEQ ID NO: 34724 - DNA, 9060 bp, Oryza sativa
gcgcccctccccctggggttatgcaataaccctttttaaattaaatttaaaataaaaaattcgcaaatattcatttaaagagcatataaacttcaaatggccataactgggccatttgaactcggaattggcccgttcaagtctctaattattccttaagaagtcaagaccccatttttgtgctttgttcctgcttgttatatggagtttattagagtaaaagccttttcttttccgttggtcatgtagacgctgcagcttcggaagatccgctcttcgtggaggttgaagccgacgttttggaaagcgagcaaggcaagtcacatcatccttgaacatattgaatcccaatttataaaattattttgatttaaattattgcattatcgctttatttaaattcccgtgttatcactgttttatttagccatgcctatttacctttgttatgaccttattattattgctattgttattattaccttgttcaccctagaataaacaaaaccccaactagtggacactctactcatggtaccactagtatgaatttaggtagatgtttcgccgcttaattaggcaacattaggtggttttacaactctagactttgggaatattcatatcacctggacattatggaatggttggattattgtggaattggattcacacctccccctctattcaaaaccctcaaaatggttttaggctgggctcggggtgcatggttttgatagtagcacctcggccatataaggaccggtcttcgggcctctgttgcaaagcactaccatacttccacatttctagtgggtaaggcttagtttgtggctcagtctggttataaacaaaagtacacgagtggagatggacgaagtcgggggtcgatggacatctctagggcaaatgaaggctacacgagctgcggcccggtagtcgagatgtcatggcacagggccgatgtcctgctgctaggggctcagtcctgcctacctgtcccggaggttccggccgtaggtggggttgggtcggtactcttgtgtatggctaggatgggttggaaactatgtcacgtcttccatccgtataccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctgggttggcttgggacaagctgggacccagggtcgggttgccagttcggtctgaatcatcgtaggccttgggttaaggcaggttcgtgtgggttcacggccttgattaataatattgtatagctctagggtcgtatttacaaaatagctttgagcaactaagtgtcttttaatgctgtttactgcaaaccctaacccctatattatggctcccttgtactcccttgcatttattctgcacttatgggtgtgtcttattgagtacggtggttgtactcagtcttgctcaatttttcccaaacccagaagaggagttcctggaagatgaaggctttggtgtctagctcgtgcctgccgtcaagcgcctgtggtcgtcgccctagtcttccgctgtttttcttttgtcttcttgtgtgctgggcctttgccgcccatgtaataaattaactatttacgcttccgcttgataaactctgaaatgtatcaacttttggtgtaccttgcctcctgggacaaggaataatacacgcacgtaaggaactcccgttgggttatttccggtcgtgacaagttggtatcagagcctccttgaccctaggatgagctttagatcccaagtcttagcaatattttcgaaataaaaatccttccttatttgttaaaatcctctagtctctctctgtcctgctgcttcatttatcgtcaaaatctgatctgtaaaatgttgcttttctcttttgtttttgtttgtagatggccggtagcatcaaccgtcgtggcctggacctgactggcttcgttttggagctgcggggcatgtgcgttgtcctggggtatccgcatggagtggactaccaaggcaagcagctcccggagcaggagggtgacgatgcagagccccacgctgcttgggaggtcactgcagtgatcctcactggctcacccgagaggacttcgttggcagtcaccgcgggtggagattctttctccgctgcttgccagaacgccgcactcctcgccattggcactcttcaccagtgctacccggacgagttgcagcactcgccctaccgctaccaccctcgtcgcggaggagcccgtgactacgccaccttcagggatgctagctcggaggatgacgctaccatcatgcacttggcgcgcatggtggaggcgtacgacgcagcccgtatcgacttccatcatatggtgcgccgtgggttggtcgagaacaacatgaagatcctggagctgcgtcaggagaatctgcagctgaagaaggacttggacacggtggaggcgcagctgtgtcagctcaagatcgcccagggagaggtctgtcgccccaagcgccgccgcgtctgccgcagtatgaagatcaccgcccgcaagagtacctccaggcccgagcttgttcgtcagtccttggcatggacctgcttcgtcgagacccctcgcgccgagcccgcaccctcggttcctcaggaggagggagcctctggcgttggcagcacggaggatgcgctgctgctcaccttccgccctggctcgtcgcagaagtagacgagcagttagtaggctcgcgcgtgtgttcttttcgtttgttttcctgctagagtcgtgtggggcatggttataccggtgtgtggtataactgtgtcggagcctgtctttattttatttgcttaagcaacttgaaccttaatgaacgaatttaatagcagtaataaattcaagaattatggtagtcgtgggtggttagttttaatagtcagctctctctgtttgccggttctgtgtgggattttcagatggtgacaaccaggagaagtgctgctaccggtgaaggcagtcaccccgaaggcagcaaccacaacaagcatggcagcccacctccacctccttccccgccaccaccaccaccaccagacaccaactccatcctcacccaaatcctcgcccagcaggccaacatgatggctgctttcctccatcacatccaaaatccgccacagcataatgctccacctccaccaccacccccgcaacattctaaactcgctgagttcctccgcatccgtccgcctaccttctctagttccaataaccccgtggatgccttggattggttgcatgccgtggggaaaaagttggataccgtgcagtgcaacgatgaggagaaagtcatctttgctgctcaccaactgcagggacccgcatctctatggtgggaccacttccaggctacgcagccaaaaggacagcctattacttgggcccgcttcaccgccgctttccggaggacccatgtgcccgccggagtcatggcccttaagaaaagggaattccgggagttgaagcaaggcaaccgttccgtgatggagtatttgcatgagtttaacaacttggcccggtacaccccggaggatgttcgggaagatgaggaaaagcaggagaagttcttggcaggaatggaccctgagctgtccgtgcgtctggtctccggggattatcctgatttccagcgtctggtggacaagagcatccgcttggaagccaagcacaaggaactggagtcgcacaagcgtcgcttggcgaatttccgcaatcaacagggggctaaccaaagggtccgctacaccaatccctacccagggggatcctcctcgtagcagcagcagcagcaacctcgctccgcgccccgacctcaattcgtggtgcgcgtcccacagccgcagcaatagcagagtcagcaagggacccgtgcgccccgtcctcctacgcccgttgtgcagcctagtcaaggccgcaaagacgctcaaggtcagcagcgtctgtgcttcaattgcttcgagcccgggcactttgtggataaatgcccgaagccgcggcgccagcaaggccaagcgcctccccgccccaacaacggtggtaaggatgtcattcggggtcgtgtgaaccacgtgactgccgaggatgtgctgacgactccggacgtcatcgttggtacgttcctcattcattctattcctgctaccattttgttcgactctggagcttcccactcatttatatctgtgcccttcatggggagaaatcagttgggggtagaaaggcttaggaaccctctgctcatcaccacccctggaggggttatgacagcaaagtattatagccctgccgttcctatagaaatccagggaatcccttttcccttggatttgattcttctggacaccaataacttggatgtgatccttgggatgaattggttggctcaattccaaggagtagtggattgcgcaaggcgcactgtcactctgtatcgggggccggaacaaccggttgttttctttgcaccctcaacctctgtcggcagttcagaacttcatcagataggactgtcagaaatacccatcgtcagagagttcggagatgtgtttccggaagaactacccggtatgctgcccaagcgagagattgagttccggatagatcttgctccaggaaccactcctctatacaagcggccctaccgtatggccgcgaatgaactggccgaagtcaagaagtagttggaagagctgaaggaaaaggggtacatacggccgagcacttccccctagggtgctctcgtgatttttgtgggaaagaaggacaagacaaagaggatgtgtgttgactacagagctctcaatgaagttactataaaaaacaagtaccctcttccccggatcgatgatctgttcgatcagcttaaagctgccactatcttttctaaaatcaatcttcgctccggatatcaccaattgcgtattcgtgaagaagatatcccgaagaccgcattcaccacgcgttatgggctgtatgaattcacggtgatgtcgttcggtctgaccaatgctcctaccttggataagtttgttgtggttttcatcgacgacattctggtgtactcacaatcagaggaagaccatcagcagcatctccgtctagtgttgggaaagctgcgggaacatcaactttatgccaagtttagcaagtgtgagttctggttgtccgaagtcaagttcttagggcacgtgatatctgctaaaggagttgctgtggaccccgaaacagtgaccgccgtcactgattggaagcaacccaagacagtcactcaagtccgcagctttttgggtttggccgggtactatcggaggttcatcgagaacttctccaaaatcgctcgacccatgacacagttgctgaagaaagaagaaaaatttgtgtggagcccgcaatgcgagaaggcattccaaactctcaaggaaaagctggtttcctagccagttttaatcttaccagatactcacaaggacttcctggtgtactgtgacgcttcgcgccaaggattggggtgcgtgctcatgcaggaaggtcatgtggtagcctatgcctcacgccagctacggtcccatgaaggcaactaccctacccatgatttggagttggccgctgtagttcatgctctaaagatctggcggcactatctcattgggaatcgctgtgaaatatatactgatcataagagtttgaaatacatcttcactcagtcggatctgaatcttcagcagaggagatagttagaactcatcaaggattatgatgtgggaattcactatcatcctggtaaggccaacgtggtcgccgacgctctaagtcgaaaaagccgttgcaacactctcggcgtctgtggcattccaccggaacttaatcaacagatggaagccctgaacctaagcatagttggtcgtggattcttggctacgctggaagccaagcctaccttactcgatcaaatccgcgaggctcagaagaatgatccagatatgcatggactcctcaagaatatgaaacagggtaaagccgctggtttcacagaggatgaacacggaatcctatggaacggaaatcgggtatgcgttccagacgacagggaacttaaacagttgatacttcaggaagctcacgaaagtccttattccatccaccctggctgtacgaagatgtacttggacttgaaagagaaatattggtgggttagtatgaagcgggagattgcagagttcgtggccctttgtgatgtgtgccagcgtgtcaaggcagagcaccaatgaccggccggacttctccaacctctccaagtaccagaatggaaatgggatgaaattgggatggatttcatcaccggacttccaaaaacccagggcggttatgattctatatgggtagtcgtggatcgactaaccaaggtagctcggtttattcctgtgaagaccacctatggagggaacaaactagccgaactctacttcgctaggatcgtaagtctccatggcattcctaagaaaattgtatctgatcggggaagccaattcacctctcatttctggaagaagctccaagaagagttgggtacccgattaaatttcagcaccgcgtatcacccgcagacagatggacagaccgagcgtctaaatcagatcctagaagatatgcttcgcgcatgtgtcctagatttcaggaagacctgggataagagtctcccctatgccgagttctcctacaataacagctaccaagccagcatacaaatggcaccctacgaagcgttgtatggccgcaaatgccggacaccgctattgtgggaccaagttggggaaagccaagtgttcgggactgatatcctgagagaagctgaagctaaagtcagaaccattcgggataatctaaaggtggcacagtcccggcaaaagagttatgcagataaccgacgccgtaacctagaattcacagtggacgattttgtgtacctacgggtcacgccattgcgaggagtacacaggtttcagacgaaagggaagctcgcacctcggttcatgggtcctttccgtatcattgctcgacgcggagaagtcgcttaccagttggagctgcccgcatccttgggcaacgtgcatgatgtgttccatgtgtcgcaactcaagaaatgtcttcgagtgccatcggagcaggccgattcagagcaaattgaagttcgcgaagacttgacctacgtggagaggccagtgaaaatcctggacaccatggagcgcaggaccaggaaccgggtaatccgtttttgcaaggtccaatggagcaaccacgctgaggaagaagctacttgggaacgtgaagacgagctgaaggcagcccatcccgatctcttcgccagttcttccgaatctcggggtcgagattccgtttaaggggggtaggtttgtcacgtcccaaaacgaccctaaaatatatcctttaaattatgcctagaataattaaaatccgtgtgaaagcctccaaaaattaaaatgtgcaaagtaaaagttaaacaaggcttagaggatttttgtatatttcctaaaagcctaaaatgtgtaaataaattttagtggaattttcggagcacaaaaaaaataattaagaagaaataaacaaagttaaaaaggttttataaaaaagaaaaaccctaaaagtcccccttccctcctttgggccggctcggcccatctccctctcccccctctctctctcctctcccacgcggcccattcggcctccctccccacgcgcgcgccgcttactggcgggcccgaccgccaccctcgctgacgggtggggcccacccgtcatccccgtcctcccgccgctcccgccggcccgcccgcgccaagcgccgcctctcgtcgaccgcgccggcatggccgccctcgggcgcaccgagtggctgccgcgtggggcccagccgtcagccgcccgcgccctcgggtgcggctgacgtgtggggcccacggcgtcggcaggtgtgagcccgggtgcacctggtccaccgtggaccgtgaggctgccgcgtgggtcccactcccatggacccggtccgcgcgcccctccccctcggctgatgcaataaaccctttttaaattaaaatttaaatgaagaaattggcaaatattcatttaaagagcatataaacttcaaatggccataacttggccatttaaactcggaattggaccgttcaagtctctaatttttccttaagaagtcaagaatccatttttgtgctttgttcctgcttgttatatggagtttattagagtaaaagccttttcttttccgttggtcatgtagatccgctcttcgtggaggttgaagccgacgtttgggaaagcgagcaaggcaagtcacatcatccttgaacatattgaatcccaatttataaaattattttgatttaaattattgcattattgctttatttaaattcccgcgttatcactgttttatttagccatgcctatttacctttgttatgaccttattattattgctattgttattattaccttgttcaccctagaataaacaaaaccccaactagtggacactctactcatggtaccactagtatgaatttaggtagatgcttcgccgcttaattaggcaacattaggtggttttacagctctagactttgggaatattcatatcacctggacattatggaatggttggattattgtggaattggattcacacctccccctgtattcaaaaccctcaaaatggttttaggctgggctcggggtgcatggttttgatagtagcacctcggcaatataaggaccggtcttcgggcctatgttgcaaagcactacggtacttccacatgtctagtggttaagccttagtttgt
